United States Patent 10,407,724 (METHODS AND COMPOSITIONS FOR SCREENING AND TREATING DEVELOPMENTAL DISORDERS) - sequence listing, part 51

SEQ ID NO: 1178 - DNA, 992601 bp, Homo sapiens
ttcaaagtgctgtgttgtaaccttcagagtttgctcctggcgacttcttttggtttgcattcttgcttctgtcatacgctggtacctgatagccccatggacctccagactgactttcgctactactgctactactacctgattctgattcctcctcactttccacacctccttccaccgaagctgattctgcactgccctcttcagggatatcttgagcttcagggtctgtactttcttccacaggggctggtccactttcttcttcttctgagtgttcttcttcttccatcttaggttctttttgttcttcttgtggctcctctttcctacccttgacttccttgacctcctcaaccatgggccttcttcttgcaagcacaatgtttttccttgctttttctccttctgactctgtggattccgattcttctgattcaggggtggaactctcctcctcctcagagggtgtctctgactcagattcctcttctgtagtctcagactcactgaactcagactcttcttcactgtattcagtatagtcgctggaggattcctcctctgattctacagtgctttctgttgcttcctcttggtccagagtgagtttcaaataatctttatcttcttcctcaaggcgtctctgccactcttcaccctcaaggtcaacgattcctcttttatcagctaatcctctaactttcttaaaaatcatggggaatattctggctctcttccatgttgtgtatgtaggctcagctgctggtggtttttcgatagttacaactacttcttcctcctcactaggctctctaatttcaacctttggttttttaattttctttggctcttcctgaaaattgtgaaaatgcaattgaagtgtcagcttggagatagctatggtatgaccttgtcccacgaaagctacgcaggaatgaatctgtgggtgatagcttcatgcatgttatataactggcttaagaaaataatcacaaaaatttctactgcatatagacagaaggtgattaagagaaagtaaattattttattttagcttgtactttacaatacccaaatatattaatttccttcttgttactcaacgtttaattttcctcttagatcaaataaaaaagaaagaattattgtctcttccttccttccttcttctgtcactagacttaggttaatagctttctgtattcccttgaactaaattttcaagaattttcaataatcacgaaaatatgacgatttatctcattttatgagaaatctattttatgaaattttgcacatgttaaagccacagtgacatttatttcttgttagtgttgtttttgtataaatttgccaagtaaatagtgaagacaaagtataagaattttatagaaatgagtcatgctaatttaaacataaattacattattccttgaaaattatttgtggaaataatttacttttctctgataattgaaaggtggagactatattttttcatgacttttagttttgctagataatgtgggagcaaaagtaacctttgtattgcagaactttaaaatatatttgcttataatatctttatggagcaagatttagaattttagaaaacataattttcattgtgccctttccaaatgtttaacacttttagaaggaaataaattaaatgatcaagaattaattttcctccaaagacaaggcaatgaaacggtcagcactgtgaaatttctatgggaaatacgtactaagtgaaaggaatttctaaaagctgaaatgttctacagccgctagtcacgtagggttaaacaatatttttcttggaatattatcttacataataaaattacagtaattacctcttcctcctcatattcttcctcagcttcaccaaccacctcaccatattcctcctgtccagctggtggtaacaatcgacggcgactcccatattgaggcatttcatacctgtaatataaacttacatctttaaacagtttgtcatgtgatttctgtagaatctaccatgagtgatctgtttccttctttttcttccgccattcaatcgacagatatttacacagcacctatcaggctccttgtaaactagttacaaaactatagagtaagaactgctacctgatgaccagtgatttttgccataatggtaccctggaataacaataaagagagttgagttatttcagatactcgtttttggagaaactagaacgagaaaaaagccatattgtgtcttaactagctgaagaatccagaacacaaaatagatactttggaacagtgtaatggctcattcaccacattaaatctgtatgttggtagcaagaagttgcttcaaacatggtctgtaatggttttcacaatttcttcagtattttttttgaaagtggttaatttatatgtgtacaagtgacttttgagacacttatcagtggattctaaggtgtgttttctgtttcctaactgctcttgggcaaaactttaaactgattagataaaacattaacatcttatatgaaagaaatggtgaatttaggaattgagcaaatatgtttcacatctatttcccatataaataattttgaataattttaccgcatttctagaattgcaatcgatatcaatgtaaaatatcaatatggaactcaatatagaaaaatggttaaaacttggttaaaaataaagctagatatactattcattttcaagtattatactagtgagatcgacatgacattaaaaacaaattctagtaataataatcatttaataatttcctattaataaaatattaaaataagaatctgaattttaaaaatctgaagatgtacccatgctcataactgtaataatcttgtccatattcctggccaggatcaattccagactccatggataattcctattgttcaaaaagaaaaattgcatttgaaaacgaattcttatcacgtttcaggtcaaagtcagatttctacacctagaattccatgattctcaaaacattcctgccaaaataactttaaatacaagtgtcagttaaagcaattaaaattactctatttaaaagtgttagtcaaatctattcatttttttctggctgtaaccatttgatacaaaataaggttatataatttgacctgaagaggaaaaagtaatttttttctaatggcaaacctgttaaaacttgcagatgagcattttcacttgtttttggatgtcttttaaaattatcaatcaatagttaatatttaactcaattttaagttaaattattaagtgatgttggccttaagaaaaattataacactatctacagcattttttttcatctccccactaacagttttctagtacccagtattcttctattcattgaaactgttctgataaagtcatctgagaacaagaatttaagttaatgtgtaatgcttcccaaggatgtttatactttaaaacatactgctgattctaaatttaagggttttttgtttgtctgttttgtttttttgagacggagtctcgctgagtcgcccaggctggagtgcagtggcgtgatcttggctcactacaggctctgcctccagggttcatgccattctcctgcctcagcctcccgagtagctggggctacaggcgcccgccaccacgcccgtctaaatttttgtatttttttttttggtagagacggggtttcaccatgttagccaggatgttcttgatctcctgacctcgtgatcagccccaatcggcctcccaaagtgctgggattacaggcgtgagccactgtgcctggcctctaaatttaaggtttttaaaggaaaaaaagaatttgttagaatagaggtccttttaatatttccagttctaaactctaaacatactgattgatttctgtcaaactctacttatagaaagatgtttttcttgagatatacatgtgaaaacggtttctgataactatcaaatgcaatttctctacatttcccttttaaattctactttaacatgttaagcaggttaaatgacaaaggttaaccaaattcatttcgcaatggaatacgagaagagaggggggaaaaggataggtactcacatgaaaatagattggtacatatttctatcatctattatttataaaaatttaattttgttgatccaggaatagtaatgagtcaggaaataaaaagccctcctctgagggcacaaatatgtcatttgcgaagtgtggaaatttacagcctgcatgattgatatggataaagaccctcagttgtgcttggtgtggccaacatcattttaaaaaattgaattcattactaacagtgctaatcagaaaatgacaccaacactgtggatgttggtttctcttgaaaaataaaaagatggaaacactaggatcatatttttacattccaataatctagttggctagattaatttttacagcaagcatgtcctctcctgtttatgacagtatccccaacgacacttttctacattcataccctagtcactatgaaatctgtcatctgctattgctttgtgtctaataaactccattcacttacattactaccctagatcctgtaggtattgacgcttgcattacttcttctatcttataattttgccgtttacaaatactttgtgaacctactctaaaggaatccaattttgatgttaaaactagtatagtttattcaccagaataactaatatttagacaaacccacgatgaacaatactatgtatttgcagggacacagaagagctaaaactctcatctaagtctggagagattattacttggtaaaactttttagaatatgtttggcaatagtactaaattaaatataaccatttcttctttcacagaacttaaatttgtagttaaatacccaacagaaacatgtacacttgtgagaaaacacattattcgtaacagtcccaaattggaaacaatgcaaaagtccatgagataaacacgctaccacatcgcacaacaacataaatgaatctcccaaacagaatgttgagcaatataggtcaggtaccaacgaaatatattatatcattctatttatataaatttcaagaactgactaaagaatatgttacaggccagaaggaaaactgatatctaggtgttgacatagaagagcttgaggggcatgtgcactctgtaaaaattcatctagttatacagtatggtttatacttttcttatgggcgtaggttttatttcaacaaaaatatatttattataggaaggttgaagtgtgggggaaggaatgaggttaagaaagacctggaagaaactgagacaaaaagtctagatttaagttatttcaaactaagtactttgtaaaaacgtttcctggaggtaagctaagaattttagggtatgtaaaactcagtgtaatgacactggtttaaatgaagcaaataggtctcagaactaatattttcaaactgcttgaccaatgcacgtttaattaaatacatacagatactgagaaaataacttcaaacagttttgaagtagacttttaacaacattaggtaatagtaagaaacacgaaataaaaatttcaagtaaatatttatggagaaataatgcaactgagtggattttggattttagaagtcagcatcaaagaattttctttacataaatactttttcttcattaagggaaaataacgctcagctcttgctagctacaatgcatatggcatcaattgcattaaaaatgtaataagaagtatagaagggatgcggataggaacccaggaaactcagcaagatagcccttgattcaatcagtcactctgtatttctgagttgagtaaagagggataggaactagcagaaggaaatgatctaaaaggtccctcttggatgcttccaccacccatgaatgaagagcagagccatcagtcgttaaaaaaaaatttgaggaaagagcccgggtgcggtggctcacgcctgtactcccagcactttgggaggccgaggtgggcggatcacaaggtcgagagacagagaccatcctggccaatatggtgaaaccccgtctctactaaaaatacaaaaattagctgggcatggtggcacacgcctgtaatcccagctactcgggaggctgaggcaggagaatcgcttgaacccaggaggtggaggttgcagtaagccaagattatgccactgcactccagcctggcgatggaacaagaatctgtctcaaaaaaaaaaaaaaaaaaatcgagtaaggaactgctgaccagtcagatccatgagtcaacctcaaccaacaagggaatgctggccctttttgttgttccacacagtcccagtagactgtaacaaccccttagttgatgaattctagattttagaaaagtatgcaaagtaacacactagtgattttcttgggtagatcaaacacttaatgtaatttttaatattcatttttgctgtccacacagggaaaacatagaattaacttaatatttaattattataaacatttatactgatgcaaaacaaaaacaacaacaataattgtaatttactgaatttcttcctgttacattccagttgttgagctaggaacttacacatttattagatattactgctaacattttatagaagatgaaattgatgttcagcagatgtgtatcttgactaaggtcttgcataaagtcattggtgtttggatttcaaccctgagttttccaattcaaattttatggagccctctccatggaaatttttgctaaaaccttataaaagtttaatattcctgccacacaacctccagattttggagagtagattctaaccaagaaatgcctctttttagcaaagacagaattctgtactcaaggaaaaggaataaaatttttgtaagtggagcttatgaaatactaaatttgccgtaaaattaaaagtaggatgtctgtgtttttatttttaattacatatataaacataataagtaaatacaataatatatatttattatacaaaaaatatctttttcacattgcagaagaaaatgccataggcaattggtaatatatgtgtccaaaagaagtattttgaatcacataaaatgatatttaagtacagatatcagcattctgtctttaaactttgcataatctaaatctgatgtcaggaatggatagatgaattcagattgattaagacaagtaactgctgatcgggttcattaattgcttcattcaatgaatggcccgtatttattaggaataatgggcttgtctcattcccagagaatgaggctaaaaatttggaagttgagctaccagcaacttcaggaggtgatttcttggtttcttttttttgaagttattttgaaagactcttttcttttcctttaaaattatgccacattggcagacacccactctgcctacaagaattaatacaatagatcttaaagtcacagtgaaggctcagtgaggttgaaaagaaaatgaaaattgatacctctggtttaagaagagagggcctcagcagttgctgttgctgtcaaaggaaattaaaatagaaaaagatttagaaaataattcagatgggaaaggtagatcatgattgagaagagaggaaaaaaaggcgacagtttaaaacgtgtttccttgggattattcattattcatgtgttagctaccaaaagcattaaatattttaactaattctttatattggaacataaaataagaattcatttgttatgttttaatttcatcattcttctagttaatgacaaatttaatagccttaataaacaggaatctatacagatttttgttttgttaagctccacagtacaaagagttatttatgtttctaaaagtactgtgtgtcatataattacttttatcaagtttaaccttgttttaagttgcccttctttttttccttcccaatcacattaaatgtgataagattcattgggaagaagagcagaacacacaaaacgataaagttgtaatgtatctatcaacatattgaagacatgctctccatttcttcttcttaccaaagtgtggatttcttgcactaaaacattaagtgtgttttcagaatgattaggaaagtcattaattatcagatttggtaggaattgcttcctgcctcttccttctttcacttgtatttatttaaagctaatacagtcaccattgatctgtttcataataatacacactttaaccagataaaaacaagatacacaattcaaattttggggttagtaactctttggagggaaaacagcatattaaactaagtattggaaaagtgggtagtgaggttctgggaggtaattccatcattgaacccactgtttaaactggctagtagaacaaccatttgactgaagggatatcctttttataatacagttgttggtgagttagttattttacttataatgaattctaaactacaatccaattaggtcgtatacttctcttgattgagaagctgtatgctaaatcaaactaggttcgcagtgacttcattggtaacatcacctgcagtacagctggccaaatactactggccagaatgcccagtaagttctctgcagacagaatcaaatgaacacagtagaaaacccagagctttctaacattctgattatttttaaaatctttaggatctcaagctttaacctagtgataggatggcgccttgaactggtaaaaagatcaaaagttaagtagtcctatatatatattctttgttttttttttctttttcttttttttttcttttttttttttttgagacagagtctcacttttgcccaggctggagtgcagtggcctgatcttggctcactgcaatctccgccttgccggttcaagcaattctcctgtctcagcctcccaagtagctgggactacaggcagtaatcctagtttctaaattatatgtatagccttagacaaataaattttggggaaatgtcagaatactgagtaatagtaatgcagaacaaaatacatgtatccttaaaaaggtaagcaagtgatctttgaccattgaataagagatttaaaaccttaaaacagggaagcaacatatataaaagaaaataaatagcataacatactaatatgtttttgctgaaatcaaagaaaataaactagttcaaaagaatgtacattagtcttgcctattacacaagtattttcctagtatgcttgttacgacatcaacaccataaagcccttacctctgatccataacctctcctgcaaggcagaaataaataaatcagtattaaacatcttagattttcgttattaaacaaaatgactgacagataagggctttaaaaaatgtctgagtaaaactgagaagacaatttctactaaacactatctcagtgggaagtatattttgtggaattatcaaaacaggaagatcatggtttcacacctgaattactaaaataatgatcaacccagagcctcgttccatatgagcaacaaaacatgcaaaatctattttatttcaatagtgtataatgacaaactttgactctattattatcaatcaatttggataaaaaatattatacatgatctctgttatacacaagtcttgatatatatactaatccttaggggaagagatatgctttatacatgaagaatgtaataaacataggatgaaaattatgtctatgattgaatatattcttccaaatgattgtatgatattttctttatgttaattctaaaaataatacaaactattggctgtccttgcagggtcaattataatattagaaattaagtgaagaagtttttagagctttaatagccaaatattcaatattacataaagatttataaagttcacacatcacaagatggtgaaacgtttgactatacttgagggggagaaaagaatatagagttttcaaagttgaatgttactaataaataatgaaaatgttctatgtgttattttttaagcagttaaagtgttaaactgatgctgtcaaccatgttatgtagaattaatcaatcagtgtaatgaagaattattacaaagaggcacatattacaaagaggcacatgcataactttctaaaatccaacaaaagaatctctgtagaaaaatttttaaaaaatgttgaggccttcacaaagtaattctacttatcagaaagcatcttgtatggtttatgcattgtatattgaaactgtttgtaaaaaaaagtaaatacaatgcttacttaagcttctcaattgattctttaaaatggttctgcagtgaatttcgtagagtgcttacacggttctgccaatatttataagactgataattcttccagagcctttagaaattgtagacattttcaacttttaccaaatttatatttttcagaaataattcaggtagggaaagctcatatttaggtttaaacaatgacaactgagtcatataccttataaaatatccaaccaaagccaggctttattttttagacgatttcttctgactccttttattagcaatgttttccatcaatgtgaaaaataaaatatcaatagataaactataactcaatgttaatgtttccattcacatttttgttgccttttatttggttatttgtattgcttgtcttggctcaaaggcagaaagttacttgaaagaggtacataacagaactactactttacctgtgtgctttcaaaacatgactattgatacttataaagccagttcatataatatcgatgcacctctttatgcaattcataatcaattgtattatttattttatatcatgtatatgtatcactgtttacttttaacaataaggacaaatgtttggtcatctttcttaagtctttatttaaaaggtatctaataatttcttatgcattaatgagatcataataaatattgagaaaaaagtgttacttttctcctctctggttgtcaggttgtaagcagttagggtttgagaggaggaagaatatttaggcttgtgtactcaaataatactaaaaggtctcatatagaagatattttaactgacttttataatgtatcataatgacattaggaatctccaaatacaatgtgtcagaaaaagactggcttaaatataaaacacaggtatctatgtttcaattaaaaagtacagaataataacaaaactttcagattatgtaaatagtaaaatgttatagaaaaaggcaatataacaatttaatagggctgtaggtacctacacaaatatgttttttggacttctcttatttcttttgttactatttatagatttatcaagaaattataaattttacatttgcaaaaagctggtgtagatattagcttagaaaagacacactcacattaaaggcttacacaattgtgaataccttgtcagagtccgccaaatagcacaagttctcatgcatatgaccagctgccaacaaaaactccaactgaagtttttcagtgaaagaaagaaaaaaatcacgttcaagaaccccaagaaagtaattactcttgatttcgatgaaaagattttgaagcagatgggctaataaaaataatcagatttacagattgttttctgtctgatcttggtaactaggaatgccaggtcaaattattgaagaaatatgagggatgaagaaaacctctgaaataacgcattgaagggggctctcaacttatattcatatacttccaatagtaattatcaggtatgagttttgcctgtattttagaattgtacccttctccatgcaaacttatatcttctaaaatcttaaaactccagagtgttttataagtatttgttttaaacacttacatgtgcattcaaaatgtgaacttccagtaaataaaacctattccatgtgtttcatgggaaaaacaaagtaattacttgatggtcacatattatacattatatactaatattgaaagtatagtttccttaggaaggaagggacatagatagtatctagcttaagtgatgctgttcgaatttaacaattggagcgctaagaactattactacaactacagaaatctcttcccagagtatacagttttattttctttgtttaaaacaaagagcagaaacctaggtaaaagagtgattgatagttcagcaaatatcacttctcttggtttttctatttaagctttttatatttcatttattaaactgaagatcatactttctttaaaaaggaatcttatgaaaaaatttaaattagggagatgattaataatatgaacaaacaaaattaaacagcactttttaagcatctgttggaacaatgaaatgccttacaaaagtcaacgactcaagatttattttcattataaagaagggaagggaaagcacaatgagaaataaagagaataagacagcaactgaaaaagtataagatttatcaaatccataagcatactactaaatccataagcatactactaagataaaagcaagtcagagtaaaagatgttcttatcagaaaacagatgactacatgttatagcacctgagatttattttgaaataccttatgtctgtcatctcctacaatctaggtacattatattttacttcggtagtatttcttcttaccaaatacataggcttcaagaaaaaacagaacctatcaatcatatcagttttaacttatttgtaacagtctgcttttttcttggaacattcatataaaactacgatcaaaaactaaatgtaaatgttactgcatccacatgatagacatgcctttggtttaagttgggtatctaattttcatgcccacatattcccactaaaaaagagattaaaattacttacttttcaaataaatgtagaacaaattatgctactttgtagtttttaaaaagtaaggtaaatctattatatgagtgagttagtagtgatgaggttaatatctttttaaattaaaaacgagaaaaaaaactgcatttcattgaatttggggtaaaataatagagtcttctttgacgttcaaatttgatgttcaacttgaagactatgatcaacaagaggtttgcccgactaaaataagaaaagcaacattacagtgaagtagattgactgtgagattgtttttcagttccctcgacaatattgttcaaactccccttgttttgttcagatgtgatttccatatttgttacttctgaagggcacatagtttgaagttctgaaacatttgtgcgtagatagtttttttctatttgactgtacatgttagctactgatttttcaagttctgctaagtttttaacgtgtctgaggatgccttttggttctctctgagggtctgttttacacactgtcgttgttgatagctgtgtcatagaggacttaattttctcggcaggcatcaagttggtcgtgcatttaacacctgttatacagacacactctgtggacagaaatgaagctgaaggaggtggagggcaaggaatagaaggaggtggtggaggaagaggagttggaaatggaggtagaagaggtggtgttgggggaccagacgttgaaacggaaagtggaaaaaatgtaggaggaggaagaggaagagggatagaaggaggagagggaggaggacaaaaaagagaaaaaggagaaatgtcaggaggaggagcaagaggagcaggagcaggaggaggagaaggaggagaaataggaggaggagggggaaggggacaggcagaaggagagatgtttggtggatgggcaaaattttcaaaaatatttctttcggtttcaataggtaacatacaaataggtgtctctctcctagagagtgaagaatgtaaaacacaaggccttgaaggagaaagttccaaggaacactcagcaggagaactgatgacattaggttctgatttgagttccacagttcttgaaacagttggcaaagtggagaatgagaagtgaggcctgggaaagcaaaatgaagagtctgaagagagagatttcaactgttctgttccttctatcatcagtgtttcaccttgccttatttcctctttctctgtcaaatttgcctcttcagttgtaagcaatggattgctgctacctcttttgtttgtacagattccagtgttttcattttcagctttctgcctggtgccttgccactgctgcagatctatgatctctggtctatttggaactttcctcatcagcctcctgggtaagctgactgactgactccacagcctctgaatcttttctcttgggcccctcagagacttactcttggcttgtattttgggtgaaaatgggtctacaaaatctgttctctgtgaaatgtctgaatttgttgatacttgacttatgttttccttataaaggggattatgggcacttaagtcatcctcatcagatagaaatgtgaattttcttgcagacttcagtttgttgctcttaagtgatccgtctacatgagctgacttgtgagcctcaatagtattggaagaaaagggcatcacaacttgttgatgtttcctgtcttctgagactgagttatttcccctgctttgttgaaaatggtagagaaggaaaagacttgaaagaaaagaagataatgaaatgtaaggaaacaagttgtgacacagctttcatgagaaagatgtttttatggctctcattactattaaatacttaaaaacatcaaaggccaaacaacactaacctactaaagcaagacattattttaattccctgctcttagaaaggcagggcagaaaaatcttagagttgtgagaagaatgagaaatgtaaatgaaaaaaaaagtactcatctctagattattttggaagagagtattttttgtttttgttttttttcagctagtgtgatacagcaaagcatccatgtccacacgtaacagttcccttatgcacaaatcacagttcttcccattgcagaacaccatccttgcctgaggatgctcagggctgcctgttacgcatagaagattcttagctgtatctgattcagtacttctgtcctagagccaaaagtaatctcctctctgagccatcatgtggaatatcctgttctccaaattaagagaattaaaatcaccaaggacagatgggagtttgtctcacagcccaaaaatcacaattgagaaattgaatgtatgctagaattgtgacagaggagtttttcttctgtttaaattttgtgcttaattagttttaaaaccttatacataataccaatcaggaaaaattgttttaaaaccttataaatagtaccaatcagaaaagatgttgtcagtaatttcttagactgatctggatcaaattttacttaaaactcaccttaacaaaaagattgatgctaaaaaaaaaaatcactttttgatatcactgaaaggcttacttatgcacggaaactgaatcataggtagttgtgagtcataaataaagttgcatacatcaaagatcacaaattaaatggctctaaggaaagcatttggacccttctcccaggattgttggctgattgataggtggttccgaattctcattagcttttactctcaagccaaaacagaataacatttattttagttactgcttaatatttacccacttagcaggaatgaaataaaaaagaaatattctgaatagaaattaactagccatattgaaaaattagggtgatagtttaggcaacaaaataataaagccacagttgttaatgtgtcttttggcaaagatacgaactataagaaagagaaagaaacaattcacacaggtagacctggagcatcaagcctacttggacaacaaagaaaattcagacaatctggactaatcagagtgcaaacaaacacttttactcttcgaatcttgaaaagtatttttcaaatatggcacgaacaactgggattgatattatatactggttgtttttgtaaacaaacatttgttcgtggtttgatttctcttggtaaagcacccaatggatataacaatatcacatcactttgactaaaagaaatctataaataggtttctatttatagatttgtaaattttaagttcttaaaatttaagaatttttaaaaactaatttaaaaaaattaaaaacaaggagaattttgaaattcctttcagtaggcacaggtaccatcacagcgaacacatgttttaagctcatgccatcaaaaggaaattgggtgtggaagacaaaactttccttttaacagtaagtgagtctgtggcaaaagatgaagatcactgtatttacagtacaacagcattttaatctgttctattgtatctatttttctaacgctcttctattagagtgatattatttacttacttatgcctatgtatccacaggtgagaaacagaaaacatgtgatagaaaaaaagaagtttttactagagttaatttaaaacaattctgaaaatatgagcaggaacttgctttaaacaaacacttagtacgtatatcaaaaaaaaggcatgtttttatattttgttattattcatatgaatgacatttaatagtagatgaaatcaaatgacattatttgaatgtcttttcacagaaaattgtatctaataaagtctgtttactatacatagataaaaattcacttctattaaacctggatgatgccaatcctaaaataaaaattttaaatgagagtttaaaaattgcttctatgatgtcttaactctgtaaaactggttaatgcacactgacttttaaagtagatatattttgtttggaagaaagtaaatatacaactactatgatgacaattaattacaaagtaattatagcattcataggaagttatcatacgaagttattactttgtgaagtagtttttccaaaatgatctttgactttgttctttttaagataattgataataatcatttaaaactaattcattttctagtaacttaatgcttagaattcctgtaaaaagttcttgaatagatagataggttaaacatttactaaagataagataattaaatatgtagaacttacttaaactatttcaatgaatacatatattacaattgcaaaatctactgagtctactacaattgttcaagtaaaaataatcttaggtattgctatttgaaaattactgtcatcaaactatgctgattccagatgatgttatagtatacctgttcttattaatttaaaatgaatacataattcattaatttcatatataaacacacaactttacacataatccttttttttagtttctaaagatctttgcttgagagaggtcattaacatactcaaatagaatcaaatcatattggctcaattcctacattcaccaataattaattacaaaagaaacaatcatttttcaacttacaaaaaaggtgaaagcatatatctaaagcatgaaccctgtattatgtccttattttggaaatagaatgtcatgctttaacctattataaattcagattttgtgttaaaataatagcattaagatcaattttaacattaatacgactatcctaaacaaaaccttgtataacattattaatatggtaagtaacctgaacacatttgtttaaaaccagcttttccattaccaggtcaatttcatgattttttaggcttttcttattgctactagtaactgatacggatgtcacatgtaataacatgttatagtccttctactccatcaaattccagttaataaaaggttttctggatttaattgtcatattcaaaattgtaaaatattcttggttgttttacatatcatgtccaaaagcagttattcttgaatttttaaaatactgacaaactgaacatcaccataaggaatccaattatgagggtagcatcattatacaagcaactgtgaggtcttttaacagttaccagtgtctttcaaaaatgtatgattttttaaatagtgactacaagtttcaaatcgtgcaggagaaatattcggtaatcaccgcagtctgagagtaataaagtgaaaaaagcattttctaagtagttgggaatttaatatagaaattctgtaatttcattgagattttaatttctatatcatataacgtcctaaaagtagtatctcagaaaatactacgattttaaaccagagaatttggttttgattaccaaatagggatcggtttggatacctaatcaggattactattttatgattgtgctttatttctctcgtctcctatgcaaaaatatatttttcagaatctatttatatatttatacatatatacatatacattatatatatgtaaaaatgcatgaccctgaggattgagatattaaatattatactcaagctataaatgtgcaattgtctcctgaagttgaattctgcttttctcttagctttctttaatttctggtttggttttggctattatttttcaacttaacctttcttagattttcgtcttaacaaattttctcttgaaaataatagaataaaataaatagtccatgtaggcatttccacatcagattgaaattaaatactcaccacacagaattcagtaaaacccaactacttctcagagttcctgaacggtctacttacattgagctgtctccaagttcttcatagagatgcgcacctggcggaggcggcggcggcggcgggggcgctgccactggtgcaggagccggcactgctggtttagccgcgggtaatgcggcctgaattcgtgcagtctttgtacactcagcttgacgtcttggataaagtaaggatggcttgtaaaactcattttagaaatcataatgcttatcaataagccaccttttaataatggggtccagttatcaggggaacccactaaaattattttacacaaacatcaatttataaacagatgtaattacaaaagcatccccacagggtatcatttgcatataatccctgctttgttcttgaaaatagctatctcttgaataaggggtagaattcagcagacatatttgcaaattaaattaaatgataatcttagagaaagcaaaattttaattaaaatgggatggataattaattggtagtttaatgaatctctttcataagatgaggcatattaaagataagatagataatttttctttattatttgtcttttaaagttatttgaaatgatttgaaacatttttgacgttatttcacagaggctgtacacacatgtacaagggaaatttggttagcttgtatatcctttaagattcctaggaatgcctaggccgggcacggtggctcatgcctgtgatcccagctactggggaggctgaggcaggagaatcgcttgaacccgggaggcggaggttgcagtgagcccagatcacgccattgcactccatcctggccaacaagagcaaaaagtccgtctcaaaaaaaaaaaaaaaaaaaaaaaaaaaaaaaaaattcctaggaatgcctgtgattctcatgttacagctacactgctgtttttggatttcctggacactgattaatttcttcctcaaaaccaagatgttacaggatggaagctataggcaaactatctttttcacatttgtgcaagttacgtccaattgtctaaaatcagctcaattctatatatatcaaaccaagaaataaactattacaaacgcaaaacaagggaataagatgtggttctgagcaggctgacttgattgatataatctcgggtttctcttttcctattacatgaaaaggatgtgtaaaatgttaattatacttacactttaaacctgtttgggaaagcaagagtaagaaaaatagaaagctacattagaactattgcattaataacattttaacatctgatttattctaaatcatgaataatttatacgttaaattcataatgacagagttaatgacagactaagaaaactaaggatatcaattcaaaaggtgaaaatagtatcgttaccgttagagtcattcaagccattaaaatatccataacagaaaaataaagaaatgaactacatagaataagaaaactggattaaaatgtaaatgtgagaatttcaactctagtggaaaaatggaatattaaagatgacctgacctttataattggcttcttggtttaccctgcttgaagaatattacaggaatggagagaggtagcaagccctgattatactcttggcttcactttgaagctgaagctacaattggaaggtcctactcttgggtaataaatttatgacagtttttacatatttgctttttagtttccattcatagaaaagttcaaaggcatatcattatataaaaggatagctattcattcttaccttatttgcaagcaaatatcaaggtacaaatgttaggtctttaaatattagaattttactttgctatgtgagcagagaaaaactcattttgtttaattatgttaatctataaaaagcagtaactaaattcatatggtattgagctgattatcaaactaaaggagaattaaataatgcgtctataaattatttaaatattaaacatctcaagtatttgttgtatttcagactaccttgtataacatccagagcgcttcagttttgatcattgcatactgtgccaaatacaagaatttttctcactgatttgcttgctagcaggatataataaagctcctttggaaaatagttaagtgtaaaaagataactggtaatacggaatggatttaacattataattaataatgggttgatggcttaataatttaaaacaatttgttcagtatcaattttgttcatcagctttagatttagcatatcaattgattggttaaggacacattaagctccagtatatcaaccttaatgctgtatttgcaacttcacattgcttttgaggtagaaaatatttctgtagtttcaggttggaattacttgaaaagtaatgacctgcttgaaaaatattaaaggaatggagtcatgcagcaagccctagttatactcttggcctcactttgaaaacggagctagaattggaaggtcctacttctgtgtaacgaattcatgatactttttttcatatttgctttttagtttccattcatagcaaagttcattcagagcatacatttggattttcaggttggaattaccttaccttattcaattcacaagaaaattttaagtatttgagaacaaagatgacagtttaagaatacataaggactattggctgggcgcggtggctcacacctgtaatcccagcactttgggaggctgaggtgggcggatcacgaagttaggagtttgagaccagcctgaccaacatggtgaaaccccgtctctactaaaaatacaaaaattagccaggtgtggtggcgcatgcctgtaatcccagctactcaggaggctgacacaggagaacagcttgaaccttggaggcagaggttgcagtgagctgagatcacaccactgcactccagcctgggcgacagagccagactccgtctccaggaaaaaaaaaaaaaaagtaaagaatacataagaactattttagtatttcctctgtaggtagtttaaatgatgaatagcagttctaccattatttcttattgtttattacataaagtaatttacatgatttattattactgtctgctatttattttctttttgtggcacactcagggctacttctcttcttaatcagctccccaattttttcaagtcattgtctatagaaatatacttaaaatgtgtggctctctatcacaaagcttccccagacctagtgtcaaagaatatattactaacctacttcaaatatggatgtttaaattagtgataattacttgactactctagataagttaaatacaattttaaaatatggatattgtcaatggatgcacttgactgcaggaaccagaaaaattaagagcctgcacagccagaacatgctgtcaaatagtacactaaaaactctggcaaagcacccaggaaggaagaaaccacatagaaaattacatcttacatgctatgattttacaatgcttttgctaacactgtgatcatttgcacaaaggcaaatttaacagtttggataaaaacctatcatgacaatgtcgcgaagttattgaccttcctttggagctgggcagagtgggtatccgcatatgacattccattgcttttaccccaggatacctgttaccttctctcccaagttggctcttaaacaaaagaagagcataaacaaagccacaggaactaaggtgatatttctattgaaagagaccgaattagaatcacaggaatattgggccatcagtgaaaaatgtactgggagtttgtactgttttccttttgaagaaaatcatttggtacgagatagacagacagataaagcaatctcagagtagttgcaccatcaatattttacaacgcaaagccatgttaccagagatggttttctgcaatgacttctgaggaactatccaggtttaccatccttgaatacttactgtctgtagctgaccaaaaccaccaagatggcaggaatgcagcagaggatgatgatgaaggccagagccaacaaggccccttctgtgtatcctagactttctcctctctttttaatgctggtcactgcctctggagtccggatctccagaatgcgtcctccttccccataatacggctgaaagtctttattgatatcaagtagtttgccatccaaaaatctttattgttagataaatagtaaaattaatgatgctagcagagaaagagcattttaaaaataaaatctttttgtaagatctttcaatattttctctaattgaaacacaagctgagtcagaagtctcatgaataataagaaaagcatatataaaaagcataagcaataaagaagaggagtaattacacatctgtatagaaatatcaaaaatattttaaaacacagctcttgatctgcttatagacttaaaaaatctaattatcagtatcattaagcttaatattactgtgtcaaaataatttaacaacattttagatggaataaaatataatatcctaaattatataccatagtttatatttatgcattttatctccttgggtcctgtaaccttcaggataaccctgtaaagatcaaacattacaatactgatttattgcaggccaaaaagctatacagttataaaaacaaatctgaggcaccaaactaagatttcagactcaaactctgtatttgtttgccataacaccatcttaaaagtaaacattctcaagtttcaaaccaaaagaatgttttatggtcaaatggtgaagacatttaaaagacccttctgcctaggaaaaaaagactaaataaatgatgcgagtagtatatcagtgttgtaagaatgacaggaagtggtagtcaatgtaattccttcctctaaataatgcaattccaactatgagtcttgaattttggaagagaatcaaggaataattattcctaatcttatgagattgaaaaaatttgttatgtatttaatatcataattagcaggtgattttttaaacaattccttgggaacttttgaacagtcccttataagctctacatattgatgcagcaactgtgttcttaatacaacaacaccataaaggtcaaacgtcttactatagaatattggaaaacaaaaatagttcaagaaaaacacaattactcatagtcccatgatctacagacagtcataatcacttctaacatcttggtatatttaagtctaatatttttttggaggggtgatattaaatattttatatacttgagtatactgcatatataaagtgcttatgttgaaaaatacagaaaacacaaaaaaatgcaaaagaaaaaattaaaatggccctaaatttcattatcaaaatataatcaatgccatgcttgtgtacttttttcagtctattttatgcccttttgagacatttaattttaatattcagagtgaccatgctgattttaaatcccgttaacacactgttcattgcttaaaaatagaagtgcctggtatcacatatgaattccatcacatatgtaactcataaactaattcatatcacacatgtggcaattagaatgcttttttgctttttttaaacagatacgcttttatagattaaaaatgtactttttatagcaattttccaagctcattgttacacgttaaaagaaaataaaaatttagccatttttatgattactagaaatagaatagtgaaacttcttgtttgaattgtttattagataaaggaagagattctaaatgatgcatagatcaagaattgcttcacaggaactatattattagaacaaggaagaatcagatccagaagaggatcattaatttaagggaagaatatacccctacaatgtggagttcagttgacagatcaaaattctattggattcctggatttcatatccaaactctctaaagtaagatttgttagtctttttacactgcaagagccctattacttagatacttattttcacttatcaatgtgatgtcataaacaattttttactagaaggatggatcacttttgaacccacacctgatctagactatctttctttactttgtgtatttaaaacaacttgtctgggtaaaaattcttgagtcataacattatcccttacaaaacagcaaaattgcttccattgccttttgtcattttatcatgcaaatgagatatgcagggcttacctaatttttgttcctttatgagtaagatatttttatttctgtttcagtgatttttaaacatattcagatactattcaaagaaacatggctaccttttcattgatttttgcctgtaatataataaactcttgaattcttttttcgattttttgcttctgttataaatactacaattttaacctcagaaataactgtcattatcaggttgtattttaatcgtcctataaatatattttgatctcttttattatttatatgttttttcctttttcttaatattgcataaattttcaatggatacacttcatgttgtcaatttaattttcacatgccttctcatttcaggaaaggttgaatccaggtgctcaattgattttaggagataaaatttaatttataaattaggcacagtaagatattaacaacaataactaataacaaaatagaacaattatagaactatagtgtaataaaagttatgcaaatgtggtttctctctgtctctgtcaatatcttattgtattgtaccattggtaactgaaactgaagaaagcaaaaccacagaagagggttgactgctatactccagttggactgaggggaaggcactttagattaaagactaccaccgtgtaggaaagggacaattctcacgagagaaagtggaattcttttaccagaaacaggagaaggactcaagccatgtaaaacacacacaccatttcaccaatccataccattctgttttctactaaaaatgttaaactgttttccaatggtttctgtaggagaaaatttccagagttatatattctccctctgggtcatcaggttattatctcctgattttccatatttattttgttttttagtatttattgctgatcccgtttttccactgcttacttatcctaaaaaagagatagatctgcccaaatccagcatcaacacagaaatgtgttttttttttttttctcgtcattttcatctacagtgtactcagttactatatgcaaaccttttgtaattctaagggaagggtatacaggtcccttcccaggatgtagccaacatgaattgattactgctatgttatcctgaaatgagataagttgctaaaccaatgtcatgtcttattattttctcaagcacatgcaaacatgtatttctgcctccattgatggatatggggcctaatgttgtgttattcagcatataattaataaatacataatcaacaatctaccctgcatctcaccttcgtgactgattaccttgatgatgatgattttgatactgcaatgtacatatgaatgtagaaataagtaaagggtgagcaggagattgtactctagacagtagagggacaactgtctatttcctttgtaggtacacaatttaggcgtacagagtgggcagtggttaacatatctacctacattcattacactgtataagatttttctgcttaatcaagcaaatcatggttagatcatcaactattttcttttcacagtttcataactgtttaactagattctaataattagtattccattgatttggattttcagtattttgaatttatatgtatagttttttacttagaacattgaaagaggctttatcagagcctgttaatcagataccgtttaaggtctaagtgtgtttttaaacattgtggtttaaaggcagtgtataaagtctttttctgccttctccatctttctcttacgatttggacatactgtttttaaataggctggatataagacagataaacaagctaaaatgtatttgcttatttttaaattttaattaaactatattttaaagtagtgtgttctgttttgtgtagaatgcagaaagccacaagagaatatggctattaacagcaacaacaaaatgacaaaaaagtgccaggttatactaaaatcataaatttccttgagctgaagtcacaatgtgagcaaaaaaaaccaaattccattgagtgacaattaggataatttcatggtgagatgtgaccatacattgtttcacctttggcagaaaaggttaaaagtggctgccataggctgggcacggtggcttatgcctgtaatctcaacacattgggaggctgaggtgggatgattacttgagctcaggagtttgacagcagcctgggcaataaagtgagaccatgtctctacaaaaaacaaaacaaaacaaaacagctaaaattgtaataaataaggttagaattatagacacccacaaacacaaggggagtctcccctcatttgaaaacttctttgcgtagatttctgtaagatagattgggggacaaggcaggacacaagagaatattccttcatggtgtaagaataggaacaaatcagcaaggctggtgcacaggcagcaacccttgtgcaattccccagacctttatctcagatgaaacaagggccgtaagtattagagggaggaggaggaagtgtgcccatccctggtgctcaggcaaaggtctactgcttctggaaaagaggtataagcaaaaatcccctacccctgggggaggagcaggaagtcctctcaggtgtaagatcttgcaccaatacaaagtagaggtctactatggattgagaaggggcagaaaattctcttgcacccaagaccccctgtaaatgtgaagcagaggatggctgccatgatgccataagaaagagggggaaaaaatcttgagaaagcccataccaaggcttacacatgcaggctgtacaaggagaacagaggaacccctattccatgacccacctcttccttataagagtggaacccagcagcaaggaggagcagtctaacactgtgggacagatcagagtgtgggcagaaacctcttctgtggcacaagcatatagagagcactgagagctgaggactgagtaagaagactgagaaaaccctacagcacgcaggcctctattctaagactgagttgacaccattccaccaataaaagaatttttgaagcttttggcacagtggaagtaataattgcaacagcaaaatccaaataattcctgaatagctttacttaacagagtaaatgtctgtaatgtccatttacaggcataaactctatttacctcacttcttactgttcttccacaccatgtctggcattcaatcaagtaggacacaaaaagcctacaaaatataaaacaaccattttcaagaaatgaagtaacagagccagatagagataacccagatattggaactgtcagacaggaactctgattcaactctgattaatacattgcaaaatagcagaaagcacaaacatgcctgaagcgatggagaaattcagtagagtggtggaaataagaaataatctaatagaaatgctagaaatatctttctaaaaagataaaaagatgaagaatttcttcagtgagttcatcaataggctaacacagatgaatcagtgaattcaaaaatagggcagtaaatattattcacactaaaatacaaagaaaaaactgtgtgtctatgtgggcgggggaggggagcagagtcagaacggaacaaaattatgagaaaaatcaaattgtaattggaatcccagaaaaggaataaagagaaaatgggcataagaaatattagaaaaaatgtctgagaatattccagaaataaaaaaagaaaaaactcaaaatcaaactcacaaaaaaatgcagctccaaagagttgagaactacaaggataaaaaagcaggataagagtaatatataattattgcataaaatctaagcaattcaggtaaccaaaaataaaaaaattaaaataccgataagctggccaaacaaaataagttattaacatatcactaaaagtcattccagtcctgtctatgcatttatgagcttttttatttttgattgccaaaatatattttttcaaatcaaagtaagttcccaggacaaattattattatgatgatttctaatcctttgacctgagcattccaacatcctcagaagcttagattttaaggtgaaaggaaattgaaagaacacttccattgacctggaccggcatcttaatgttctagtacatttatgcagtgttaaaaactaaataaccaataactctcacaactacagaatagataccaatacttgggcactggcattatcagccttggaaaacacacacacacacacacatacacacatatacacatgtatatgtatgtgtatacaattttattataaaatctttcaagaaacaattctagagtttcaaatagaccagtgactctaagcttactataatacttcaaggtgaagactgctaaggcaaaattttcatatttcatggctattctatcttttcttcaatataaacatatattatttatttatttatttatttatttatttatttatttagaggcagagtcttgctctcttgcccaggatggagtgcagtggcatgatcttgctcactgcatgctcggcctcctgggttcacgccattctcctgcctcagcctcccaagtggctgggactacaggtgcccgccaccatgcccggctaattttttgtatttttagtagagacggggtttcaccgtgttagccaggatggtctcgatctcctgacctcgtgatccacccacctcggcctcccaaagtgctgggattacaggcgtgagctaccgcgcccggccaaaaatttattttatgatttatatatattctgttttttccttgcctgctggctatgatagttattttattgaatttagatgtttactgtccataatataatttaggtttggaaaaacttatttagaattaattaaagatgttcatcttgtatttcatggtgtcacttaaaacccaagtggcttttttttccccaaatatttaatctctagaaggtttgctagttaaattcaaattctaatcaccattattttactctttaaagttagcccaaatataatacatatttttatattcaggtaaaaacaccctaaactcaatcaatcgtgaaatttaaaaacaaaactaatgtatgcaaaaaacacagaatgcaggtagattcacataaaaaagaaatgtgttgattttctgacaatcgaaagaatatatatgaattactttggaagtttattcctaaactttttaaattaataaactttttaaattaataaaacttacaaaaaattggcttggtagatctaaatgttgcttcattttggtggtgactataaaatcagagtgcgagctattacttcattcatctatatttcctccacggttagtatcctgttttgcacatggcccaaatatctattaaaaatgaattgatgagccaggcacggtggctcacacctgtaatcccagcactttgggatgccaaggcgggcggatcaccaggtaaggagatcgagaccatcctggctaacatggtaaaaccccgtctctactaaaaatacaaaaaattagctgggcgtggtggcgggcgcctgtagtcctagcttctcaggaggctgaggcaggagaatggcgtgaacccgggaggtggagcttgcagtgagcgagattgcgccactgcactccagcctggggcacagagtgagtctccgtctcaaaaaaaaaaaaaaaaaaaaagaattgatgagtaacatgttaaataattatggcttttaaaaaattttagctgatattaaatcattattttattattgccaaaatagaagtgatgaaattttgtcgatgaacacatttaaaataaaactaaattcagaatttattaatttgaataaaaattgaatagatatttacaaaataaataaatttacatacacataatatagatatatttgtaaatgtgtatatggatatgtttatatgctgtttaaaaagtatagacaaagaaaaactaaattatgatgtttcacatatagagttcggcatgactatatatacaggcacatataaactattatgattgtatatcaatatatatttttaactaaaaatgtttcattgagatagaatttcattacaagacccagttggacactaggtgtcaccagagtaaagaaaattctgttaacaatttttttttttttaagtatttaagtgtgctcgaataacatccaaagaaagtaagtagcaggattttctttaagattctgcactttatttatttttaggatttataactcaaatttttaagttcctgctaggatgaaatttcacatagagcatgaacttaaatgggaatgattatcccacctgctctccacctgtaagttaaagaaaaaagcagatattgatttttgctgatttagtagacctgtaagaaaggtggatttcttcttaaaatgcaagcatatgaaaatcattgcagaaaaactgcctctttaagaatctgtgctttcctcattaatagccagtgcccttgagcaagagtgaggagctggcagcaggtgatttcaaggagctgttccttgttcttaagtacaaaaggtcatctgatgcccataaagaaaatgggccctctgaagtcactgtagcccacacttagacctgaaaactttaaggcatgagaatcctaggtatttcaggttctttgcttacacttcactttcagtaactatttggtgggttttaaactttaagtacttatagcctcaagtcagaatcatctatggttgctattgtaaccaaagagctgttacagataacaaaaagcacttacttaaaaagctcatttctatcgatggctctgttggtttgggggtcaattgcatagacagtcaagtcacatttggtgtaatcttctagggaaaaggcatctccatgccggcgagctccaatggactccactacgaccttggcaccaggaatttgttcctgaacatagcgatccaagatcctataaatcaaacaaagtacaaacatgacagtccaatgggctttctgggagtaaaaaattactcttaacttgaaaagacatttagtaaatgaaaaatgatgacagcctagttttttgttaatgtttactgaatataaacccttgaaaaacattctctatattttttcagcatttagctcccaatgatgctagaagctgaatacggtagaaaaggtcaccaaccatgtcctatttaactttaggctttttgaatttatgatactatttgagcttttacatgagaaatgccaaatatgctgtacaaataaagctgtctatgctttataggaggcatggggtcttagaacccttgacttcacatggttggtgtcataaattacatctcccactaaagtctgtgacacatgacacgtagctatatgctaagaagcaggactaggatgcctgttttcccaaaggtataaaaatccttgcagaatcacagcaacgggagaatgtggagatattttgcaatggcaggattaccacgttaagataaaaatatggcatgcaaatctcagacactatttaggtgaataaaaacaacatataccatctggtataaattagtgatatttaatttaaaaagcagagacaatattaatcaataagtaattttcccatctcatgactggattttaattgaaagtatgaattattaccatttcccaaatgtctcattccttattaaaaactttatattattaacccaagtatataaatattaagagcatataattcagtatttacagatgtttaaatttaaataattttaattactatatatgataaatattctaaaattcgtagactcaatgctcttttctgagtctatattttgaggtttttttagggggagaagggcaatatattctaaagtcctttgatacatcagaaaataacttttgcttctaatgccacaattgacatatttcttgctcgactgaaagtatattcccttaagagtcttgtatgtgcttggtttgccttgttattagaacaatgaggttactaaactttggaggaaatggctctaccagtgcatgccaggagacactaccaatcatagtgaaatgtttgcttgcttgtttttaaatgtttgtaacccagtactgttgaagtctgtcttattgaagtactattcattattttccttttctgtcaccactccacgcccactggtctctcggcttcgcaatttcttttctgatgacatccttgaagtagactaagaaaagatgatgtgtaaaaaaggaggaggagcaaattcacttggaaaatatcagttaatagttgaatgcctgcaattccagctagtcgggagatgaaacagaagaatcgcttgaacccgggaggtggaggttgcagtgactccagcctgggcgacagagcaagattttatctccaaagggaaaaaaaaaaaaaaaaaacaaccccgggaacctgaagataatggatgtactgagagacacagactagtctaacatcatttggactgtgtttttcagattttttttcctgagagatttatgctcatttaacaaaaataagagaggcctcggagtcaaaccatattatactcttgacattttgtaggaggcacaaacaataatgatataatgttgaggagtacagatgtctggctggcttcaattttaatttcctttgcctttcaattgcataaccttagacaagtaatcttaagctctcaaagtctcaggtttgtttgtttgctttttgagatggagtctcattctgtcgcccaggctggagtgcaatggggcaatctcggctcactgcaacctccacctcccgggttcaagggattctcctgtctcacgcctggattacaggcatgcaccaccacacctggctaatttttgtattttttagtagagacagtgtttcaccatgttggtcaggctggtctcaaattcctgacctcaagtgatccgcccgcctcggcctttcaaagtgctgggattacaggcatgagcatcacatctggccatgtttccttaaatagaaaacaaggaaataatgtaccacatggggctgaatgtgcattcggtgaaataaagcttttacacagttcctagcacatagtaactattcaacaaaatgaatcttatttttattaatttgactgaaatatttccattaataagcttcttccttgtctcaaattcattcaaggcctttaattaatttgtggaataggaaagtatacttctcactagtataatcaatcagttcacaaatcaaaacgcaaacaggagtacctagttaaatacaatgcaatagatggctctctgtcccaatactttggtctaacaatttatgccttctccagtgcattttggcattgatttgacatgttccaaggaaatccttcatataagcatagattaattgtgtgtgatcctacagtgaagaaacatatctattgtgcttgggttcttttctattttcagtgcaatactgcagaatcatttcactaaaaaaaatagatgtggaataaaatataactgtaccaattccttcatggtagcagggaatcatgaataaaagaagtctaaaaacaaattatgtcatttaaaacatgcaataatgtcttcactttgagcatttttttgttaaacttttaaagatcttttgggacaaagtatatcttatgataaaaagagatatagcctaatcttaactgcttctgtatctttttcttataaatgtaagtaaaactaaataccttttaattgagaacacatttcataaaaatctatcttttcatttatcatctatatctatatactaagtattttctacatctatattcattacctatatgtatataaatttcctcacatatatacatatacccccacacacacaaagaaaaagagatttgcaatgatgtttatctaacccataatatttgtatcatacacacacatatcaagaaagatgtccataatgatgtttatgtaatgttaataatgcttagagctggatggtatgattttgagtttaccttttataactttcttcttcatatattatattgcttatatttctttataatgggaataaaagaacaatatagttatatttttaaaaaatctccttaactccctatttcctctccccaacttcgtgataaaaaaagtcttcatataaatctatattttctagtttaaaaatgaaaaaaattaaattggattcagggcttttcataaaattatagcaaaactcactcagggaagtgttaagtaggaaaattttcatttattcattccttcaacagatgtttattcaatgcctatcctgggccagaagccattccagacacatggaatacatcagtgaacaaaatacaatctttgatgtcaaagaagaatttacattcaaattgaacaagacaagtaacagatcatggattgataaaattggtaaaagtgttcagaataaatatcattgagactttgatatttgagcaaaaactttagggaacaatgtgtgctgtggctattctaggaatgagtgttctaagaaaagagaattgctaactgcttgtataaatgtgctgatgtagtagtgtgtggccagagcagatcacgtggggactttgaggattgtaagagcattgttttttgttctgagtgagataagaatctgttgctggttttgaatactaaagtaatatgatctaccttacatttaaaggaggcacactggttgctgtgttgagactaggctgagtagaatcaggaaaactagttagtaaagaacttaagtacatgaaggttcattaaatgctcagcctactcaataatttagaagaaaagacacaacccaatccatgactattagccatatgaaataaaatataaatatcagagcagatataagcaaaactttgaccaaaaagaaaacacaaaaaatcaagaaacagaaaatttgcttttttggaaaaaacatgatatgaccataaaaacagacacgtacaccaatgaaacagaagagaaaactccaaaataaatccacactcttacagccaatcatttttgaccaagatgtgaagaacatacactggggaaaggacaatttttaatgtatgatgataagaaactggatatccatattcagaaaaataaaaatagattcccatctttttctatgtacaaaaatccactcaaaatggattaaaagcttaaacataagacataaaactgtaaaactactagtagaaaatattgggaagagacttcaggacattggtgtgagcaaagattttgtaagactccaaagaaatataaattttccaatgaaagcaaaaataggcaaatgggattacattaggcagaaaagcttttacacagcaaatgaaacaattgtcaaagagacaacctatagaataagagaaaatatttgcaaactatccaatcaacaagagattaataaccagaatatataaggaactcaacagataaaaaccaaataatccaatttaaaaatgggccaaggatctgaatagacaattctcaaaagaagatatacaaagagtcaataggcatatgaaaaaatgctcgacatcactaatcatcaaggcaatgaaaatcaaaatcacaatgaaatattatctcatcccaactgtaattgctattgtcaaaaaacaaacaaacaaaaaataacaaatgctgtaaggatatggagaaggaggaacatttatacattcttggggggaatgtaaaatagtacagccattatggaaaacagtatggaggttcctcaaaaaactaaaaatagaactataacatgattcagtaatcccactgctaggtatacatccaaaagaaagaaaatcaatatattgaagagttatctgcatgcctatgtttatcacagcactattcacagtagtcaagatatggaatcaaccaaaatgtttatcaacagatgagtggataaagcaaatacagtatatatatacaatcaaatattatttagccataaaaagaacaaaatcctgtcatttgcagaaacatggaagaaactgaaggttattatgtaaagtggaataagccaggcaaagaagaaatatcacatattctcattcatatgtgggagctaaaaaatggatctcatggaggtagagagtagaatggtgcttaccagaggctgagaggggaagaaagatggggataatgataaaatggttaatggatacaaaaatacagatagagaaaataaataagttatagtattcaacagtacggtagggaatttatagttaaaaataatgtgttgtatatttcaaaacagctagataagaagaattgtaatggtcccaatacaaagaaaaatattggagttgatggatattccaattatgctgatttatcagtacacattatatatatatgaatccaaatatcacatatatcccaaaaatatgtacaactaggttatatcaatagtgtatgtgtatacacacacacacacacacacacacacaaacaaaaaaagaattaaaaaatgaatgccaaaaatttccctgaatctgacttcttggtagcaatatacgtatttaaaatgcaaatagtacaatcaagtatgaagcaaaacagtatctgattatgtcgagcattctcaaaacagagaactggctgtgattggtcttctaaaaagtgaaaaatatgttaataaatttggatgataattacaattattgaataaaaattacattttaaggctatattgttccactttactttgaatgctctctaacatactcctgttaatgtctatttaattatgtcacctttaggaaaagttttaaaaacagaaaacttctaaagaaatacgttaatatagctaatacaaacattttatgtaacatatgttagtatagtaccacatactaattaatgtccaatacaaaacagtttatctaaataaccttcttagaataaatgctgaaaggtttatttaactgattttttttcctatgcagatagcattattttaaaatcacaaactaagggtgtcaataaacaattggttcgcttaacttacttattcttgaaccaagttatttttggtagatgctctaaatttcaatttacagcattaccttatccagttacctgtatatacatcttcaattagtttcaactagaaattgcattatgaaaaactgtagtgtaaggtgtttactgatagttttatagctgggacaggtatttactcatggttgatttagctttttatttatttttttacactaaaattattacagcagccataatctcaattacccatttgtctgtgtgaatgagttgagttaaaattaccatgtgatgagaatttctggttttgcatgctcagtttactcccaagaaaagatgggttgggtttttaattaggtttgcctcctaagaggcagtgtaacagaggaaactccatctgctggtggctggtagacgtagattaaaattaaacctccattattgtgtctttgtggaaattacttaacttttcaaagtttcagggaatttatctgtacagtgggaaaagtagtcaaacctacctcaaaggtcctctgtgataggttaaggagactacacccattaaatgcacaaaaatctaaccaatatgaagcgtgtcataaatgttggctacctgttgtgatggttacaagaactcttcagatttcatgattataaaccctacttaggcttttgttgaggtaaatggcttatatttatctagcatcatagagagttccaccccaagtgcttatcaatatttttacacaagcttagctaaattaatcaataggcattgcagctggctggagggataaaaatacaggcatacagttcctactgttctgaacttctttcctccattaatacagacccacagggactctacccagaccatatcctaagtagtgctctagatgccatggagcattttgttcattacattacatggtaacctctctgtggtatcccacaagataaaaatattttcctctaatctggaattagactttgaaagagttcttttgtcccagaagagatatggttttgttaattttgtaactgagtctgttctttttgtttagcttgtttgcttctttcactttggccctaacaaggtgacagtcaagtttgtgactactctatatggactatacaggcctttgcagcatctctgtaattacttactcttactctgatcctttctttaacttctttctcatctgtttgctttatttttctacactcatttttaatgtattttacctttttttctgtgtgaatcattgtaaactacttctgtttttctttggaataaggtagaaaattaaaacaaaattaaatttagcctttaatatttattagacatatatggaagcatctaaaatataatttatgactttctgatacaaacggaattctcttgcataaacattttgtggagtttatgtctcacattaaaaaacagcagtacagactgcggtaaattgtgaataaattgaagaaagtatagaaaagaataataaataggattaagagaacagaggaattgactcttgatgattaaagtggcctctaaaggaagtgatatatctaccttgtaccatgagttggggtgaattacaaaaataacaagctgttcaatttgacaaaacttctaggttataaaaaaaaaaagaggaggaagagaggaaataattttaaaagaaataaatgtccactatgtattttagagatctccataaagcaactgtgattcaaatgttttgataaaataatatataatgatgtccttatttttacactacaactattttctagttattttctacttggtacaagcaaaagatcttaaaaataaactgaactgaatgatatttgaggggagaaaaacagattataatacaagttaagattaaccgctcaatctttctttgcttttcttcctaatttctagatcttaaaataaaaacataaataaagttgtctggaaatgtttttttccttagtgttttataagtgaatttcacttttgaacatgaataaccccttaccttcaaatctcaggaaaaaatatacctgtatcaattattttttctccatcataagttgataagaacattttaaacactttaaaattttgaagcacaattcaaagattcagttaatatacgggtaccttcattacgatgattcattgtgcattaattaattttatttctttaatgtatctttcgatcatgctattttcttaaacaaaatagtttccccaaaattttgtttgtattattttcatagtgcaaataaaggcaacataaacatatttatctttgatttaaaactaaacacatagtgtttttaattgatcttccaataaaatatatttttaatctgggaagatctcatttatctctttttgaaaacaacaatagctcaaagattttaaacttttttcacctaaaagcaaaatgaaaatgtcctcaatgttcatttatttgtttgtttgttttggctttccattgtctccaaaagtttgaatactaaaaaagtaaaaaagataaaaagtagaaagaatattgattctgacaaaatacaccacctaaatgtagcagccctgcctcattctttagtttttaatctttttttttctatgttgctgagaaggcatggagaaagtgtgcaaatatgatttcttttttttatattacatctctcagatggcaagtgttaactaagaaagttgatttattttgtatatgtatatatattttttccaaacagaagctgttataatagactataagcattcagaaatgtgttaatgaatgaatgaatgacgaccattaaaataagaaacatatctatctgaagcaaacatgtcagcatacaggaccctttacggaatcaatatgcaatggaatcttaagaaaaaaagtaaaacctacttgataagtgatttgcttttggttaactttgcttatagaaaaatatgtacaaattggccggacgcggtggctcatgcctgtaatcccagcactttgggaggctgaggcaggcggatcacaaggtcaggagatctagaccattgtggctaacacggtgaaacctcgtctctactaaaaatataaaaaattagccgggcatggtggcgggcacctgtagtcccagcaattcaggaggctgaggcagaatgacatgaacccgggagacggagcttgcagtgagccgagatcgcgccactgcactccagcctgtgcgacagaggaaggctccgtctcaaaaaaaaaaaaaaaaaaaaaaagaaagaaagaaaaatttgtacaaatttggaaaatccaagtcatacaaaataaaaaaaagcttaccttaatatacgtgaaatatattatcagagacaaaacactaattattgtgactttgagccatgtgacagatgattaatccttaaagtaaacaatttactcatattgggctaagataacattcctccaaataataactaagaatccacgtaaaataaaaccttttaactctcaaaaatagaacagaactgaaaatcatggagcaccttagtttataatcatctttgttccatgtgattatttcaatactaaagttttggaaacaattaaaaatcctgccatatttaactaaaaacagaattttaaatctgtgctttttctacatttcaaagagttaagcattaaagatgctactgcaatgtgcacaaggattattataaaatagtagcttttaattgtataattgcatattggggtatcttcagttctgtaaagaactatgatttctttaatcataattaacctaatgagttaaagacaagtcattcttcttgtaaacagaggttacttctctactaaataatgctccaaatgaatatttcaaaaagtagcaaataaattttctttctgtcaaaacaatgaatttccaaggctttgaataaagcttagtcacacttaacctttttttaaagaatagtaaattataccttgaataataaatggtaggatttattattatatttctggtttgtattttatttttatgattgcttttagtttattttatagctattacattcctattacagaaacattattttcaaaaattgtactattaaaatgggtgtgctgcattatctgataaaaattaaatcattcatggcaattctctgttgataatatcttcaactccaactatatctttatgctaagtatgctgagagaaaattggcatgtaatagacaatacagcaatttaattgtagaatatggcagctagggagaagactacataacaaaagaaactcttaaggtatctagtggctaccatattgaacagatgggtctaactaaggactttccatctcacacagaataaaacttgaaatcgtccaagtgatctatcaggtcctagaactgattttctaccatgatatctatattttaataagccaagcatggctctttctctgggttttcataactgcagttctctatcaggaattgtgcctcttcctctctcatagtcaaacgactttttccatcacttaatatagatgtcttctcagatttcaacttatcagaaaggctttctttaaccatcctatttaaaacagcacctctcttccaaaattttctacttgatacttgtatttatctgtctttattacagttatcactacataacttaatattacatatttattaatattgttattttatatgccatttttatgcaatcgaatagaagctccatggcagcagggacttcacactgttcactgataatctccagtgcttacaatctgtaactatttattttttaactaataaatccccagctctaagatacaaatgcaaaaactcaaagagtttgatagactggcccaagacttcctagctagtctttggtggtctgggaaatgagcctaggttctctgaaacaaaaaggagctcaaactttccccttaaaaccaagtttttattacattgatttaagaaaatgtgctagcagttagcgtttcataggtatgcttcccgagagaccttctaattatcctcctagaaatatatatatatatatatatatatatatatatatatatatatatatatatatttacacacacacatatatacatatatactatacaaataaataaattctatatacgtaatatatatcctggctacatttctaatgtaggttttgtaaccttaattctaggaactatagattgattacacagcacatttcaggtgctacataaatatttcataaagttgaggctcttcctcatcaagtcagtaactacttcagtaaagctctactataattgaattttcatattttattcagaaggtaagagatgggtttgagcaactctgagaaataagttgtcagttccgattcatacaaaaatactctaactcagtgtttctaaactcgagtttataattttcaaaatatctcttttatagatgcttaaggatttaaattttagaaccacagattcctcttatttgagtttcatggtgaactgggagtagaaagaagttataaaatgcaaacatttcatagtttcttctttagacaattatttgccaattatttgtccattgtagttacgtgtccctactgttattctcacagctgtttctcctataccttaatttaaaaaaaagtaatttaaaaaaccacaagccttacaaagaggtgaattctaagatcaacttaaaatacgtcagagcacagatattcaagggtatctgtagtggatgcagatcctcactggaatttgttgaatatattaatctaattaaaaaggtatatgtttccttacttaggggaattggtcaattttataagcttaaaatctaaaaagtagtaaaaaattttcagtatagtcatttcagctgattcagtgaggtgaggagtaatcattacagcagctaagatttattacaagcattccattttccaggtactgcggtcttagctatcaaagtgtactgatctttgtaaaatctgctccattgtaaaatggatatgtcaggtcattatttttcctttcatcaagtgtcctcatttgtactgattacatacttaccaaggaaactttatatttttgcctaaaatattggtctaccaaaaaaaaaaatgatcacatgacattccagttttccacttcatcggatagggatgtctcaagggaaatatagaaatggctttgatgataactaacttgtcacctaagaatgtcacagggaattaatgtgtttactggtctcgtcactagaacaataaattcttctatttaattaactatttggcaccccgatggctacctgagttatgtgtgtattttcatcactcatcccagacatggatagggggagcactggggcttcacagtgctgactcaggtcttacagttcttatcactaccacttccatctactaatgtaggtttcaaaaagagatcagaaatatttctgcttaagaaaactctaaatttacataggttttaaaaaaaatctacaaaatgaaatcagacatggaagggacaatttcttaaacaactagtattgaaaaaatggaatatccatatgtaaaaaaaaaaaggctggacccttatcttacaccatatacaaaaattaactcaaaatggattaaagatctaaatataagacctccaaaccataaaatgcctagaataaaacgtatgagaggtgttttgtaacactggatttgacaacgatttattgaatatgacaccaatagcacaggaaacaaaagcaaaaatagacagatggactacctctgactttaaaactttttgcccaattagtgacacaatcatcagggtgaaaaggcaacctatggaataggagaaaatatttgcaaatcttacatctgataagggattagtatctaatatctaaacaactcctacaactaaacaactaaaataaatcaagtaacccaattaaaaatgtgcaaaggacttgaatagacatgttttaaaagatgatatacaatggccaatagcacctgaaaagatgctcatcatcaataaccatcagagaaatcaaatcaaatgacaatgatatatcatctcacacattagtatggctactacgtataaaaaaggaaaaagaaccagaaaataaaaagtgttgataggaggttgagaagttggaaagcttatgcactggtggtgaaattgtaaaatggtgcaactgctatagaaaacaattttctttaaattagaactaccatatgatttagcaatcccacttctgagaatgcactcaaaagaatgaaagcaggatataaaagatatattttaatatttatgttcatagcagtattattcacaatatccaagagggggaaacaacccaaatgtctattgagaggtgaacagatgaacagaatgtggtatgtattgagaactattcagctctataaaggaatgaaattctatcacatgctaagctgtaacatggatgaatcatgggaatatcatgctaagtgaaataatccaatcacaaaatgagaaatactgcaaatttccacttttatgatgtatttaaagtagtaaaatttatacatgtaggaagacaaaaggttgttacccagagtctaggggtaaggctggaatggaaacttgtttaatgggtaccaaatttcagttgtgcaaaatgaagaagttctgaaaatctattttgaaacaatgtcaatatacttaaaactaccaaactgtacacttaaaaatgtttaagatggtaatgtttatactatgttttttaatcacaacaaaaggaatggggcatgtatgtgctgcttaataaactcgcagatttatatttaattcttttaaaatcaacatgagatagaggtctttattccaattttcatgaagaataaaagtggctctaggtgctaagtagcttgtccagaggttacagagctgtaataggatctaaatctctgtgtctgaaaccataatctgcattccattaccaaatgcttaataaataaaatgtacaaaactcctagccactctccacctaagtctactgactttgagctgctagctccatttatatggaatatttaccattcaccgaatagtcatactttctattgtcctagatacattatataattcagttttcaaaataattctatatgttttattagctcttaacagtgaaactgaggttgaaaagattaaattatttgcccaatttcatgttttaaatccaaagttttatgaagtcagagcttccttcacaatgatacgattctctcaagacctgaaagttacctgatttttcctatttatatcatcctatctacttaagaagcattaaaatcttataaattcctgcaaaactatacttttgctattttctttttcagtttgataaattttgtctcaaaataaagaaaatggcatcatgatttgcttgtaaaacatcctttcaataaaatgtatcaagtgtctactatataactggagttatagaaataaaacacaagtctcatacattcgtagagataatattctagtggaaattgactataataataacattagataatgctttgtagaaaaataaactagaataaagggttaaaatttgaagctgggtatcatttcttacataatagacaacggaatcagagaaagcctgtctcaataggcttttattaaagcagctaaaagttaggcacaattctaattatttttaaagtataatcagctattattttgaaaaggctcagtgtatataaactacttctgcagaaataaacaagacactgtacaattgatattccatgcataaatgttgataaccatcaccctcataaaacaatttacatgacaccaaaaggttaaatttgtgaactatcctgaaataattgttatgaatcatatatgcttttcttatgggaaaatcacatatgctttaatccgtgcctactgtattttatttggcatataattactaaaagtttagttatctgactctttaaagcttcttctggcaagctgaagtgatgatattttgctaaagaggcaaattgacagtgacgataattgacctctgtcaaactgaaatcaacagaagacacagaagaacaacctaatgcaggcagagcttaaaacctagacaacgggttgataggtgcagcaaaccaccatggcacatgtatacctatgtaacaagcatgcatgttctgcacatgtatcccggaacttaaaagttaaaaaaaaaggtgatatgtatatatatatatatatgtatgtgtgtgtgtgtaatgaaatagtattcagccataaaaaggaacaaaataatggcatttgccattattggagaccattactctaagtgaagtaactcaggaatgaaaaaacaaacatcatatgttttcactcataagtggaaactaagctatgaggactcaaatgcataaagatgatacaatggagtttggggactcaggggaaagggtgggatggaggtgagggataaagactgtacgttgggtacagtgtacactgcttgtgtgcaccaaaatctcagaattcaccattaaagaattattcatgtaaccaaaaaaagaaaaaaaaatttaaaataatggcagctaaattagggtaattaagggtaaaatagtaaagatattttaaacatcttttacagtatcaaaatataagaactgcagtttaataaataatcacaactagattggagttaactataacatactcagccatggtgagtctacactgttaaggaggcagagggacatgccacatattttacaataatttaaaacatatatattgcttaatattagtcaacttggttttaaaagactaagctctaggcatttagacacattgctttgagaaatgacatatttcctggactggccagactgctttttgagtaaattggagccacaaaatcaaggtatatattcaatccatgaatgttatgatttctcatatgcagcattttgaggttctgatacatcaaagcattctgaataataaaatctcacatctaatttttatccttatttgaagacactctcaaaatcttcacatatttccaattagactttgagaaaacagtaagctaaattattattaaaacactcttaaactatatgtttaatctgaacattgtaatgattaaaatgacccactcagattaaaattgtggttgttcaaatactgcatgttattatttataaatgagagtcaacaatgggtacatgcagacataaagaaagaaaataatagacactgagggctccaaaaggagggaggatgggaggggcatgagggctgacaaattagctattggctacagtgctcactatttgggtggttggcacactcgaagcctaaacctcaccaatatgcaatatatccatgtaacacacctgcacatgtatcccctgaatctaaaataaaatttaaaaaatacagttaaaaatcatggtcatataaaaataaatatataaggagacaaaatcaattactctgtaagatcttctatctttttttccactagagtaggaggcacattggaaacaatgacttgcatatccagctgattgaccacggagacctgaaagaagaaaaaacagaattcatttaatttttactcactgaaatttccataatcagaaaacccccacattacctcttccctactatgcatagacacagtggtttctgattttcaaattcaggaacaaatatatatacatttttaattatatgatctacacaaggggttggagactaactggggcagactgagcatgagaaactatttgttgtttacctagaaattaagaatcctgagtgatttcaattgtttttggttatgtgtttgttttattggttatttactgagacatgaagggtggcatttttttttaatttgattgttaaggaacacccaagataatgaaaaatacgttttatattttacaagtcttgagaaatcatttattcattataactaagaatctgagatatgactggttagaataattcattctatgaggtcatcacatatagttttcttgtctatttaaccaactttaaatttgtgtaggtagaggtatatatttagaactttacatatgggttaaatgagctaatttaatggctgttgataactatgtatcattcatttaaaatctactgaatttcttctatgttcttatatttgaaaaatagaagaaaaataaaaatatttattctgtgcttacaacatggcatttcatcttttcctcaatattctacaggtttaactcattgaaatctatcaacagaatcaggttgttattaatatcatttcgattttaaaacaaaaaaaataaattgaggatatatttaataacttaatcctaattaaatgcagtctgccttacaccagagcttgtgctctttactattatccaatactgatataaaaattctaaaaagccatatattatcatgcacatacatttatacactattaaaatataaatgcatttgtaccagaatcataaattgaacactctgagttaggcatatttagcaccgtatctcaatacaatctacagtagggagtaatttcacattgccacacatgtttttataggctccagattctttacatatagagaccccattaggggtcacaaactcaaatgccttcaggaaccaggcaggtaacttaaatgagaaaagtagccaaaagtatgaaatgatagaaagaagtgtaagtaacaaatccaagagcacataactctgctgaagaggtcagctactactcacctctaaggaatattgcagtgtgggaaacaaaatccagatttcctagatatttcagtttttcaggaaaaaaagaaatccaaaatattttgtaaaatgtttgcaactagttagaaatctatcaaaccattgtgtgagcatgatcaatcatgtctgaagactgtattaagacaggagtaggtctgattattacttctgagcaagcagtttatgctggcagttctaaccttgtacccctaacccgtcataggtgtctgggaccaaatgactaaatttcccttcaacatgtaaatgagtcttgattatctttttacaaaacactagctacttcactagcgaactagcgaaagggatcattacagtttttgtatcactttgtcttttcttattggtcttgagttaaagaggatatagaagttgaatagaaatattttttgttttattgtttttgagtttttagcagtaaaattacatgataaaaatttctagaagtatgtatatgaaacttgcataactgttccctccctccctcccctccttccttccttctttcttccttccctctcctcctttttttctttcttttaacattgggccagaaacggttaaaaaaaagttttgataaaaatcaaaccacccggaacaagtagtaactatagggtgttatcccaacgagaagtataatcactaggcctcattctctgttccctgaagctcccatcatctcctctaactgctggactcagaagtactggagtcctggcctcaggacagaggagcttttgcagtgggactagtgctgaagcacttcctaattccaccatctgttgggagaaagctcctggaccatgatgtgggttatggatagggtgagtagtagggaacattagcaggatactggaaaagagaagaaaatgagtaggagaaataactctttattactggttctttcagtggagaattgttaggactgtctgccctgtcaaactgtcctcttctcacatgtctgtctcctggtctggtaagcatgtgcttcaacccaccttttctggctgacagactgttacagatccgtactattagtatcccttgaattttccactgtctcttatttccctacattcatcctgcccaggccttcaaaaatagacccttcattaaactgtcttcaaattatctgactcttgcagcggagacttaaaattaaaaaaaaaaatgtttcacatgtgcatgaattttctgccaggtccttactgatatagatccgaaaaaccatacaatcaggtgtcaggctgtatataccagaaatcggtcacactttacaaatatgatatatgatgtgaacaaaaacaaaagtgggaaaggaactaagtagtaactagtggaggatagattcagcagcctcagaggaagaccaaacataagccttcctatcttagggtagaaacaggatttaatcaaggaaatctcctgctcccgggatggggatctacattatatatacccaacaggatttcagaattggcctggacaattccatatgtctaccattactgtcctcttcaaataggaatttctagtggatattctgtatttttccatcatctatactgggtgaatgtgtttgctggatcactaaaacatcagaagttccctctagacctgataaaaagaacagcatgacatctgagatccaggtgttaactttgataagactttgttctatttgtgtggaaaataatgaaataaatatttggtaatcagaagtatagactggttagctgttcatccagctctttctgtcttcccactgggaacacacagtcgatttctcagccttctttgtagtttagtggagccatatgatggagttctgaccaacgtaaacttagtggaagggaaggaatgaatgttcttaaatttgaaggatagtcactgctttctcttcatcagaaagataggttacttattcaaaatactttaagccaggcgtagtgcctcacacctgtaatcacagcattttgggagactgaggcaggctgatcaattgaggccaagagtttgagagcagcctggccaacatggtgaaaccctgtctctactaaaaatacaaaaaatagccaggcatggtggtgcatgcctgtaattccagctactctggaggttgaggcacgagaattgcttgaacctgggaggcagaggttgcagagagtcaatatcacgccactgcactccagtctgggcgagagactctgtctcaaaaaaaaaaaaaaaaaaaaaagtgagattttgtgcaaaattctgactgaaatagtaggagctaacatttaaggtatctagaatatatccattttaaggttacattttattaacaagattttatgatgttaatacattttgaaaatatacttttatattttattttaaggatataaaaataaaaaacatttaattctgataaattaacagaagtcgcactaccgggagtagttgtcccacacttacctctaaatcattactttaaaatttttaaatctcctgaatgtgctaatgtctggtttatgtagaacacacacattttgactatgcaaatgaagaaataagatattacagtttacatttggtctttgacagaaattctacatcctaactctggtttgttttatcatctataacaaggatatttagctgtttaagattagtagattttatttatgctacttttccagtatagcttctgcaaatatgcaaatatttccagaaatttgcatgtcagtttattacaccaaatatttaataattctctgtgaaattatttaattctgtagcttaataactaatgaaagctttataaatatgtttccatcatcattgagattgatatttgtaatggattcaaattactaggtattgttaaaaagaagagaaataacatttgtgaagcacaaaattaaaaaagcaatggttggaaatttacatgttactatttctatgtcctttccatttattctcataagtttcttttctttcttcctctatactctcataaattttaaatagtgctgtccaatagaaatacaatgtgagccacgaatacaaatcacatatgtaattttaaattttctggcacccacattagaaagataaaaataataagattaattcaataacacatttaacccaatatgtttaatatatgtttagtaaaatatcattttaacatgtaaagaacattttacatatttttatcaaagtctttgaaatctggtgtgtattttatacttatagtacatctccgtgtgacctagccatgttgcaaatattcaatagctacatttggctgatagctagcatattggacaacccaactttagagatattcatcatctcctgcttgaactgtctttcctaactaactaactggtctctgctgcaaactcacattttattaaataaaagaggtgttttaatagtccatttagataattatgtattttcttttttaaatactataccaaaatttagtttccacatgaaatctgaaaccatgttcagttatactacaatctatttgtctgtcttgtactttttttttcttttttgcgatggagttttgctcttgttgcccaggctagaatgcaaatggcgtgatctcagctcacagaaacctctgcctcctgggttcaagcaattctcctgcctcattctcccgagtatctgggattacaggtgcccatcaccacacctggctaattttgaatttttaatagagacgaggtttcaccatgttggccaggctggtcttgaactggtgacttcaggtgatttgcctgcctgagcctcccaaagtgctgggattacaggctgagccaacacacccggccattgtactttgaattgattttttacacgtgcataattttttaacatcctgcattggccacttggaaaatacaagtttactgaacactgcagatattgtaaatatcaacacacttcattacacaatatcaataaataaatcacattatttaatacaaccactgactcatcaagaaagtctaaatattcggaagctagtcaagtttacagtgacaggtacatttttttaatattctaatttgtgcttcaaagcttcagtattatcattagttggttgttttcaatgaaatgacaggctcccttcatccattttgtgtaaatgcctaccaaatatttaagtttgaataaccatattttgtctctaagttgctctttcatataaaaatgttagtccataaaaaaagcagcttgttcagcttgcatagtgcttttccttgaggcaaccatcttccacatacagcagatgtactctatgcatacttctcatttcatcaacaaaataatgaaaaggtgtttaggacactttcgttgataggttagctagctgcctagatagatatacagtatttactaagggaatgaatgtgaggtttaggagagaaaggagtcaagaaattttttgcctaaggaactcaaagtgatttggtcatcaaataaaatgaggaagactacaggtggaagaaatgtgatgaagaagagaaatccattaggaaacactaaataaacaccttttaaaaatattcgggtggaattgctacatgtacagataaatatgcaaatctggtgttcaggaatgatctttagtgtaaagatgtaagtatgagcgcttttactatgtagatgatattttaaagttatgggactaagtgagcttaacaagtcagtgagtgcagatagaaaagagatttaatgtctgagccctgagaaacctcaatactacaaggtcaggagaagaaaatgaaccagtgaaggagactgagaaggagtaaacagtgagatagtaggacaagggagtatggtgggtggtctgaaagcatagtgagggtaatagtcaagcattgctgatggttcaagtaagataaggactggcatcatcagtacatttcctaacatggaagtcattggtagcatcgacaagaatagtttggaagagtgtttggagagaaaacactcttatgattagagggtttaagagagggtttaagagagggttcaatagtgagaaataagtcaaatctaacatagaattttgctaaaaagaagaatagaaaaatggatggcagctagaaggtgatatagatcaagggatgttttataatttttggaagatagaaaaaaagcattgttgtgagaataatctgatataaggaggaaatttatattaataatgtagaaaagaaatgggagagctgctgaggcaatctcctagagctggcgagtgggaattgaatctactgcataagtagaggtacaggctttagataaaaacagaattcatctaaaggagccagaaagaaggcaaagaatgttggtctagatcctggagggtaggtaaatttagtggcaggagtcatagaagtgtccttctaaatgctttagtattatttttctgtgaaatagcatgccagttaatcaggccatagtgagaatgaggacaaggtattggagattcaggagcagagaagattttctaggacatcgaggcaaaatagagtgattactgaccaaagcaaaagctcatttggagggtttgttttagtcattaatttaaattgatactgatgcaggagaacagggtctggaggcagggaacctaaggccaatttgtgctgacttcctaaagctaaatcaaagggaaaacaccaaggtctggggtcagggaatctaaggccaattcatgatagttttctaatggtggattaaacaggaaactcctgggtctgggggcagggaacataaaccaattaatgccaacttcctaaagctaaacaaacaaacaaacaaaaataccatctccccacaccccacctgagtaacaaaggatcaaaggctactctccctaaaaccttcccccttcccccatgtctcagatggaaagggaaagtgccttggagtggctgtgggccaagcaggggccatcctttcatttgcttagggcatcaatccactcaggccttgggtcaattcagctcagcctttagcctcaggccaaatccttcatccagataaggggtagcccacagggacctcaaaaggagtattaaaacccagaaaactttgtaaccaggcccttgagtcacttgcttgagtccactcccaacttgtggagagctttcttgctttaataaatccctgctttccgaggttgcagtgttgcagtgagccaggatcgcaccactgcactccagcctgggagtcagagggagagtccgtctcaaaaataataataataaaataataaataaataaataaataaatgcccactttccttgctttgttcctttgtttcgttcctgtgttaatttgtgtgttttgttcaattctttgttcaaaacaccaacgacatggacaattcacactcaaagccgtcatgtaacaatactatagctaggcatggtggtgagtgcttgcagtcctaggtgctagggtggctgaggtgggaggattgcttgagcccaggattttgaggttgcaataagctttgattacaccactgcactttgacctgggtgatagaaccagaccttgtttcttagcaacaacaacaacgatactaattatagaattttgtatgtttttgcagacataatcagcatggatataggtctggagaaaggagacagttggaattaaccaaagtggaggttttgctaagtgaatatgacatagagaaagaaagcaagaaagttaaattttatatgatgtactgcttattataattggtaatgcattataaatccagtaaacaagaaagagaacatgagaggttctcatgagagaacacaatggaagttaaaattattcggctaattggactggacatcctggtaggaacaaaagaatgatgggtttagctgcaatgttaattaaatgttatggacaaagagtgggaggtttgaaatggaggttataaaggtaatggcaaggtaagccaagaacagaaagttaaacaccacatgttcttattcatatgtggaatctaataaaaagtgtttaccgatcttaatttgatcaaaaatttatgtcaaacttaatatctcctatgtcaaaagcttcttggcttagagtggccttcatttactctattgcagctttactgttaaaaatgagaatgctcctggaggactgttttggccacaatcatggtgattgttcttcaccattatctaagaagaaaaataaagcattgatgtctgcatgtatatgaaggttacgcttgtccagggaactaaatgagaagaactgcgaaaaaatgaaaatttatgatgtaaagaacaaaagacaacttattcttgatctgtttttatgtgacaaatatttctaatgaatatactttgtattagattcatcagacaaaactccaaataacccatgctttcaagttggtaaagagtccacaggatatatgcactggtgttaaatattttcaatacaagctaatatcaaacttccctttcaaatgatctatcactaaacttctgcactgcctaagtgaaaattagaacagtgatattattgactatagccaaatataacttagtcaaggctaaacaatgtcatcattgggaattttgatagaacaaagaaataaatactattggaacaaaatttgtccccaaacattttctttgttttctcaattacaaaatgctgaaagtaatttaaacaaataatttcatagtttaatttctatagtataactctgtgaagcatttaaaatttttatgtagcactggacaccctatattaaacatgagctttgaagacaaaatagaaatccagtgcttatacctttgctgttacaatcatattttttcaaatattataatgtttttctcaaaggtcaagaaaaataaacaccttacggtgtttttgtaaatatatatatatatatatatatgaacaatatatttacatattcctaaactatagtgactaacaatctgagtgaaaataataattatgtttttgaaaacccgttttaaattaatcttagaagttctataaactgaaaacactgacctatggctagtatcgtagctacttccctttcctgaagttttatctacttacgagtacatcggctttgccgctcagtcccttcccatagtcgtcagttgcaataacttgaaacttgaagtaggatctcctcatattatggaagagcatagcagttttgataagccctgtatatgtttccactacaaatccttcttttccctctttaattggtggtattatgagtctgtaggccatgacactataattgccagtatctttatcagtagcctagacggaggggaaaaaaaaagagattataattaagcaggaaaagataacccttatgaaatggcttacttttgtttgtaagaatgaggtttcttatgtaataataacacaataaagccctcctaaatgtctgttttttctggatatagttatgtagattaatagactttgtgtccacagtttcgaatggttgctattagaatgataataactgctgaagtatgaataaaagggacataggtataattctgtaccctttaacaaatttctccctacccctcctttccttttacccttaccagcctccagtatcttgtattctacactttatttttatgagatcaccttttttttagattccacatatgaataagaacatgtatgtggcatttaactttctgttcctggcttatttcatgtaacataatgtcctagatagggagaatatgttctagtgctctataccactgtagaataactacagttaacaatagtatatagttccaaatagctagaagaaggatatcgaattttcccaacacaaagaagtgataactgtttgagatgacagatatgctaattaccctgatttgattgctatgcattatacatatagaaacatctatgtacccaataagtaagtactattattatttgtcaattttaaaaatagattttaaaaaataaacagacatagacactaacagagtcaatgaatcaagacttttggtttacaggtttgttgagttcaactgtgtgtgctgatccaaattggttgaaagatgggattggttgtttacctaatgtttgtcttgctgtaataggcatacagtgtgatggtatttttgatgtagtatatagcctaaggaggataaatataaaagaacgtagtaaaatatctcgaatgaaataaaataaagttgagttataacaaatttagagatgcataaaaatattctaattaattaatgccataacataattctctaattagagttagaatactatccgacttcctttttaatcatcctgtatcccgattaaacatatttgttcctggtgataggtacttatgatccacatattaaagtttcctaccatttagaattaaaaaggactaacacattgtttagatttttttcatttgtttttaaatacagctatgagaatcatatattgggctggctttatggtgtctaattaggggtaattttttagaatgtctatttcagaaccatttcatagtgaaatacttggaaaataaatggtagataggagagttttagaggcttgataaaagactatatataccttattcatgatactagatatgtaagttatacattttcatttgttataacaatgattattatttttattatccgattattcttatttttacctatgctattattattaagtatgagtatgcatttatgatctgccattactaagaattgctaagaatcatacaaaatacaaaatacaatcacacaaaataacatcatacaaaaatagtcttatctaataacaatataaaaaactgaggaatatattgttttacttatataaattagtgatattcaataaaattttctgaaatgatagaaatgttcttaaccagctctgtcttatgcagtaggtactagccaaatatgacaaatgaaaagtggttgatgtgacaaagaaactgaaatttcaattcaatctaattttaatttaagttacataatgaaagactacataataagtagtaaagttgagacacaaatgattaaaatagtaaatcatagcaaatgtgtattaaatacagcatcaacttgatttagcttcaaattctatatatattgtgaaccatttaaaacgtttccagataatcatatctacttgttagaaaaggtaatttaaactactcaacacagataatttcacttcaggatcagctgtttcatgaattttctagggagttaatattctcttttctttatttttttctctgtcacccaggctggagtgccatggcataaactcggctcactgaaccttagtctcccaggttcaagctagcctcacatgtcagcctctgagtagctgggactataggcactccactacgcctggctaattctttgtagacacagggtctcgctatgttgcctgggctggtctcgaactccttgactgaagcaatcctcccatcttggcctaccaaagtgctgggattacagacatgagccactgtgccaaacctaaaattatctttagaagaggacaagctcaaactaccggctaatcactttagatagtttatatggcttacagcatggcagagctcagttttggtattagagtaatagtaattagttatcaatgttaggtcacattctcacttaaaggaaaaagaaaatgaacaaagaaagaaaaacagtatcaaaattttttgtacttaaactttgaaccacaggtttataatcactcaacaaaggatagcataagatagaaaaaggcatattcccagctaaaataagtcaaagtctgagtcaaggtatccaagacatttcttccacatagaatgagcaaatttgggcctaatgtcagatcagtcagatttggttacatattattctctatcttcttattaacatggatatttctatgaaacaaactttttattattaatgtaaactttataaaggaataacaaacatgcaaaaagtgtacaaattataaatgtaaagctcattaaaattttgcaaaatacacacatctacatgaccagcatttacatcaagaaacaaaacaagccaggcatggtgactcatgcctgtaataccaacactttgggaggctaaggctggaggatcacctgagcccaggagcttgaaaccagcctgcacaatatagtgaaactcttatctcttgaaaaaaaaaaattacccatattccagaatgcacttcatgcacttggagtcacaatctgagaccttcttaaggaaaaccactttcctaatctaacattgttgattagttatgcctatttttaaaactttacattgactgaatcataaaatatgttctattttctgtctgacttctttcattcaattttgcactgtaagattctaagcccttatatttaaaataaatactgtataacaacactatcacatttggaaaagaaaaggtggttaccataaaatcaccacagtgattgcttggtatattaagctactttacacagttctgactgattaacttccaatttcagtaagcaggtaatttcactttgcaatattcctaatatattaaattatgataactacaaaatagtcatattccatcttaaaatattaaagtgttctgttaaatgtgcctttcctgaaacaaattatcacttaatgcaaaagtttgggtgtggaactagacaatttaactcagaaataactattttcttttatgatttttcatataaatgccttaatatttgcagaaaatagtcaagaatgagataaaagtttttttaaaaatcttgtctactggaattaaaaaaaataaaaccctattgtcatatgtatgttatacagtaaggactctaatttttatttctttgaatgaatatgatagtctttgggatcttagagatcttatttcaggagatattcatcaaagatgattgccaggatcattagcatatttttcaaatctcccctcttcctcaagtatgttcagttgaatactagtaatttaaacagtgactgatgaaaattccaatgggtgccatacttaagagcaattgcatggatttttaatttttagtctccccaatttataacaaatacatattttaaaatccgaaacctctcctctaagatgtgactctgattgatgtggagcatatgcaataccatcatacatagataacaaccaaatgttctttctataaaatcaataacaggatacgatatctttaaatacacactgagtcacaccagagataccaataataaaattcagagcgcagttttaaatctgggtcaatatgtgaaaaataagtgagagtttcagcacagagtatattgtctctatttgttgttaaataattttaaacttacttttttgcttgttttttgcattatgttttggagtgaggtggactccaatgtcaggtgtgactttgaaaaattaataactcaaggccgggcgcggtggctcacacctgtaatctcagcactttaggaggctgaggcgggcgggtcacaaggtcaggagatggagaccatcctggctaacgcagtgaaaccccgtctctactaaaaattaaaaaaaaaaaaaaattagctgggcgtcgtggcaggcacctgtagtcccagctactcgggaggctaaggcaggagaatggtatgaacccgggaggcggagcttgcagtgagccaagatcgcgccacagcactccagcctgggtgacagagcgagacgtcgtctcaaaaaaacaaaacaacaaaactaataactcaaaatttcagatttctttattcataagataaaaataaggatgcccaaaaatagtattttaaaattttatatatattcatacgtgtgtgtgtgtgtgtgtgtgtgtgtgtgtatatacacaaaaatataaatatgaccaagtccagtgtaactattatagttacctaagttgtcataatggtgattcaaaaggtttaacattttttcatattatgtttatccatgaatatgtaaatttatgcaatcaatttagacccttattacttcagacatattatcacacaattgtaactcccttataactctacttttcttaattttcttttccagctctcctttattgcttccagttcttgttttgttttgttttgttttgttttgttttgttttgttttgtttttgagatggagtttcactcttgttgcccaggctggagtgcaatggctcgatcttggctcaccgcaacctccacctccctggttcaagcaattctcctgccttagcctccccagcagctgggattacaggcactttgggaggctgaggcgggcggatcacctgaggtcacaagttcgagaccagcctgaccaatatggagaaaccccgtctctactaaaaatataaaattagccaggcatggcttccccctcatttttgaagcaattttgcaaaacctcttcctcagttgaaatccatgaacttttgtacagtacacactctacccctccttgttgccaaacataatgaggatgttggtatcttgctctcagtctaccccttctacttcaacttcctccctctttacaaatttcagtattcattgagatgacacatccagcaacttatttttaaagtattaggcatgaataacattcatcagtctttgaacgacctcactgcatcgatttaattctacagtcacactttagtcttttgccttagggagatattccgcttaaagaaacactccatatttaatttatatattaaactttcatgtctaaattctgaccacaactttaatcatcatacttagttaagacctcttctttgatatcagtgaattttcagttctgcaaactgccttttgctcccattacttcagggtttatgtccctttctgctttatcatagaagtcagagttgatcacattgttctcatttctctctccttccacaacacctggatctttctcctcttggaccaaactaaccatcagtttactcctggtgactgaagagggcgcagagaaattaaataatcagtcagactagtgttactgtaagtccatggtctctgagtttcactgtgcctttgtctatttaggaaatccttgctatatgtaataagttctctttctcactccagaagtttgcctttttctttagttcacagattctttcagtcttctccagagataaggaagctctaattcccataaaatttgaggatatcaaatgtgagatctctcagcttttcatcacataactaaaaaagtacctatatctgtacttactttgactactttcttcaaatctcagaggagcagctgacacgtatctctcactgaaggtacttatgccttaatctgaatcactcccatcccttctgcatttaatgcttcatcagctctattgatctctgtccttttcacctctcctctacagactataaaacacgttatgtctctctcattaaaatgaaatgaaacttttcttttactgagtccacactcgtgacactagcccccaaacttccatacctatttttcacagttaagttcctcagaaaatttttatagaatcaccatctgtaattccttactttacaatcatgccttaaccgcagccagatctctgcccctgccatgccatttaatttgctaacatcagtgactgaggctggactccatctcagatcaacaatcagtctggtgttctttaaattaccaagtccatttatgttgtttgtataatgctgttgctgcttccgctgtttgctaacatttattgaacacttacaatttgccagatgctatgtaaatacatatattattacattatctcatgacatcctttccattgagtagattccattattattttataggccaagaaatggaggcacagagagattagtaacttgttcataatcacacatatggttgttagcacagtgggataagtctcactttaaagccactacattccacatgtgagactaaataccagggataaaactgcagtttaaaaataaaacaacaaatgttcgataaaatattctaagaaatcttcctagatccatcaagaagatggaaagacaataaatatgccagtcaaaaacaaagtgctatggactgattatttctccccaaatttatatgttgaaacataatactcaatgtgatgtcatttgaaggatgggcctttgcaaagcagttaagttcatgatggcagagcccccatgaaacggattggttcctttttgaaaagaggccccagagacttcctttgttccgttttgccatgagaggacacactagaaacgcagccatccatgaaccaggacggcctcgctaggcacttaatctattagcaccttgatcttgggcttccctgcctccagaactatgaggaaaaataaatttgtcttgtatataagcttccaagtctatggtattctgctatagaagtctgaatgcaaaagtaaaggtaagaatataaaaaccatagtactgatgggagctttcatttagaatttttttgttttttttactgacctgggtaaaattaaaatttaacttgtctggttttcagtagctcagacaataggaggcaaggccccaagcctactcatgaaagtgagtctattaagatttccctccccagaaagttaaattctcaccgtaagagtaaaggagaaatttacttttccccctgctaccactgctactatcaccccaaactgcaacgaaaactgtaaacttaaactttgctattgaggggagtgaagagaaaacttctttgagaatctaggacgaaatacagcccctcattttagtttgcagccattatttgccggccaccagtttgcccaactcaaggagaaatcataatattccattggtaaagtctaataggcctgatctccacctgaatggacagaaaaaccacaacctgagaatttaagagaaatcatctatgactgaaaatggcctggtctcctgcctgacagaagcaggtgctttttcaaaaacccctcctgcaagccatgcctaaaataattctaacaaataaagttccaagaaagatgaaaagttataataattatcaaaacaaacaagaaacaatcataaaaaagtccgttgagataaaaaaatcaaattcataacaacatagactttaaatatttgaattagtagacactgaatataaagcaaatatggttaatacatttcaataataaagagctttaaaatgcggaataaaaaatgagactcgttgaaaagaaatgaaaaagtatcttttagaaataaaaaaaaattagaattaaataccccaagatgggattgttagcaggttaagcgcagctgaccagggaattagtaaatgaaatgatagggcaaaggaaatgacacagaatgtttcacagagctacgaagatgaacaacctcaaaaaaaaaaagtttgagatatggagtttagaatgaaaattttggcaaatatctaatcagagtttcagaaagagagaaagcgagaatagaacagaattttccagaactgataaaagattgttatccacagatattaagaagcccaataaactgcaaacaggataaataacaagtaactcacacctagaacccacatgtcatatagaaactacagaaccacgtactgtaaatataataagtattgttttcttaatattttgggaaaattcatagagatattttagtaatggcataaataattcataaatatattctataatttattaatagtaataaggagatgtctaacaagttgggttaaattaatgcataaaaattaaaactgactcactgtggaaacgctaaatgaatacaatttactaaagaattaatatgatattactttttccaccaatttctctataatcaaacatttatgctcagttcacaacaaagtcattaatatctgggagaggtgactctggaagatttgattcactgacttttatgagtttcccttagtgaacaaaataaaaaaaaaagttagtctagagttcttttaaaagaataaaagtcagaaatgaatattataattatacttgctataattatattttaagtgaaagcttagatacaggaaaccacttacccatttctaagacctcatctggaaattttaatggatacagatgtacaacattaaaagaaaatcaccaaataattgcctctatcatacaggggagtaggggagaccattaattttctaatagcctaaataactgttcccctctgttgcctaaatgaataccatggatgcagaaatattagtgaaataattagtgatgtcctaagaactttcaaacccattaaagttcagtaatgccaagtttaactttagcttctcaattagacccattttaacatttaacggtattgaaggctcacttaccctgaaatagagtgaaagtgttttagactgtctggataaaaatactcaaatctcacatttccacctaccaaggtcactatgtcaagtttgcaaaaagcaaaaataacagagctttggcaggttagaaccactttaacttgagtcttgtttttttttttgtttttttgttttttttttgacacagtcttgctctgtcaccaggatggagtgcagtggcatgatctcagctcactgcaacctccgcctcacgggttcaagcgattcccctgcctcagccacctgagtagctgggactacgggcacccaccaccagatccggctaattttttgtattttaggagagacgaagtttcgccatgttggccacgatggtcttgatctcctgacctcgtgatccacccggctcggcctcccaaagtgctgggattacaggcatgagccaccgcgcccggccaactcttgtatttttagaaaccagaaagaaatctttattttaaagtccttaaagacaatatacccagaacatgataaaatatgaataagaaaaatgtcaggtagattgatctacttttagggctattcaaaacttttgcaaaaaaaaaaaagaagaaacaaggagagaaagagaaaagaaacattttaaatatgcaagctcaagtgtttgattttgcataagaatgtcaaacagtgactacaatgcaatattaataatttctaagttcaacatacctatttactttttgtagagttaagtaaaagtctaatataattctgagagattctaaagagtaaaatacaactcattgtagaaacagcaatgtaataatggaaacacgccagtgcaacaataatagagacatgccatcatagtttgaattacaaagacctttacagggctgggtttcggttagaatttatcaaaatttactcttaatttaaatcatggtgcaaaaaattacaggataacatctatttagaaaattaaagaaagaaactaaagaaaagccaaatgttccttttattattttaaaaaattatatggtaaattctgaaccatagaaggcttgagagtacaaaacaagcaggacttgcatgtatgttataattgaagtttccttttttattttttcctttcttttaaaaatgttttgtaaaataaatattaccctataaatggttttgctttttccgtcattattgctaataataaaatgattatacctccctcagagatgctttaaaataaactctgagctaattgttctaacttttcaaccatgtgaaaaagaaaaaaattgtgctctattatatagacaagttaacaaaagaaaacacacatgtaatttatgctttttacttgagaggaaacactagtttaaatgttggtttggttttgaatcacaaaatgctattaatttttaccgaaaatatccactcttaaacagcttatcttttacaataattctgtagttatacatcctaaatccttcagcattcaaagcaaattaaataacatacttgttatttttgaacttcctgatttttccttagttacattaggttcaatcagtccaaaccaaattcagctgctgcttcttggctcccaccttgctgtccctcttctgactatcatatgtggttctccttctgttttttctttttgcataggaagggcaacaccatctatgaactgaactgttctaaaaaatttcagcatcctccccctcggtttaatctcacctcctggctcctccctacttccagtccatcagcaagcattctgatttctacctatacaatatttctcagttctgtataatactttaggccaagcttacactggccaatttcaggctctcatcagatctcacttttaactctagcgatagcttaaaaattactgatagctcccacttgccagagatgaatgttaaaacaagtcctttaaatattctcaatctgattaaagttcatgattccaactttttgctttacatttattctacttcccagaaccatattattttgtttttctgaagaatgtgttctttcaggtttctatttctttgtatacattgtttcttctaccttaaatgaaatgtcttttgtctgctaggccaaatgatgttcacttcttggctatactatggcacacacacacacacacacacacacacactttgaatatatatatatatatatatatatatattctacatatacatacagtaaactatggcatacacacacacactttgaatatatatatagactatatatattctatatatatagtctatatagtctatatataatagactatatatactcatataatatattctatatatagtctatatatatactatactatggcgtacacacacgttgaatatatatatatatctccatatatataaaatgtgtgtgtatgccatagtatagtatatatataaatatataatatattatatatatacgtgtgtgtgtgtatatatatatatataataaaacactgaataaagcaatcaaacctcagcttaaatgaccccttttctgaaggtgttcttatctctactagggagtgctgcttctacttacatattttcattgttatgttacataaatgtgtgtgtatatattagcatttattatgacacgttttaattttgtgtgtccattatacgtcaaatttgtttcagttcatatttttcactgtggtaccacgtgcagtcagtggtcaaataatatttggcttaaatgtctatagaagactatcatagtggttgagacatcaataattagaattgaaagatttgagtttagttctaccacttattagatacatgagcttgggcaagtgattctctaaggctttgctcctcatttgtaaaatgaggaaaataggacatgctgaataagttggctgtgaatattcactcgggtgtaaaatgcagtgcctggtacaaagtaaacctaaatcaaggttagctgttgttttactattgcatttactactgagatctttgaatactttgtagctatcttcctgatctcttctatttgttctttttttttttaaatcactttttgtacacttaaacgtacctttcactttctgcatcgtgtcactggctataaattctttggaagcaggaccattttctgaatcgtctttggatctcataagtctcatggccagtagaatgtaattagaaaatatttgctaaagaataaatctgccactgaggaaagtatagttattgatgtctctttactgaatgctatataatttattgatagcaaagcaaaagcacttaaatagaaaatatttataatgatacagatataataagatgcttataaggagggtgggagccaagaagcagtagctgaatttggtttggattaatgaagactaatgtaactaaggaataatatagaagtttggaagtttgaaataacaagcatgttatttaatttgatttgaatgctgaaggatttacgatgtatacctacagaattattgtaaaaggtataccattcataaataatttaagtataggcatttttggtaaaaattaatagcattttgtgattcaaaaccaacattcaaactaatttttttctctcaaatagaaagatcaaattatacatgtgttttcttttgttaatatgtctatgtgcctcagcctctcgagtaccagggactacaggcgcgcaccaccacgcctggctaatttttgtatttttagtagagacaaggttttgccatgttggccaggctggtctttaactcctggcctcatgtggttttgccatgttggccaggctggtctttaactcctggcctcatgtgttccgcctgccttggcctcccaaagtgctggtatcacaggcttgagccatcgcggctagccgtaactttatattctatacttaaaatttgcttcatgataagctgataaatcctgtttgtaatttctgcattttgtatttgtactttttcattcattttaaatcttcttcatgtaaaacaaatattttgtactccaatgcagtgttcaatattaacttgtaatttctgaaaattttactgagaaaccactggaatatttagaaattcaaataaaataggtgttatgcatattacatataatgaagacttcacagttcataataaacatctattttaaaattacatggccacagattcaacccatgggcccaaaatttgcaacagagcaggaagacttgtattttaatatgctaacagtacaagtcatttgacctagagataaaacaatttaatattttaagaacacagggttcacgaagcaaacttgaacttactgtaaaatgaacttactgtaacatgatttcaaatatgaatagtgtataagaagtctattcatcttttaatttctaaatttaatggaaagtcaaaggaaagtaatagcagggcaattgaaaattaaatctgaatgtcgaatcctctgtaaattctgacaattttactgcctacctaataaatttacaaacagaaacaaaaagctctattacaaaaatttttaaaaaaacctttcttattgctttcatagtaaaagagtatgtcgaggcaaatataattcaatttataaatgttttaccttggaaaataaatttataattttcaaaatagactggatatatagggctatgatgaaagtaattattaccaaacaaaatgcctttagtattgttataatgacactaattgtaaagaagactgtatttatggactagaatggtactatttgtacatgggacaataagatctgtctcctcgaatttatataattgtaacatgttaatataaacaaccctcaaaaaaacagtgtctgtcctcagtgtccttcatttaaattgatggtattttggagctctccctcgtgctctctctctctctgtatgtgtatgtgtgtgtgtttaaaaacacacatatgtatatatcacatatgtatacacatgcacacatatatagttatttttatattttataacatgatgtattttgtgtcatgagtaccaacttacaagtttgctaaaaagaaatggctccaacaccagtaaaatttcagtgaaatagtcttgctgcatgcagctatactacctaaaatttcaggatttgttagccagactcaaatactgcatgttcttacttatacgtgggagctaaataatgtgtacacctggacatagagagtggaataacagtcactggagactcagaaaggtgggagggtgggagagggtgaaggatgagaaattacctaatgggtacactattagggcgatggttacagtaaaattgggaatttaccactacacaatacatccatataacaaatccacttgtaacccctaaatgtataaaaataaaaaaagtaaaaataatcattgataaaattttcttagcttaggcagcagaaagtaattgagcatgaccaaaaacgtttatgccaatagagcaaagagaaaaactgagtacacataataaaatttatcttttgaagttcacacctggactaaattattagacatacataatttttaatcattgaaaaaaaccaagccaccatgtatttatattcttaagaataatatttctaaaatgtgtatgctagattacttttgtctacataaaattatacatatttttaacccttgcgatgttttgatgtgaattgtggttcacaaaatatactgggaactaagtaaaaaaattacaacaggtaaatgacacagatctgatcaggactgagatgaaatattgtggaagcatccatggtcagagattgcagtgatttttatctgaagagttggccccaaaacaatttactatacaggatgattaacattacaattccattttgagataatttggtaaaatgttaatattatgaattgcccacttgcttttttttttttttttttaacatggagtttgtttctgttgcccaggctagagtgcaatggcacaacctcagctcactgcaacctccgccttctgagttgaagcaattctcctctgttgggagaaaagctgagtgttgggagaaaagctgagtgttggcagagaagctgaggcagggcttgcatgtctgtgagacttgctggctccttgcttctagcactccccttatctcaagcagacatatgtttctcattcacttgatacactgtttcctttcaacccccacatccacatcaccttttttgtttgtttgggcaccaataaatagcatgggctcccagagctcggggcctttgcagcttccacactcgtgatggccccctagtcccactttctctctcaaatgtctttttctcattcctttgactctgctggacttcgtcgcccccactacctggtgttgggtctgatcaccccaacattcctgcctcagcctctcaaatagctaggattacaggcacgcgccaccacgcatggctaatttttgtatttttagtggagatgggggtttcatcatgttggccagtctggtctcgaactcctgacctcaagtgatctgcccacctcagcctcccaaagtgctgggattacaggtgtgagccaccgtgcctgaccccaactgctattttttaaaaatatggttatttttcatgaaccactgatggaattgtaatacacgcatatctctttgcaaagttattagaatgtatttgtttttccctctgtttttcttttaaaatattcccaaatcatttacatctaattattaatgttctgtattatgtgtaaagatgaaaaattgtaaaaatgtaaatggccaatagtcttttataatgtgtttaatatataaaatgctttgtgcttcttgctttttagaaaaataccattaaatgcaaatggaccaaggaatacaaaaactttataattttatccatttacaggcatcattaacacattggtgtttgttcctttatgtttttttgatgtacatatgtatatacatatatgtacatacacacatatacatataggatattatgatcctagtttactgaaagaatacacatatgtatacatataaaaatacataagaatacacacacatatatacacacatatgcatacacatacatatgtgtgtgtattctatgtattcatatatgtatatgtgtgtgtgtattcttccagcaaactaggatcatgccatcctatagctttgtaatccatttttttgtcattagccagccattaagaatttttttgttttaaccattttctattttaaacatcatacaacagaaagagtaggataaaaatatcataatgatcaggtaaaattatttaaagagatatatttttttctttgcatcatcatctcctttttctcttttcttattcgttaaatctttgtttttacaaatccctgtgctaagggctgatactcggtagactgcagggaggaaactgctctgccacttaaaaaacactgaccaagaagcaggtcatctacactagttcctcacaaatgtcctttgtatggcaggaaggaagatatgtatgtttttaagtgaatacatacacatctataaattgttgtaaaataacccccagagaacaccaacattaccaaagcttgaaagatagtttctaaataacattcacatttaaaaggcttttgttttgtttgagatggagtctcactctcttgcccaggctggagcgcaatggtgtgatcttggctcaccaccacctccgcctcccaggttcaagcgattctcctgcctcagcctcccgagtagctgggattacaggtgtgtgtcactgcacccggctaatttttgtatttttagtagagacgggctttcaccatgttggccaggctggtcttgaactcctgacctcaggtgatctgccctcctcggcatcccaaagttctgggattacaggcgtgagccactgtgcctggcctgtttttgtaaaaaaacaaaacaaaacaaaacaaaacaaactggtttgtttttatttgatttggccaaaaaatagcactgctcaatctgtctttaacttacttgcctttggccaacttgctctaaaccaaattgttcttcagccaaatctgcaggggctgacactgacaactactggggcgattaaatgcaggttgagttttgtactgaaaaggagtaagagacagaagactatatttgaggaagatctgggaaatgtaagaaatcatctgaaagttgactcagtgccctgctctgttttacaccctttaacaaagagggtatcataaaaatttcttaattctggtagttagaaagaataaaagtcattccgtgggtgccatttctaaaccatggaagattaaattaatgaccccaaatcacacagttggtgagcagaacatatagtctttaactccaagcccccatgcagagttcgccaaaaaactgactgtactgagaaaagtatgtggtgggctgaagattattatcaggttccttggttcagaaacagataatacctgtactgaacagatagctttcattaaaaattacaatctaatatttctcacatttttccctctgtgtagatactgttaagtccagtaggaattagattaagacaagcagctttatctctacacctctttttcaggacaaagcagaagacaaaactggcaggacacagagttgcttgtatccttattagtgatgctacttcattaaatttcatgttgaaagataattcaatgatttaattgcatttaatgctaatcagacccttataaatgtaggtgagatacacattctcattgtattatttttcatttctcattagttacccctaattttcatgatgattactaacataatataccattaatactctcaggaggtggcagaaaagattatgtgtcatgctgtgattcattaatgccagagaaagagctgcttcgtttttcaatattttataggtaattcattctttaataatgaaaaataaattttctgccattcagaactttctatcaatacatttactttgaaaaatggcaatgttgaccatacctatatacaatggggtacttatggtctctctataaacattcttaacttgctggcctttcccaggctgggcttattttttatatagattgtgccccctccttctaaagaaaacttatttaataaatttcactgccttttcccttttttcctactttaattaagagaacttcaagatttatttccacttagcagatgtacattaattagtataatataatttcactccattttatgatatactgtggtataaggaccaaaaaaccttcaatatgccttttaaaaaaaagaaatattattttaaaaactgttctctggataaatttatactgatactgcttgaagactgtttgaagtgtttccagctgtgctgttagggtttgtttctcaggacttcatgcctgtacatatagagataattatttattttttcttaagcttaccatactcccagaaagaaaaatatcaagctacagataaccattgacaacaagaaaattctatgcaaaaatactttataacatggtgctaagataatactactcatttaaaacatataaatatgcctcacacattttaatctggtcagtattcatataagagaaccaactatctcatttaacatatacaaggatttagaaaagttatattgagtattcctcagtggaataatattttcatgtaaataatacactaaggtgtatctcaaagagaactcatctggtgacttaatggaggaatctattatgttgtattcagcttcttataattattccttattctactattaagaagacaaattagcattctatactaatgctgaaggtgaattctggaaagagaggcccagtattcagttttaagggcaaagaaaaatggctgtgtgttcaataaaactgtgtttttaataacatgtatgcactgtgcatgctgtttgaaacattttgattttgagattactatcatcttacagggaaaaagaacaactcaggtaacaggtaacaatgactattgagagatctattgagagaatgtctatttagagaatgtctaagttcagagagaggaacgaaccgtgctcagtgctttatgtgcattttctcatttatattcagataaaattcattagctagtgttgtcatcactctgcagacctgttgcttacagaaattaagaaacctgtccactcctggttacacagcccactcatggttaaataaaacctcacatttgtccttattatgcttttggaaaacggttagacttaaatatatcaaaactttatttttataatgtcctttatatattatattcattaacctttctttcacagtcttccgatttagcatacccataacatttggttaaactttaatcaacattgacttaaataaaatgttcttgtagtaattcctatcatgacttcatgtttttggggcaggagctgctagtcgtttcctgcccacatgtatgcctcttttttttttttttttttttttttttggcacctttgggctcagccgcatcttacactcatatcttagctctgaaccagaatattgagcccaaaaagagcccattcctcaaaagaggttgtttcagtatcaactggtcttgttctattcaaatgttacttaatctcaaagtgaatatgttcagagctcactgccttctgggtctggaagccacactgtttactttttcctatgatgtttgttctctgctgagtgtcgaaatccctccaactgccttttctaagatgcaggctgttccctttcacttatttttattgcccattttgggctctttatcaacgccctatattataaaacatcagcaaggactgtgtctgtgcttacgtttttgaaggatttatgaatctgtttttgacatgttggcatgattatgcaattttttcaggtccaaatgatactatactagctcatgatcctggattctgaaaccaagaaccaaagtaaacacatatgctagttcatactgactttcattctccctaccaccctgtctttcagatccaacctaaggtatttgattactggcacctctcagctactaccacctgtaatatagtatttcgtcttcctaaaacatgcattcttgctataaatgacaagaacactatgtggcattgttttaccaagcattaaatatcgagaattccttaacattaagtaaagagaagactaatatttagatggaataaactatgctaaccaataagaaaaatactagcttatccccttttgtcagaattattttatcttccatgaagaataacttaaaattaacagaaagttgaataatctttttccttttccttttaatttcaagcttgttaaacatttttagaaatgtaatatacatttctaaaattgtgtctctacagcttcacgtttcttctttgtttctacagtactctcatgaaaattcaattctcttccctgtatttttaaaaactcattaaacaggtcgggcacggtggctcacgcctgtaatcccagcactttgggaggccgaggcgggcggatcacgaggtcaggagatccagaccatcctgactaacacgggtgaaaccccgtctctactaaaaatacgaaaaattagccgggcgtggtggcacatgcctgtagtcccagatactcgggaggccaaggcaggagaatggcgtgaacccgggaggcgtagcttgcagtgagccaagatcgcgccaccgcactccagcctgggcgacagagcaagactccatctccaaaaaataaaaataaaaaacaaaaaacaaaaaaacaaaaactaactcctaaaacataggtaataaaagaatacaggatcttcaaaaaaagaaaacagtcattaaaaactacagaaatactataataatttgacatctactccttaatttggcagtgccatacaccatgggttgtaagaaagaagagaatatatagtttaaaaaatgctattaatacttttctccagcccctaacccaacccactcatgcagtttttcttcatagaagaagagattttgctggtttgtttaaacacagaccaaaaatatgttcacctctgctcaatattgtatagctgacattctctttaaatatatctgtagaccaattggatacaaataaacattccaacactatatatacatatatatatatatatatgtatatatgtacgtatatatatgtacgtatatatatatacgtatatatacatatatatatatattccatatcagttgtttggggtttcttaatattacaaatttgtcttacaaattacataggagtagaaattctaggtaaggagatatgcataagttcagatgtaatagatagataatatcaaactttttccaaaatgtcttactaatttttatcccctcagcaatatctgagaacttcagtcgcttcacaatttgattttgtctgttttttttttttttttttttttagtcattgtgatgaacatgtgttggtttcttatggtttgttttcaattccctagcagttaagtttgatatatatatatatatatatatatatatatatatatatatctcctgtggaaattgataagctgattctaaaccttatttggtaatgagcacacagagagagccaagagaagccaacaaaccttgaagacaaaaaaataagcagaagacttacactatcagatattataaaactatagtaattcagatagcagaatgatgcaaagacaaacaggtcaatgaaatagaataaagtattcagaaataagcctttacatccatgaccatttgacttagaacagagagaacacgtcaagtagagtggagaaaaaaaatggtctctttagaaaatgatgctggtcaattaaatatccacatgggaaataaaaaaaaaaaaatcttgacctcctacatcactccaaacacacaaaaaaatcccatatggactgtaaatctaaacataaaatatgaaataaaatttttggaaataaacttaaaaaagtcatgtttttgtgttactcaaagagcttttaaacaagacaaaaagttgctcaacatgaaaaaataataaattgtattaaaagtttctgctcatgaaaaagcataaaaaatagggtgaaaatgcaagccataccttgggagacgatatatccaatacatatattgaataaagatatgcaatccagagtatataaagaattctaaagacttaatgagaaaacaaaacaaacaacagaatgtccagagaaaaatgttagaaagagaccaaaatagtcgccacataaagaggatacaaatactggcaaaaaatatataaagagacatttgactatcttaactactagggaatggtaaacgaagcacaagaaaccatcacatgttcatcacagtgactaaaaaaaaaaatcagacaaaatcaaattgtgaagcaactgaagttctcagatactgctgaggggatataaattagtaaaacatttttgaaaacagtttgatattatctatctattaagtctgaacttatgaatatccccttacctagaatttctactcctaagtatatttgtaatattaagaaaccccaaacaacttatatggacagtatataggatatattaactgtaatatatttgtacaatgaaattctctagagcaatgaaaatgaatcaattattactacatgcaataataacatagatgaatctcacaaatatagtgtgagaaaatgaatctaaacaaaaaatacaattttcctaagtctataaaaatatcgtaaacaagaaaaacaaatttatggttggaagtcatactagttattcttacggggatgtggagcaggaactggtaatgctctgtttcttgacctgggcactggttacactaccgtgttcactttgtaaatatttatctagctgcacacttagaatctgtgtgattttgcatatgcaggttgcattatgtatgcagcttgtaataaaaattatacatcaaaaatattcttttaggctgggcacagtggctcatgcctgtaatcccagcactttggaaggccgatgcaggcggatcacaaggtcaggagatcgagaccatcctggctaatacggtgaaacaccatctctactaaaaatacaaaaaattagctagacttggtggcacatgcctgtagtcccagctactcgggaggctgaggcaggagaatcgcttgaacctggaggcggaggttgcagtgagctgagatggtgccactgcatgtccagcctgggcgacagagtgagacactgtctcaaaaaaaagaacaaaaaaattcttttgatatcagcattcaacatatcttggggtctattggcttcaggtgttgatagtctttcaaattactatgagcctcactgacttttgtccttttctagattactgggtttctaagagaccataaatgtctagggggagaaatcctggaaatgagtaaaatgaaacattattaaagagagaattatctttataaaaactagtgtagctaccacataaagtttctggatcaacttgatggagatgcctagtttagatgttatttttgttcactagaatgcatttttgtgaatccaggcatttcattgcctgtttttgaaaaaaaaggaaaaataaaaaaattttaaagtctctgcaattctcagattttcagtgaattacaactaaccagtgcaaattgtattctctttatgcataaaatctctctccaggcctgcgggtttcccttaaggtaaattaattgaaactaataggaagaatcatttatttcttatggcttatttggaactaaactttcttcataacgcattttaaggaactcttgtactttaccgttcttattggaaatattgatagacaattcaaaattaagatacatttatagaagtatgaataaacaatttttaaaagctcattttcctcattttttccccttatattcgtgttatagatctcctgtgtcaggtcagtacagcacaaagttaatggaggttcaagacattacaggacatcttcagacaaaagtaatttttatttgcccaatttatcttctgaattgtgccttgcaatgcagccttcactttcagaaaaattctgagattttcaaagggagaaccaaatgtcagtattcttgctctacagatgatggaggatgtggcctttgaaacataatataggagagtacacacaatcatcactactctaaaacttataaaacctcctaaaagtaaatgcaagcttacctccaaaaatagtattccatacctataccttggattgttacacatttaatcatctgagagatacaaagacatttaataaatttctaatactgctagagtgcactcaaactttaaaatatatgagccaccagcaagtttaggaaaggcaaaattatttggccatttaccaaataaactactttattttcatgtatcatgtccaatggctcttcaaattcataaaaagtccttaaactctctactttaaaaataaagtatccaggctggtcgttgtggctcatgcctgtaatcccagcattttgggaggccaaggtaggcagactgcctgaggtcagggtttcgagaccagtctggccaacatggtgaaaccctgtctttactaaaaataaaaaaaaaaaaaaaatacaaaaaagttagctgggtgtggctttcacctgtaatcccagctacttgggatgctgaggcaggggaattgcttgaaccagggaggtgaaggttgcagtgagccgagatcatgccaatgcactccaccctgggtgacagagcaacactccatatcaaaacaaacaaacaaaaaagtttccagttatcagagcagctttacatctatgttttttttttttttttttttttttccaagacagagtctctgtcgcccaggccggagtgccgtggtggcatcttggctcactgcaacctcagacgcctggattcaagcaattctcctgcctcagcctcttgagtagctgggattacaggcgcctgccactgcacccggctaattttttgtagtttttagtagagactgggtttcaccatcttggccaggctggtcttgaactcctgacctcgtgatccacccgccccggcctcccaaagttctgggattacaggcgtgagccactgggaccggcctcatcgattttgaaacatccaagcttccctcattcttcagataattatagtctgggaaaagtagtccgatttctattataagtaatacgaattaaagcaatttttaattaaattacattcaaattaataggcataaattgtttgctaggagaatgatattttttggtgtcccttctacaataacaaacaaactgatttgtgtggagagggggaagaagagtaaaacatatgcagaattatttcattgtatactcaactgacatctaaaatagacttcatcttgtccacttatattaaaagaacataacaagaatgttttacttgttcagactaataaggagaaatgctatgtatcagcaactggtaatgttttttatggttctcaactagtacaggagaaaatgcaggattagactatttgaaacggaatatcaagtttcagttatataggaggaataaggtaaagggatatattgtacaacatggtgactatagtaacagcgatatattctttaaaaataaaatacagaatacagtgtagaaacagaatagatttttttgtaatcatctgtctgcatttgtgccacagaatttcaaaatgaatgtgaagtattttctaaaaatatatgatataatctaaaaataattgaaagaaaagatgatagagagtaaacgtaaaatatataaaggaaatcagagaaagtcagtataccacaatttgtattgcattcatcttctaaaattgccaaagatggatcaaatatttgactttgagtgtcggtggaaaaaaacaaaaggaaaatattaagtacagtatagcctgtgatcatataacaaaaatagcccagttgttcaggaaaaaaaaaatcttcacatttgatgtcaccagtgaggctaaataaatgtaaaactatgatacatggataacattcataaagctgtcatcaagtctgagtttctaatttggcaagaagtgaaacccacagggaagtccagggtgatgttattctgtgttgtaatcagcccaaaagagtttaatgtaaaatgtattttactaatttgaaatgatcattcatgcaacatatgttaaacaggttaaaagacatgagtatatgtaaaaataaataaataaaattttaagaagtcattatatgaaaaaggtacttgcacacacgtttatagcagcacaatttgcaattgcaaaaaatctggaactagcctaaatgcccatcaaccaatgagtggataaagaaaatgtggtatatatacaccattgaatactagtcagccataaaaaggattgaaataatggcatttacagcaacctggatggagttggaggccattattctaagtgaagtaactcaggaatggaaaaccaaatactgtatgttctcatctgcaagtgggagctaagctatgaggacgcaaaggcataagaataatacaatgaattttggggactcgggggacagagtgggaggaaggtgaggggtaaaagactacacaatgggtacagtgtatgctgcttagatgacaggtgcaccaaaatctcagaaatcatcactaaagaacttatccatgtagccaaaaaccacttgttctccccaaaatacttttttgctaaactttttttaaaacccaggggtacaagtgcaggtttgctatatgggtaaacttgtgtcaggggggtttgttgtacccaaaaattattgaaataaaataaactaaattaaaatcaataaataaaattttaaacaaacaccaatttgaaatgttaagcccaatatataatgtctttaagttgatgggaaaacataatgtctgcttagatgaaatttaaattctagtaggaaaatcatgcacacagataaacgataacagtataattggtttaagtgctaaactagacatatagtgattcagttacagggtcatagtcaagaaggcaatgcaccctcagacacctacatatgtttgctttgttcaaagtacaaaccacacaaggtcaaacaccgtgccaaaacatgaaggaaaccagacgagatcgggcgcattcagggtggtatggccatagatggaaggaaaccagtgattagtaagaccttgtgaaaacacctctcccttgaaaccatgagagagtttcctcatacttggcaatggggaaccaaaattagtgttttattggacctttacttcaggctggttcttgtttgcatctgttctatatgtaactaggaagaaaattgtcacaaaataactcactagctttcaagtaacataaaccacaaatactgtaaaacataaatggtgattttgatttcagaactaagtaatctacgctatttgacctctaaaatgtggttctcaagtataacagttgtcacaggacacttgacattgtaacagtaaataacacataaataagcaaaccatcagcttaaagattttaaagggcacctgcttctacagcaatatttatgtgagaagatatctgtggcacagagtgatggagcataaagtctcacagagagataagagcatgcccagaactaaatccaggtgattagaatgtcagtccagtgctcttccactggaaacgtggttgagcttggtctcggaagcagaatgccaggctgtaaattgtagcctcactcccaattagctgcacatgttgggaaggttacttattgctcctgtgatgcactgttctctgtaaattaaagagatgctacttggggaaaatacattaaaaattcagaaatgtgctggagatgttttacctaagacccaggtgagcaggtatagggctagagaccaggagcccccaggagcccccaggagccctaacctctgtctagaaacattatgtattaccctacattgttaaccttgtacatttctataccttttgctactaaggaaatttgcatcctctgaccatgactgtggcttttttctatctacggcatcactctgctgaaacctctcatcaccagtttgtgcttttgaaaatgtaataaacaatcagccattaagtgttaagtcttttttcttgctgctttttcacaatattattttcttttagtccataaatttcttaaatttggcatctttaataattcaaaaatagaatattcaaaatctttttaactttcagtagagatcaaatcaacattataactcaattcttctgacactgtttttccatatgtgcaacttgtaaagaatgagattaatcctcactgcattaacttctggaaaatatcttcataattcagagttttttaaaattaatcttgatcacatttaacatctccctgtatttgcaataaatgctatttttgcagttaagacaacatgcaataaactggaaaaattagttaacaatttgaaaagtgtttttaaaatcaaatcttacttgttaccttaacagggggtgtcacaatttacacagttcatctcaagttgaaaagaaatcggttgcctttttacttgtctcctaatttttcacagaaagttagtatgttctcttattttctagcaggattctacgcctcatttctcctgggaagcaatgtaagaggttacaagaaaagttcttgaactgaggtagacctaactttaaattccaacttcactgggtatttggctgagtaatactaggaaagttatccagacttactgagcttcaattttcccaaaagtgcaataagaaataattgcatctactgcataaatcaatgtttaaatttacttgttttattttaattgatattattttatttattcattttatttatttatttaaagagtgtaggctaaaataagtaaatgacatttcacagttctcagaaaaataataatgacaaataaaccacagttattattatgaattagggaatatttatccattaacatttcttcaaagcccagcagaaacaaaaagttaatgttcaaaggcctagcttcaactttccttcttcacacaaaaaattacaaatattacaagtattcatcactttttctatttcttttttgttgactacatagttgcttttttacagttctttctatattctggatactgctcctttgagatatatattttttaatagatgtcgtgagtatttgcttttaacatattgcttcactcagtcatttatagcacccttgttgcaggagtctgctattctgatgtaaccatattcatcagtcatttttcattagtgtaggacaggggtccccaaccctcaggccatggacaactaccagtcggtgacctgttaagaactgggccacacagcaggaagtgagtggtgggtgactgagtgaagcttcatttgtattaatagctactcttcatggctcacataacctcctgagctctgcctcctgtaagatcagtggcagcatcaggttcttataggaacataaaccctatcgtgacctgcgcatgaaagggttccaggttgcacaaaccttatgagaacctaatgcctgatgatctgtcactgtctctcatcacacccagatgggaccatctagtttcagaaaaacaagatcagggcttccactgattctacattatggcgagttttatcattatttcattatatattacgatgtaataataatagaaataaagtgcataataaatgtgatgcacttcagtcatccccaaaccatccccctctgcactcctgtctgtgaaaaaattgttttccacaaaaccaggccctggtgccaaaaaggttggggaccgctggtgtaggacatttcagttaatgatgttcaactaatggcctgccctagagaaggaggactcagaattgtggggaggctttttcaacatacaaggtaatgcagattctatatggcctcctgacaggctgagaggattagcatgttcccacaatgcacatcactcccatattgttgcaactggtgttttatgaaataaaatgtttaaaaacgcagtacatagtcaagaaaaataaattgactaatataaatctttacttctgaatttgaacataagcttcacattcataagagcttcaaaggaatgaattaaattaaatatagtttaaaaaattttaaagtttaaaacattttataaattaaaaatagtttaaaaaaggtgttcacattctttcaataaaagtgatgccctctctcctctttttctttactgtggtaaaatgtacgtaacacaaaagttagcatttcaaccacttttcagtgtacagttcattgacattaagtgtattcacattgttctgcaaataccactgccattcatgctcaaaacgtcttcttcttcccaaacggtaacagagtagccattaaacaacagcttcccatttacctcctcccacttcacccctaaaccctggcagccaatattctgctttctgtctttatgaatttgcctactctaggtaagtagagtcatacaatatttgcccatgtctaggttatttcacagagcatgatgtcctcattaatccatgatgtaacatgtattagaatttatttccctttaggactaaataatattccattgtatgtgtatatcacattttgtttattcattcatctatagatgaacatatgtgttgtttcttttccctttttttttttttttttttttttttgagacagagtctcgctctgtcgcccaggctggagtgcagtggcgtgatttcggctcactgcaagctccgcctcctgggttcatgccaatctcctgcctcagcctcccgagtagctgggactacaggtgcccaccaccacgcctggctaattttttgtatttttagtagagacgggggtttcaccgtgttagccaggatggtctggatctcctgacctcgtgatccgcccgcctcggcctcccaaagtgctgggattacaggcatgagccaccgcacccggccccatatgggttgtttctaatttttagttgttgtaaatagcacttctatgaacatgggtgtacaaatacatgatcaagtctttggtttcaattattttaagtatatagtaagagttatattttaactgatattaactaattgttttaaagactaaagaaaaacgaattaccattggattttcttttcgcactcctcataattaaaatgactgattacttgtcactaacggaaatcaacttcgtagaaccagttgtgacacagatacccagcatgaaaccatagtaaatatagatcttctcagataactttttgttctgtgcacttttgatacaattcatgtacttaaatgtgacatgagccttcaaattattgagccagaaatcaagtatctacatgtctgtatatatctttgtcctagaaaatcctcaggagacctcccttaacaatcactgctcaaaaatgactcacatatccacgtgcaaaccaatcatttgcaaaggtaacaggacaggcatgattggctctgaccagccatttttcaccactttggaataggcttcacttcccctgaagcacatgatccccaaaaataatacctaaataaaactgaaattctgttaaagtgtgaggtaggagaaatagccaactaatggtgtctactatactcagacaatgtgagtatattaaaaccagagacttcacctaaattaactcagtggtacaaacagaataatttaaaactcaccttcacctaaatttcagataattatattattttccactcactatagtataaacatgaactgaaactaaattaggtattttgtccatctagatttaattataacatatgtttttatttatttactttttttcgggggggggtggtctagtttactagaatgtggcttctgtaagggtagagagagcctatttttgttgcttccatattttcagtacagagtaagaacacagtatatattttctttaaaaaaatgaacttagaacctaagtttttaagtatattaggtataccacttcagagcagatatacaattgtctttattatgttattacttatattggataattcacttcaacaatgtttttattgtgtcactttacctgtagcatattttaaaaataatgccccaaattcactactcatcttttaagctaatatagccttattcactgctatttcaaagtcttatcttactttgtcaatcttattctatgtcacatttcttctttcccttcttacacaaagcacatatttacatttaacttttatcattctgcgttatatcatggaccaaaaaaaattaacttgtatgcatggtagatgatctaccattacctaatattgtatagcaattggtagaaacacctctttcacaatcatgggctacttcccatttttaaaatcatctttccttccttcaaacaccacagctgaactggtcctgattcagtgctgtttgcattaatatttttgttgctctaagtataaaatgagaagaactgcttaactcatgctctgattaaattctggaaaggagatttcaggcttcaaggctaaaggcagcaactggaattgttaaacattaagtatttattactcccttccgctcgtaaatcccttgcctcctatcactcagatacgctctgcactttgtttcttctgagttttggcttacttagtttgtttcctctacttagactgtgtcttcctcacatatgtttcactttggaaaaaaaaatctaaccacccttcagtgctagtcttaaattcttcatcctccaggaaacctttatgttcattcaccaactgaaatgttttcttcctttgaatccacaagacaatttgcgctctgctacttgactttattattatagcatacacttgcataaacacattctttctctctctctctaaactttctctctctctctctctctctctccccccctctctctgtctgtctctctctcccctctttctctcactattgtataaagtacctagtatattatattgcatgaagttggtttcctagaaaggacccctttccctagtctgaattacccactgatagtttgaagggggagggttccttagagttctcagtagtctggagacacaatcaatcccaacactgtatacttcatctgaagaagtccatgcattctgtccagggcatatgtcctcaccctgatgcttctttcaatgcaatgtctttacacaccttattaagactcagtttctcacctgacttttacactactaccaaactttcgccagaatcccttggaaatcacagaccatcatcaacaaaatcccctaaatgttcaactttccctctgagtattacctatactttttgattccttctttctccctctaaccatcctcgacaaaagatgctgctttctgtagatctcccagtagtggctaccataatttacatagcacagagcccaggagtacagggcaagcatccttctgtctcctttgacactctgtcccaattcctctgaagtaaatcccatcagataatgccacccactaaatttccttgttatagtcatcacatgccttttgagtaatctcctttattaatggactagtttaacatttggcttatctttttttcctacatcacactataggattagtaacataagtggtgatgtaaaaatccacaagggcattctaatcacagtagcatctgacagtcaacgatcctcttttatcaatcttgttctttccatggttcagggaccttgcattttccctgtattcctgtcacctcatggcagcaacatctcagtatccccaaacccttcttctcctgatctctaagtgctgaaattcccaaagcttagtcttcgtattttttttgtcaaacccattttcagggtgatttcatcttggccccttatttctctctcaagtctagatcagcatttgcaaatgccttgccaagaattaggtttctgtattgaaaaagcctcccaaaccttgattactgccatcacaataggcagtggaggaggtatggggatctgttcaggacaaaaaccaccaagtcattcttgatttttcctaatgtcccatgtatgattcatcggcaaatcctatatgttctatcctttaacccccttctcaaggtctccatagcctatcaacgtcgttcaagctaccgtcaaatttttcctggactcgtcatgcattaaactctacttgtccaaaacactgtgttacccattcccaacatcccccatgcagcatctacaataatctttttatattggatgatgtcataactgtttaaatcattcaaaggctttctttccaacacacctagaacgaatcccatattctagccccaggtacatttctgatctcatttcctaccagactttttcattcacactagcctccagctccctgtctacctttagggctttacagagaaatcccagaatgctgctcacttaagaatccatgtcttgatcttttcctttattcaggtcactgtttcagttttatccaaaaagaactatcttaactttcttatctaaaattgcaccactctcattcttcccttatcaaacttttttgtttccttagaatttatcactacataacttactcatctattcatttcttcaactagtttgtctgcattactcgggtggaaactttgtttgtttgtttgctttgtcaattgctctatatcaaacttctagaacagtgtttagcacattataggtactcaaacatatttgactaaatgatagaactaaatcaattaagagttaatgagactaaaatataaaataagataaaaatcagctacaaaggattcctacttgtggataacaacataaattaaatgtaatgaatgacagatttgtggactacttttagttaaactggtgattcaggtcaggggtctgtacttagcatagtggaagagctattttgcaagcccaacccaattaggttgaattttttttcttactgagagtgtttgataggtgataaaactacacgtaagaagagctctaatcatggtgctcctggtaataggaaaagaaaggcaattactcatgtgcaaaactagaagcaatcaaaagctagatttgccagagatgtttaggttttatgtgcaatttacagctatttacaagttaaccattgaaatgctgtccaaaattaactccgcaattgagaatccaaaatgtttagcatctaaactttttcctcagtaaaattcaatctttaaaattttttcttagtaataaaacattagtaatacacagttgattagaaatagtcataaacatttgattataaactattataagagtaattagtaataaacatttgatgataaataaagaaaaaaattgaaaacttacaactttggtcttagatactgcatttttgaaattccaagtaagccaacattctctgagacatcaaggtttttgtaacttttagtaaagtactaaaactggtagtgttatttttttactttcattcaatcagcatttaaaattcacaatttcagaaaaaaatggttaatttattccactatttcttctattagaagtggtaattttatatttgtcattagagatttcattttgagaatcttttgagttatcctactggaggaatacaaaccattaagaaaagatatacatttcaacatcttattcaatgtaaaacatcgtaagtattttgttaccattttcatagtaaaatgaaactcaagaagttgcttagtgtttacctgatataatctgtattgagtttagataactaaactaatatagctccaagtttcaggcttttgtttatacagcataagtatgcagttaatgcaaactacaggcttacagcttatctgcaaaacctgagcttttactttagttctgtatattaacataattccgcataccttcactctgagtacagaagtaaacattcttgcatcttcagatacacctccgatgtagaattttttctgaaacactgggggatgattattttcatcctgaatctcaatgtatactttagctgtattgcctggaggacaagaaacgatgcattttttattggtggttattcatgggggaaaaaatgcactgaagtaaatatttgctgcacttttttttggaaacattgaaaataaatcaaaagccatttctagatgccatgcctagcacccccaaattcaggggacactgataatgatgcttctggtataaaaatgttaagttgctgttatttcttttaattacaatgtcctggtagttcactttacttgatttaatttggcactaaaatactgcaccctgttaattttaatgaaacaactctactgttcacgttcacaaacacttcacacacaataccagttataccaaagggacacaaatatataaaccccttatgaaatagtagaaactgccataaactattatatgaatatatatttattcttaagtataaaatcagcaatggcatttctttagcttaaaattgtacaataacttttatgttttaagactaaaagtaacagtgttcgggtgaggtgtttatttccacaaatggaaaacaagttttatcatgccttggaaactgtcaatgttagaggctaacattcattgaaaacaatggagctgaagatatgattatgactcataaatgctgcattttaccatttaaataacagtaaatgtaccataaatgatatgtcatcatcaaatgttagaacctccctcaaatcatcacacctttaatgagaaatgtggtacttgtcactagtccaataatgaccttttaaaaaacaatttaatatgtataaaaataacttataaaccaaataaaatgggaaataagtggctattcattttgtaaaaaaatagtcaaataagtattgctaatgtattacataagtcgacttttctgattcatttcagttatgaacaaacggcaattaacgtacatactatttatcaaggatgcccttattttggtgttttacctgtgtttaatgcctcctgtacaattttaagtaattaacaccagcctacttgcaggatacatcatgggtatacatttgtatttgttgaataaattaatgaatgaatagcttgtattagtaagaacttagaaatagtcttttttttttttttgcttgcccttggaaaggtcagacagaacagtgagttaacctcaagattttgctcctatcctgctgctactcattcagcttttctctgtttgtcatctgtgacctggaagaggtagaatcaagaggaaaatcatgctagcgcaacagattagagaaccaacagcgaaatagggctaatagcagattatgcttctctatcctgcagtgccagggctctgacttgtaccttagtcagccaccacaaatcagaattcacccaaaatgaaatcatttttagttcagtagcagaccacttttatctctagaataaaaaatgcgaacagctctaaatttaaaaataaaaaggaattttagaatatgtcacctttccaataacttctttgcactttcattcagaaacatatacaattcaaatgtgctatttcttttcagaactcttagagtgacagaggtctcggaaaaatactgatgacgtatattttcttctttaaatgggatgagtcatttaaaatgttatacaatttgcaaagaacaagaactttgtcatgacctgttcccttacctcccaaccctaacttcatatctggatggtaaccaaatcctacatgtcagcctcataagcaggtaaatcatcacctaataaatatatcttgtgtcatttttctctcaactccacagctgcccatatacttaagtctgttgttgtctcacctgagtgactaaacgtcatctgctcccctgtcgtgtctttctaatgtgtcctgcattctgatataacaaagacatcacaaaatacaaataggatacattaaatcaaatgttaaaccaaccaccattcatatgtacatttttttctttttcttgttttttgagatggagtctccctctgtcgcccaggctggagtgcagtggcacgatctcggctcactgtaagctccacctcccgagttcatgccattctcctgcctcagcgtccctaatggctgtgactacaggcatgcgccaccatggctggctaattttttgtgtttttttagtagagacgggatttctccatattggtgaggcttgtctcgaactcctgacctcaggtgattcacccacctcggcctcccaaagttctgggattacaggcatgagccaccatgcctggccgacaattcttaaaaataccatgtgtatattcatatccatacttatatgtatactttgtgcatataagtttaagattcaaataccaaattgttcctatgaaagctcctttgattcagtggcctgtatcagatattaagtggtttgtgggaaaaggcctatggataacccaaaatatgattatataacctgaacataatggggagagatgattatacttaattataatattttaattaaatgatatttatttatatgaaaactaatgactatacaatacaaaattccagaatacttcacaaccagcacacaaacaaaatctcaagaacattgtttagacttaaaagaacttatacatttatttattttaaaaagccacgatcatttagttcttttcacaaaagagaaacagttataatgcgatttataacaatactgtatcatgaattttgaaatttatgatgttagctatatagctaattatgtaggatagtttgtaatagtcaactaaaaataaatataaagttgtgaaaaaggtgttttcattaagtttgtgacttagatgttagaataaaaaaaattgttaacttttattttccataatgtaaaatagactagtcttcctttttttttgcttctccctgataactttaggcagttgttatgtatccctcctttgaaatgctatagtgcactaaaaatgtttctttctataaataacctttccagagcttggtttacattgcatttagttataagcatgattttattcttattagatttcaatattcttaaagatggaaattgtatctcctacatctatcagtactataatgcctcagtttgtaggtaatttttccgctcagatattattgtaacaaaatttcttaatttttgttgaacaaaaaagttgatattcaattaatttgttagctttctttgattataatcatgagattatgattaactgaaacaaaaagttaactcttagaaggatatgagggagctcactaaatcaaagtgaagtaagtccaaagaaggcttttggtaccacaaaataatcaggaagttgtagagcctttaaagcagcagatgtttgattttcttgcagatgaaataacagcaaactctcttcttttatgttattttaccccaccccttattcctctttttttttttttaaagaaacaaaccaaaaaacaacccactaggcttaagaatcataccctggggacacattacctgactgtcctagtttgggtcatgtgcttgctccttgtctcgggaaggagaagtcaccagattatccacttgagaagtcactgggacaattataagaaattgtagtgtgtctacttaaagaatgtaaaataaatgttggccagtaagaaaaggaaaagcaaataagtatacacctatagttaaatcactagaacagcgttctttttgacttttttattcatgtgtatacaatgtacatgacatcatcaatttccttggctcacgtgcttccccactaaggattgtaccatgttcttccaccaaatttggatattgattatttcaaggcagaagcttggaagcaactctgatttaaattcttttaagatagcctgctttttatctccttgagtacttacaaaaactttttttccatgttgtatcctttatttaatgtagacatcaaacacataacaaaagaaagatactagaaagagaaaggaaagcacagatagaaaaataatgttaagggaacaacgtgcgtgcctaatatcctagtattcccctccagtctcccttctggctcatctaaacaatgcaagtattggaaagagaaccacaaacagtgaaagaaattacaaagtaggcaaaaaagttatttggaaagtgttttggttaagagacattataatttttctgtgtgctttggggcaccctgccttatttttcttccattattaacttttttctccaattttctatgggacaatcttttctttggctagaacttttggctttagtaagccagaagttttaaaaatgactcctgaggtaagaaaatgtgagataccttcttgcaatgttttaaagaaagagaaaataatacttttatgtagtcaagctcaggggaaaatgtaagtcttagtatagttacctccttgaatagcacttctgttctattttagacatttaaacatggtagaaggagttcagaagagtgattttaaatacccattaacctcaacttgactctatgatttttaagaccaaatttagtttgatttttcccttcccttacttttaataatcaagactgtgatgctagttttttctttttaggaaggccctattatcctcaagatgaatccatttcatttatccacatgactaatctagtgcctacactgcactggattttcaaagaaagccttactgaataagaagccaatgagttaaaagtgttctcaactgggatcaatttggctgctctagagccatttttggtagtcacaacagtgtggataggggaacgtagtgctactggaattaaatgagtagaggtcaggaatgctgagaaatattctgtgatgaacagaacaggctcttaccccaaacgaacaaacaaacaaacaaaatatttgggccaaaatgccattagtgatgaggctgagaaaccccaagttaaataacaagagaaagaggaattagatgagttaagataaaatggaaagtttccaaatgctatagtaataccctctcctcaatccatctgcatgcacatgcctttaatgtggaacttatcaaaatatgctgtaattatttgatcacacattggttatactcttttttgactgtgtcctataaagtcaagggctcaagcctgtttacctccactcttgtcactgccttctggcctctgttcctgacattctctccatctaaaatattcttaattccaagccatttctctagtcattgccagtaaatatacatcacagaaatatttattcctgtacttgggaatgtagaagtttagtctgattaaaaaacatacactagactatattttcctcaaaccttaaaggaaaggactgtgcttttcttattgttacgtatcgttgcctaacacattaaatgatttttaaaattgttatcatgataaatgatttatagattcttcaaacagtcctattgcagagaattttttaaatgcttggaataccagatttatatttgttaatttgttggtatcaggagattgaagtcagttcctcactttaaaaacacacaaacaattttttatgctgtttttcttttaagacaatttttgtttaagctttacgggtatattaattatggaagcattgtgacttccacatagtaggtgatatggtttggctctgtgtccccacccaaatctcatcttgaactataatcctcacgtatcgacggaagaacctggtgggaggtgatcagatcatgggggcagttttccccaatgtgttctcatgtagtgagtttgcacgaaatccaatggttttataaggggtgcttccccctacactccctctttcctgctgccttgtgaagaaggtacttgcttctctttccccttccaccatgattacaagtttcctgaggcctccccagccatgtggaactgtgagtcaattaaatctcttctctttataaattacccagtctcggttatttctttataccagtgtgaaaacagactaatactgtaggtgttcaataaatgttaaattaaattgtaattgctaccacttcactactcccaagggtcctcttaaataaaataaattactctattttattcctgtaaattaaatgaggtaacagatttttaagcatttaaaaatcaaataacagacacccccattccaagacagctgaataggaacagctccagtctgcagctcccagcgtgcttggcgcagaagacgggtgatttctgcatttccaactgaggtacctaattcatctcactgggactggttggacagagggtgcagcccacagagggcaagccaaagcacggtgggacatcacatcacccaggaagcaaaaggggttgggggatttccctttcctagccaagggaagtcatgacagattgtatctggtaaatggggacagtgccacccaaatgctgcgcttttccaatggtcttagcaaatggcacacaaggagactatacccacacctggctcagtgagtcccatgcccacgaagccttgctcactgctagtgcagcagtctgagatcaatctgcgaggcagcagcctggcagggggagaggagttcaccattgctgctgcttgagtaggtaaacaaagtggctggggaagcccaaactgggaggagcccaccgcagctcaacaaggtctgctgcctctgtagactccacctctgggggcagggcatagctgaacaaaaggcagcagaaacttctgcagtcttaaatgtcctggtctgacagctctgaagagagcaatggttctcccagcacggtatttgagctctgagaacagacagactgcctcctcaagtgggtccctaccccagtgtagcctaactgggaggcacctcccagtaggggccgactgacactgcatacaggtgggtggctctctgggatgaagcatccagaagaaggaccaggcagcaatatttgctgtgctgaagcctccgctggtaacacccaggcaaacagtttggagtggagctccagcaaactccaacagacttgcagctaagggacctgactgttagaaggaaaactaacaaacagaaaggaatagcatcatcatcaacaaaaaggacacccacaccaaaaccccatctgtacgtcaccatcatcaaagaccaaaggtagataaaaaccacaaaaatgggaagaaaccagagcagaaaagctgaaaattctaaaaaccagagcacctcttctcctccaaaggatcacagctcctcacaagcaatgaaacaaagctggatggagaatgactttgatgagttgacagaagtaggcttcagaaggttggtaataacaaacttgtccgagctaaagaaggatgtttgaagccatcacaaggaagctaaaaaccttaaaaaaagattagacgaatggctaactagaataaacagtgtagagaagaccttaaatgacctgatggagctgaaaaccatgcacgaaactacatgacacatgaacaagcttcaatagccattttcatcaagtggaaaaaagggtgccagagattgaagatcaagttaatgaaacaaagtgaaaagagaagtttagagaaaaaaagagtaaaaagaaatgaacaaagcctccaagaaatatgggactatgtgaaaagaccaaatctatgtttgattggtgtacctgaaagtgatgaggagaatggaaccaagctgagaaacactcttcaggatatcatccaggagaacttcctcaacctagcaaggcaggccaacatacaaattcaggaaaaacagagaacaccacaaagatactcttattccaaaattgaccacatagttggaagtaaagcacccctcagcaaatgtaaaagaacagaaatcacaagaaactgtctctcagaccacagtgcaatcaaattataactcaggattaaaaaactcactcaaaaccgcataactacatggaaactgaacaacctgctcctgaacgactactgggtaaataacaaaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaattaaaaactagagaagcaagagtaaacaaattcaaatgctagcagaaggcaagaaatcagagcagaactgaaggagatagaaacacaaagaacccttcaaaaaaatcaatgaatccaggagctggttttttgaaaagatcaacaaaattgatagactgctagcaagaccaataaagtcttgcaccatcacaagactaaaccaggaagaagttgaatctctgaatagaccaataacaggctctgaaattgaggcaataattaatagcctaccaaccaaaaacaaagtccgggaccagacagattcacagccaaattctaatagaggtacaaagaggagctggtaccattccttctgaaaatattccaatcaatagaaaaagagggaatcctccctaactcattttatggggccagcatcatcctgataccaaagcctggcagagacacaacaaaaaaagagaattttagaccaatatccctgatgaacatcgatgtgaaaatcttcaataaaatacccgcaaactgaatccagcagcacatcaaaaagcttatccaccacgatcaagtcagcttcatccctgggatccaaggctggttcaacatacacaaatcaataaacgtaatccatcacataaagagaaacaacaacaaaaaccacatgattatctcaataaatgcagaaaaggcctttgacaaaattcaacagcccttcatgctaaaaactctcaataaactaggtattgatggaacatttctcaaaataagaggtatttctgacaaatccacagccagtatcgtactgaatgggcaaaaactggaagcattccctttgaaaactggcacaagatagggatgccctctcttaacactcctattcaacatagtgttggaagttctggccagggcaatcaggcaagagaaagaaataaagggtattcagttagcaaaagaggaagtcaaattgtccctgtttgcagatgacatgattgtatatttagaaaaccccattgtctcggcccaaaatctccttcaagctgataagcaacttcagcaaagtctcaggatacaaaatcaatgtgcaaaaatcacaagcattcctatacaccaataacagacaaagacccaaatcatgagtgaacttccattcacagttgcttcaaagagaataaaatacctaggaatccaacttacaagggatgcgaaggacctcttcaaggagaactacaaaccactgctcagcaaaataaaagaggacaccaacaaatggaagaacattccatgctcatggataggaagaatcaatattgtgaaaatggccatactgcccaaggtaacttatagattcaatgccatccccatcaatcggccaatgactttcttcacagaactgggaaaaactactttaaagttcatatggaacaaaaaaagagcccacatatcccagacaatcctaagcaaaaagaacaaagctggaggcatcatgctacctgacttcaagctatactacaaggctacagtaaccaaaacagcatggtactggtaccaaaacagagatatagaccaatggaacagagcagagccttcagaaataacaccacacatctacaaccatcttatctttgacaaactgacagaaacaagaaatggggaaaggattccctatttaatgaatggtgctgggaaaagtggctagccatatgtagaaagctgaaactggatcccttccttatatcttatacaaaaattaattcaagatggattaaagacttaaatgttagatctaaaaccataaaaacctagaagaaaacctaggcaataccactgaggacttaggcatgactaaaacaccaaaagcaatggcaccgaaaaccaaaatagacaaatgagatctagttaaaataaagagcttctagccgggcgcggtggctcacacctgtaatcccagcactttgggaggctgaggcaggcgaatcacgaggtcaggagattgagaccaacctggctaacatggtgaaatcccgtctccactaaaagatacaaaaaaaaaaaaaaaattagctgggcattgtggtgggcgtctgtattcccagctactcgggaggctgaggcaggagaatggcgtgaacccgggaggcagagcttgcagtgagccaagatggcgccactgcactccagcctggatgacagagcgagactctgtctcaaaaaaaaaccaaaaaacaaaaaacaaaaaaaaacaaagagcttctgcacagcaaaataagctaccatcagagtgaacaggcaacctacagaatgggagaaaatttttgcaatctacctatctgacaaagggctaacatccagaatctacaaagaacttaaacaaacttaccagaaaaaatcaaacaacaccgtcaaaaagtgggcaaaggatatgaacagacacttttcaaaagaagacatttatgcagccaacagacacatgaaaaaaggcccatcatcactggtcatcagagaaatgcaaatcaaaaccacaataagataccatctcacaccagttagaatggcaatcattaaaaagtcaggaaacaacagatgctggagaggatgtggagaaataggaatgcttttacactgttggtgggagtttaaactagtttaaccattgtggaagacagtgtggtgattcctcaaggatctagagctagaaataccatttgacccagcaatcccatcactggatatatacccaaaggatgataaagcatgctactataaagacacatgcacacgtatgtttattgtggcactattcacaatagcaaagacttcaaacccacccaaatgtccatcaatgatagactggattaagaaaatgtggcacatatacaccatggaatactatgcagccataaaaaatgatgagttcatgtcctttggagggacatggatgaagttggaaaccatcattcttagcaaactattgcagggacagaaatccaaacaccacatgttctcactcataggtgggaattgaacaatgagaacacttggacacaggggagggaacatcacacaccagggcctgttgtggagttgggggctggcggagggatagcattaggagaaatacctaatgtaaatgtcgagttaatgggtgcagcaaaccaacatggcacatgtatacctatgtaacaaacatgcacattgtgcacatgtaccctagaacttaaagtatataaaaaaaaataaaaacaactgcatgttgtttcaattaaaagcaatctattacaaacaacagatttctctaaaaagtttaactttaggaaaatattgactctgaaaccattttggaatttgatgggctatttgaaaacatcttgaagattctggtttttatatcattattaattgtctttatgttcccctgttccagtttgtattctggataatatctggttctataggcaaattaatgtttaaaacaaaatgatcatctgagataaatgcttaagctgttcttactaaggggtttatagatacatatttttgaatatacaggtggaaatacatatttttactacaaatagaataatttatcttaatttgtgtatttttaagttattcactaaaaatataaagtagaatttgagagaaaagagagaaatatgttatagtgtgcccactagacagaattaacaggaacaaaatatacttacaaaacatttagaaaataaattattaactgtattagcatgagaagctcactggttcttctcagcttttgctctgcagagattatatttagctatatttttatatactattcattttcagtggctaggcagaaagatagattgatcttttgtggttcatttcaatagttttcaaatttagcttggacatttaattaattagcctttgcataatattaattgcttgtatctagaagaaatattttgtgtatgtgtttggctgataggttaataactgaattgagtaaataactgctgtcactactggctccaaaatgtgacattcatatttccttttttttgagacagtctcgctctgtcatccaggctggagtgcagtggcacgatcttggctcactgtaacctccacctcccgagttcaagcaattctcctgcctcagcctcccgagtagctaggattataggtgcccgccaccatgcctggctaatttttgtatttttagtagagacggggtttcactgtgttgtccaggctggtctcaaactcctgaccttgtgatctgtcgcttcagcctcccaaagtgctgggattacaggtgtgagccactgtgcccggcccgtatttgtataatatataatacttgattttggctaagtcttttcatgaagaaaatgacaacactgacactttgtcattcctcagtatctgtgggggattggtcccaggacccccttctgataccagaatccacatatactgaagtccctgatagaaaatggccatagtatttgcatataacatatacacatcttcccatatcaatcatctccagataacttataatacctaatacaatgtaaatgctacataaatagttgcatactatattgtttaaggaataatggcaaaaaattctgtgcatgttcattgtagacacaaccatccatttcttttctgaatattttccatctctggttgtctggattcacgaatgcagaacccatggatacagaatgccaactgtatagtcatgaggaaataatcaggaaaaaacagtaatattctaagtattacttaaattttggttttgaatccattttaacatttttttcctcctggaaagattttatgactaaatttatctgcaaattgtaatcaccaaaataggagttaaggatgcaaaattgtttgttttcattggtactgccaacattttgttattcctgagttcaaacggatacatttaaaagcctctgcaaccaaatgactgtgacttttagctcagtttctgtgagaaaaaaagacactattttaaatcatttttatttattaaacactagctctctacaaaaagcagctattatgatattacaggactataatgatcaacaaaactgtagtagttgtaatctgggcaataaaactttaagcataaactttggaagcagagcctgggtctaacctgataataccacatgtatgctgtgtgaccttatacaggttacttactctctctgaggtaaagtttcttattcataacatgatagtaattttacataaataaccagattaaatgagcaaatatatgtaaggcattaaatacatggtagctttactatttcatatatgcctcagagattcctggctctcaaggcaggagggagaaaatattagtaacattattactaataccagaaggaaaaaaaaataccaatagcatgaaattgaaacaaaatttcctagcactaaattttaaaagaaaatggtttttatatgagatatataggaatatagtacacatcaaataatgtagtggaaaatacatatttttagtgcaagtaaaataattttatgaaatcataatgaaataactattggaaaacatatgaaaagtactgtgtcctattaaatatgcatacttttgtttacacaagaccacaaatttatagaaaatttatttcaaaagctgagagttcaagaaaatcagacagtatataatatttgacctaagactattccactgataatacaagccgaataggaattattgtacactgaattgcaggatcatagctgaggaagacaaaattattatgtctgaatagaccattaaatgacctctgaattctttgacatataattaaaaataaaagcatatttatgccccaaaactaatgctttgtttaaataaaaaaagatgaataaatttactaaaataaataaacaagctaacagaaaaacaatcaaagatgcaaaaagattgtgttgtggaaatgcaatttgctaagcacttgaaaagatacatgggctgtagttattgtcacatgggcagttttgaactttcatatatgcacctaaacacagacacacacacaacagatattaacactatgttcttttttttcttgagactataaaggagctgtttctaaaagataagagaagaatccatcaaaaagaaatgaacacactgatacggtttggatgtttgactcccctgcatctcatgttgaaatgtaatccctagtattggaggtggggcctggtgggaggtgcttggatcatgggggtggacccctcgtgaatggcttagcaccatctccttggtgatgagagatttctcactctgagttctcaagagatctagatattgaaaagtgtgtggcacctccccctccctcttgctcctgctctggccatataacgcactggctctcccttcactttccaccatgattggaagcttcctgaggccctcatcaagagcagatgccagcaccacacttcctgtacagcctgtagaaccatgaaccaagataaaatatattttctttataaattacccagcctcaggcattcctttgtagcaatgcaagaatggcctaatacacaaaccaaatatggttttccatatttaatgggaggaatggaaggtgcgttactctttcttgaagagtttctctacattagacattttacttccaatatttctttaaaaaccttgcaacaaatccatgaaataggtattttcattctgctttgtagataaagaaactgagactcaaggagattaaagaactagtcaactattatacagaagagccagacttcattcccaggcatggttaaattcatgcccaggtttctctccctagttaaaacaagatttgtaataacagcaaaggtaaattccattagacacttttgctcagcttctagaatacaggcaatcaaatagtagtactgaataaagaattattgaataaaacgatacgtctatttcaaaagacagacaagtacagttgccccttctatatttggatatcaactgaagagttattacaaatgaattaaaggatttataaatgtctatggtattgttgaaggaagagaaaaaaatgcctttcaaacaatgtgctaaattatttaatgctgctcaaataggcgcctctgtcctttaatgcaaatacacaaacacacacacacacacacacacacacacacacacacacacacacacacacacggataccaccatagcttcctattgcttctgtaatagattacggcaaaattagtggtttaaaacaacaccagtgtattactgtatagtttgtaggtccaaatgggtctcactgggctaaaattaagacgtagcaggtctgcatttctttctagagcctctagggctgtatctgtttccttgtcttttctagcttctagaagctgcctgcttgcattccttaagcttagtgtcctttcatcagtcgaatctagcaatggccagtggattcttctgttgcatcagtctgacactgactgtcctgccttctttcacttataaggattcttgtaattgcattgagtccacccagatagtccagaataatcaccctatattaaatccttaatccaattacatctgggaagtcccttatcttatgtaaattaatatcttcccaaatttcagagattagggcatagatgtctcaagagaagggggcatcattctgcctacaagaggcatattattgtgttcttttcaatgtaaaattcgaaggatctactacatttaaaaacagaaatgtgttaggatgttcccaaatgacaaatttaggaaaaacaaaattctgttttaatacaaatatgggagctctcaagctctttttatgtgcaaacaacatcactgacagaaagctttaatggtaatactaatcactgagaagtttctggaccaagtgttttctgtgcattatttcaatttactcctgtaataacattgtacatattattgattgtccacattttatcaatgaagataatgaggcttggagggattaaataacatgtctaaaattactcaactaggagaaggcataaataagattcagactgaacccgtaacaacatatagatgtaactatttcactttatggccttaaatttgagtcattttttaaaaacctgaagtaatccttggatttgtgatttatggggagtggggagcaaggcggtttatttctatagtgaaaaaaataatttatttgtatttaggtattaggtatttaggtatatacttctatgcctaggaccacaagaaaaatgaacatttcactgggaaatttctaaaactttctaagtttttataaatacccaggaagccaagaatatagattgctagaatggggacagggaaagcaaacctacttctaaactgcatcaggaaaataatttaaggaatatgtagataatctggttggaattaaagcctcccagtggaagtatttctatatgccttcatttgaaaatatctctttcgctcacctcataacagcttgaggcaaagtaaaaacagtatggatacaagatgagaaatcccatttctataaagttgaggactttttcatcttgcacaaggcggttgaatacaagggcctgctttctcatgtataaactgtagacaaacaataagattactgtgatgattaaatgtcatcataaacaggtatatgtttataatcaccatacacctataaaacattagaattgtctataaaaagtgaaaagtgttatggcatatattctattttcaaaacatttgcatcttttaataaaaatagtggataaattatgtaaaagtgcatataagtgtatgtatagatactatataagtatatattaggatattacaatataattgaaaaagatatataatttaaaaaaatcaaaatcacgggatgatagattattttaattttcttcttttcgtattttatttttattgtatataatgataagtactgcttttctaatttaaaatagttaatgttaatgttatgatggaagactagaagtagagcggaaacagaagtcataaagcatacgtacacgaaactcttgaactttatctgttcctttctatgccttttctaaaatatctctttcatctaaagaacctgtggagatactatgtgcaaatcttcattttcttttcctccatcaacaagccctggcttacgctagtaaagcatacattttttttcctcctgaaataaaataagaattttcctgcttgtttgcgaaatatttccctaggtatattggatttactcgtgaagattcaaccaagaagcaatgaataaagagagaagtggccttgaaaaacacagtctaattattatttatctatatatctttgctgtgttcattagtcatatggtatacaacatattaaataattcattttttgcacaaattttagaagtaatataagtggaagcaatttaactacaactacttagtgtaatgaacattttaaattgagcttttggaaagtgcttaattaatacttgtaaaataggggttcacagttcttgcaatatgtcattaagtccaagcattatctttaatcttctcccaaacttctgagaggagaaaatagtttttgaagcaacacaaattgataaaccttcaaaagttgaggtaatcagctacttacatttttgagcactagtcacagtataaatggaaattaaaattccattatgacataaagtaaaaatttagcactgtaagtttcaagtaatatgccacccctctacaccaaccttaccaagcacttcattcaaccacatttcagccctaatatgactttttttttatttgcctaaacagtatcacttcctcctttattttggcctcagaagtccattttccctccttggtttactattacctccacattccatgagtccttaatagaaatgccaactattgtactcttcacttcacccctggccaaggatacacagctcaagccaggccaatcagattctctcaccttcagatgtgtgatccttgaactgactgccagttgcttgaaggtcattgacctcagctttcttaatggcactgcccaaaaaggaattgctacttgagtttctaagattgctgaagcctctccatgtttttgtttttccttagaccctattcaatttctctcttgctgtacaagccaccaagtattcttctgatatgattcctttagtataagccagtcagaagtggtttctgctgtttccaacttactaaccatgccaaaaatagtttggaatgaccaatttagttcatagcagagaatggacaccatacctccctatttatggaaaagatactggattttttcctcccaaaagacattatgaaatgtagatttttcattttgtgttgcaaaatttaatcaagtattaaattttagtatattttcttttttataatcatggattttacatcattttaatttttttttgaagaaagttgtctttgtttatgtatatacattatccggttgtcaatcaaggtaggtgtattcaaatctaaagccctcagaagatgcctggctgcttttctaacatgtcacaacctacaatccctggtaatacagagaattcagaggaaaatatgagatatctctctgtacacttatctaaaggagtagatgaagcatatttagtatgtgcttattataattttgtgtggttcgaacatatcacagctagcagtagtaataaaaaatacctttttatagagtatttcttatgttacaataagttaagtacttttctgatatgatagtccttaaaattctcaaatacccttatgaggtgtagacatatttaccctaagagaaagttgaagattataaaggttagagaagtttgtaaagatcagaactgggtatggaattcaggcctgtctgataccaaaatcatggatcttaagtaatttcatatatacaatttttatgtatctactttttctctgcttttctattaaggtaattttaaatgggaacaacttaatggtttaataatctgtgttacatagaattttccctagtatagatttttgataaaatttctcctttactgtttgtcctttaaactcaggcatatctgagcatttatgaaatatcatcaaatagggatcatttagaagcaaaactgaaccactaaactggttaaagtatccaactttcttgtgtattttaataaaacacaaatataggtcaggtgtggtggctcgtgcctgtaatcccagcactttgggaggctgggggtgggtggatcacgaggtcgggagatcgagaccatcctggctaacacggtggaaccccatctctactaaaaatacaaaaaataagccgggcatggtggcgggcacctgtagtcccagctactcaggaggctgaggcaggagaatggtgtgaacgtgggaggtggagtttgcagtgagccaagatcgtgccactgcactctagcctgggtgacagagcaagactccgtctcaaaaaaacaaaacaaaacaaaacaaaacacaaatatagcaatctctattaaacagtcttgatggcaagcatatgctgtaagtaaataactagtaacaggctttcaaaattgaaagtgacagcttttaaaataatgatttcctctaaactgcttgtctgtaattatttttaagatattacataggggactaattaggtacaagataccaaaagggataagaacaggaacaagattgattaattgaacttacgaaagttcctgggaataaaaaatgaattagattgggaagaactgactacgagacttgtgttctgaataatgattaaaaagaatgacaagctaaatttatgtttcttatctctgaatcataaaattctgtttttgcttttgcattgaagcaatgtgtacattaaattgaaatgcatgccttataaaatgtaaacattaacaaaattagggaatatttaagaataaattaaattttaaattgtgaagataaaaccaagaaatcttctacctacttaattcccatgttttcttccacatacaagccctttattatttatttggcactagctatagttattgttggcccaagttaactattatccaacatactttctttagtcataatttttctggagtatctgcaacatttgatgtttcagccatttttgacttttcttgaaaccctcttctcctttggctaacaggtcatcactacataaattgtactcattttttccactggtctcttaaatggctattcttttcctctcattcactaaatggaagagtttttctcaaactcagtctttcatttttctctcttgacagcctcagaaagacaaatgagatggggcctcaagggacaataatttttttttcttttgacagcttaatttggtcattgtgagaggttacagcctgctggcagccctcgcagccctcgcttgatctcagcacctcctcagccttggcgcccactctggccgcgcttgaggagcccttcagcccgcggctgcactgtgggagcccctctctgggctggccaaggccggagccagctccctctgcttgcggggaggtgtggagggagaggcgcaggcgggaaccggggctgcatgtggcgctcgcgagccagcgtgagttccggtgggcatgggcttggtggactccgcactcagagcggccggctggcaccgtgggccccaggcagtgaggggcttagcacccaggccagcagctgcggagggtgcaccgggtcccccagcagtgcaggcctgccagtgctgcactcaaattctcactgggcctcagctgcctccctgcggggcaaggcttgggacctgcagcccgccatgctggagtgtccccccgccgtgggctcctgtgcagcctgagcctccccaacgagcaccaccccctgctctgtggcacctggtcccatcaaccgcccaagggctgaggagtgcgggtgcacagcgccggactggcgggcagctccgcctgcggccccagtgcaggatccactaggtgaagccagctgggctcctgagtctagtggggacttggagaacctttacgtttagctaagggattgtaaatacactaatcagcactctgtatctagctcaaggtttgtaaatgcaccaatcaacactctgtatctacctaatctggtggggacttggagaacctttatgtctagctaagggactgtaaatacaccaaatcagcactctgtgtctagctcaaggtttgtaaacacatcaatcagtaccctgtgtctagctcaaggtttgtaaatgcaccaatcagtgctctggggttttggagaacttttgcgtctagctcagggattgtaaacgcaccaatcagcaccctgtcaaaacagaccaatcagctctctgtaaaacagaccaatcagctctctgtaaaatgtaccaatcagcaggatgtgggtggggccacatgagggaataaaagcagactgccccagctagctgtggcaaccagctggggtcctcttccacactgtggaagcttcattctttcactctttggaataaatcttgctgctgctcactctttggttccacgctgcctttatgaactgtaacactcaccgcgaaggtctgcagcttcactcctgaggccagcgagaccacgaacccactgggtagaatgaacaactcctgatgggaggaacgaataaccccagacatgccaccttaagagctgtaacgcttaccgcgaaggtctgcagtttcactcctgaagccagcgggaccacgaacccaccagaaggaagaaactccgaacacgcccgaacatcagaaggaaagaactccagacgcaccatcttttagaaccctaacactcaccgcgagggtccgcggcttcattcttgaagtcagtgagaccaagaacccaccaattccagacacagttggatctgagttagcagaatggatctaaacagcatttctccctgatacaagcttcactagctcatctcctcttaaagagatcattgcctcgacagggaatctcctatcattacactgccagtggatttttgtttgcctttatttccatatttcctttatatttgtagagtaatagtgtttccagtccctggtttctagtcttgagccctttctatggtgtgttcagatgtgtgcaaattaagtttttttctttgtgcttatgggaggtcaagagatactttttcctttgatgctttctttgcctggttttctcacttaagcctcattattttacatttgtaccacgtgagactagcgacgcttggcataacaattccttgacttaagtactcatgctatatgattttttttcaaaacctacctgtcagtcttgaacacctttggaagtccagttccttgtttcctgcaagtttttatttagatcttattcatgtcacccaagatcaaaagtataaaatcatccttgatttcttcctttctctttataaccagtcatcaagtcctaccaacttctcttttgcagttgtcctatattttcctcctctcactggcccaatcctagttctagtttgggactggcctatttatccaattctttttagcattcattctatctctctccaagctattctacatactgagctaactttctcatgttaattccctgctttaagaaacaaaacaaaacaaaaaactgcaagcagttaatcttcctatcagtatttcaaatagttgtgaagaaacaacaacaacaataaaaacagtaaatattcagatttccattttccatttccagatatcttaattaagtaggtttggaaaagagatcacaaaaatatgtattattaaacgagtatctcaggtaattatcaccaggtagttcaaacagttgctttatgagaaacactattttatgattcttttacttatctacttcctttttctcttcactaacttttgtttaccactagggcaattcactgtcttctgaagccactttcaaccaattgccaattagaagaattttaaatttatacaaccaagctgcacctcaaccaccttgggcacatgttctaggatctgagggctgtgtcaagggccatggtcactcatatttggctcagaataaattgcttcaaatgttttgcagagttcgaggtttttcactgacaaagctactctaatttcaaatcatgcatgtctatgtctcttgtatatcaattagtcatgtacttcatgctactacttattgtttatacctatgttatagcttctccaccaggatagaaacttctttaaagcgctaatctcaccttgtggatacgtatccccttacagcacttagaacaaatatgtgatatatatttgttaatttaacatacttttcattatctctgtagcacaaaaataatgtttcaggggccatgtgacaaaaaaacagaatcatattagatgtgcctcaaaaataaagggaacagagttgttgaaagtgaaataataacttaaaaagtactagtctgtttggaagttttgtttatatgtaaatgcaagtgtgtgtgtgtgtgtgtgtgtgaatgttaacattagtcaaagagtaagaagaattacaaggggacccacaaaacctttaccaatccatgtaatgttgtcaaagataataagtaatatctaatttcaaaatcaaaggagcattgtcccagtcattctttaccacttttaccttttaccttggaatacactaaattccattgtttgcccatgtatctattattttattaccactttatatgtttaactcatcaaatgttcttgcaaatctgatacaattcacaattcactgtgaagaattataaaattatactgttattaattagtccaggtcaaaatcagatccattttggacaaaatcaatcatgaaaatatatggttaattataatgtgatcttttatataaacgataaatatcaaaaaggtggagtagtacaacaatagatattataacagcgtttctttgaaagcattagaacatggcatcaaacataatttactagacaaattctgtattgtgcaggaaaaggagtatttactattttctgaaatacatctttcatcttcatagtgttatctatactattctcttctttgggatctatctcacatttttatcttctctgctatcatccacacagcacctgtgataaaatctgggacaaaataaaattgaataatactacatctttttatttgaggagaactcacaggccagatgtatttgttcttgtatgacagggacaatgaatgattaagcaaagtctcaaaaatgagatgacctttaaactgacccttgtagaataattgagttgatctgaaaaacaatgtagaaaggacattttaaaaagagagacttgtgcaagcaaagacatttaggtatagacattccttgaggttaagtgaaaagaatgcaatgaatatagaaattcagaaaagcagttacataggatatgcccagtagaacttcagagactggtgaagttgagacaatgaaaccttctgaatgttcactcctatgtacatcttttctatatggcacttttccccatatttctttttattatgtaagcataatgctgaatttattttcgtctatttaatgagaagctttttttttcttctttcgatagtcaaccagtaagatcagctacttgttaaagttgggaaaataaatattttactaacagaaaaaattgcattatccataagtgataaaaataaataaaaaccaatctaataactatgctaaatctttagcaagttattactttaagtgcagacctgaccttgattatattacaacagaatggggatagccaatgcctacaaccataatcaataatgaagaattaattctgataatttccctcatatctatcaatgttaaactacattttatgcttatgttattcatgtagttgcatctgttttctatttctgcaaaggttgttatttctgtaacataagtgacttaatagattccagttcttctgtgcatagtttcatttgcatttaatagggcttagtgtgcctctactgaaataggagtttttctaaagcaagaggtttagagtgactgttgtatcactttggggcctcattattaatcagtaattaatactctctggaaagcataagtttgccaaaatatttggcattcaatgaatggcattttgaatcccaatttaaatttggactaaaaaggcttagaaaaaaaatctaaattatttactatattaattataagtacgtttccaagaatgaagaaaactgtatcttctctctttagttccaggcttattcttaggtataagaaggagaactattttatgcattcctagattcttaaatattttaattttgcttgcccatggcagcaatatgtttccgtcatgaaatatatattttttctcatatatgcagaaatgtaatatttttctattttgaaaagtctgattatatatcattgtcatcagttcagcaaaccaatttgggatcaatggaagagcactgcctcaatgcatttggtttcagaaatgtattaataatagtgtataccatgtttcaaatcacatttccaaggaaacctattgtgcacaatgcaattttttcttggacagacaattttatgctatgagtccactggaatacatttttgtttcattgaaaatataattttttcaaccatatatttatataagatgcctaaaatttctgaaagaaaaaatgctgttaatgatattatcgtgttaattttcataaactcctctccatattttaaagtaatacattattaatatagtttctaaaacagtggccatatatttgtactataaatataaggctatgatcattcctgggattttaggactaaaaaataatatgtgacaggctacaatattgttacccaagttatagcagggatacttttgttttaagtcagtcaatcataggtaaagagtcattagcattatttgtcacagaccttctgttagaaaccacaaaagtcagaagaatgaaatgtattacaagcttgtaccctacagctaaaacataaaatgaaatcaatagcatttgagttgttttaccctcagtttaaagtttatcttaattgtcttgtaatttattcctgattgaaagtctagttattgaatcaaaacacaatgacatatttatagaaagctatggctttcttttttcatgtttaaagataattataattttaccataaagcaaaaattgccacttcaattatggagttacataaatcaatctgtgctgtaaacttgcatgttactgcttttgctctacataaaagaatgggaatgactctgtggcacaaatattaacataagcttctatagatgttctgggtacaggcttcttgaagcttctttgggaccaagtaacattatatcctaaaaacccaggagagtttgagtttttctgcaaagaaagagactatggataggaagaaaagatgactcataattttgaaataatgtattagaaatagcaacgcattcggctgggcgcggtggttcacgcctgtaatcccagcactttgggaggccgaggcgggcagatcacgaggtcaggagatcgagatcatcctggctaacatggtgaaacctcgtctctactacaaataaaaaaaattagccaggcgtggtgtcaggcacctgtagttccagctactcgggaggctgaggcaggagaatggcatgaacctgggaggcggagcttgcaacgagctgagaccgtgccactgtactccagcctgggtgacagagtgagactccctctcaaaaaaaaaaaaaaaaaaaaaaaaaaaaagaaatagcaacgcattcacatttgtctttccttttgaaactagtccaacagtcccacagacagttgttttcagataaacacagagattggctcttctgctgctaaagcttaaaacttttatttgttttatctgagctctttcctcagcaaaggaggaccttcaggcctctgaaaaaagtttcagttatttgaaacttaccagatcactgccccagaggcctccttgctcctccccagttcttgttttcttacactcttacgtttcttccctactacataaaccccctagctttagtcaatcagggagatggatttgaaactgaactcccatctcctcagcttcaacacccgattaaagccttcttccttggcaatacttgttttctcagtaattggctttctgtacagcaagcagcaggacctagaccaaactcctggtgtttcattaacactttgtaaaaggaagataattatttgatcaaattagtggtcaatatgggagtaaaggaagaaaatacggatgcttaacagaatgagacaggaagaagagataaaatgtagggagtctagagggccagaaagtttgagtgcaggaagaatgaaaaatcaacacctaatttctaactgaattgaagagagagaaaactccaaagcttttcagattccctgcaatttcaagtactgggaggaagctcctaagcacattcccatgattaaaacagtgtactgtctccatctgtaataatgactaaaccactgttatgaaaaggctgcaaatcaggggtggtgaggtgggagtgggcagaactggagcttagttagcagtcagccatcaggtggattgtatgagtggtatgtatgctacaaatttgcatactgttagcttgatatttaaaacgcttcacaatctggccttaattttccagactcactcatgcattggacaaatctttattgggggtatttatgtgccatgcattttaggctattgggatacatcaataaacaaaacagatacaaacttctgtcgttgcgcagactaaatccattttaacaatatccactaaattctgttctacagtctcactgaaacaatattcttaatatgaaaatatagaattataaaactctattattttctttcatactatctctttaatcctgctaatatgggctaatatctttcctgctgttgaataaaagctcaagaaattttataatttttaaaaaaattgttaatagtactatggtaaaggtaactttaaaaagaatttaaaaatgattctctagttcaatatatgaatctaatactccaaatttcatttaaaggtaaaatgtccttccccagcttagatatgttaatggaagttcctctgcctttggggaagaggctgtaagagatttctttttacttttttctttattaactaccaccacctccttcattcactagcagttgatttttatcactcagacttctattacctgaccttggagattatggagaaaaggcatgtaaggtaggtagcgaagttcctacttcaatattactgttgtgaaatggctgaatactctttgggtcagacctgggtttaaaacagacatggtcaatgagagcatcttcagcactggtatgcttttcttcagcaacttcagtttgccagcatacttcagttaattccagtttgtcattttataggaattctgcggtctatgtccagtttttgccttttgcagtatcatcactccttcaggtaatcctaccgaacaggatttaagaaaactggcattcacctgtgtcccaaatctggtcctttgggttggtttgggtataattatgcaggcaaagaacagtcacaggctctttgcctgcatacttatagaagcacagacctttctagatgtagctgtaatataatgtaatactccagtcattgtaattgcttgttgctctttttctgtctacatttatctgatatgtctcaaacatggatttgctgtgctaggccaacataagggcagcgttttttactgtagttgccaatgttaaacttgagaagggaaagcatatatttccccagccattgtattttggggaaaagtatactgttgaagtgaattcaagtacaactttacaacaaccctcccctataaaggaatactcatacaaagtcacttctaaattttaattcgcgtgaccattttcaattctcctcgagagtaatggtgttcagagtgttaaactctgttactggaacatgatggttttggtctaggttctgctgcttgccacacagatgggcaatcactgagacaatgagtattgctagggaagaaggttttaatccaatcgggtgctgcagctgaggacatgggagatcagtctcatggagacagatccctcatggcttggtgttgtctttgccatagtgagttctcacaagatctggttgttgaaaattgtgtggcaccttcccccaccactctctctctcccttgctactgcttttgccatgggatgtgcctgctctccctttgacttccaccacgattataagcttccggaggtctccatagaaccagagcagatgccagcaccatgcttcctgaagagattacagaaccatgagccaattaaacctcttttctttagaaattacccagtctcaggtatttcttttttttttaaattttattattattatactttaagttttagggtatatgtgcacaacgtgtaggtttgttacacatgtatacatgtgccatgttggtgtgctgcacccattaactcttcaattagcattaggtatatctcctaatgctatccctccccccttcccccaccccacaacagtcccccgtgtgtgatgttccccttctgtgtccatgtgttctcattgttcaattcccacctatgagtgagaacatgtggtgtttggttttttgtccttgtgatagtttgctgagaatgatggtttccagtttcatccatgtccctataaaggacatgaactcatccttttttatggctgtatagtattccatggtgtatatgtgccacattttcttaatccagactatcgttgttggacatttaggttggttccaagtctttgctattgtgaataatgccacaataaacatatgtgtgcatgtgtctttatagcagcatgatttataatcctttgggtatatacccagtaatgggatggctgggtcaaatggtatttctagttctagatccctgaggaatcgccacactgacttccacagtggttgaactagcttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgttttttcttgtaaatttgtttgagttcattgtagattctggatattagccctttgtcagatgagtaggttgcaaaaattctttacagtaatgtgctctaatacaaagagatgagcgagaaaatgatgaaaagataagagaagattcaacacttgtatactaggaatctcccagtgagacagaggagggatagaactttgggttcagatcacctctactagagcattatttcatgcagtcacactagtcaccagaccttgcaccactgtaaggtgatggcagcatcacctcactcatgccatccccactgaccacaagactgtgcaagctataagttacctagagaaactaagatgagggacattctaccatacatcttactcaaggaagttggcccccaatacccacatgcacagaaggctaaaaaaatgactgtggtggcaggcgcctgtagtcccagctactcaggaggctgaggcaggagaatggtgtgaacccaggaggcggtgcttgcagtgagcccagatcacgccactgcactccagcttgggcaacagagtgagactctgtctcaaaaaaaaaaaaaaatcacacggagatgtaacatgttaatgagacgtgtgacacatgaagaagcaagtcatcaaactgtgcaaatgctataaattcccatttctacatgctttaatgtcactcctttcatggctaggcctgttaaaattactctcttggctatctccagggaggcagcaagagcactttctcttttccgggctgctttccttgtgctccagcataagttccaataacgcctggagtctgggaaattttcttagccttctgtcagtttctattgcacaagagcataagaacttgtggccagtaacaccagaatagatgccacattaataaaaaaaaaaaagtctagaattaaaaaaaaaatccctaaatgagacttgaacagttatactacatatatagaaaatgacccagaattgccaacatgtagaaatacattgacaaaaatactgaactctaaagaaaaaataaaggcaattatttggaaattcagaaataagaccagtttgtcattacacatttttttacagtaatgcttcaaagaataagaaaatggaatgaaaaatttaatttaaaaaaagaaaatgagtcaagttatccagtcaaattggtcttcaatgttaaagccctaagataagcttttcttaatgcaccaaaacataggaaatagtgtctctataatcctgcatcaaggactttacttgggaatgggttactgataacaaaatgactgaattgtgttattaagagggataaaacaatatcactttcaattagatgtgtgggaaaatataagagatgaagcagaagcattgctcacaacaggaaacatatgagcagtgcaaaaaaaaagtgtaccatgtaatgtaaaagtaagtcgtagaacaaatgtgggcaaactacagccctttggtcaaatccagcccacagacagcctgttttagtaaaatgaattttatgggagcatagccaaaccctttggtttacgtattatctcttcttgcttttaagctacagcagagtagagtagttccgacagagaccatatgacccagaaaactaaacatatttgtcatctcagtattcccattttgagtatgatagtgaatcaactcattattttgaaaatcaataataaaaggaaagaataaagtttttttttcttgtttttcctatagttggtggacctcagggttactgagtatttgctatggagacgtttttctttataaaaatattttggctaatgaatatagaagtaataaaaataaaaaaataatggatttagaaaattactattggtggttgctactatctatatcacaaaaagagaatcaaagagatttaatgtttaaggaaggagtgaatatcacctatgatttatttgtttaaaaacaaaccaaaaataacctggatatgatcaagcctccagatctaactacttatttcctggaaattaaggaagcagaaagaatatgaaatgaccacttggagagacagtcatcaatccaggcttcagaaatgtggtttcttgcacaaataaatatcaaggtgaataaaagagcgtagtggtgaagcctacagattaaaagagacttaacagacctatcaaccaatggcaatgtatagaccttattttgattctgatgtaaataaatgttcaatgtgaactggatatgtttaatatgaactatgtttaataccaactggatatatattgatatcaaataatttgttacttttggcagcagtaatcatgatattttaattgttttaagagtccttaagatatacatatcaaaatatttacagattgaatgttatgactctgacctgcttcaaaataatgcaatagtgggtagttgagagcatagaggaacaactatttcccagggcgtgattatgttgaattagggagttgatacatggaggttcaccgtaatattctctgtaatttttgtatgtttgaaatgttccaagtaaaatgttaaaatatttaaatattcctagtgttaaacttatgaaattagctctaaaattttacattttaattaatttgcatttaaatattaaatctaatcacatcatggttgcacaatttactttgaaaataatttcattaacaaatttttggtaaagaagtcacaataaaatacttctttaatgaattacacttctgatttttattatccttattcaaatgatatgtggtagggcaactaattctgctgcagagatgaatatttagctaactaattaacctcaatttacataatggttgtatttgcataactaatgggctggggattgactataggccattaacagttattaattaatgagattgaattagaaatatatgggtttttatttcaaacttaggaggcaaaggtcaatcataaaaggttaataacaatattcaaagaatcaggcagtaaatattttagcttttagacttcatgcatttctgacaggataattcaggaattggtttcacctctacatgcatactggggcacatggaagtatacacatgtgcattagagaaacttttattagcctcagatttacatgtaaattaaagtaatgggagctagttgtattcacatataagaacttaatgcacctctattcataaaaatcacaggtatcacttgagaaagttctacaacctaaaatttttctttcttaaactgttcatttgtttcaaggaaagagtgcaggtacacttttcaattaatcttcctcatttttgcatttgcaataaaataggttacattatataatttagagttactccaacctttccactcctcatttatccaattcagtttacaattggaagcatcctctatatttttaaaaacataattgcctgtagtttaaagattttagaaactcaaagaattcatctgctatttttaaacaatttaattatgtgagtgatgcataattattgaggacaattcaattcctttaatttcaaagacacctgtataatctgatttttcaaatgatttggttgtatctctacaaggaactgagcagctctctacactgaatcagtaaatgaggttcacgataaatgaaaaggagtgatttctttttatgatcaactgccaaactgatacagaaaattctgtcctgcatcttctgcctgttgctcctgtcttgctttcttttctctcacactgcctgggttcttgctttatgcctctgccctcttctttttccctcttctcccttctaagaacgctcgcttgctgaaatgccttgaaatgatgtccagggatagtccctgggtgaatgtttcagatcctgtttctcatttcacactctgtctgggcctctattctattaatagttaacttaaactggattatcttgagtcttctagattttaaaagggttgctctgattacaaaaagatgattgcttaaatgcaaaagagtattacctcaatagatgggaaaagaatagcatttattgcattattgataacatctttaaatctgtgtcagttcccttcacaaattggcttttatatgcttctctgtgggggtaaactatatgccacagaaatgttgaagttcggagtcacagaacgtgggcttaaatctgtgacgctttgtttactgtcatttaaaaaaataacctttttaattattaacaaaatcttgcctttgtaaaacagggtagtaattctcatttcatagattaaaagtgtaggttaaaaagtgtaaattaaaaatgaaaaatgatgctacatataaattacaataaatgttagtcgctaattttaagatgattttttcttttctcgaagaaaatatgtaaatacaagaagccacacaattcaggcaatttctagaagtcattcattaaaaatatctatttcccaaggtttatccagagcttcacagtgggactaagttttattatttaacatacacagacaatggtggtattttaacaatattggatacacaatttgaaaacggtgttttattatctcgacatttcaggagtatgaaatcactccctgccttgtcatatattagctgtttaaacgaataggcaatcatctcagagtattaatgatctttctatgttgtccactgagaatgatattttagacataggtatttcatttaaaaaattagcagagacaccatacaattctggtaaaagctttaagtagtataacttactttttgaaggaactcggagattggcaaggaccacttccagggaatcagcttggactcgaagtacatagcttgtcctggtctcataatccagaggtccattcacatagataacacctgtgatgttattaattccaaatgtatctagaaattaaaatacaattacctggtcattgtctttacgctataaggaaagaaattctctttaaaaggcactgtgatttcaaaaacactaaaaatgcctatttataactagagtgatgcatgaaagtgacaaaatgctggcttttggaaactgttccagctctttgaatgatcaacatcaatacttcgctaaagtctgccttgaaattgtagggtttttttgtttttgttgttttgagataatcctggaaaacaaagttctatggtcaattacatttgggaaacactgaataatatattctttaccttagattcagatggtcttctgtcacactaaaggctttcagaagttgtttcaaagaaaaccatctaattttgtttaaccaaaattttctgaacttactggattattatactctttgtaatttatgaatattattattttgtagatttagtgttttgctaagaacacttgagagaaaataaaaaaatggataatttaatgttgccctgtgtctgtttatttaaataaatttgaatgaaaatcagggcactttggtaaactttataatatctccccctcttatgctctccatattctctccttactttattttttcatgtaattaataatcccttataatactatatatttctttgtttaataatttttattattaatctccgcttactggaccattaacttccatgagggcaggaatctattttgtacattgttctatctgtagtggctagaagagtagttaatacataatagatgctcagtacatatttgttgaataaataaataaatgtacaacagtcactgtgggggacagacgttaataaatatagccactctgctgtcttcaaagaaaaggacaaatagaatcaaaagagaaagtttcgggacggaacaggttgagaaatcatagctttagtcagatgttcgaagtccaaggaaaaaggaaatttagttatttttagggaggacacatagtagcacagtaataatgtagaaagaaaggcaataaaagtaagatattgaccacttgctacactacacgggcagcaatacctagtaatagtttgtcattaaaaagcttaacagggcctttataatttccttgcaaactcttttacattcactcatttctttaatatttactattgattaacttattacatgtatattaactatttcctgactacctacaatatactaggctatctaacataccaaaagggaaaacagaggagaacttgtggagaacaggtaaaacaaaaattaatgcgaaagattgagctatgaccttattcccagaggcctgcaaattcctatgattcttaaattacaaaaacttatatttttatttttaatcatgaattgtatgtctaatttgactattttgggaatcatataacatgcatagcttttaacatggatgtgactctttttaaaattcacaacttatttacaaccttgaagttccttcaggattagttaaggtatgaccaacatggagtaagggtcatggatggttcagacactggggcggacgaagctactgtaggcaatgatcatggccaaaagctgaaaatttcatgatgcattaattttgaggaaatgtcattaaaatattaccaaatgaggaaaagggcaaggtttcattaattagatacttaatatttcttaaggtacttaatatttcttaagggaaaaaatcactttagctaacatcactggatttttaatcgagttcaggatacatggttaacaattacatttaagatgggcacaattttattagaaaacaatagaatagataataatttcaattcaatctgaaattaggccaaatctaagtttactggttgatggtgagaacacaaactaaaagtctactcaccttcttcatttcctgaaacaatggagtacacaatactttgattaatggcagcagcagaaattacaccaaccatggtccctttggtggcaagttcacttactggaggaggtctgcaggtttagagaagatgatgtatttatttttaaatataatttttgatgtaactttacgttcacagaaaaattgagagaaagataagagatttctgatataccctctgccctcacacattcatggcctcctccatgatcaaatcccccacccaactgctacctttgtgataaatgatgaacctacattgacccattatcactgaaagtccatcatttacatgagggtgcatattgttgttgtacattttatgagtttggacaaatgtgtaatggcatgtatccgctttcatgtagtatcatatagggtattctcactgttctgaaaatcctctgtgccctgtatattcatccctcccctcaactcaacctctggcaaccactgatctttgtagtgtctctatggttttgccttttccagaatgttgtatagctggaatcacacagtatgtaaccttttcagattgccttctttcacttagtaatatgcatttaatgctcctcaacatctatggcttgattgcttatttcatttttagcactacataatatttcgcggtctgaatgtacccacagtttatttccataaataaaaaacatcttggttgcttccaagttttggcaattatgactaaagccactataaacatctgtgtgtaggtttttgtgactctaagatttcaactcttctgggtaaatactaattagcatgattactggattttatagtaagactgtttagtcttttaagcaactgccaaactgtcttccaaactgactgtaccattttgtattctcaccaacaataaatgagagttgctgttgccccatattctaaccagcttttggtgctgtcaatagtctggatttcagacattctaataggtgtgtggtggtatttatttttatttttttatccatatttatgacagagttttgaacttaatagaagaatgtacacggtagttcttccaagctacattatgcaattacattgtgctttcattgaaaccttttacaaaaaatcctgaaatacaaatttagtctgaagtataggctttataaatatctggtccaaattgctttgtttttggtactgctgtccatacacttaattgactaggttatctaaatgtaaagcagtctttctcacagatactctagcacctaatggtggtccatatattcattgcatgagcaataactgcttcttgctgaagaataagaaccaatctgtatcattttaaaatgaagtgtgtaaagtagatatttaatttactagtttatttacttacttattttactgtcctgcattttctttttgctttcttttgataacatccaaatattgttttcaataatcttgcctctttccttctctgtacaagtgctttgggtaaggctttgccaatccccatggtacatgcataagcacattaaccaactctggtcaatgggggcattttatcctttgctcagtgttcatgtgatgtatacgtctcatgtaaattcaatggacatactacataagattatgacttgactagattctcgctagccaactttttgggtatatccctcactggatttgatgaagtaagctgccatatggagcagtcctcgtggcaagaaactcaaggtgatggctgactaacagccagcaaggaatcgaggcccttagtccaacatcccacaagaaactgatttctgccaacaaccacatgtacttggaagtggatctttctgcagttgagcctcagatgagaccgtagccctggatgacaccttgattaaaagattatgtaagtccaaaaaggagaggacacagctaacccatgcctggattcctgacctataggaaattcaaaatgatatatgtgttgttttaacccattaagttcatggtaatattattatgccacaacacaaaactaatatttgaacaatggattgttaatttatgacagatcaagatacatactacttatcaaaagtttaatacaagaaaatatgtcagtcatattaggggataattttcaaaaactgaattcctatttgtggaagtagacattacttaaattgtttacttgtctatcttgttactgcacaagatagaagctaaattttatactttccataattcatctgtttgctattccttatacagtatggaaacaagacgtctgcaacttatgcacctttagctttaacatgagaaaaatgctatgtcgggccgggcgcggtggctcactcctgtaatcccagcacttttggaggctgagccgggtgaatcccctgaggtcaggagttcaagaccagcctcaccaatatctctactaaaaatataaaaattagccggttgtggtggtgtgctcctatagtcccagctactcgggaggatgagacatgagaattgcttgaacctgggaggcggaggttgcaatgagccaagatcacgccactgcactacagtctgggcaacagagcgagtttaaatctcaaaaaaacaaaaacaaacaaacaaacaaaaaaaacaaaacagaaaagaaaaatgctatgtcttctttcaaatattaaaaaatgcacgtgtacatttttgctaaccttaactgcacaattaggatagaaataatactaaaaaaagtaattggcataatttaagaagacatttaaatcctatgcataccactaaaagcatttaaaattctatttgttagtaaatgtttacaacagatttacttctagacaaaatttctcctcattaacctttgtcttaattgttccagtacacttgtttctatcagaactaaaacactatacaaatacaatcttctcccaaaaagaattaaatgaacctccatgataatgagcattagattaaaaatatcaattattttctattttttggcaggattacaatgtacaatattaataaaaataatattattttattattgttttaggttgtggaaagtaccagttacatgatggaggcaaattgcatactctctttggagtcacatatgtcttgaatacaaatgatggagttggtataaatcaggattcattaagccagatggacagagaaggtaggaacataaccaaattgaataaaatgggctgaatataaattaatagggagaggaatggaagttaggaatgagagagtatgtaactactgtacaataattcaagtctggtgtgatttgtaaatcaataaaggaaattgaaaattttgtatatgtttatgaacgatcaatgggaatttatttttttaaagcatcaatgactacatttgatctatgggctgtcagtttacgatttttaaagcagattaactatctctaatgtcttttctagttctaccattctgaacctgatataatgtgagttatcattcactcttctttctgttgagtataatcaaaatctattgctcaatttcagaagcaatgaattatggccaaatgaaacatttctcagaaggttttctaaaaaaatattttctctattaaattcataaatcttcaattcatccatttatgaaaaaaatgcatcactagctctcttccaatttaagcttttcgcacctgatttataacaaataattgtgagtgtctgaaatggaagaatactatctttcaaagctaaatttactgccaatacaactgacaaactgcactcttaaaagaaacacttgaaacagcttcagtaatggaactatacagcttactgatgtagcttgagatagataccaactagatggccattttccaaagatggctaagaggatgctaaaggaaatggttatttagcagatatgaactggaacatgggagaggctagtggtttcatgttttcataatggccttcagtaagggcttcctcaaaggccctttcacaaggcttgacctgaattgggtttgatgtccttgcatatccatgatggcagtgttggttcctatttactccacaacggcaatgcttctaactttcttggccgttttaaacaaaatctacaggctttgactaaaattccaaaatcacctcaactaaaactgaaatagaatccgaaataatatttgttttataaatatatttcctcattgttactatttgcattatccttaccttctaaattttacatgtaaaacagctgtgtattttcaaaattaataatatttttgtttttaataaaaatgttattgagaaataaattaagataaaaatactggcacaatgcctatgcatttcagtatatttatacttcctcccagaaaagttcaatggtctcagaattttttgtattcttatttattttttaattggcaaatagaaattttatatacttatggtgtacaacatgatgttttgaaatacgtatacactgtagaatggctaaattaaactaccatttgactacctcacaagtttattagtggtgagaacatgtaaaatctattcccttagcaatgtacaatattgtacattgttgtcaactatggtcaccatgttgtaaaagaaatctcttcaatttattcttctaacagaaattttgtatcttttgacaaatatctccccaatccttcccttcctacccagccccatgtaaccatttttttacgctctactttcatgagttcagctgttttagattccatatatattagctttattagatcactattagaacatgcagtttttttctctgtgcctgatgcattttagttaacataatgtcctccagatttgagacaaatgaacgtatttgagacaaaatagaatactaaagtctaggttcattcacattgtcccaaataaaagaattcccttcatttttaaggctgagtaatatttcattgtatatatatatatatatatatatatatatatatatatatatatatcacattttctttatccattcattcactgatagatattttgtttgactccatatcctattataaataatgctgcaataatcatgggagtgcagatatctcttccaccaatagcctgatttaaaaatggaccaaggagcagaatagatagttccaaaagaagacatacaaatgaccagtaaatatgtgaaaaaaatgttcaatatgagtaatgatcagaaaaataaaagttaaatctacaatgagatatcacctcacatctattagagtaactattaataaatccacttcatataacttgtgtgtgaatatgtctctcaccaggttcaggcactggtaatactgcagcccagaatgcagtggagggaagcatttgagttcctattccggctggttcacatagtgacactgtgtgctatcttccacacggtgagagttttcccttaggatcagttattagtgaacttccttcacactgacctaaaatgtttctgtttttcgtctactcatctcacttttcacctgaacccctggtaaccaatgatctttttactgcctctatatgtttaacttttctagaatgtcacatggatgaaatcatacagtatgtagtttttttggactggcctctttccttatcaatatgtgcttaagtttcctctatgtctttttgtattgtgatatctcatttcactttattgctgaataatattacaatgtattggatgtatcacaaataactgcacttttgtaagaagaaaactgatcaaaataactccaaaatggtttaaagtaaatatttgcagattaaatgcaaaccgaaaaagttaactgctttggaattcgcatgcacaatacttacaatataacctcatgaagatataaactaattcatacatatcctttttgttttgtttagacggagtctcgctctatcgcccagactggagtgcagtggcgcgatctcggctcactgcaacctgtggctcccacgttcaagcaattctctgcctcagcctcctgagtagctgggattacaggcgcccaccaccacacctggctaattttttgtatttttagtagagatgaggtttcaccaccttggccaggctggtcttgaactcctgacctcatgatccacccatctcggcctctcaaagtgcaggattacaggtgtgaaccaccgcacctggcccatatatatccttttaatatttctaagtgttttttgaaaatatagattacaataaatctttcaactgagtatatattaactaattttctgaataatgactatagtagaataacataatttgcaatgtctaaatgttagacccagtttttaccgtataaatatagatgaaacaattacaatttaaaatctacttttattgttgagttcaagaagtaacaataaaagtaaatgttgtatgtgtcaaataaagcttctaattattttaaaagccaggcaatttaggatataaaagtgtttgtaaatagatgctataaaatttcactaggattcaatctggctctattgctttctttgtactaagagacaaatctaatttattttgacatgtttgagttcaatatatttgcaaatcagtaccaattaagatactgtttttctacctactatgagaggatttaataaaaatgggaagggaagaataaaaaaaaaacacccactagaactccgattatttataatcttggagtaattgcatcagagtgatctaattttacatatttaaataagaaaaacagtttaaaaaagacatgaatcaggagagagatgctagttcttccagaatacttaggatggattttagataagaaaattaatgaagggccaaaagactagacactgctttttacgtatgttccaaagaatgcgtgctttctgtcactaagagttttgcttctattcagttccttaaagaatcttcatctggaggatacaaaaactgaagtataaacaatttatccaaatatttgaaagcaaaaactgcaatctaaggtgtttggtttttcctttgcttaaattattatattgttctcattaaaatagtgtgttctaatctctcatagtcattggctcttaaagcttaaatccataagaatgcgctggagaaattttttaaacttactaaagtacagaagatccctgatttatgatggtttgactttcggttttttactttactatgggtatgaaagtaatatacattcagtatgctcctggacttacaacggggttaggtcctgataaacccatccctgtttgtctactgccctaccttaattattatagagggcccttctcactctcaaaagtgccctgctttggacaataaattatatggtcttacctatgctggaaactatatggatatattaaagtagcaaatttattcctctcgcttgaaaatttacaatttttttttagtgagaccgagtgtacaggtaatcagaattctgttttgaattatacattatttgacattaatatagtaatttctgctttcccttgtttgtaattgccagatatacattttctgttcactctatttttgtgcatgtgattttggtttaagtacattacttaatggcataaaatcatgtgtgaaaagtttaccagaggtaaaaagcattcttagaagattaagtaaatggcacagctattaagcaccggaggagttgggaaatgaatgacttatccattataaattggtgataaaaatgtgatgattttgaatcaagatttaaatagtataaaattctactttccatggagattgtggaagcacaaagtgacttccattaagaggatatgcatatgtcatttgcctgtttaacaccattcaatgtcttcaaatttctctgtgataatgaacaaagtttttagtatgactcagtaagtcccttcacagtccaactctccctacttctccagactcatcaccataggactccatttagtatgctattttgtctcaaatatgtttgcattgattactaataaaataaaattaatgtatcctactgtatgttttacttggatcaaaatttcccatagatacaatacaatgaaataatgggacgtataaaatcactctttgtattgaaaagtttgtgctaaattctaaacagtggatgtaagttgaactgtttggacttgagtcctttgttgaaggaagacttgcttcactctgctacatgagcaaatgccaaaatgtgtataaccttggaaatgtgaaagagaaattaaattccatgtaggtgcacagggaacctatcaaaactgtaatgaaagattgtcagaatcattttgtcaatagttaaatgggcgaaacctattatgtttgaggcaaggttttaatagtgccataaaaagacaggaaaggctatcttcaggtaaagccagctcttacattggacaacaaatctaaattaaaatagaaaacaattttagcaatcgagttatgctctctgcatatgcatttgttttacattattttaatagtcttcagacagctttcattaacttatttgcaatcaagacaaatcattctttccaaactattgttcatcttattaaaatcttttctcaaaatctgtaagtccaaacttggaaggttttataagaatgatagcctgggcaatatagcaagacactgtcactacaaaataattaaaaaaaaaattagctgggcatggtggcatgcacctaaagtcgcagctacttaggaggctgagggctgagatggaagattgcttgcagtgagctatgaccgagccattgcaccacagcctggaagacagaatgagatcttgtctctaaaaagaaaaaaaaaatgatggctatgttcctcaacataaggtaattttaattctctttaataatgaaatgttaactagacctgctcacttgctatttctttggccactgtgataatattacttgcattttcatagtttacaaaaatgaatgccttgattataaattatactttttctgttttgtatatcaagaggtataatgctaatcctttgttaaatatactctaattttattctttaatataaagcttcttgagaaacttattttaagtataaattgtgtaaaactttcaacctgtcatttattacaaaactaattcgtatgaatcaaccaactagcaattttttattttaacagagaaagtggtaagattatcttttgaagaagagttaaagtttttcaaaatttcagaatgttcacatgtataatattctgattttgaatttgatatattaaattttaataataatagaaattgaaaaggacttatagtatattctctgagtttagcaatatatcaacttaagaggttaacaaatataacttagggatatttgcccttattttattatatatataccagtataaattttgaatttaggttgttatggaaattacacttgcaaatatacaaatcttaaaaattaacatgaatgtgacactaaatcatgcaatggttaatattcaagttgatacatttccatttttaaataaaaaacaaaggcctacctatataggtggcatatatctttgaaaattttgcaattaattgtatttggcaaattttttgataaattgtgtaatataatgcatttcccactcaaaatcaatattcacatttagactctatgatctattccagacgtgttgaccttttcatgatatttacttttaaaactgatgacaagtgaatttcagtgtgtataagtcttagtccatcatcctgaaatgaaggtcaaatgtcattctcattcttcagaaggctaacttacttcacctatgggagtcaatgtaatctcaagtagtatgtgtttgaactactattaggattttgctatttctgtagggtttaaatgaaagatatataaaaggaatttaatgactctgacattgtaactaatttctaaaatatataaagagataattgaccgaaaatctcttagtaaatatgaacatgcagtgacaatgagagtatgcctctcagatcttcaactacaggaagcacaattggtcaaggtcccagttactgtggactgaaatctgtttatgtttgtatgaaggacatagttcctaagggctgcttaaggagtcaagtattgaaatgattattaggccaactaaatgatctctatagtctatttcattcattgcataatgtgaatttgagaaaagaatttttatgaataagattaacacatttttctcaatttctaatgaaaaacaaattgtagaaaatgatttaaacaaagatatgcaattgtaaatagatatgaagaaactacctaatcacttgaatggttaaaaaatcaaagtttataattggaatatttctgtgtaatagggatattacccggacttaattcatttccctcccacccccaccaaaaaatgaagctagttggagataattttgagaaagagaggtggaggatgtttcaacaataaagaatgaagaaatgccattagctttttaagaactctttgtttagctctttgttcaaggaaagatagtagagcaagaaggaagaatgatcacatggggcatgcaaattctaagacactaatatcattgttatatctttgtcaaaaatagaaactgaaggaaccaaataaaagagaaacaatgcatgtggaagatttgttacaatttgagatttttggtcgtgtgtatgcttctaaaatatacaaacgtttgtttacagttgtagaaaatgtcacaggatccttgggatgttgcttttccagtaggaagcctctgtggctggtggcacctttacatgaatttttttcaggcctactgggcttgtttcacccactcagcctggcaggcttcacttggcttcttctaccggcccagatcccatgcctgccaagggtgagccaggtgcagagcagcaaggtggggatgagagtgagtgtggggtccaccactgtgcacagccaggcacgctggctgctgtggtgggaagggtggccccaggtgccagcacagatgccagctccatacaagccagtggctggatctggtgcactgcaagcagattccactgaaggcacccatgtctggatgaggagaacgtggtggcacccagtagattggagacaacagaaaccagagtcccaaagacggtgtcatagccctggctcagggagctcctaggtctgggatccctgaagggccacttcgcttctcttctctccttctcattgcccacaatgtggcaagcggggaggcatgtttcagccctgctggtattactgctctttcagtcctgccattcagcaggtcccaagttcttgtcccacatctaggaagaattaggtatatagccatctgaagggtgagcaaggcaaagaggtgcttcattgagcaacagtacatctctcaggagacctgaaataggcagctcctatatgcaggcaggctgtcccgatgtctgcagccctcagtggcgaggagacccagagtgggtagctcctatcctcaagcaggttgtcctgatgtctgcctgagtctggttgagactggggtttttatgggcttcagaagggagaaagtgatattgctgattggtccatgggcagccatgggcagccataggcagcctggagaaagcaccataagttctcactccagtccagggaactggcaggctgggcaccagccttcaggcaatccttggctagaaggtggggtttcaccagacccatccctttccacccaggagcctgtctgccttctgctgccattcatggcacccaggctgtttgtgcccaagaggttcctgcaggcccgctccaggccacccccagccccaccttggcttctctcccatgctcattggtgcccaaagtccagagtgggctgaggtggcaaggggctggtatgtcagcaccacatgagtgtgggaacacacagccaggtggtgacaatgctcggggcttgatgacagctttgctctgaaattggagcaggccctggaagcagggagaggccaggcattgggagaacacactttgagcatgcagcaggaggggggcccaggtccacagtctcagctgggtgattgcacctgcacctgagagctctgggctccagcccctccaactcagaagtgggtggggcccctgcctgttctcagctctcactgactctgcagagtgcatagccccagctgtgtttccctggttgcagccagcgtctttgcagcaaatgctccagacaggtcgctgttgtcatcaaaaggaatagtatacagtatgaagagatatatatttcaaaagttttaagaagaactcattgttttctggatagaacaattgatcattaatgacaaatgaagcacacaatgtcttgatcctccatttcacctaagtgactccataaaagattgatgtgaaaaggtcaagaaattaacaaaatgagtctgtttcaattactataacagccctacaaagcaaagagaatcaagtgtatagtaattcttatctactataactctggccattataaaagtaaacatatgaggcaattttcttgccattatgtgattactcctacccttaatgattattgaaagccagccaccaggaaataacatcagttcacaggatttgaaaaaaaaaatcaaatcttttcccaatacatataaaatatcttaatattataaattataaaccagaaaaacatcattttccttgagaaatgtgtttttaaataatgacaacctaatttattttattgagtatagggttgtctttgtaaaattcttcaataattttcaaacttcattaagggagcattagcagaaagtaaagaagtaatttttttgttctgttttgttttgttttgttttgttctgagacgaagtcttgctctgtcacccaggctggagtgcagtggcgcaatctcagctcactgcaagctcagcctcttgggttcatgccattcttctgcctcagcctcatgagtagctgggactatgggcacccgccaccatgcctggctaatttttttgtatttttagtagagacagggtttcaccgtgttagccaggatggtctcaatctcctgacctcgtgatccgcccatctaggcctcccaaagtgctgggattacaggtgtgagcaactgcgcccggctgtaaagaagtttttaaatatgcaaatgaaacagaggcagagcatgattaactatgtggaagaaggggctggttttttattatgttgttacttttacataagtcagaaagcctactaattatctgtcatcaaaacttcacaggcaaaccagtaggtttttcctttagtaaatattaaagtacttactgtggtgtttattacttgtgtctattattttgctattttacaattttggaagaagacaatgataggtctattgttatattccagcaactaatcaattaccaatagaacaacatagaagtgctttcaattctaaaaaaagaacaatggattttgtttctctgtctagctagaactggtatactgaaaaacgtatgccaaatagtaaatgcgaactctgaaccatttttgatcaaggtcttcacaatgctagttttcagctcataactcaaatttacactttgccattatgctttcatttttattttctttatattttacttctgtgaccaagacactgcaacttctcagaaaactggagaaagtaattcattgtataaaatattcaacctttagcttgaagtccagaaaggtttggcttggaatatgtaatgttaatactcattaaactgaaatcactaaaaatacagatttttaaaacaaccagaaatgttaatctgagatttgctttgaattaagaaaataaatattcattctcttgatattttaagaacaatttacttcactaacgcatatttaaatgtaaaaatgtttctattctatcattagctcatgtaccccatggtgcattctaactaatcagtcattttaaaatcactgtggcaattaaaatctatgaatctgtaaattgtttacaatcacatgtttaatgtgctaggtcttcacctacaccatttcccctttttcctcaacaactgaggttgaactaggacacagttgcctagcaaggaacagcattcctctcccctagttagagctaaatgtagacccgtacctggattctcacaacgtaatgtgagctgaactgaaatgtgcaattctcacctcacttggttaaggaaatctctagatgtggacttctgtctggtttcccctttctgctgactaaaatggtaataatgagttattttgaaatagagtgttgaagatggtgacccctgagttgtcccaggtccctgaactttaaaccattgatatttggtggtttcctattacagtgacctaaactaccctaactcagtctgattaccctgagatttaatgatttaatgactgtctaatagaaataagtcaacggagtcagtgacagaacggggacgtatgggtcaataattcagttaaacattctacgataaataaatactttatctttaaaatctctcttttatacctaatcatttgttaaatgctaatttttcctatggaattcaaacacaagtattggaacgaagacattcctgagatgtaaaagccatgtgtacctcagcttacagtgctagattactgctttccatttgtaacacattaccttcccctacaccctacaaagaacataaatcttgagctatcatttttatatttcccccaaatttgatcacaagaagtagaagttttttcactaggagcaatcccaacacgaaagaccatcctaataatcaaaaattaataatgtcatttagcatctctgggaataatgtgcatccagttgaggcagtaaaatgaatttgaaaaaattagagaagaatgaggcatatgaggttggcagaaaccattctgtgcttcactttttttcattaagaaaggaaagtgtgttggcctctaaagcagcctgaaatggcataggcatattgccaaagctagcaattgaacatattaaaagaaaataccatacagaaataaaaatattctaccatgaatattttcatatttccatatattcatattttgcaatatgaatgagaatgacttttaaatatgattaattaattatgcgattagttgttggaaactaataaaatgttgaacaacttatattagttgaaacaacagtagctaataggactaagcctgctcaggaaatgatgcagaccacttagttccatatttttttggccagaaatcagtcaaacggcagaattcagaattcatccctagttaataaggagaggaaatgtaatccagctatatgcccgtgagaaaaaggatttaggaggcatccagatactgctatgtatttcctcaatggtcttcaaaaagaatgaagagataattgaagatgataatcattagccttaagtttctttatagttcagttaaaattttggttcaaatttagacctatataaacatttatattcaattatttgcatttatccaaaaagtagtgtccttgttcatatttggcataacatttatttttcaaattttctggttatttgataaaaaattaatccttttaagtactcaagtactactaaatgcattatgatcaagatactgattcttagcatctctgggagttatgtgtgtacagttgtgtatattattaatacacagtaggatgcaacaagattaccaaattctctttataactcagaataacaaatgaactgggataatcaagggcaattttgtaattgttagaattctggaagatcaaaattctcccacatgtacccatgtgactgttgttaattttagtaccatataattggctaacttttgctctctaagttaacaacaactttattaagagaatctatttgtagttaatagttctatgcagagacggtatgaaatggtaaattatacgttgaacaacacattcgcatttttaaaacatggcattaagcaaagatacttaataaagaaagttaaatgagcaatgccctgtttcaatttatgaccttggcctcaatgccacaatattttagctaaaagagaagtctagaggcatatttctattgacaaggaaatgagctctaaatgaaaacctagagaaacagtacaccacttaagtttatttaaagaggaagtttaagcaatatatcactttcttctcttggagtttccaaagataattagacttgccgcaaggggctttgaagaacacagatgggaattttaagttaaaactgtgagcgtttttttggatccacttagaagactaagtatattttttgagaacacctgatctagataatttagtgagaaacaaagtgagtttatatccgtcctgttcttgagaactccaaaattaacatgttcagagaagttcttccaaaacagaaaactgtgcataggagtccccctttatttatgggggatatactccaagacctccactagaagcctggaacttcagatgacaccaaagcctatatttactatgtttttttttttttcctgataacccagacagttactaagtgactgatgggcagcctggatacaatggacaaaggaatgattcagctccagggcagagtgacacaggacagcacaagatttcatcatgatactcagaatgccatacaatttaaaacttacgaattgtttatttctggaattttccacttaatattttctgaccacggttgacctcgggcaacaaactgtgaaaaatgatactgtggataaggaggggactactgtattccatagcaaagaattggaatccaatccaaaggattggaagcacaggttactgtgtcagaaaaaaaaggaaaataatagataataatgtacatgtgggtgagaataaccttttaaaacagattaaacaagaattcttatttgttttacatatggtttacatctcgatgatttacatacatgctatggaagattttctggtaattatattacataatttaattttgtgtagattcttctaaacgcagctttgtatgagaggatgaaactgcttggttcagtgggttaagtgcttgcagatgtatccctcacctaccttattcctcagtaccttagctgctgttctagcttaaaattattaattcattctaagaaagtaaaaaacactaaagtcatcctagaacatgatcaagttctccattacctgaaatattcatttttcattatcctcaattattatcatcatccaactttcaatttttctttggatagactaaactactaaaatattctggaatttaatgtagactcccacaccccttatttatatttctgcataggctgaatatttggtgtggaatatccatctatatctttttggattgactaaactctacatttccttcaatctacaacttaaaactgtgttaatcatgttcaaatatagttaagtgtcccttagcctgcttcctcaatactgtgatcttatttctaccattgtgttctcacagtgtattatatttttcatatagttatttgtttccagagataccagagagcttgctttctctctctctctccagataaggacatggcaaaaaggcagctgcctattaagaccagaagagaccctgaacctgaccatgcagacaccctggtcttaaacttggattgtcagctaccagaacaataagaaaataactttctgttgtggccgggcacagtgcctcacgcctgtaatcccagcactttgggaggctgaggcaggtggatcaggaggtcagagatcgagaccatcctggctaatgcagtgaaaccccacctctactgaaaatacaaaaaattagccaggcatggtggtgggcacctgtagtcccagctactcgggaggctgaggcaggagaatggtgcaaacccaggaggtggagcttgtagtgacccgagattacgtcactgcactccagcctgggcaacagagcaagactccatctcaaaaaaaaaaaaaaaaaaaaaaaaaagaacagaattttctgtcgtttaagccacccaatttatggtattttgttatggctgcctcagttgactaaaacagtatatatactaaccataaactataatatataatattggtgtatatgcatatagtgtatatatataaatgtatatgtattatatatgtgtatatatagtgtgtatatatatatacacacagtatatatataaatttatgtatacacacagtatatataaatacacacactacatttatatatatatatacacactatatatatacacatgcactacatatttacacacacaaacgtacacacatacacacatacacactgattagatggaaaatatgattgcagattgcatgccaaaattggaaattgaatgaaatgttccacctggcaataatgagaaactaaagatctatttctcaccattcagatcattaattagaattgaaaccccaaaatataatgttgtattttaataagtttgcactaattttttaaaaagtatccattattcattaaaccattactaaaacatattttatactaaattgtcatattaaccatttaaaaatttaaactatattttatgttaatttagaaacgcctaaaccaaaattggaagtctactcataaattcatattacatcaattttgagagactcctttcaaaaatgccctaaacatttcgtgtatttcaaaatcggacagaaatcaatacctatattcctcctgtgtgaagcgtgggatctcaccaggatgtaagacaagaatcttcactgtggcactgctggacatcacaggctccccatcatcaaaagcaaccaccaccaacttaaaaagcaataaaaattcatgttaaagattataagtaagaacagcgtaacagcacaatttttatatgtatgtttttacttattggattgcctggttccagaaggggaagcaatgatcatttcctcactgcctaccaggtggcagacactatgctagaaaatactacgttctcacttaatctttacaataatccagccagataaatgttattattttcacttgctagatgagaatactcaaagaagtaactaactctatgattaaaaaacaactaccagtaaaacaagtgtattatactatatctctccaattaaagactcatttctataattccactgaagcccacagtaaatacacatgattttatagcaccaatacacttatttaagaagtgttaaattcagacacataaaaagctaattatcttgctcaaaaaagaaattaattttcctagtgaattagttgtttttgagattatagggcagaaatactttactctagaggataaaattggaaatctttatagtttaacactctttggtatactatctcttaaaaacaaattataaggccaagttcatttggtatagcagaaattgttcaaatgatgaaaactaagaaaaagctttagtgttgagatgtgatgtctgacattatttatcactgcaataggatttataattgattattttctttaataacctacattacatcaaagtaattctatgtttactttaagacatgttaaatactttcagaactatgtgcttctttggaatataaattgttttggaagctgcaggttaacaatgtaaactaattcaacctagatcacagaagactgtaaccaaggatcatcctgagagccacaattgacctttgggttaatgctaatttacaaactgatcagctgttccaaacagcggtaaaatcatgagagacatagtgctcactgatccttacgtggttaactgataaagctatttccctactgtagagtcaaagactttattcacagtgacaaaaattattctaagtaactattaaaaatggaaatgttcaaacacttaataaaattgtctacttatggtaatgcaaattattgttttaataccttgccaggtagagacaggcattattttgtcaaatatatttttaaatatgtaaaaaacaaaagagggaatatgttctgtttcattagtatttgaagaaaagtaaaatttgacaaaaaatcaaatagatacagatattttcctagatatatgcaaagattaacataacaacaatcagtattgagtggtattaggaaaatggatactctcaggaaagatgaagaatgcatacaaggggtatttttttcaaattttctaggattgtaatatatcaatcttatcttaaaaaagtgagtaagggaaaaatgatattcatacaagtagttgcatgatagcatttattgtaacaaaaaatggaaagtctaattataaagcaactcagtattatattaaaaagaaaaacaaaatgttatatagtaaaatactatgaaaccactaaaataatagtattaatgtcacttattggcatagacaacatcatattgaatttaaaaaccagtatgtataagactatgtgatttgaaaacatatatttatatatttgtgtttgtatgaaatgtcatcatgaggatagagatcaaaacgcaaattctagctatttccaagatgtgagataccaagtggttttctttttactatttttgtaagtttctaagagaaaaaaaaattgtaatttaaaaaaattaaaaaggagaaaaattgaaagaaaaaaatgtgctgtcatctgttaagccaaattctctatcaaaaattaaacatcaaatagaccacataatgaaaagagacactgaccttaaaaattgttgtaggttcttcattaagattgactcgtgttattactcttccagaatcttcttccacttcaaaaatactggcagggtaaggaaactgtacatcatctactctatacctcacacgacttgcaggtaatccctaaaataaaattattaattattaatttgctgttaccaagttaaaacacagtgcaatgataatattaaatggatctttaaaattcatggtcttttagaagtgaaaatcatatttccatattttcattctttcagagctgaaatgtagccagatcattatttcttcatgataactcaatctgaatcaatgaagtatctctactacaggttattttaaaatgatttatatgagagaaaaattaatggttgctttgggcatcttctctaccactttcctttaattatgtgaattacatcttcctcccaaaacacccaatatctccttttttaaattcagagacagggtcttcctttgttgcccaggctggagtgcagtggcatcaccatagttccccataacctcaaaacttctggtttcaagtgttcctatcccactttagcctcccaagtagctgggaatacaggtgtgtgcaaccatgcttggctaatttgagaggactgtagtaaagtgcaggaatggacatgaaagctaaaaaaacaaaaattatttaccatctacactgtgttgattaccatgctaggtatttctatacatcattaggttaatgctcaatcttttaagatgacattaataatgaagatgatagtaataatggtaagttaatgacgctaacaattgctagatgcttaccacttgccggaaccacattaaagatgatgtatgtgtactctgttacccattttagagctaaggaacttgtggcttacaataagttaaagagtgctgaaatattccagagataggccaagataagttgggacaccaaacaaagtcacttttaaagaaaacaattaaaatttgataagtttttaaaagaatcaaagtgattgtaaaggaacagtcaaaattttgctggctgtcctcacttatattaggtttcagattggtttcctttggaactatgtagggtgacattgaggtgagcactgtaacatttacagtgcttaggccttgtaaatttcttaaaacctagaagtcaaataaatatcttgagcagagaactagtatgtggtaaagttttacttcaaacctaaacactaaattacaacattaacttcttcagagaaagaaacactcctatttggcattattctgatgaagaagaagtaagaacattaccccccacagggtgttgatttggctggacttgacactttggtgtaaaaactgttctgagaacattgctttttatatttccattttcttcaagactgtccttgaaaataatctgttgctcatgttggttcctgaattacagttgggctatgagataaatatgagttttcaggatttgtataattccctattttctgttagttcagtcctttcatatactacacgtcaccactgatgactgtctccttgaatacattctttatttaacctttttccactattctgccttttctccttcccatctggtgctctgtctcagactctgcttgttcccactctttctggctactaaatgttggagttttccaaggctctgtttcaagaacttctacattttctacttctactctcggcccctggaacctctcccagtctgatagcttcaaatatcttctatttgttcataaatatcaaattttaatatctggctaaactctgaacattttaagtccaaactagtacacataattgtccacagatatgctattttcaaataaatgtattcaaaaccagaatgatttcatctcccaaatttataactcttctactatagataatggctctaccttttactaaggtgttctatctgaaagcctaggggtaatcattgatcctttctcttaagccccatagccaaatcatcatcacatcctgccaatacctcaatgagtataggccctaatgtcttctcatatcctctgtgttttctgtagtagactcttaattgactttctgcttccattgtattaaaattatctcatgactcctgcttaaacccttccaatgattttgcatcacacacaaaaaaaataaatacaaagttgttagtaagggcaatctgatcctaaaaacatttcttttttgcctactcatctgatttcatcttgttcatttccctttcacacattttccttgttcctgcctccttggctttgccaaggcaatagtcctttaccaggaaaataaggtggcaatataatacactcatctctcagatttttggctaataaatttaccttcctcttctccaggcgttctctaatactccctttaaattatctttcttcagcaaccctgtctgaaattatagcatatattttatgtatttacttgtttactgtttgtctcccacataagaatacaagctttattagggtagggactgtagctgagtaccttgaatgttacctgacccataatatgtactcaaggagtatttgaataaataattttttatttataaaaaaatttatttataaattttatttattcataaaatttttataaattttatttattcataaaatttttataaaattttatttattcataaaatttttataaatttatttaaaaattatttataaaaattttatttataaattttatttataaaaaatttatttgcataaataagtgaatggataaccacacatcaagggtgcccagacacttcaactgatatctaaagtattcatatatttgaaggtttgggaaatagagaacattgaataaaccttgaaagcatgttagggaactgccagttctgggataatatttttatataaaccactgatttcacctagtggtggatggtcagttcacccactgaagatttatagaaacaaggacacatttttttagaaaaactttggcctatatggacagaatcagacttattataatcatatacaatggcaaaccttgtatatgatttgcttgtgaaagagtgggggtttagcagaagacatcgtaggacttggggcacagtgtcatgcaatgtcagcaactttgcttgcatttgaataataatgataataacaagagttgttagctatcagtttgagtattttactatgtatcagactgcatgtattacatgcattttcatacctacaataagttcagaagttggtattaatagtacctacatttttttttttttttgagacagagtcttgtactcttacccgggctggagtgcagttgcacgatctccgctcactgcaacctccgcctctcaggttcaagtgattctcctgcctcagcctctcaggcagctgggactacacgagcccgccaccatgcccggctaatttttttctatttttagtagagatagggtttcactatgttggccagccaggtcttaaactcctgacctcatgatccgctcgcctttgccttccaaagggctgagattacaggcgtaagccaccgcgcccagccctactacctatatttttaaaataataaaatctaggctttaagaattatcttctgaaattttcttagctggaaaatgccaaagttattaattgaacaaacttggctcacactaaaaccgaagtcttttaataacaaatcaacttaacatttttcagtactatcttaaaggcaatagtcctttaccaggaaaataaggtggcaatacaattgagcaaaagtgcttggcaaagatactatagaatttgataccctagtaaatctcgccttagaacactttctaagaggttatgcagcacataattcaagtcacctccagaacaggaggtcaatgatgaaagaggataattatagcaccaactgcttcaagaacaaatttttagagtttttgctagcatgaggacccattcagtctgtaggacggtgactaaaattacttatgacaatcagattggctctcaaaaacataaaataagttaattatacttagaatcttctttttaataaagccaaaatttttttttgcatatggaattatgcctgtaattgataaaatgaaaaagaaaacatgctggtattatggaatgttatctctcagatgcctaaaatagtttgctatccagaacatcttagaacttcctggatgatttttacagataagattgtatgtatataaatatgaacatatgactaaaatagtttgctatccagaaaatcttagaacttcctagatgatttttacagataagattgtatgtatacaaatatgaacatacatgttacatagtgactacatcaataaactttttattctaagattgcaattattctatagatataccacaccatcatgaaagtgtggccctgagaggactcatttagcctgcaagaaacattttgattcttttatcacccttgttatcaaagcacattttattttatatcacatattatgataactatactaaataactaaaatgatgtagactttcctctcaaaacatttaaaagtttttttctctctctgtcctttcctaaaatcttccttcccttcttcccttctttttgctttcccttcctccctcctttcctttctttacttctttccaaagtctttttaaaatagttgcataaataagctatataataggtaaaggtaataggctttgggaaacagctctaattcctaatattatttctgggaaatttacaaaatgaatcaagtcaaattcattgttttaagaaattataaaaatagctgtggctttaatcttggaaaaaattgtcattttgaaacccagaatttcaagtactctaaaaaagttataaacttgatcacttaaaattatgaattagcatttattaagtatcttttaatactttattccactaaaatataatagatatgatcgaagtattctaatgtataaaactcacccttattagttatgttttaaaaactaaaataatatagtaaatgagtttatgaattatatattttaattattatatatgtgacaattaaatatttaaataatcattcatatatatatgtatatatattttaaagacaggatcttgtgttgtcacccaggctgatgtgcagtggcatgattatagctcactgcagctcacacaatctttctgcctcagcctcccaagaggcttgatatggtttggctttgtctccacccaaatttcatcttgaattgcagttctcataatccccacatgctgttggagggacctggtgggaggtaacttaaacatgggggcagttaccctcatgctgttcttgggacaatgagtggcttctcacgaaatctgatggttttataaagggcttttcccccttttgcttggcactcctccttgctgctgccatgtgaagaaggatgtgtttgcttccgcttccaccatgactgtaagtttcctgaagtctccccatccctctggaactgtgagtcaactaaaactctttcctttattaactacccagtcttggacagttctttatagccatgtgagaatggattaatacatagctggaactacaggtgcatgccatcatgctgaactaattatttttaattatttgtagagataaggatttctttatgttgcccaggttggtccagaactcctggcctcaagtgttcctttcagtttggcctcccaaagtattaggattacaggtgtaaaccactgcacctggcctagacaaacattaaatttccaaatatttgcttttattttaaattgtattaggaatagacagaagtctcttttatatatacccaataagttaatgtttctttcaattaaatacttcaaataatcatattttttaaagtaaactatagaaaacatttaaaatcaatatgaaaattttaaatattaatttctacttcattcatgataatatagtatgtatattctaccgtatctctctatgcatagctgtatatatgtcaagaggaattttttggaccatgaataatgataaaagctatctatttacaagtaaatcaatatttggaggaggttccaagatggccaaataggaacagctccagtctacagctcccagcgtgagtgatgcagaagacaggtgatttctgcatttccaactgaggtaccgggttcatctcactggggcttgttggacagtgggtgcagcccatggagcagggtggggcattgcctcacctgggaagcacaaggggttgtggaatttcctttcctagacaagggaagccatgacagatggtacctggaaaattggtacactcccactctaatactgcgcttttccaacagtcttagcaaacggcccaccaggagattatatcccacgcctggctcagagggtcccacacccatgaagcctcactcactgctagcatagcagtctgagatcgaactgcaaggcagcagtgaggctaggggaggggcatccaccattgctgaggcttgagtaggtaaacaaagtggacaggaagctcgaaccgggtggagcccaccacagctcaaggaggcctgcctgcctctgtagactccacctctgggggcagggcagagctgaacaaaaggcagcagaaacttctgcagacttcaatatccctgtctgacagctttgaagagagtagtgcttcccccagcacagagtttgagatctaagaacggacagactgcctcctcaagtgggtccctgacccccaagtagcctaactgggagacacatcccagtagaggccgactgacacctcatatagccggacgccactctgagacgaagcttccagaggaaggatcaggcagcaacatttgccattctgcaatgtttgctgttctgcagcctccgctagtgatacccaggcaaacacggtctggagtggacctccagcaactccaacagtccagcagctgacggtcctgactgttagaacgaaaactaacaaacagaaaggatatccacaccaaaaccccatctgtacatcaccatcatcaaagaccaaaggtagataaaaccacaaagatggggagaaaccagagcagaaaagttgaaattctaaaaatcagagcacctcttctcctccaaaggaacacagctcctcactagcaatggaacaaagctggatggagaatgactttgaggagttgagagaagaaggcttcagaccatcagtaataacaaacttctccgagctaaaggaggatgtttgaacccaccacaaagaagctaaaaaccttgaaaaaagattagacaaatggctaactagaataaacagtgtagagaagaccttaaatgacctgatggagctgaaaaccatggcacgagaactatctgaggcatgcacaagcttcagtagccgatttgatcaagtggaagaaagggtatcagtgattgaagatcaaatgaatgaaatgaagtaagaagagaagtttagagaaaaaagaataaaaagaaatgaacaaagcctccaagaaatatggaactatgtgaaaagaccaaatctacatctgattagtgtacctgaaagtgacagtgagaatggaaccaagttggaaaacactctgcaggatattatccaggagaacttccccaacctaacaaggcaggccaacattcaaattcaggaaatacagagaacgccacaaagatactcctcaagaagagcaactccaaggcacatgattgtcagattcaccaaagttgaaatgaaggaaaaaatattaagggcagccagagagaaaggtctggttacccacaaagggaagcccatcagactaaaagtggatctctaagcaaaaaatgtacaagtcagaagagagcaggggacaatattcaacattcttaaagaaaagaattttcaacccagaatttcatatccagccaaactaagcttcataagtgaaggagaaataaaatcctttacagacaaacaaatgctgagatattttgtcaccaccaggcatgccttacaagagctcctaaaaggaagcactaaacatggaaaggaacaaccagtaccagccactgcaaaaacatgccaaattgtaaagaccattgatgctaggaagaaactgcatcaactaacgagcaaaataaccagctaagatcataatgacaggatcaaattcacacgtaacaatattaaccttaaatgtaaatgggctgaatgctccaattaaaagacacagactggcaaactggataaagagtcaagacccatcagtgtgctgtattcaagagacctatcttatgtgcagcgatacacataggctcaaaataaagggatgaagatctaccaagcaaatggaaagcaaaaaaaaaatagcaggggttgcaatcctagtctctgataaaacagactttaaaccaacaaagatcagaagagacaaagaaggccattacataatggtaaagggatcaattcaacaagaagagctaactatcctaaatatatatgcacccaatacaggagcacccagattcataaagcaagtccttggagacctacaaagagacttagacttccacacaataataatgggggactttaacaccttcaggtcttcagagcagaactgaaggagacagagaaacaaaaaactcttccaaaaaatcaatgaatccaggagctgtttttttttaaaaaatcaactaaattgatagactgctagcaaggctaataaagaagaaaagagagaagaatcaaatagacacaataaaaaatgataaaggggatattaccactgagcccacagaaatacaaactaccatcagagaatactataaacacctctatgcaaataagctagaaagtctagaagaaatggatgaattcctggacacatacaccctcccaagaataaactaggaagaagttgaatccctgaatagaccaataacaggctctgaaattgaggcaataattaatagcctaccaaccaaaaaaagtccaggaccagatggattcacagccaaattctaccagaggtacaaagtggatctggtactattccttctgaagctattccagtcaatagaaaaagaaggaatcctccctaactcattttatgaagtcagcatcatcctgatactaaagctggcagagacacaacaaaaaaagagaatttaaaccaatatccctgatgaacatcaatgtgaaaatcctaaacaaaatactggaaaaccaaatccagcagcacatcaagaagcttatccaccacaatcaagtgggcctcatccctgggatgcaaggctggttcaacatacgcaaatcaataaacgtaatgcagcatataaacagaaccaaagacaaaaaccacatgattatctcaatagatgcagaaaaggcatttgacaaaattcaacagcccttcctgctaaaaactctcaataaactaggtattgatgtaacctatcttaaaataataagagttatttgtgacaaacccacagccaatatcatactgaatgggcaaaaactggaagcattccctttgaaaactggtacaagacagggatgccctatctcaccactcttattcaacatagtgttggaatttctggctagggcaatcaggcaggagaaagaaataaatgatattcaattaggaaaagaagaagtcaaattgtcccttttttcagatgacatgattgtatatttagacaaccccatcatctcagcccaaaacctccttaagctgataagcaacttcagcaaagtctcaggatacaaaataaatgtgcaaaaatcacaagcattcctatacaccgataacagacaaacagagagctaaatcatgagtgaattcccattcacaattgcttcaaagagaataaaatacctgggaaccctacttacaagggatgtgaaggacctcttcaaggagaactacaaaccacggctcaaggaaataaaagaggacacaaacaaatggaagaacattccatgctcatggatacgaagaatcaataccatgaaaatggtcatactgcccaaggtaatttatagattcaatgccatccccatcaagctaccaatgactttcttcacagaattggaaaaaactactttaaatttcatatggaaccaaaaaagagcccacagccaagacaatcctaagccaaaagaacaaagctggaggtatcacgctacctgacttcaaactatactacaagtctacagtaaccaaaaacagcatgatactggtaccaaaacagagatataggccaatggaacagaacagagccctcagaaataataccacacatttacaaccatctgatctttgacgaatgtgaccaaaacaagaaaaagggaaagcattccctatttaataaatggtgctgggaaaactggctagccatatgtagaaagctgaaactggatcccttccttacaccttatacaaaaattaattcaagatggattaaagacttagatgttagacctaaaaccataaaaactctagaaaaaaacctaggtaataccattcaggacataggcatgtgcaaaggcttcatgactaaaacaccaaaagcaatggcaacaaaagccaaaattgacaaattggatctaattaaactaaagagcttctgcacagcaaaagaaactaccaccagaatgaacaggcaacctacagaatgggagaaaatttttacagtctacccatctgacaaaagggctaatatccagaatctacaaagaacttaaacagatttacaagaaaaaatcaaacaaccccatcaaaaagtgggcaaagcatatgaacagacacttttcaaaagaagacatttatgcagccaacagacacatgaaaaaaatgctcatcatcactggccatcagagaaatgcaaatcaaaaccacaatgagataccatctcacaccagttagaatggtgatcattaaaaagtcaggaaacaacaggttctggagaggatgtggagaaacaggaacacttttacactgttggtgggacagtaaactagttcaaccattgtggaagacagtgtggcgattcctcaaggatctagaactagaaataccatttgacccagccatcgcattactgggcatatatgcaaaggattataaatcatgctgctataaagacacatgcacacctatgtttattgtggtactattcacaatagcaaagactttgaacaaacccaaatgtccatcaatgatagaccggattaagaaaatgtggcacatatacaccatggaatactctgcagccataaaaaaggatgagctcatgtcctttgtagggacatggatgaagctggaaaccatcattctgagcaaagtattgcaaggacagataaccaaacaccacatgttttcactcataggtgggaactcaacaatgagaacacttggacacagggcgaggaacatcacacaccagggcctgtcatggggtggggggaggggggagggatagcattaggagatatacctaatgtaaatctcgagttaatgggtgcagcacaccaacgtggcacatgtatacatatgtaacaaacctgcacgttgtgcacatgtaccctagaacttaaagtatattaaaaaaataaattaaaaaaacaaatcaatatttaaaattgcgttactacggcgatatatttcttttctatatcattttgaaattgtgataaaattgctttaatatgaacactaaaagcagtatacagaattactttcttaaagttcttactgaccagtaaattacttttttggttccgtactctcatcaaccaaatatagtgttctctatttaggtttagaaaaatcttgaggtcattagttatttccctgtattcacacagtattaccactagaccacagcatttaaatagatttttaaaagatttttagaaaaaaaaatcatagccattgctccttcactgctgaagacagaatgagatttggtttcaacaaatacttagatatgaggaagagcctttctaattggtaaagtaacatagtctccttcagaaggatacatgtattttagaaataaaatattcaaaataggagcatgctattacaggaaggttactaaatcaaagtgagctgaaaacgttgccaacatagaataataactgaatttaatgacaattttatatttgtttatttgtttattttaccttatttttcttgagacagagtttcactctgtcgtccgggctggaaggcagtggcgtgatcttggctcactgcaacctccgcctcccaggctcaaatgattctcgttccttagcctaccaagtagctgcgattacagggacgctccatgcctggataatttttgcatttttagaagagacagggtttcaccatgttgcctaggctgctctcaaactcctgagctcaagtgatccacccaccttggcttcccagagtgttgggattacaggcatcaaccaccacatccagccagaaattaaacacaatttaaaacaaatctctaggggctttttgttttccattagataaaatatacttaactttaaagattagtatcatacaactaagtaataatatacttatttatataagatatatttgtaagagaaatttaaaaattgtctaaaatattagaaattaaaaattttataaactactaacctgtcatcatgctcatatgttttatttctatttatttgtgaaatacagcattttttcagtccttgtttatatgaaaactgtctaaaggtttgatagttaatcactctatctttcctggaacactctttatatgggttatagaatatcatattccacactactggctgccttagtgatcactcttcattcttctatttagctgattcgtttacctattcacaactttcaagtgatggcgaccacaggcgcctctgccctttttcttattttttttttaaatttcaacttttattttaggttttggggtacatgtgcaagtctgttacacgatgtttcataatgctgaggtttggggtacaattgatccagtcatcgaggtagtgagcatagtactcaatatgtagtttttcagctcttgctcccctccttcccccacctcctctaatagtctccagtatctattgttcccatctttttgtccaggtgtacccaatgtttagctcccacttataagtgaaaacatgcagtatttggttttctgttcctgcattaattcacttggtataattgtttccagctgcatcaatattgctgcaaagggcgtgctttcattcttttttatgtttgcatagtattccatggtgcatatgtaccacattttctttatccaatacaccactgatggacactcagattgattccatgtcttagctattgtgaaaagtgcagtgatgaacatataagtgcatgtgactttttggtagagcaatttatttttctttggttatatacccagtaatggaattgctaggtcaaatgatgattccattttaggttaattgagaaatctccaaactgctttccacagtggctgaattaatttacattcccaccaacaatgaataagtgttttttttccccccataacctcaccagcatctgttttttgactttttaataatcaatactctgactggtgtgcggtggtattttactgtggttttgatttgtgtttctctgattattagtgatgaacattttttcttatgtttgttagttgcttgtatgttttcttttgagaagtgtctgttcacgtcctctgatttttaatagggtgtttgttttttgcttgtcgaattaggttctttatagatgctggatattagacttttgtcagatgcatagttcataaacactttctcttattctataggttgtctgtttactttgttgatagtctcttcgctggggcaaagctctttagtttaattagttcccactcatcaatttttgtttttgttgtaattgcttttggtgactgagtcaaaacttacgtgccaagagcaatgtctagaatgatatttcttagatttccttctaggatttttatagttttatgtcttaaatataagtaatttattcatatcaaaaaaatttttgtatgtggttgaaggaaaggcctagtttcattcttctgcatatggctagcgagtatactagcaccattcactgaataggcaatttttctctatagtttgtttttgtaagttttgtcacatgtcagatggttgcaggtgtgtgactttatttctgagaactctattctgttccactggtctatgtgtttgtttttgtaccagtaccgtgttgttttgattactgcagtcttgtattaataatatagtttgatgtagggtagtgtgatgcttccacctttattctttttgctttgctcatatgagttatagtaccatgcttaaccctaggtaatgtggggttcattcattcattcattcatttaacacgttcactaaatagaaattactgagttgtgagagtataaaaaatgaaaaagctcacaaggagatggagttgatctcacacccccttctcctgaatgttctttagaaataattcatccatattgaccttatcaaacaccaacctccttcctacctcaagcttttccatttgcttttgtctttgcctgtaagactcttgcatcattatcctcttttaacattctggtctcaaatgacacaaactcctctgcatatactcatccacaaactactctatcactattatttttatagcacatatgcttatgtgaaattatgttacatatttacttgtgtatggttttgcagcctgtctctgtccatcatctgtaagctccattcgagtagattttttttgtgatttgccattatttaagagggcaataataatttgttaaatgaatactacaactgatttaaactgtcccatagaagtgatatttacggtgtcttttaaataaacatagaaattaaccttctcagtcttaaaacttgagagagctacatttgttttatctgagttattttctaaggacaccaaccatcgggcctcccagagagtatcaaggaactgaaacttactagagcactgcatctgggcaacgagatacaagacccttcactgtcatgactggctaactgagtccctgtttactgttaaccaactcatcttctttatctgtccctaattcctgttttcctgcatgtagttacatttcttctctgcaatataaacccctgattttagtcagtctgggagatgtatttgacactaacctcccatctcctgggctgcagcacctgattaaagccaaccctggcaatgctttttgtctcagtgatcggctttctgtgcagtgagcaacaggacctagaccaaggatgtccgatcttttagcttccttgggccacattggaagaagaattatcttgtgccacacatataatacactaacactaatgatagctgaaagctttaaaaaaaatcacaaataaacctcataatgttttaagacagtttatgaatttgtgttgggctgcactgaaagctctccttggctgcatgtggcctatgggccatgagttcgacaagcttgatcctagaccaaacccctgacatttcagtaacacttacgtgtatgtgtatcatgagctgccaagatgtataacacatggggattatgagaaaaacagttcaagataagatttgggtggggacacagccaaaccacatcattccaccctggcccctttcaaatctcatgacctcacatttcaaaacacaatcatgccttcccaacagtccctcaaagtcttaactcatttcagcattaatccaaacgtccaagtacaaaatctcatctgagacacagcaagtaccttctgcttatgagcctgtgaaatcaaaagcattgttacttcctagatacaatgggggtataggcattggtaaatacacccattccaaataagagaaattagctaaaatgaaggggctacaggccccatgcatgtctaaaatccaggggggaagttaaatcttaaagctcccaaatgatcttctttcactccatatcatatccaggtctcactgatgctagaagtgtgctgccatggccttggacagcactacccttatggctttgcagtgtatagccccctcttggctgctttcatggctggcattgaatgcctgtagcttttccaggcacacacagcaaactgtcagtggatttaccattctggggactggaggacagtggctctcttctcacagctccactaggcagtgcaccagtggggactctgtgtgggggctcccaccacacatttctcttctgtacttccctagcagaggttctccatgagaattctgcccctgcagcacacctctgcctggacatccaggcatttccatacatcctctgaaatctaggcagaggttcctaaacttcaattactgtcttctctacacccgctggaccaacaccacatggaagctgcctaggattgagaattgcatcttctgaagcgatggcctgaactgtaccttggcccattttaaccatggctggagtggctaggatgcagggaaccaagtcctgaggctatacacagcaggggggtccctggacccagcccaggaaaccatttttccctcttaggcctctgagtgtgtgatgggaggggatgctgtgaatgtctctgacatgcccagcagacatttcccccattgtcatggtgagtaacatttggctcctcattacttacgcaaatttctgctgccaactggaattcctctccagaaaatgtttttttttttttttttctactgcatcatcaggctgcaaatttttcaagcttttatactctgcttccttttgaacactttgctacttagaaatttcttccaccaggtaccctaagtcatctctctcaagttcaatgttccacagatatctagagcaggggcaaaatgctgcgtctctatgcatagcaagtgtgacctttactccagttcccaacaagttcctcatctccatctgagaccaactcagcctggactttattgtccatatcactttcagcagtttgttcaaagccattcaacaaatctctatgaagttccaaactttcccacatcttcttgtcttcttctgagccctccaaactgttccaacctctgcctgttacccagttccacagtcacttccacattttcagatgcctttacagcagtgccactctacctggtatcaaattactgtattaatccgttctcacactgctatggggacataccagatacttggtaatttataaagtaaataagtttaattaactcatagttctgcagggctggggaggcctcaggaaacttacaatcatggcagaaacatacaagacatccttcttcacagggtgacagcaaagagaagtgcagagtgaagtaagggaaaaatcccttataaaaccatcagattttgtgagaactcactcactatcatgagaagggcatggaagtaacctccccatgattcaattgtctcccactgggtctctcccactacacgtgaagattatgggaactacggttcaagatgagatttgggtgaggacacagcaaaaccatatcaccctctaagaatttatttatctaagaatggggatacattgttggcaagttttcaatctataacctataaatatctgctaattttcgcattgacagcttctcatattcgtctctcaagatggtggacaaggatgagaaacataggtatgcttttgtactcatgggcctcacaattggacaggttggagagacaaaatgtacacataaaaacacaattatttcccaacatttctgattaaaactgtgaaaaggaaacatgtggtgctattaaacggaggtgctacaactagagaacagatcttaagatttatagtaaactagactttaaaactcactgcagacactcacaaatcacaaaatacacaaaatgtattttagttcatagagcgtatagtaattgtgttatatgtacagtctaatttagtatatcatttgagtattaaaatgataaactaggccaggtgcggcggctcacgcctgtaatcccagcacttcgggaggccgaggtgtgtggatcacctgaggtcaagagttcgtgaccagcctggccaacatggtgaaactccgtctctactacaaatacaaaaaaattagtctggcatcgtggcgggcacctgtaatccaagctacttgggaggctgaggtaggagaattgctagaactctggggcaggaggttgcagtgagctgagatcacaccactacactccagcctgggtgacagagtgagactccatctcaaaaaaaaaaaagaaaaaaacttaattttattaggattttgaacaaggggtaaaagtagacatatatcagtaggaagttacataaattaaagctgtcttttaaacaaaaagtcttcctaatttttggtaagaacgttattaaaatatgtatattttaaaaatgtgtgggattctaaaggccctgtcagcatattttcacgaaaactttcttctcgaatattacagtgccatggatgacatcagagttacttcaagagtttaggtattaatatcctaaagtttacagttgatgaggatgtaagcactgtaccaaactagatgcaaagttgtgtttttccatcactctggaagtgaggagaaagaggaggaaaaattaactaacatcaatgtgcttcacatgagctaagtgtgtcattctccatcaagcccaaacaataatccagcaaaatagttcttcttattcctatatgattacaaggtttaaagaggttaattaactgctgtacaatataatttttatgagttaaacaaaaacaacaacactagtgacatcagtcaataattttcatatactctagagtgcccaaacctaacggcactcaggaagaacatgatttatgacatctattataaaggaatcaattttttttggttcatgatttaggtatctttctaaatatgattgggggtagtatgtaacttatttaaatattatgtggtttccaaaatatgtaacaaatgatatcagctttgtgatgtccttttatctgctaaatttgaaatgtgtaaaattcaataattatgagtatggatatttactcatatctgtattaacatgaataacacatggcagacaaatcctgcattggtgatgctcacattagatttttaaaataaaaatgtgatataattctacagagtaataaggcgagaataattaatatagcagaatgaatgtaaatttacaccaagaaaatagaataataagatttcaattattttcttcattattcagcacattttctacttttgatttctattcttacagtgtgtgttaaacacaatatgtttcgacttagttatcatgagaatataattaattactacagaaggtaattgcatacctgtatgaaggatgtttcaaacttgaaaacttagggaatttcagtgaggcatcacgctacctgacttcaaactatactacaaggctacagtaaccaaaacagcatggtactggtaccaaaacagagatatagatcaatggaacagaaaagagccttcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaaggcaaaattgacaaatgggatctaattaaactcaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaaggtggcaaaggatatgaacagacacttttcaaaagaagatatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttggtgggagtgtaaactagttcaaccactgtggaagtcagtgtggcgattcctcagggatctagaactagaaataccatttgacccagcaatctcattactgggtatatacccaaagaattataaatcattctgctataaagacacatgcacacgtatgtttattgcggcactattcacaatagcaaagacttggaaccaacccaaatgtccaacaatgatagactggattaagaaactgtggcacatatacagcatggaatactatgcagccataaaaaatgatgagttcatgtcctttgtagggacatggatgaagctggaaaccatcattttcagcaaactatcacaaggacaaaaaaccaaacaccgcatgttctcactcataggtgggaattgaacaatgagaacacatggacacaggaaggggaacatcacactctggggactgttgtggggtggggggaggggagagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaatataaaaaaagaaaatataatggactaaaataattaggtccttagtatcaggggaaatcttgatttagtcatttttcttaaacacataattatcaagaaattacttactcaggctcacattgtttccttcataatttcttcatagttatagcaatcacattgtagcagggaataccaaacttattattatcattaaaaacaaatattaagtaatttgttttcaagaacacaaatattttaccccgacatggtttccaaaattctttttcccaaagtctttgaggcaactactctgactgattttgtaacagtgcaattcacaaaatctcccaagtatgatttaacatcaggaattactataaaggaattactataaagtggtttgggtgtgtgtgtgtttgtgtgtgtgtgtgtgtgtatacatatacacacacaaaatatatatatacgttttgcaggcatgtgacttagtcatattttagtgaatttaactggatgtcaaggtatccttaaaggacaaaagagaaagaaaaaaaaaaaaacagcaggcggaactcttcatgtaaccactgagaaagtcctgtgctttttttacttcttcctccctcttccctgtttttaacacctggaatgaccaatatgttttgacaacatgttggcaagttccttatgcagtttgacacttaatataaggtgtttgtatagttcagtttctacagataggatattgacacagctatttaagattgtaaaaaatacttgctttagggctatttaccactaaatgttttgggaaatgtgcttttcaaaggtaaacgtaactcgacccttaaaggtatgaaataacacattccttgtaaaatttatttatttaaacacagttgttaagtttatgaagttgacatttggcacaccgtcagactttcctaatacaaaaaattcatgtagccaaaggaacttagagatgaaccttatctgagctagtaattagtgaccctatattctatgccttaaattcttaacactgtcttcacaatctacaagattaagcaggatccaacttaggtttccctctccatcctcctgaaaaaaaaatggccttggtttttgaaacttactgttcttcctcatacttcagggcctgattcttttgttacgtgactttatcttggcataaccttcagacctccgctcagaatcacttctagaaccttccttgactctctagatacaatcatgctccctcttatctggtttcatagaaccctaaacatttctaagtgcttttctttttttttttttcttttttcttttctttttttttttttttttttgaggcagagtcttgctctgtcctccatgcttgagtgcagtggtgcaatctctgctcactgcaagttccgcctcctgggttcacaccattctcctgcctcagcctcccaagtagctgggactacaggcgcccaccaccatgctcggctaattttttgtatattttagtagagacggagttttaccatgttagccaggatggtctcgatctcctgaccttgtgatctgcccacctcggcctcccaaattgctgggattacaggcgtgagccaccgtgcctggccttacttgattgactttttaacttttatcctttcaagtttgaaataccaaggcttggaaccatgacagttttcccttatgcttaatctagcatctcttatataatagaatctctttaaataatattcaatgcacaaacatatagtaaatcttgaggaatttttattgtgtttggatctcaagggcacagatttgagttaaatattacctatagtttatgaaacattatcattgatggatcttcaaggcatatttgtttattcatttctttctcttcttttattctcatacctgtttttcctatctctctttgccaccaatggcaatctttttaatacatttaaggagtatcttttaactagaccatttatggtacattgtattatagtttagcaaatatcccctcccctttcttctacttcctattctgattttttgggctaggccatgtgacttgctttggtcaacagacatgaagaactgtgacacgggagcagtctttacatgtcatcatgtggttaggcaagttctcttaggattctattctcactatgtgaaaagcaggcctggttagccatgcgtccctgcagaaggagatatgtggaacagacatgagcccagacaaggtcagccaactcctagctgcctcacagacccataaataaaaatattgatctttgctattgcagaacagtgagattttggtgttgtttactaagaattgtttttgtaggaaaaactgtagaagcttctgtgtgcttaaaaaaaaaactttatataatggtattgctttctttttctattttcattgagcactcagttcttacacttcattctttttgctatgtgttaatcaaatcctgctgcaccagaagttcacagggtacttcacactaactaatgatcacagttgtataggaatctctggtatatgttagaaagttcataatatgacatacaatgttcctgacagtggcattgtcttgaatgcttttaaattatttgactctgtagtaaagatggcttgaggttggagagaggatggggtggcaggctctccattaccatggtgagtggaacagccaggtgtgaagccaaacaagctgtagcatttagccacaatggtagtgtagtcaaagggaaacttcaaaacagaatacttgggtccagtccttagattataaacacaccccgagaaaagatcaagcagggaaaaaattgtcatggtcatgtttcagaggcatagcaccttcctgactccctactaccttatgctacccacttcttctctacaacttatgctcaggttcctggacctctgacctttacaggattttccagaatgcaggggaaaagcacaaagagaaggaagcagatcacaaaatataaatatggatgacagatctcatagacttaaaccataaaaaaggtcagagtaaacataaaaaaaagatagttaatatatattatttactatgtagtaggcaccaactgttccacataaatgacatcatttcaacatcacagcaaccctataaagtatttcttttgtttttagaacacatgaaatatattctttaaacaaatttttaagtgtatcacacagtattgttaactacagtcacaattttggaaagcagatccttagaacaataccagaaaaacaaacaacaaataactcaattaagaaatgggtaaaggatttgaataactttttcaaaaaaaaacaacaacatacacactcgacatacaaatggccaacagtacataaaaatgtgctcaacatcattagtcataatggaaataaagtcaaaactacaatcagatatcgcctcatgctttgtaggatggcttttatttaaaacaaatttttttaaagttagcaagaatgtgaagaaattgctacacttgtgcattgttggtggaaatgtaaaatggcactgtcaatatgagaaacagtatggggtttcctcaaaaaaattactaatgtaactaccatatgatccagtagttccacttttgggaatttattcaaaatatttgaaatcaggatctttaagagatatctatctgtactcccatgtgtactgaagcattattcagagtatccaagatgtggaaacagactaaatgttcattgatggatgagtggataaagaaaatgtggtatatgcatacaagtgaacattactcagctttaaaaagaaggaagtactgccatttgtaacaatgtgaacgaatcttgaggacattatggtaagtgaactaagccagtcataggaccaataccgcatgattgcatttacatgagatatctaaaatagtcgtcaaactcaagaagcagaggtggttgtcaggggctaagggaaaggggaaatagggagtagctgttcaagggttataaagttttaattgtgctatttttgttctcattttccagatgccagaactgagggttacagtaaattaagtgacttgaccaaggccacagggctagtcagtgggagtttttgaagttgaaaccagacattcttgctcctgagcccacacttttgaaaccacttaaaattttattgagctgataaactatataaatttgcatatgaggggccatcatacaccagacacaattcatacaaagaaaagaatatctaaatatatactagtaaaaaactttaatataaaaatggagatttttttaagcagataaagctaaaatatctaaaaatgaagaaaaattaatttggcttcacactttataatttattaaataataaaaacatagcgaaacatcatctatatagctttaaagggaaaaacttttgacccaagactctagtagtctttcaagttttctaagtataagcaaaaaaaaagtgtcatataagaacttacaaagtgtatatcctcaataaattgaatacataaataaactaagagatgcagcaaatgcagagcttaagagtggatgggtcagaatataaaaggagtgttgcacgtcatacataggtttaaatatggaaaatataaatggctgtttaaaaatgcctaggaaatataattaaggcaccataaattatttttaaataaaatgtatgtgactaattcttcaaagaaaatataatgaaaataaacttacagagttaaaaacaaaaaggtgagtcataaataaatgtcatgtccccagatgcctcagacacatgaaaattaaaagagtaagaaggcagcatcaggagaccagaggccaatttaccatgaaggccgcccatgggttcctaatcaacagaactatggtccttcatttaaatttcattgtccttaccctgtctgcaaagtttttcaccattcatttccttctctccattgaaaacttcttttcacctgtaccacattactagcaggtttcccttccatcttgtcagtctttaatttctctggctctttccactaatcagtccttgacatatccccaaattctgagagtctatttccaggtttttctcttatctaattatgttttcattcttagagaatggatttactttcagagtttgaacctcaactcaggtaactcctgtgttcacgtttcttttttaagctcttagtctgatattttctgcccgatccatcccaggctctttaaatgcaaccacatcatccccgcgtcagatcaaagcaatcaaagcagctgcggcaactcaatacctatcatctagggtccttctcacggagttgctgatctgtgtgaaggcaaccttagcctcacactgccatctgcctctagcctcccctcagcattaggtttcatgtactccttggtttgataactgggcaacagataaggtttctgccagccccatggtacagctccttcagcctccatcctccacacctgaggccgaggggatgggggagggtgtgggtgccaatttttctcattctatagatagttgcactcagatgttttgaaatcatttaaaatttaatttgtcctaaaagtgacctcaggctgtgacacagtctctaggctatgttaggtctgtgtttgattgtagggctacggtccaaacatagccaccatgcaagaaaatgaacgaattgcaaagaggacaaagataagaccaggaattatgagtggcttaatttagagggtgttaaggccaagaatccaggtcatgagaagccaagataccctttcagagggtctgtttccatttcccctggcaagacactcagaataaagaatatcatttaagccataagggaggtctgtgggccagtcccagagaaagtctattatatttcactcaattttcttggaaatctgtcttgtttaaagtatgttgggacccaggtcctgtgaggtatattcttattccccactcccgaaatatgtgaattattgatactgttaaaagaaaagctttagacaaatttaagagtttaattgagaaaagaaaaaaaacatgatttccaaatcagcccctagaatcaaagaaaattcggagagactttggcactgtcacaaggtcaaacatctatgggaaaaaaatgtgatgtgcaaaaactaaaactgagatacagaaacagctggattggttacagctcagcatttgccttatttaaacaaagtttaaacagttggccgcctatgagtggttaaagtatacctactggaattggctaagactaagctgtcattacagggaaacatactactaaagttaggcttttagtctgtttacctgctaagtatctgagtatggacattttccaggctagattttagttttatttagtaacacattatgggatctgaaggacacttttttaaaggttgaaacaaacaaattttacgcacatttccatttataacaaaagaaaaatgcccctttagctctggtaagtatgacaatttctaaattaaaagagcattatttacatctgaattgttaattctaatattaatttcaagtattattaataatataatcatttttcactaagccttcccttttatacccgtttacactttcaaatctaattatattccactgttgttttaaagatcaagccccaactgtttcatggtgtaccttctttctaattaagtatttgagacaaatgggagtcaggctgggactatagcatgtcaattttcacaagctgacattcacagtaaaagtagttcttgattatttccctaacagctttgatgttaaggggaaaaaaagcaacaacaacactgagctgtgtatattccctcctcatgctcctgggtgagaaatcatagttagtagctgctgatcttaaaaatcagagtctctgctacattgttagcaataatctaaatcaatacagactaacaacacaagccagtatgtggtgagtcatgaaaaataaatcagtagtgatatcaattgaaaatgataccaaaaaactatattatctggaaggaaaaatacaattttataacactcttggtcctgaatagttttgactatggcacacaaagcaagcaagcagcgaattacatgactgttactttctttctactgttagcaccctccgctaatagattgtaacagaatgactgtttggagggttaagcattgggaaatgtccataattacatagcatgtttggtaacatcgtgacattttaataaaacacagatatacattatagaaaagaagatctagccatctttttacactctctagagatcaataaatgtacccttgaatgacagatgggtgttgaaacccctttgcaaataattcctcaggtagctcttctaagctctgaaacgctacaatagttctcaaaatctcaacagagggaaataaaatacttcacagttgtaatgattttctctttatatatatactttctgaaaaagtatagtgagaatactaagtatttgggaactgattttaaagtccataactattaaaaattgcaagaatttttatggagcatatttatttcataaatcagtattaaagcctgaaaaaagaagtcttaaaagtctacataattctcacaatgttatatatatgttatatatatatatgttctatatatgttttatatatgttatatatataaagaacatatttctcacaatgttatatatatatgttatatacatatatataaaagaaagttggtcaaaattgttcatattgagaggtgacaacatgctggtggccctcacttgctctcagcgcctcctcggactcggcgtccactctggccacacttgaggagccccttcagcccaccgctgcactgtgggagcccctctctgggctggctgaggctggagatggctccccctgcttgcagggaggtgtggagggagaggtgcaggtgggaactggggctgtgcatggtgcttgtgggccagcacgagttccaggtgggtgtgggcttggcgggccccacactccgagcggccgtctggcgccaccggccctgggcagtgaggggtttagcacccgggccggcagctgcagagggtgcactgagtcccccagcactgcccgcccgcccacgctgcactcgaattctcgccaggcctcagccacctccccacggggcagggcttgggacctgcagcccgccatggccgaaccccccccacccccgtgggctcccgcgcagcccgagtctccccaacagggtgctgccccctgctccatggcgcccggtcccatcaactgcccaagggctgaggagagcgggcgcgcggtgcgggactggcaggcagctctgcctgcagccccggcgtgggatccactagccaaagccagctgggctcctgagtctggtggggacttggagaacttttatgtctagctggaggattgtacatgcaccaatcagcactctgtgtctagcttggggttcgtggatgcaccaatcagcactctgtatctagttaatctggtggggacttggagaacttttatgtctagctaaaggattgtaaatgcaccagtcagtgctctgtgtctagctcaagtttgtaaatgcaccaatcagcaccctgtgtctagctcaaggtttgtaaacccaccaatcagtgctctgtgtctagctcatctagtggggacttggagaacttttgtgtctagctaaaggactgtaaatgcaccaatcagcactctgtgtatagctcaaggtttgcaaacacaccagtcggcactctgtgtctagctcaaggtttgtaaacgcaccaatcagtgctctgtgtctagttaatctagtggggacttggagaacttttatgtctagctagaggattgtaaataccccaatcagcactctgtgtctagctcagggattataaatgcaccaatcagcaccctgtcaaaacagaccaatcagctctctgtaaaatggaccaatcagctctctgtaaaatgggccaatcagcatgatgtgggtggggtcagataagggaataaaagcaggctgcccaagccagcagccgcaacccgctcgggtccccttccaccctgtggaagcgttgttcttttgctctttgcaataaatcttgctgctgcttactgtttgggtccatactgcctttatgagctgtaacacttgctgcgaaggtctgcagcttcactcctgaggccagcgagaccatgaacccactgggaggaatgagcaactctggacgggaggaaggaacaactccagacgtgctgccttaagagctgtaacactcactgcaaaggtctgcagtttcactgttgaagccagcaagaccacgaacccaccagaaggaagaaactccaaacacgtctgaacatcagaaggaacaaactctggacacaccatctttaagaactgtaacactcagtgcgacagtctgcggcttccttcttgaagtcggtgagaccaagaacccaccagtttcggagacaatattaaacatgttccaattactactctactttaaacaagaaccttataaattcctaaaatatataaaatataaggaatggtacaaataatgcttcacttgttggagatgaagtgaagatgaaacataaaccctatttatttatcccaattattccatgttcacatactcacaaaagactattctgtcacaatttaaccctgttccccaaaatctcctcataaatgcagtttcaaaaagaacaaaactatgcaaataaacattacacctgtagttttgttctgtcaaatttgggaatgaaacgtctctggtgaaaagaaataaacggttagccatttttaatttcaaaaatgatcagtcattcactattcatgtctcatgtgaactacataatgtcaacgctgtcacgaaagcacggtagaaaaaagagatcctctcagcttcaatttagtagagggaaaagttcctggaatatgtttttcctccctctggagcacttcagttttgcaaaacatgtattttataattcttattttgtattcaacaatagtgctctctctggctttcagagtttttccagtttctctgatatttcaaaaagttatggtgttgtcattttatagtttaacatgagtggttctcacttcattcaaaagaaacaggataccttgaaaacgatgtggccaacctctagaaatgaaaattattattgcttaataatagtaatacctaatatatgcaggggcagaagcctggttgagcatgtatatacatcaatcatttaattctcatagcccttacatggccaaactaagtcttggagatattaagaattttttctacagtaatacaaaattaaatttctggaagtctggcacattttgtcaatcctgaagaatacagaataaacgtttatttattcacctattcaattattcaacaaatgtttcctggcagactagtaagtagcaggcttagagttagacatgagaatacaaactgaaataagttttgattcctgtcctcaaggaccttacattctagtttggaagagagactattaaataaacctacagtgttaagatagatacttacagccccaggtagtggtataggatccctgaagagtatgaaattgaaactattttcttctaattaataaacatttataacagtaacagagtagaaaacacttggcaagcctatctgaataataattattctgtctttatggtaccaacataaaataagggtaaaaagcataacatttaaaaaaaagtaattatgtaatatagtaatttcaaaaacgttcatggaattgagcttttacttaggattcgtgtaggtgcaaccaaattgcaactatgctcacttaagggtcccagtttgcaacaatgattcaaaagctcaattctgatcatagctatatcaaaagattgttggtgtttccaggggcaaaactgagtctgataaatatatactcaataactgaaataaatagattcagtatttcaatggaatgactggcatccactttctatctaatgaaaggccaatatcaattattaaacgctaaaaattactactgggagtgcaaaactgaaaacctcttccaaagaaatatgaaatttaaatctggcaattttatttaaaagagcttcaaagtgtaaaaacagagctttctctttacataaatacttacgataagtaatttatcttctttatagaacagacaacagaccaagacaacttttcgcaccttggtggatgcgctctgaatgccaagccaggcaccacagtcattactaccaaaggggaagtaataaatttactgtctatacgaagactttcaggtctgtcccatgtaggtgaaaaatagcgcgacttttaatctctcatcattaacgccattaaactctatattaaattctgtgctgatgaaaattttttttaaatgtatgttagtattgtgtttccttacactcatttattacagagtgttatggtttctatttgcaattctgtcttttctataaaattttcagtttcttgagagcaaaaactggttgccacaatgaccagtatatagttggtgctaaaaacacatatgttgaataaaattgaatacatattcctaatttcaaagtaattgtacatgttacaatgtacttaaaaaacagaaaaattgccagtttcacattcactatctttattgatgggttcaagtctatgaaatttttgcctatcatatatcccaaagcacaataaagcagtttcaaagacattttaacacacttaagaaaaggagcttctgaattaaagcccaccactttcatattaacattaatacattttgattccatatagtcacaatagagtttataagacttgtccaaatcgaagctgaaaaatgttatgatggccattcacttttaattaaatacaagcattaaaagaaatactatttatattagcaatagaaaacagaacttctaaatcacttataagattcaggattttattttcttactcttctaaaatagttcatttaacttttatttgtatttttctaaaatttatcagccaccaacttacagtgtgagcccactcagagaaaaatttaaatcatcaggataataattaatatttataaaacaaggtatttatagaaagcttttttatatgtatactattaattatacatggtattttatcactctcactataataatattttaattaaaaccttgccttgaaagataatttgggatatctcaaaaaagtaaagttctatatgataaaagaatgttaactattttctgtaagcaatcttaagctttttaatttaccaaaataaacacattcaatataagtttcatgtgatatgttgatttggagtttgctaacaaaatagtcatatatgcatacagtggaaaatacataaatttaaaacatatccagattaagtgaagcttacaaatggagacaattcatatatatttatcattgttagataaattagtaattagtacattgtgcattctagaaaaacaaaaagcatattctttgtctaggttcaataatagtcatctgaaatatgctctgtacctgtggatgaaataagtaaaagaacataaaatgtatgaataaatagggtgaaatttacagagactacttttgctgtcttgtgattcggtcatttatgagtgttaaggatttttctcagtacagttcagaatattaatcaatgccttctacttacaggagggtctgcatcttcagcataaactgttgtgataggtgtacccttgactgcatccggagccaccatccctttgtatattcgtttactaaagacaggaggataatcattcatatcctgtaaaacacaattaggagtttagtacttcagttgaaaccaggttagggatacagttactagattgactcccagtcttcatatcacacaacttatttaccactgtcagccttccatcctctcaattccattactctcatttcagactggcacctcagaggaaactgccagagttctcatacaatattaatgtgtggatatcaactgaaggccgttccactggaataaagtctttcaccctcaaaaacatgccttttggagactgaagtgaccctggaatttttttctaacttctaatggtaagaggtaaaattttaacatttgaaaataagaacaagtttctttaaaagctacattctgtgaagcaggcgtaaaagattttttttaaatgctctttatatgtttttatagcaatgtaaattattttatatacttagcataatactgactagaacatttcagatacaaactgtgaaatatcctttgttgccattttacatgataaaaggagattttctctgcagcgcactaaaataatgacacttaagattagatatatttatacacagaaaacaatgttaatttactgaatttttttcagagcaacttatatgtatcttatttttccaatttggcgctatatatgcattgttattcatgcattgtcaagttcattaaataaatagttatcaggtatttcccactttcatcagatatttagcacttcagtgcgaggcactgaagatactgttgtgactcaagaaaaagatgtccctgtctttgtgtcacttaactgccattaggctagtaaaaatactaatctgcagaaaggctagtaactttgactaaattaatctacttatcagggccaaaataataaatcaagtcccctgaaaggaagaccatatttttctgaatcattttatcttttagagataattgtatataatcttttgtcaataaataatgcttattcatatggcagatttatttatttataatattttaataatccttaccctaccgtgttttgggtagtgtgggtcaaacatatttgaactgaaacctaaatttgttaattatctgctcttctcctccaagtcccctttttctcacttgctagtaaaaacaaaatttaaaaaattctacatattctttgatatttgcttagacacaacaattttcctgtacagtattaagctggaaacacataaattaacagatctcaaacttctctttttgcaaagaagtcagaataattatttcttactatcaaacaatgcttccttttatattcgccatagagttgagttctgagtagtcaatatgaataaacctgcatattctaataggagaacttgaactgtacacaaaactgaaaaataaaaaatatcatttcttctgttttgaaatacagtattcaccatctcttctatgaaaaatatttttacaataaattatggactttagaatctgaacaagtaaatgaaccgagaagttttagttctctataatgaggactgtgaagggtattgatcttgaggctccatgcagggagtaaatatataaaacattagcattcacacattttcgtgccctttccaagagtgccaattaacttaataagtggatgtggtaactaagggtgtggaaatcctttagcacccctaaattgtaacttctgaaggttcgaaaggaaggagcccaacactgcaatgtttccatgcatgagtttccaatgagctcattatgttcttaaaaattttattctttattttattctcaggggaaatttaaaaccttaatgtcacaaggtactttttggaaaatttgattcttcagaaacaaaaaaaatgtatatacttttccaattatgtcaacacagctgttcacagtgttgaatatgatgaactttttatttgcttgggaagtattcattggattcaccttctaacttgaatgtacagtgattcacaaactgattagacacacacctaagactgtaaatgactgaagcctatgaaaagattggttctcttccccctttattttctattgacaggatgaagaataaattaatgtagttattgtagtagtatttctttttatggcacgttgtacatactttggggttataatctttcattgtggttacaaaagcagctagttgcatatagtttttccacaatgcattatttcaagaggagaaatgtattgaaatgcaattccaacaagcataatcaatagttcactgtatttatgctcagggacatctgaacaaaaatgtatataaatcggcttctgtgcaaatgttctcttgtgcagtaaattaaggactcgctcagcactccaaaaccatgctcttttctcttgcccattattccactagagggtagtattagcaaaaagaaatatttcctcctctgtagttaagaattgtatcactaaaacccataatatttgtttcttttggtaaaaatttttattggtctcaacaaaaaatagttttaatgcttcaaaagagtattctgaatgttatgatttacaacttgaaaaaccttatggtttttttcttaaggaaaactttaaaaaatggttatactcataaagcctgcaatttgtttccatgtgtcaagcaaataaaattatacctgaaggtgtaggtagctaacaggagaaaactatgttttatttatttatttgctacattagagtctgtaataatcacagaaaccttttctcctttagcagactaccaagaagatgtaaggaatctttttaatgatcatgctaggaagataagaacttgctggtaagtttgtaaatgtaatgacaagttgaagttctacacacacaaaaaaaataaaaataaagagaaaaagatgataaaatttttgattttctggaatcacaggcaaaaacctatagaacagtttttatttagaagataagtagaaagttctaactagttggaacttgatcatctttttaaaaataacgtgtaggctgggcacggtggctcgcatctgtaattccaacactttgggaggctgaggtgggcggatcacccaaggtcaggagttcgagaccagcctggccaacatggcgaaactgtgtctctactaaaaatacaacaataagcctggcatggtggcgggcacctgtaatcccagctactcgagaggctgaggaagggagaattccttgaacccaggaggcggatgttgcagtgagccgagatcgcgccattgcactccagcctgggtgacagagtgatactcagtctcaaaaaaaaaaaaaaaaaaaaagatatgtatatagcaaatgccagtccttaccatactaaagctaattcaggctctatgaggagacacagacagtataagccaatgggcggaatgactttagttgtttctgtcttatggtctagcattagcattatccttgttgagctatatggctgctctataatgccttgaggtttatggagccgatacctacttttacgtgggtgtatggttgattgtttgcctcttaccagttctgttttccactactagacactttctatttgctgtccaagttgctgtttctcatatttctcatattattagcattctgctgggtttttttctctctcaatttctgtattgtctccttgtctttactgacttatttcccttcttttatgcttctgcataaaaagtcataaaaggctacatctgcagctaaagaaaatatttgatatttttactgccaggctaggcatattcaccacaagctgatttaagaggccatgggccataagtgaacattggtggtagcctggcagtactccccaagggtctttgatagtggcacagggtaaggctcctctgcttgtggagaaggactgtttctcataggttgagtgcctgctcagccacagtacacaagaacacaaggtagaattctaaggttttgacttccagacggtaactttgaacctgttcagggcctgggagatttttgccaccctgaagggaaagacacaggtctggctggctttgccacctgctgattatagagacccatggccttgaacaaacttaagtggtagccagggtggttacagcaggtcttggacaagacccagtgctgtgctgggtttaggtctgacccactgcagtcccagcagtggggtccacaggggtgcttgtgtcaccccaaccccagctccaggtggctccaaacagagacactctgtctgggagagagcaagggaaaagaacaggagtttctgcctggtaattaagggaattcttctggatcttatccaagaccattaaggtagtaagagtctgccaagaaccacagtgttactgggcttgtggtgcctcctaaagcagatacagctttagcaacacctacatcctttcaaatacctgaaaagctttccaaataacaaatacgaagaagtccagactgtgaagaatacaataaatacccaacgcttaaatgcccagacacagacaaacatccacaagcatcaatatcatccaggaaaacatgaagtcaccaaatgaactaaacaagccaccagaaaccaatcctggggaaacagagagagtgatctttcagacagagaattcaaaatagttgttttgagaaaactcaaaaaattcaagataacacagagaagaaatttagaattctatcagatacatttaacaaagagattgaaataattttaaaaatcaagaagaaattctggagttgaaaaatgcaactgacaccctgaagaatgcatcagttttttaatagcagaattgaccaagcagaagaaagaattagtgagcttgaagacagcccatttcaaaatacacagtcagaggaggcaagagaaaaaaaagaacaaaatcaatgaaacatgactacaagatctagaaaatggcctcaaaagggcaaatgtaagtgttattggcattaaagaggagacagacaaagagataagggtagaaagtttattaaaaggaataataatgaagaacttcccaaacccagaaaaggatatcaatatccaagtacaaaagattatagaactaccagcagatttaacccaaagaacactagctcaagttatttaataatcaaactcccaaaggtcaaggataaataaaggatcctaaaggagtaagagaaaagaaacaaataacatacaatggagctctaatacatctggcagcagacatttagcagaaaccttacaggccaagagagagtggcatgtcatacttaaagtgctgaaggacaaaaaaaattcctagaagagtatatctggttaaaatatccttcaaacaggaaggagaaataaagactttcccagacaaataaaagctgagggatttcatcaacaccagacctgtcctataagaaattctaaagaaagttcttcaataaaaaaagaaagttcgtgagtaataagaaatcatctgaagatacaaaactcactggtaatagtatgtacacaggaaacacagagtattataacactgtaactgtggtggtgtataaaatattcttatgttaagtagaaagactaaattatgaaacaaaaataactacaatcacttttcaagacatagtaaaataaggtataaatagaaacaataaaaacttaaaaagcatggagatgaagtatagagtttttattagttattttttcttgtctgtttatgcaaacagtgttgttatcagcttaaataaagggttgtatgatagtatttgcaagcttgatgataacctcaaaccaaaaaatgtacaatagatacataaaaaataaaaagtcaacaaaatcaaagcaccagagtatactaccttcacttaaaggaagacaggaaggaaagaaagaaagaagacaaaccataagacaaccagaaagcaaataacaaaatggaagcaataggtccttagttataaaaaataacattgaatgtaaagggattaagctctctaatcaaatgacatagagtggatgaacggattaaagaaaaaaaagacaaaatgatctgttgcctacaagaaacacacttcacctataaagacacacatagactgaaaataaacacatggaaaaatatattccatgctaatggaaaccaataaacagcaggaatatctgcaattacaggaaacaaaacagatttcaagacaaaaactacacagagagacaaagaaggtcactatataatgataaatgtatcaatttatcaggaagatataacaattgtaaatatatatacatatatgtatatatatacatgtatatatatacatatatgtatatatacatgtgtatacatacatatgtattcagtgtgtgtgtgtatatatatatacacatacacacacacatatatattttcaacattggagagctcaaatatataaagcgaatattattaaagctaaagagccagatacatccccaaacaaaaatagctggaaacttcaacatcccactttcagcactggacagatcttccagaaagaaaatcaacaaagaaacatcagacctaatctccactgtagaacaaatggatctaacagttactcatagagcatttcatccaacacctgcagaatacacattctcctcagcacatggatcattctcaaatacaggccataccttaggtcacaaaacaagtcttaacacattaaaaactttgaaataatatcaagtatcttctctgaccacaacagaataaaactaaaaatcaataacaacataaattttggaaattatactaacacatggaaattaaacaatacattactgaataaccaggggtcaatgaggaaattgataagaaaattgaaaacttttttgaccaaatgataatgaaaatacaaagtatcaaaaccaatagtgaggtgtggagttggcaggacttcctgggttgatttggggactttcacaaaagacccctgtgactcagggttttgagttcttaatcaataaagtgaaggattcaaagttaaccactccaagggaggattgaaaaaagagccactctcaatggacaaaaagaaagaaaggggagggggtaacacagggatataagtcctagccaccacagccagcagtggcaacccttccaggtccccttccaccatgtggaagcttccctttcgctttgttcaataaactgtgctgctgctcactctcctggtctgtggactctttttgagttgtaacactcactgtgaaggtccgcagcttcattcttcgaagttagcaagaccacgaatccatcagcaggaaaaactcttgattcaataggatatactgaaatttttactacgtgggaaatttatagctataagtgcctacatcatgaaaggaaaaaaacttcaactaaacaaaacaacctaatgatgcatctttaaaaactagaaaagcaagagcaggctgaagccaaaattagtagaagaaaataaataataaagatcagagcagaaataaatggatttgaaatgaagaaaacaataaaaagatcaatgaaacagaaagtttgtttttttaaaaagttatataaaattgacaaacctttagccagactaactaaaaaagaagagagaagacccaaataaataaagtcagatatgaaaaagaaaacattacaactaatactgcagagattcaagggatcattagtggctactatgaacaaacatatgtcaataaattggaaaatcaagaagaaacaaataaattcctagacacacacaacccatcaagattgaactatgaagaaatccaaaacattgaacaaactagtatcaagtaacaagatatagcaaataacaagtatcaagctgtaatgaaaagtcacctagcaaaggaaaagccagaacctgatggttttgctactgaattctaccaaatatttaaagaagtactaatactaatcttactcaaactattccaaaaaaaaaaaaaaaaaaaaaaaaacaggaggagggaatactttcaaactcattctataaagacaataatactgataccaaagctagacaaagagacatccaaaaaagaaactataggcaatctccttgatgaatattgatgcaaaattcctcaacaaaataataacaaagaaattcaacatcgtatttaaaagatcattaatcatgaccaaataagatttatctcagggatactaggatggttcaatatattcaaatcaatcaatgtgatatatcatcaacagaatgaaagagaaaaaccatatgatcatttcaattgattctgaaaaagcatttaataaaattcaatgctctttcatgataaaaaccctcaaaaactgggtgtagatggaacatacctcaacataataaaagtgatatatgacaaacccgtagctactcccatactgaatgaggaaaaactgaaagcctttcctgtacgatctgggacacaaccaggatgcccactatcaccactgttattcaatatagtactggaagtcttagcaagaacaatcagaaaagaaaacaaaataatgatcatctaaattggaaaggaagaagtcaaattatccttgtttgcaaatgataaaatctaacacttggaaaaacctaaagactacacacacacacacacacacacacacacaccacacaaagtattagaactgataaatttagtaaagttgcaagatacaaaatcaacacagaaaaatcagtagcatttctatatgccaacagtgaacaatccgcaaaagaaatcaataaagtaatcccatgtaaaacagctacaattaaaataaaatacctaggaattaaccaaggaagtgaaagttctctgcaatggaaactataaaacatggattcaagaaaatgaagagaacacaaaagaatgaaaagatatctcatggtcatggattgcaataatcaatattgttaaaatgtccatactactcaaagcgttctacagattcaatgcaatccctgtcaaataccaatgacattcttcaaagaaacagaaaaaaaattctaaactgtgtatggaagtacaaaagacctagatagccaaagctatattaaacaaaaggaaaaaaaaaaacacctggaggaatcacattatctgactttaaataatattacagagctatagtaaacaaaataggatggtactggcataaaaaaaaaaaacacacatatatccatggaacagaattgagaacccagaaataaatttacacaactacagcaaagtcaattttgacaaaagtgccaggaatgtaaccagggaaaggacagtctcttcaataaatgatgccaggaaaactggatatccatatgcaaaagaagaaattaggccccatctcatgccatatacaaaaatcaaatcaaaattgattaaagatatgaatctaagacctcaaactatgaaatgactgaaagaaaacatgcggaaactctccaggagataggactaggcaaagatttcttgagtaatacctcacaagcacaggcaaccaaagaaaaatgaacaaatgggatcacatcaacttaaaaagcttctgcacatcaaaggaaagaatcaacaaagtaaagagacaacccacagggtgagcgcaaatatttgccaactacccatctgacaaggaattaaacagaatatataagcagttcaaacaactttgtaagaaaatatctagtaatctgattttaaaatgggcaaaagttctaaacaaaaatttctcaaaagaagacatacaagtgataaaccggtatataaaaaggtgctcaacatcattgatcatcagagaaatgcaaatcaaacttacaatgagacaccatcttacaccaggtagaatggcttttatctaaaagtcaggcaatggcaaatgctaataaggatgtggagaaaaggaaccctcacacactgatggtgggaatgcaaattagtacaaccactatggagaacagtatggaagttcctataaaactaaaaatagagctatcatacgatccagaaatcccactactagatacatggccaaaagaaaggaaatcagtatatgaaagaaatatctgcactcccatgtttattgcagcactatttaccatggccaagatttggaagcaacctaagtgtccatcaacagaataatggagaaagaaaatgtggtacaggtacacaagggagtactatttaaccataaagaagaatgagatcctataatgtgcaacgacataatcaatgaaggttaaaagtatatgagagaggcactttctggtgtctcccagaaaccagtgggtgatatttatggagccatgggagagattctttactacgtagatatactatttttaatcctggacatgcacattttctttgttttctctggtttggatttttataggaaatatgttatatcttagtcctaaaactctagaatagtagaattaaagatattttctcctgctatcaccaagttcactgacaaatataatataaagaacacaccaataggaatctgaaaatgcggactagaagagagggaaacatttgaaagccatacttcaaagcaaccccaacagaacaattagcaagttgtaaaaaacaatattaaatctgaccatacaccaactagctggttcacagaaattatcatttattcaaattcccacctccagacaatacctcttacctccatacaataggtatgctgtagatgaaatgtccagaatttctgttttgtttgagtctgggacaacctcctggtctctcaagcatcagcttttctgatgaaatcaaaagcaggaccctatcaacactgtcatgatggagcatcagtagcacgtaactgcctctcaggtgtccacggtttcacaaatgctgccttggtactgggcactgagttttcatctagaaaagctatcctttttcttctattctatggggtagcaatatttctttctggagaagaaaactcctctgaaaggtggaaatcttagcttcattttccaagactcactgtgtttaacaacaacctcagcccttgttacaaggtgaacctgatgatacttcatttctcgtcatttcacccctccctgcctactcccacacctgcacactaagacaggcaaacacaaccaagggtcaatctagtctcccgtcttcacagaagcatgtctccctctctcctactcccatgcagccattctatccaaaattataatgagcaaaatgacttgggtcatctgtttatctcagacaagttctttatactccttataatgctgcttagtataatatatccatttacatattcagcttttcagattcatattcagttttcagtttgctgtagaacagcccttttctttctgtgtattttctatattatgttacaacgcagactctaagaccaggtttctattataacttagtttgtaaggctagttatcactctggatcttttaaaattgtttagaattttattttcactttccagagatttgcttatatcatctaatttactatcatcacagattcagttcttctaaatatttagtatatctagaaatatacaagaaaaatatttacaagtaaaatacacaagaaaatatctctaatttactatcatcacagattcagttcttctaaatatttagtatatctagaaatatacaagaaaaatatctacaagtaaaatacacaagtaaatatcttgtatatacaaggaaaaagccttgttacattgatgttctataaaatcttttcaagaaaaaatgtatgttatttgtttgatcatcacaggttttgttttggattcttaaaacttgacactaagaaagctgtgtgcagatgtcttgataaaaatttttatttatactgtggaaatattgtttttccaaataatacttgaattttcccattcttgctccaattttaaacaggtttgatggactaggcattaaacacttcatcttttattttttcctcttgtttacaaaagaaattatgtttctgctcattttgaaagaaagaacttcaagatgttttcctgtggtgactttttgggtccaagtatctcctagcgaataccatacaattatgttatcaacaaaacagcttttcagtactgcgagtaattagaccaagtatagacaatttgaaaagctggtaaagactacatttgtagagaactgagaattgtactccattcttctcttaaaaaaaggataataatattttatgggcctcagtagtatatactagaattttaaagttatatttgtgataatccccaccctgagttatcagaaaagaggaaagcaagtgtcagtctacatttgggagaatttcctacaaattttattatgcttagatgaacttggaataaaaaagtggtattacatatgtctagagttaaatgttaagttttgctttaaatgtataataaataggcaatgactttgcatgagtcaggacgccttgaccaaaggaatggtgtgatttctctaaataagataaagcaattgatacaacacgaattaaaccaacactcttctctatctgaggaataaattatcttccagctgctgatgtagaagcgttaagtaatacccccatattgaaataaagggatgttgaggcaacattaagaacttttttaaagaggtatgaggcccagatacagaatgagggttacttagggcatatcttgctttttgaggtgataattttggacataatttaactcccctaacattttccatcaaaacaagccaagcaaatatatccaaattgaatccagagctgccaagtcagaatctatgagtgtttaccataactgtctgtcatcaaccacaccctcatcagagaaaaggccacaccatttgaggatctatttttcgatctgggaagaaaaggggaaatgtcattaatagcaagtcttttttttctcttctttgtccaaaatcatcaataaatgaattatttttctatttttaatgttttaactgttcaattccaccaagtcatatgagtagacaagagtaaaccaaggcaaatttttcacctggtccagaagatattttgctatttagtctatatagatcactctcaccttagtctttttcatctgcttacatattatggcatcttcataaccaccaatattatattccctaaatatttttgtaacagatttctaaatgttataacacaatagtgtgacaaaatcatatttcaaaatacaatacaatcaaagccctcccttcaggcaatccataattttgtcttgtcccttgatcctttttccagaccactagagcactgataattattgtctcgggaaagagaggtatgaaaagaaaaatcaggttaccccagaaaagattttgacagtttgagttcctatttccaaagaaaatttagtactgaataaagttttaatttcctgaaatagacacatttcttacctcctgaaataaatatcttaggacagagagacacaagaacggaataattaagtatatagacatgtggacccccgagaaataaagaacccagatcctgataaaactctcccaacaggtttagggtgtccgaggatggaaggagcttacgatctccattccaaggtagtttagaggtggaaacagtatccatagaagaaatggcatcaatttgtgtgctagcagataatccaggtcaagtgtaaaaaaagacagcgaaagaggtgggggccaagagaactaactagagggagctggtgtgtgtcaatctcattgagaaaagaaaggctggcgagtggacactagctcatctgaaaaatccaggtggagacacactggaattcatcaggaaacagcataacacatagagaacagaggagagcaagacaagacaactgcccaccctggggtggcacagagtcaggggagtcctcccactgtggagaaacagtgagtaagtgagtccctggggacccaccttctgccatggacttttgcatccctggactcaggagatctcccccatgagctccccaccggtgcctccaggctgacacggagaaccatgtggagtcttggcagagccatactcaggcacacagggagtcccaggagacttgtatccccagacactctggcaccagtggctgtagctcctgcagcagtggaggccagacttgcatgcctccagtaaaggggccaaatccacgaggctgagcagtgaaacattgcaggcctcatctcagctgcaccttgcaggataaggcctactgtccattccagccccacctgagttcctgggtcgggagcagctctgtacttctctgggacggagctcccagagggagaggctggctgccatttttgctgctctgcaaccctccctgtttttgctcttaggcttgggagggacagggattagggactaatgccgacccccaacacagcgcagtttccttacagaaaagcgggtaggctgttttccatgtgggtccacacccttgctacttctcaccgggcagggcttcccaacctaggacctcggcaacccccgacctgggctcttgggccagtagcagctctgtactttcctgggacagagctcccagagggcaaggcaggtcaccattttttgctgctccacagtcctcattcctgttgccctcaggctcaggagggaatgtggtggttggagactgatgcaaacgcccagcacagcacggcagcattacagaaaagcagctagactgctttctatgcaggtctctgcctctgctactctttactgcccagtgcctctggacttgggcccctagcacaaccaccttgtcaatgcctaacacttcagtcagtggtgagaaaaccccagagacaatccacaacctctctgtgactgcagctacccttgggctggggaggaacaaagggcttggccactatgcaggaactccagcacaccacagccacaatatggacagaagcccagtgtctgtttcccgtgagcccccacctctcactctttaccaggcagtgcctaagctcgggagcacggaacagccaccccatctccagctgagcattctcactgctagtggctttgtgtttccttaaggaggggctcctacagtcaactaacagccactctgccactgccacagcagtagttctgcccctgctgcccttggactggagaagaaagaaagggccaaaggttttactcactcttccaggaggacacagtcatcatatagagagaagcccagactgtcctccctgtgaatcctcaacctcccgttctttacccagctcaggccagcagtgcagccaccccactccctggctggacattcccagtaggagcagttttgagtttccctcaggttgagcacccagggacaaccgaaagcccctctaccactgctgctgcagtgatattgcccttgctgccctcagactgtggagggagcaaagaccctgagtgctttagccacacctccagacagctgcatcacccacaagcttggtcctacaatgcagccaccacaccccaggctgactgtactgattagtagtggctctgtatttttctggggtggagcaccaagagacaagtgaaaggccatctgccacagccacagccaaggtcccttcccttgttgtgtctaagctggggaaagaacataaagcctgagcttgccccagagctacaatgtgtagcctgggagtgccaaacagatatacagccagcagtcaagtgcaaaaggagccgacactttcagatcactgagaaggggcacaacaatccttaggaaatagaggagactgacgaagagtctacctactggccattccagttaagtgccatctgctggatcacagcccaaactttactattaaaaatattttgctaatatattcttctgtgaaaccaaggacaagagctcagttacaaataaaggtcatgcacaaaacctcactcctctgaaaacatctaaataaaccaactgactgtactcaaattagacagttgaaagaacatcagcgaacacagatgagaaagaaccagtgcaagaactttggcaactcaaaaaacaagtgtcttctttcctccaaacaactgtactagttccctagccaggattcttaactcagctgaaatagttgaaatgaaagaaatagaattcagaatatgggtaggaatgaaaatcattgagaatcagggaggaagtcaaaatccaaaccaaggaaactaaggattacaataaaacaatacaggagctggtagatgaaatggccattataagaatgaaccaaaatgatctgatagagctgaaaaacacactacaagagttttatattgtgattgcattaacagcagaagagaccaaactaaggaaagaatcagagagcgtgaagactggctctctgaactaactaagaaggacaaaagtaataattaaaaaaagaataaaaaagaatggacaaaacccctgaaacatatgggattatgtgaagagaccagatctacccctcattggcgtcactgagggaaatggggaaaaagcaggcaacttggaaaacatatttcaggatattgtccatgaaaacttcccaacctcactagagaggccaatattaaaatttaaaaactgcagagaactgcaagatactatataagaagacaatccccaaaacacataattatcagattctctttcattctttttaaaatgaaagaaaaaaatataaaggcagctagaaagaaagagcaggaaacctacaaagagaacccatcaggctaacagtggacctttcagcagaaaccctataagccagaagagattgggggcctatgttcagcattcttaaataaaagaatttcaacccaagaatttcatgtccagtgaaactgagcttcataggcaaaaaagaaataaaatacttttcagacaagcaaattctaagggaatttattacaaccaggcctgccttataagagctcctgaaaggagtgctacatgtgaacagccactacaaaaacacacttaaatacacagatctctgacactataaagcaatgacataagtctacataatatccagctaacaatatgatgacaggctcaaattcacacacatcaatattaacactgaatgtaaatgggctaaatgacacaatttaaagctggataaagaagcaaggaccaacgttatgctgtctttaagaggcccatctcacatgcaatgacatccataggcccaaagtaaaggtttggagaaaagtccaccaagaaaacagaaaatagaaaaagctgaagttgctatccaaatttcagacaaaaagagactttaaatcaacaaacatcacaaaagacaaagatgagccttacataatggtaaaggatacaatgcaataagaagatctaaatatcccaaatatatatgcatccaacacaggagcacccagattcataaagcaagttcttacagacctacaaagagacttcgatttccacacaatagtgggacatttcaataccccatggacagtaatagacagatgatggaggtgacaaagtgaaaaagatatttaggacctgaattcaacaattgaacaaatggacataatagacatctatagaactctccacccaaaaacaacagaatatacatacttctcatcaccacatggcacatactttaaaattgaccacacaattggacatcaaaacaatctgtaacaaattgaagaagactaaaatcataccaaccacactctctgaacatggtgcaataaaaacagaaatcaatactaagaaaaacattcaaaaccatacaattacatggaaattaaccacttgttcctcaattatctctgggtaaacaataaaattaaggcagaaataaaatatttcaaactaatgaaaacaaagatccagcataccagaatctctggggcacagctaaagcagtgttaagaaagaagtttatagcactaaatgcccacattaaaaaagtcagaaggatatcaaatgaacaatctagcatcacatctacaggaactagagaaacaagagcaaaccaaactcaaagctagcagaagacaagaaataaccaaaatcagagctcaactgaaggaaattgagatgcaaagaccatataaaagataaatgaatttaggaattatcttagttatttgaaagaattaattagatagatggatgaatagctagacaaataagaaaaaaaaagagaagatccaactaaacacaatcagaaatgactgactgaatgaaaaaagacattaccactgaccccacagaaatataaaagaacactcagagactatgaacacctctgggtacacaagctaagaaacccaagaggaaatggatacattcctggaaccattcaacctcccaagtttgtgttaaaaagaaactgaatccctaaacagaccaataatgaattttgaaattgaatcagtaaataaagagcctaccaactaggaaaagcccaggaccagttagattcacagccaaattctaccacatgtataaagagctggtaccatccctactgaaactattccaaaaaattgaggaggaggcatccctccctcactctatgaggccaaaatcatcttgataccaaaacctggcagagacacaacaacaacaaaaaagaaaacttcaggccaatatctttgatgaacacagatccaaaaatcttcaacaaaatactggcaaaccagcagcacattgaaaagctaatccaccacagtcaagtaggttttatgcctgggatgcaaggttggttcaatataggcaaatcaacagaagtgattcaccacagaaacaggactaaaaacaaaaactacatgatcatctcactagatgcagaaaaggatttcaataaaattccacatactttcatgttaagaacgcttaacaaactaggcattgaaggaacatactttaaaataataaaagccatctatgacaaatgcacagccaacgtcacactgaatgggcaaaagctggaggcattctccttgaaaagagaaacgagataaggatgtcctctcttattgccactcatcatagtaatggaagtcctggctagagcaataaagcaatagaaagaaagaaaacccacccaattaggaagagaggatgtcaaactacccctgtttgcagatgatatgattctacacctagaaaaccccatagtctttgtccaaaactccttgatctaataaacaacttcagcaaagtttcaggataccaaatcaatgtacaaaaatcagtaatagcattcctatgtaccaacaacatccaagctgagggccaaatcaagaatgcaatcccatttgcaatagttacacaaaaaagtacctaggaatacaactaaccaggtggtgaaaaatctctacaatgagaatttaaaatattgctcagtgaaatcaaagatgacagaaacaaattgaaaaacattccatgcttgtggatagaaagaatcaatatcattaaaatggccatactgcccaaaacaaagtacagattcaatgctattcctattaaactaccaaaggcattattcacaagaaaaatgtattctaaaattcatatcaaaccaaaaataagcttgaatagctaagacaatccaaagcaaaaagaaaaaagctgaagatatcacatttcttgacttcaaactatactacaatgctacggtaaccaaaacggcattgtcctggtacaaaagcagacatatagaccaatggaacagaatagagatcccagaaataatgctgcatacttataagcatctgatgtacaacaaaataaataaaaacaagcaatggagaatggactccctattcagcaaatgatgctgggataactggctatacatatgtagaaaaatgaaactggaccccttccttacaccatgtacaaaaatcaactcaagacggattgaagacttcaatgtcaaacctaaaactataaaaacacaaagataacctcggaaatatcattctggacataagccctggcaaagatttcataacagagatgccaaaagcaattttaacaacagcaaaaattgacaagtgtgacttaattaaactaaagagcttctgcatagcaaaaacaaaacaaaacgaaacaaaaaaactatcaacagagtaaacaggccacctacagaatgggtgaaaatgcttacaaactacgcatctgacaaaggtcaaatatccagaatctataaggaacttacaaatcaacaagcaaaaagcaaacctcccacttaaaaagtgggcaaaagatatgaacgcacacttttcagaagaagacatacatatggtgaacaaggatatgaaaaaatgctcatcatcactaatcatgagagcaatgcaaatcaaaaccacaatgagataccatctcacaccaatcagaattgctattaaaaagtaaaaaagaaaaaaaaaaacatgctggtgaggttgaggagaaaatggaacaaagcagtttggtgatttctcaaggacctcaaagcaaaatgaccatttgacccagcaatcccatttttaggtatatacacaaagataaacaaattgttgtaccataaagacacatgcacatgtatcattagtatcatgctattcacagtaataaagacatgaaatcaatcaacctaaatgcccatcaatggtagactaaataaagaaaatgtggcacatatatgccatggaataactatgcagccataaaaaagaatgagatcatgtcctttgcagcaacatggatgcaactagaagccattatcctaactgaactaacataggaacagaaaaccaaatactgcatgttctcacttagaagctgaaggtaaacgttgagtacatagggacacaaagatgggaacaacatacattgggggctgcttgagggtggacagatggaggagagtgaggataaaaaaactacctataaggtactatgttcattacctgagtggcaaaataatctgtacagtcaaaccctgtgacacacaatttacctgtataacaaaccacacatgtatctatgaacctaaattaaaagctttaaagaaagaaaagtgttggaaattactcagaatcatttgaattactcacccgaccattccctaaaccttttgaattaaaataataatatgttttcagttacaagagacaacatatgttaagatataacatttattttattttattttttgagacggagtttcacttttgttgcccgggctggagtacagtgctgtgatctcagctcactgcaacatccgtctcccgggttcaagcgattctcctgcctcagcctcctgagtagctggggttacagttgtgtgccaccatgcccagctaattttttgtatttttaatagaggtggggtttcatcatgttggccaggctaatctcaaactcctgacctcaggtgatccacccaccttggtctcccaaagtgtagggattacaagcatgagccaccatgcccagccaagatataatatgtatttatcaaagttttatgagttacaataacaaagacatggaatcgacctagatgctcatcaacagtgaattagataaatacaagggggtacatatacaccatggaacactatgcagccataaaaaagaataaaaccatgtcctttgcagtaacatagataacagcttgaggccattatcctaaacaaattaattcaggagcataaaaccaaatactgcatgttctcacctctaaatggtaactaaatattgggtactcctggacataaaaatagccactgaaaattaatagacagaaattgggtggggtaggaagtgaagaagcgggggttgagaaactaattattgggtactatattcactatctagttgacaaggtcattcatatcccaaacctcagcatcatgcaatacacttatgtaacaaatgtgaacatgtaatgcctgaatctaaaataaaatatgaaaatgtaaaataagacactaaaaaaagaaaaggtagtggaatacttccgtgtttcactgtgactgaagaattatcttaaaaaaataaaatccataccccaaaattttatggtcaagaacattaacctactggaaaaatacagttatactaattatgtattggtgaaatcttttttcacatcattactttgttgtctaagaaaaccactagcatatggctagctatttagcaggataacaatcatactgcaacctaagaaaagtgatgatttcttcttccatcatttcaaataaaagaaaatcttatttgtagtccctataatatgagaattgtagaaaagttgcctatgaccttcttttccttaggaccctggatacatatagtcttctactaaggtccctcagagacatttgtgttgcacatgcagaatctgaatgatctcacataatagctttgctattgtagtactggccactaaacaaaataaaaataaaaataaagaaaaagggagtaatcctcaggaacttttatttttaggaataaatgtatctgcactttcccacagtcttcaggtaaccaacagaatccaaatgatatggaattgtcagtaattatcataggtaaattctgctaaacaattcaccttaaacacataatggactttaactataatcacttcaaaagaacaaatgaaaaggcattcatgggaacaaaatacaacctgaaaatataatactggcaaagattaagtgaacatagatgcctagagttatctgcatgatctccaggattagataacctaacaaagttggtaagtcatgtaactttgatcccactcagctcttacacattttagcgactatatgaagcatgaatagtatcaccatgtagtagacaatatgtggttgccaatatttcattccaatcctatggtatgatcctgcaactaaacatttattaaaaatgtccacatctttccacatttttctatctaagcccatagatttcattgttttttaacatagaaacttgatatctatagtcacttggtaaaatctgagccataattatcaattatatttttgggggtagaacatagatacaactgtgaataaaatataaatcaaaacatgtatactaaagttaaattgtttattcaactaattactcatattcatctattttattcatggtcattgatatactctataggcttctttgcaagtgcttcatttatcttatagatcttctgtctttttcctccctccactgcccttgctctgtgcaggtatctctattcctttctgaccagccctttttcatcattccaagtctattcaggaagcagaaaaaaacactttaaataagacttttttaagtttctattttcttcccttaccaaaacaaaaatttttacaatgtaccatgatagtgaatgaacttttactttatattgcctaagaaattattgtcatgtaaagtcattttttagtaatatactcatttagtaaagtaacttgaggatttttgtatatgtatctttgtaattgaagtaaatttctcaatatgggattcagatgtcttgtataagaaacatctgtgtacttttctcaaatgctgatgtttatgatggtccccatgggacaggtccttctttggggaaggagtagagaaatctgaaagtttaagatgacgctcagaggatcacggtatgtactactatttgagaactgatcaacttacagtacttcttctcatatctacttttgtctcttaaaaatcactagaaattcaaaaagttaaaaatgccatgctctttcaggcaatcatctggcacatggtattataataaatgggataacaaatccagagaggttaacaaagtccccaaggtcatagagcttaaaaagggttgagccagaatttaacctcaattccatctaacttggaagcttatttcattccagaggtttgggccctaaattaattttagggcctaagaactcttggcccttcagagtcatatataaaatttttttagttgaaggatttgtaccaaataattatgcctgatgctgtggaatttgaactaaaatctagtctagagaggttaggacttgatggaagtcacagagctgatgcagactcaaatttccatggtctttgtacacatatttactgcctctttcaaatttatcttttatagtcaaaaatatagttatttcttatgtattcataaatatttccattggaaaatctatgttatgggtctggtaccactgtgtcattaggaattgttatcaaaacatattataggtataatagaaggaacaaaacctacatgtagagagagcaaagcaggcaaccagaagtcatctctagcccttacctttacaatcactgtgacagtagcaataccaggtggcattgttccataaatatcaaaggcctctaccagaaaagtgatacttgcttcttggtctggaaatgcctcataatctaaactccttaaaagcgatagttctcctgtaaatggatgtagtgcaaaaaagtgcttcacttctgggcttcttatccggtaagacacatttgctccaaggtcgacatctttggcctgtaataagcagaagaatagttttattagtgacgttaccaaaataaagaaatgcaggaaggatggaagtcatgcgttagtgcctaggacagcatcaatttaacgaggacaaaaagacacgttttttgtttttgttttttaaaaaagcacattatttaataatttaccagggaagagaaggagggatgggggagagaaagatggaggcagggaggaaaggagggagacagtgagagggagagtcagagagagagagagagggatctttctataagattttgtcattgttgacgttattactgtatctgtttaacttgaaaaatcactaaatgaactatatcacagtaaaaaaataaatattgtcttaaatgactgtttcttattttctactgatttgataatcatgaacaaatattttaaataaaaataaatactgagtgatttccataaacataatagatggctaaagtactataagaaaactgagaaaatataagtagtaattatttgtcacagggatcctataatacatttctagagatcactctaccatacttcctttgatttaactaggatttgagtagtagttacgcacaaggtgctgtagagagcaccaaaatgaatccagacacaattactgccctacaggttatggtctcagagaagaaacaagacacaaatactaaaatagaaaggaaaaaaatgtgacatgctatctaaaagatgttctaaattgggaacgatatcctttagctgaaaggatgggttttcatgggagtcttgtagaatggctatttcactcagcagtacagactggcaaatgcacctcaggtacagaaaaccgaatggagcaagaatgaaaatggggaagatccagagtatgctataatgtgcatttttaaatgcaaacacctcctatggtgaacctcagccttggtctcctccaatcaattattgacttaacaatcagaaagatgctattaaagcatacattttattatgtggtttttcctgcttaaaatcccctggtttttaattcaattttcaatcaacgccattatccttaacatggtaagagccactacattttctagacctttagcccctcacccctcacactttcccatcttccatgattttgaccaggctttttccccccaactactttgaacaatctttcttccttttctgcttggatagctcttacttgtccctcagttcaccatttagaaataagtttctctagcaaatattctctttgccttaagattaggttaggagctccacctctattacctaggccctttgtactgaggacctacgttttaactactaattttcttgactgatagctaaaccagcctgaaaactcgaagaaagcagtaaatttgttttgttcacctttgtatccccaaagtctttgcatcccctaggacagcatgaatttaacaacaccagcaggagacttggcatactatacatactgaagacatgtttgttaaataaataacttaactaattaattaattgacagatgaatggtggaatagatgaaggaataattgttctctccctggccagtatttgccttatttagatttgttaatgtttattgctgagttcaattatggaagggatacagagtctggaaaagtatgctaaaaacattcaagttgtggactgcaggtggaaaaatggctacttttttttttttccaaaacataccttatagaccaactgagtcagtattaaatgaggtggttgcttaaaaatgcagatttatggatcagcctaatctactgaatcaaaatgttcaggactgtgtaatttatagttaaaaacttaaaaaagaggcttgatacagagatgtcattaaaaaggagagttagattactagaagatggcttttgtgtattgaatgtgaaaacaatacagaataatgggtataaacaatatttgtaaaatagaggggaaaccaatttgtaactctctatattttttctgtgtgtacacatttatgttatatatgtataacccacacaaattcatatatatatatgtattttttgacatttgtgtgaacacaaagataaatgtgaaataaatttaatgctgagtactctggaggcacaatgtgggagattattaacttttgcttcataaactattgtattgtcaactgttggaataaacagaatattacttttgtaaattaaaaaactattaaaaagtatatttttaatttcttacaaatagatctttctgcccttaatttttgggatatctttaaagtaggcttgccacataaaatacaatatgcaatattggagaaataataaaaatttattcattgtttatctgaaattaaaatccaacttggtatgttgtattgttacttgctaattttggcacacaaaccctaatagcaaatctcctaatgtaggattcatgtaataaatgctttttcccacacacctctatttgaaggatggtagtcccagctggcaaattctcttcaacaaggacagtgtatgttgaattggtgaacacaggactgttatcatcaatgtccaaaaccttgatggccaaggttagagttgaatgacgagggtgtactgctccatctgttgccacaacaacaagttcatagtagtccctgacttctctgttaagcttcactgctgtgtaaatgctcccattggatgtgatacgaaaaagattattaaagttacccaaactgtagtgcacttgaccatttattccagcatcagggtctgttgcctattaaataaaacaaaaaaacaaaaaaattcacgtaagttttgacgggctactgtaaatgaaggtaacagttaacaaattatggtatttttctaaccaaaaattatttggccctctaaggaggaaatgacaatgacaatacaatgcaaaatttaaaacatgaaaaatattatactttaatattcttcatttaaaattaacataacaaaaacggataatgtcattagcaataacaatactatgttatgacagaaaactcataaaaatactgaatctttgtcttatgattttaataggttttgaattctaaagtgagaaaaaattttgtttgtaattcatttaacataatctgccgagtgacaatttaagattatgtaggtttttgctcactgtatatattcattttatatttatatatgtttagtaataatgttacacattatgtttgtttataataaataatattttattatgttatgctgttatttatgtgataatgtttattataataaacattaatcatatttaccataaataatatttataagtataacctgacttaatcctcatgatgttgttatgagtaaatattattaatctcattttacaaatgagaacactgtggcttatggaaggttacacaagaaagaaatatctcagtgtcccagttcttaacacaatacttcatatataaaagtacttaacaaatgcttgtggaattaatgaacattagatgaaataaaacagatttgaaactaaatctgttccaaaagtcaaataggattaaaactacagtaactgtaatgtatgtgcaagggactctttttcaacattagaatatacatctctgcataagtaagaatgtttgataccataatatacctatatttactgaaaatttgaagtcatgtaaaatcactttgcatcaaataaaatgagaaaatattgagtaaatattcatcgaatgaaatgtaataagaattaatcttagctaaaactcaattgtgatactaattatgaatctcactatcagctactgtatattttgttttgaaaagttccatgtaaaagaaactgaaataaatcttagaaactgtaaaatattatataattatgccccaaactgtcaacaaggaaaggaaggaaaacaagacacttggctgccttatgagccagggacacaaaaatcactcgaggtccataaagcgtggaatgcaatatgatgtattttaacagcacatatgcagtggtatatccagttttacaggcaatggtaaagcatgcagaatggggatgctgaatatttgcatcttctttgaaacaagaatgtctaagatgtgaaaatcatgtttacaacagtgctcctatatgtcataatgccaagcatttcagcaggatttgtctctttgactcatcaaaacacaactgcccctgggagtttgacatctctgaggtttaattctgagaaaagatagaagaattgcagaaatacctgaagagaaaaaatacggtgacagagtagaatagtttctgttgatatagtttcttttacttttatactttgcctagaatttgtcttacgaattattgacaaatcagtcaagctgatcattctagtgaaaacaaccaacactgccttctccctttttcaccaaaaaaagagggtgatctctttttttggtctgaaattactcatcaagtaaatagataaaattgtaagccaagaacaaaatataaatatgttttgtttcataataataatacccttaaaaatttcagtcactttttctgtctatggaatatcttaagatcaaaaaaactaatcatttatgcaattagaaatttaaatgactcttgttcaagttgtttttattgacccatataattgaatatttattatggtagaatggctcaatttgactgatgtggctgtgtgtccgtgtgttttatacatgtccagctgcttaactatacatccactaggaaacatatctaaacatatctaaattagttttgtttttgctcccatagcaaattatcacaaatttagcagctgacacaaaacaagttcattattttaaagctctataggtcaaaaattcaagatggtctcaccagggctatgtttctttctggagactctaaggagaaacaacttctttgctcattcaagttgttgacagaattcagttgctagagtttgtagaactgagatccccacttccttgatggttgtcatgtgaggaccaatcccggttgctagaggtccccatatcccttggttcatgacacatttccaccatttttttttttttttttgagaccaagccttgctctgttgcccaggctggagtgcagtggtgcgatctcggctcactgcaacctccgccttctgggttcaagcaattctcctgcctcagcctcctgagtagctgggattacaggcacctgtcaccatgcccagctaatttttgcatttttagtagagaccgggtttcaccatgttggtcaggctggtctcaaacccctgaccttgtgatccacccgcctcggcctcccaaagtgctgggattacaggcgtgagccactgcgcctggccatttcttccatttttaaagccagcaatggtggtcaagcccctcacattttttgaatccctccctccatctttttccattttatctttctgacctactcttcaggcatcctccttcacttttaagggcatgtaagattacattatgctcccttggacaatccaggatagtatccccatctcagaatttttaaccttgatatatgtgtgtgcacatgtgtgcaagtgtgtgtatactgccatatataaatatatagcaatctatattttaggatgggatttttttttttttttgaaacaggtcttgctctgtcacccatgctggtgtgcagtggtgtgatctaggctcactgcaaccttcacctcccaggctcaagcaatcctcccacctcagcgtcctgcgcagctggcactacaagcacatgcccccaggcctggctaattttttgtatttttatcagaaacggggtttcctcttgttgcccaggtcagttttgaacttctgggcttgagccatcctccccctttggcttctcaaagtgctgagattacaggcatgagccatctcacctggccggataggagtttttagagaaaatatccaagcagatattcattaagcagactgacagtaaatgctaaatggggcatcctcaccaatagagtttcagaattttaaataatcagtttaaattggtataaattacgatatgtcaagtacacacacattttgactgaatctatgacaacttaattcactgaattcaaagctaccatgacaagaagtatatttgatgcttatggaaaaaaagactacaatatctttggctctgtttatatgctggattacatttactgatttgcgtatattgaaccagctttgcatcccagggatgaagtccacttgacagtagatgcagaaaaagcgtttgacaaaattcaacgacacttcatgctaaaaactctcaataaattaggtattgatgggacttatctcaaaataataagagctatctatgacaaacccacagccagtatcatactgaatgggcaaaaactggaagcattccccttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagaggataaaatacctaggaatccaacttacaagggatgtgaaggacctcttcaaggagaactacaaaccactgctcaaggaaataaaagaggatagaaacaaatggaagaacattccatgctcatggataggaagaatcaatatcgtgaaaatggccatactgcccaaagtaatttacagattcaatgccatccccatcaagctaccaatgcctttcttcacagaattggaaaaaactactttaaagttcatatggaaccaaaatagagccttcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaacgttagacctaaaaccataaaaaccatagaagaaaacctaggcattaccattcaggacataggcatgggcaaggacttcatgtctaaaacaccaaaagcaatggcaacaaaagacaaaattgacaaatgggatcgaattaaactcaagagcttctgcacagcaaaagaaactaccatcagagtgaacaggcaacccacacaatgggagaaaatttttgcaacctactcatctgacaaagggctaatatccagaatctacaatgaactcaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaactacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactagaaatcatgctgctataaagacacatgcacacatatgtttattgtggcattattcacgatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattgtcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataataaaaaaaagactacaatatcccccagaaagctactctaaaaattttaaggtgactgagacacacatctaatggaaacaaagggaacagaatataaaatgcagagctatttccttatctattcctatgtccccattaaattaaggagcataaataaggtgatgtaagttaagcaacatgagctggctaagcaaggcagttttacttctttactattctagatgaacatgtagatgttaaacaagataaccaaacatagaatcccttattatcagcagtactgtcaagaactttgcattgatgtttaatatttagtcaagcagctcagtgtatgatgctataatgaaaatatatattttcctagaaatcaattaaaagttaattaaatttgttaataagaaaaataacacatctcttttccccttgtactacatcaaagcaatgaacagtaatagctgcaactttataatcatctgtccatggttaacacatttttgtaatatacaccttactatggggcctgatttgtggctactaatttgtgaatgcatattgctgggaaattggctgatagcctgtagtcaaataaagacctcactggacagaactttgaataattgccagaaacaccacttgcaaaccttattcattaacaccaaagttagagtatatgaaagacaaccaagtaattacttaagaaaaaagtcaagggaatttattgaaccaaagttttttgtataatttttgagaagcgattttatagcatgccacttgaaaagggaaaagggaaatatatttcttaaacactaaattcattccccacccctttttttctcattatcttcttagaatggtctgttacacaattctttccatccataaaagtggaagtccattactgggtttgctaccctgggggttaccagtcctgtagagaagaccttaaagcatgcctgtatgggtggaatatactaggataaaacctcaaagaacaggttgatgtttgcactccttccactgagaagtccctgggtaggttacttgtgtaatttacaatgattcatttccatttaaaatatgtcaaatatccattcagattaattatttagatagaaaattttatgacaaaaatcagccccaaggaaataacttgaggacaaaaccaaaatgttatagctattataaaggtgtgaactaccatgtagcacctaattggcccagtgtgaagctgagagagtgctttgctctaccttttgcttgtcctttacagcgatttaagaggtcgtgtacatctttctcactttgaagtgggaaccataaaagctgttgatcagggaggttgggcagtgcatccttcatgacattattagtgaaaatacatttttaaaattattatctattaacttcaaaaagatgtacaatagttgtctttttttttttttttttaaggagctgagctatttcaagggctgtgattattagtgtaaaaggagacaagcaatttaaagactcataatgcaggtaaattttttcactctccacacaaatgcctcataatcattattgaacaatggcaagtagacttactggccagaagataacttgcataacttgaattaaaatcactaaaaacataaccagaatgaatagcttttcattctagtccctagaaatctagtccctagaaaacacatatttaacacaaataatttctcaaggggtcagctattattctaagatacacaataaactacattttatcctagcattcaaggctctacctggtcttgttctaacctatctttatgcatttatatccctcagactaactctctgacacaaactctgtgttttagtcaaaggagtctatttatggtatgaatcaccaccaagaaactctcaagtgtcagtggtttgttaccactgatgtttctttctcgcctatacagcacccactgtgaattccaaatccagctttactctatcttgtctttactcagaagagaagctaaaggagcaggcttcattggaatatgaagctcatgtggtgcaagaagaaaaaaagacatgagatagccaagctgcagcttttaacgcttctgcttggaggtcaacgtatcacctatactcctgcttcatcgttgaaggcaaatcacatgacaaggccgatgtcaaggggtgcagaaattccattccctcacacagtgggacagtgataaatcagaaacacttttacaatgtactaccctggttttccttgaaatgaccatgctctccctcaccttccctgatataggttttttttttgtttgtttttattttcccccaatccaacttaaacgttcaaaacctagcttcagttctacttcatctgggaaacctcttctttccatccagccttctggtccctcttgcacatagcaaaactcactttttattgctatttaagtatgctacgcaattaaataattggcctaaaaatctgtggtgtatccatgtattatgtaataggagacactgttagagaaaagaatctgtaaattgttttgtggagtgtacaatgtatgagaagtggaaagttggagcacagatggaaatatggtagagaaggaaaaaaaaaagatagcaagcaaataaaaataaacaatattcctgtagttgggtgttatttaacgcaaatgaactgaaggtgtcaaattaaataagacagtttaagctgttccaacataacctgcaggcctcttactaagtaagcattaggaagaaactttgcactaaaaacctttacatattcagttctcatgttaatggtaaacacttgaagattatgacatcaatgcttcaggaaaagagttgttgtcatgttcacgctcatacagcaaagaaagaaagtaatgttgtttcatgttcattaaatgtatttacatagtaaggctgtcttttccctttttcaaatattccttatagtgctgaaaacgaagaggaaaacctgggaggactcatttcatatttccccaccattgcttagtatttgataattatgcagtataggttgagtgtgtatatacctctttatgtgatggtaaaaaaaattatatattaaattatatttagttttccaacctcttcttacttctatttctccaacttcttcattctcatctttttctctgtgggcgaacatattcttaccactaaatctaagtgcattttgccatactaaccatgctatttcatgtctgctttatccagtcataaaatcttccccttatttccaaaactgattattcttcagccctagtatcacctctcagaagcatctgagtaagctaaatgcctcatcttcatgctcctgaagctcattgtatgtttctttaccacatgccctattgctttttttctgtcattttttaatagcccacatgaaattaagaattcataaggacaggatggcttatttatatcatacaatgcctgctttatttttctttttgcaatgacataggttagatatgcaataatttctgccaaaatttcttctgaagctatttccatttttcaattacatatcattcccaccccaaccacccaaacacatgaagaaataaaaattgccaattagtatttataattttgtcttaaaagaaggtatgttttctgtttattagaagaaatataagaaaataagacacattttgttctttaaataaaacttaagtgatcacataactacttattaaactttgtccttttgttacattttattgctttcttgttttcaattttgtcactatattagtcagttttcacaatgctataaataacttcccagaaactgggggatttataaatgaaagaggtttaattgactcagtttcacatggctggggaggtctcaggaaacttacaatcatggtggatggtgaaggggaagcaggcaacttctttacctggtgacagaaaagagtgaagaaggaactcccaatcacttataaaaccatcagatctagtaagaactcactcactgtcataagaagagcatgggggaagcctcccccatgatccagtcaccccgctccttggacaagtggggattataggtccctccctcaacacatggggattacaaatcgagatgagatttgggttggtacacacagccaaaccatatcagtcacctagaattctttaaggaaatctatttctaggtcagttttaaagtaagtacaatatatatacctatttttgtataattaaatatattagtttaacttttaacagtctattctagcattgcttaacctttttcattatcaactcctgtcaaaagaggattttaagatttttttctttctaatagaacccttataaatttgtacttccacagatatatttatgtatatatattatccatgctttatacataagaaaagtaaggttttcttgtctcccaaaacctgattttccacattggaaatgatctaccaccgttgagaatgcatgctctagccaaaagagagtcctctgtaacttccttatataccataaacatttccacataagcattgttctttcagcactcattacagtggcatcactttctaaaatgtctgtccatattactatatggggcaactcagggtatctctgagcttgtactcaatactcatcacttcttaagtaatgaaataagggaaaaataccatctccatgaattgcattttatgtgataatctgcttagcccaggccttcctatttatttgattatgcttacattttctgccaagttataacacaaagtattgtggtttgttttctgaataactattttaaatagtcttctctatgcttattgaatatgtgacattttgcttatcaggtgtttttataggtcctatatactaatccaagttttaattttcttttttctagtattctgttgggttcaatataaacatgcccatgcccttctctgaagagtcaagagtaatgtataccttaagcattgtccttctgtcacagggcttttcattatattacattgtctcacaaatcattttcttgtatcatttctagaaaaaaaattcttaactggaaactgaaaagaatgtgacagccagattggattctctgtgaaattctatacaattaaattttctggataacattcaagtaaaggattaacagaattgtaagtaaaacaagagcaataaaaatgcctctggctaatataataactatttaatgagagaaaaatatctcttaatttcccaatactatcaatcatttcatttgctgaatataagctcacgtttttcccaaacaatacccataaaattaaaggtgtttttctctattttacacacattgtcacaatttgacctaccttgataacatcacagggatagagccagatataggttccagttttattttatcatcactcattccttgagctagtttagtaattttcagctgtttcattaccttaatttgggatgtctccaaattggttgatttaaaaatgtatgttaggtattcattttgctgacaacaattcactgaagtaactgaggatcatgttttctaatgtcttgtccaacacagtaatttaaattaggaaaacagaattaattggaagaaacaacttatgtttctctatctactccctgggactgcattcaaagagctaagatgtacacaatgtgaaactgccttttgaattagaagttatgaactcagattctgctgtgtccttccttttccagctgccttccttcagatatactttcctagtaccttcctgtgtgctactatgtaaatagtaggtaactattttagaatcattcctcagcagcaggctttatgaaaagtgctgtcagtttgttttctttaattgtggtgtaaacagtactgctgcttaccttaatattaattatatacacacatttttagaagttacagatatataaaagggccaggtactttattaacatccttttttctttctggtaaaggtaaaataagccagattggagattaaaaagtgtaggaaacttcatttggatgccattcctttgttaattgttagcatgtaggcaataagaggaatatttcaatatcaattggccaagcagaaattttcctgagaataacagaatgttttcaatgacatgttatttatggagtgtaactgttccacaggagcagtctagtcagtagaattaaatgatactgtatactagaactggaatctgagataaaatagaagtggtaagtttacaggcacactctgtttcattgcacgtggctttattgtgcttcacggacgttgcattttttacaaattgaaggcttctgacaaagatgccttaagcaaatatattggcaccatttttccaacagcgtgtgctcatttcatgtctctgaggcacattttggtaattctcagaatatgacaaacttttaaattactactggatctgttatggtgatctatgattagtgatcttttaagttactattgtggttgtgttggggtgccgcagaacacaccatatgagagcaaatttaattaataaaggttctatgtatacatttttttgacacatggtccaagatgagatggtgtatgtgttctgatttctccacccactgaccattcccccatctttctcactttccttgagccttcctattctctgagacacagtgaaattaaaattaggccaattaataaccccactatgtatgggctctaagtgtttaagtgaaagagttgtgtgtctctgatttgaaattaaaagctagaaatgattaagcttagtgagaaaggtaggtcaaaagctgagaaagcttaaaaacttggcctcttgtgccagttagccacattgtgaacgcaatggaaaagatatttcataaattaaaagttctactccagtgcaaacacaaatcataggaaagtaaaacaacctgatgtgaagctgatgtgaagaaagtttgagtggtctggatagaagatcaaactagccacaacattcccgtaagccaaagcctaatctggagcaagaccttaactctcttcctttctctggagcttgagagagggaaggaagctgcagaagaaaagtctgaagctagtagaggtgggttcatgaaatttaagggaaaaataaaaagccatctccataacataaaagtgcaaggtgaagcagcaagtgcagatgcagaaggtgttgcagctagttatccagaaaatccagctaagatatttgtagagggtggctacgctaaaaaaacagatttccaatgtagataaaacagttttctattagaatatgccatctagaacttccgtaacttaaaacagagaggtcaatgcctagattcaaggtttcaaaggatgggctgactttcttgttaggtgctaagagctggtgactttaagttgaagccaatatttattgaccattctgaaaatcctagtgcacttaagaattctgttaaatttactctgtctgtgatcaataaatggaataacaatgcctaataaaagcatatatttatggaagcataaactatgtttacagcatagtttagcaagtattttaagcccatggttgagtcctactgctcaggaaaaaaaaaagacttctttctaaacattactgctcattgagaatgcacctggtcactcaagagttctgatggagatgtaaaaggacatcagtgttgttttcttgcctgttaacacaacttccactctgcagctcatggataaaggagtaaatttgaggttttcatcttattatataagaaataaatttcataagattatagctgtcattgatagttattcctctgatggatctgcgcaaagtgaactaaaaatcttatggaaatgattcaccattctagatgccaatagcaacatttttgattcatggaaggaggtaaaaatatcaacattaatagaagcttggaagaagttgatttcttccttcatgaatgactctgagaggttcaagagaggtttaagacttcagttggatgaaggaattgcagatgtgatagacatggtgagaactagaattagaggtggagcctgaagatgtgagtgaattgctgtaatcttatgataaacttgaacagttgaggagttgctttttatggaagagcaaagaaagtggtttcttgatatgatacctactcctaatgaagatgctgtgaacattgttgaaatagcaacagataatttagaatattttatatactttgcagcaaggattaagaagattgactccaattctgaaaaaaacttatttagctacaatgctatcaaacagcatcactagctacagaaaaaaatttaatgaaagcaagaagtattcaatgcagcacaattcattgttgtcttattttaagaaactgacacagccatcccaacttcagcaaccaccctcctaatcagtgagcagccaccgacagtgagacaagaccctctatctgtataaagattaagacttgctgaaggttcagatgattgacagtatttttttaagccataaaacactttaattaaggtatggacactgtttttcagacacaatgctaattgcagtatggagtatacttaatggagtatagtatagtgtaaaaataatatttatatgcactgggaaacctaaaaccttatgtgactcgctttgttgcaacatttgctgtattactgtggtctggaagagaactctcaatatgtctgaaatatgcttgtattaaaaatgtgtattgctttgagaaacagaaactctacaacctatctaccaagaatctttgcagataataaagaaagaagttattgacttatttcaaacttaaagtctgaggagtctaaatggagactgaagttacgtctaacatgacaagtgtgaaccactttgatttggtttgcccagaggaaacattactcctgctactttcataaagactgattgcttttgacagaaatctgtctgtgcagagttggatgagtatgatactgagaagtcataaaaccattagaaaagactgggctcagaggatctcctcataaaaatgttcacatagaaggaataagacagtgaaaaagaggctgtatttgctatatatccacgttttgaattatgacacacatagggaatatttccagagcttggtttcagaaatcccaatgaactaattcttctgagatatcataaactaaatagtgggaaagcaagccaaagaaatactgtctgatttatttattttgcagactgcacttagattttttaaaaaagagcctctcactttgattcttgtatgacttgaagaaaaagctatactgtataaaggtgtttgcaggtgggttctctggcaagcagacaatgaggcagagattagttgcaagagttttgttggggtatgctttgggggtcaacatttttggagggcaaaggacaagaccagaattggattcagggagaaagtcaaactactgtgcagggtcaactacagccttggccaacccaaggaaggagctgcagaattgcaattgcatgtcacagtttttctgagctggggtaaaatgtccagcattttacactcaggcatcagtcaggatatgggctacactgaaatgggtgtgactatgggcaagggaaccttctgtagataaggtcatctctgaagtggctagcagctgtacatccctctttactccttcatccctacatcactccaaaaagccaagacattcagctctaccttcaagggagatctgcttggcacacagtcttcataacaagcctctatcttggattggtttttttcttagagtataaaatccttgcttaacagaatatagcaaattttatacacatacacacatatattaaattattacaatatcattcattgttttcaaatgaaacagccagctacattattacctcaaaggtgaaaaagtctagggtttgatttttttgatccaaactaatatttgtcattttccacccctgtgcccagagacgtaactcatattttcctgttgaatttgtttcccaagtagaaacagaagtcttaaatatgatgaactttaggttttttcttttagttcttataaacacccagtatggcagttattattgtccatattttacagccaagaatatttcagaaaaacaaaaaataagttcattttcctttagctagcaaataagagtatttggatttgaatttagagtatgaatgtgccatctgtttgtaatttttgtgcaggtaggggatgctgctataactagtgtagcattattaattattctagctgcatgatagattggagtccagagatagaaagatgagctggacataatttagaattcactctgaattattttcatgatggggattaagggccatatcacacaaatacacacttgaaggttatcattacatagcccctcagactttacatatatttcattagaaaaataaaaatctaagttacagagaattgtcagtgggttccctcaatgtctcccttactctgtggcaagctagtctgacatgatatctaacagaaggaaaaacatacttcagataagtcatggaagtcataccatgaagtcatgagaattacagtatatagtgtgcccagagctgtgaattccactaattattttgaaacattgaaatattcatttcaaaataaatctataaaccatccaacatctgtacttatctttatcattctcctgctgctaaaattgaggaaaactccacttcctcctaggttctcaagggaacatatgacacttgagcttttgggactctgttgcctctctttctggcatttctacatccctctttactccatctattgccatcagttttcaaacctgctgaagaatttatcattacaaaataaagagaaatgagaaagaaaatataattgcttcctactatgtctgttttcctacaatctcttcacatcccaagattctatgtgagggcagtgggtgggggaagaaaaggacaacatatatatccattgcactcatttattaatgagttattttgttatttagtcatgcaaatcatgcactatacaaaacatacactatgtttcctaatactgtttacttaattactcttaaaaagtcataattagttctttaaaatgtaaaactaaaatatgacaaatgatgccatctttgctattgagatggtttggctgtgttctcacccaaatctcatcttgaattgtagctcccctaattcccatgtgttgtgggtgggacctggtgggagataactgaatcatgggggcggtttcctccatactgttctcttggtagtgaataagtctcatgaggtctggtctgatggttttataagaggtttcccctttgcttggctctcattctctcttgcctgctgccatgtaagacgtgccttttactttctgccatgattgtgaggcctccccagccatgtggaactgtgagttcaataaacctattttttctttataaattaccctgtctcaggtatgtctttatcagcagcgtgaaaatgggctaatacatctatattcagttactaaatgtgttctgtgaatgaagttggatgttgaatgcagatgctaatgtactgccacatgccagttagacacaattatgtatgtatggagatatatataataaagggtacttgtttaggaatattttacaaaagcatggcctgtcagtgtgcaccatacatttcagagacatgatgaaaaaacattaccactagagtgtcacactacaaatgtgattttttgaattctctataaaaatgtcaatttcccaagcttagcatatatgtgtgtctaaatgtaatggcaagcttcataaatgatgagcatgccaatatacgaagatttggatgcaattatttactctaaaacttcatcaatattatgtggttgcaggtaacttttaaataggcccttttggatctcacatgaattgaaataggaaaaaaatctatttaaagaagtcctgaagtagacgtatatgcttaatattaaacattgtttgaaattgaagagtctggcttaacacactaaattaagaaagaagaaagaaagcaagaaagttggatgttgaatgcagatgccaatgcagtgccacataccagttagatagcatgtggcaagttctaatgggcacaaaatgtgccttgttcacattaatgctttagtgtagcactgaatttgcctctcagtaaatgttaactaaatttaaaaaatagtattattttccccaaatacatcaattcataacattacaaaataattatgctataagtttgatttgacttaaccatacatgttttcatccatcaattcattcatttattcacccacatttattgttgactttaagctgaacaacattttcagggctggggctctaactaaggacaagagtaatgtgttctttgatcttatgtcacttgaaccaaggtgaaaaagtagatattaaaaaataattgccttttaaaaattattacagtgataaacctaagtaataaagtaaatatgcattgcataataagagcatacagcaggacttttaacccggcctcctgaaaattacattctaatgggaaagacaaatgtcaaccaaaatattaagttacgaaaataaacaacttcatattttaatggacattatgaaaaagtaaagtgaactatgagagcacataaatataggtacttaaatccaatattgtgggttcaaaaaggaaatgacattcaacagcatccagaactcttaaactttagttttcacactgtcaggaagtttggaatcccaacggtgactttcacattacttgtattaaataaaagtcatgacaaaatgattacatttttcccattagtttacaatatttgtaaatacaggaaatgacaatagatacagtacctcttgatgttagtaacattcttgagattatttgatattagtaacattcttgagattatttttagtaattaagatagaaaaaaaatgttttctatataatggcataatgacttagattcagggatgactgaagaatcattctcaagttgaatgtcaaactggggaggctctgatggcacgaagcagctttctataacaatttcccatggatgaaatattgccagacatttttgtaacgtcttgggtgatggtaaattctctcttttaagttttagggaatcctattaattaggactactctctccatttcatagctaaggaaactgagtttcatatggattagatcatttgcccaagtcaatagttactaagtgatgcagctagaatttgaatgcagacaacctaaataggaatatgctatatttgcaggcagtcaaaaatgctgtaaagaaaatttaatgttggtaaagggaaagggggtatacttgtttctggaggacagggagagtgctattgaaatggggtactcagtgaagtcatccttgcaaaagatgtctttttgaatgaaagagtgaatcacacagagagttagagaaagagtgctccaggcagaggtaacaacaagtacaaaatccatttgaaggtttggtaagcgtagctgtgttcaagaacagcaagaagcccagtgtggctggagtggagtgatgcaaatgatgttggagagagcaggaggagccaagtcatgtggagatatgaaggctatgaaaaaggagtttggattctgttctaacacaatgagcatccactgaaatgtctgagtggcaaaatggtgtcatctaatttgcatttttaaaatatcactcttgctgtagtgcagaaattgactgtaagaggggtagcacaggtcaaaaagtaagatactatttacataatctaggggaaaaatgattgtggtttagaataggtgaggagtacttgcctttggaatatgtttcagacagatttactgataatgcaagaatcagaagtggtcctaggaagcagatacttaagatgagattttggaatttgctaatttgctagccaaatggcatgcttactgtacaggagttcagagtaagtcatgattcatttgaagccttcacctgagatgaactgatatggtatatgggggaatggggagcctggtttaatgccatatctgtataatttcagatttatcggtgaacattaattcataaaacttacagagttgattggttgctaaatataacaaaggtgttgaaaaagaataaatgaagctcagaaccagcaatatcaattcagaggtaaagagtaaaaaccaatgacctccattagcacgtttaaagaagctccatatccacagacaatgacagactttactcaaaatcatgctcaagatgtaattacaacctgctctctctctctctctttctctttctttcttttttttcgagacagggtctcactcccatttcccaggctggagtgcagtggcacaaccacagctcactgcagctttgactttcctagctcaggtgatcctctcacctcctgaatagctgggactacaggtatgcaccaacatgcctggctaatttttgtatttttttgtacagacagagatttgccatgttgctcaggctggtctcaaactcttaggctcaagcaatccacctgcctcagcctcccaaagtggtgggattacaggtgagccactacccctggtctcaagacataattacaaggaaagatgcaatcaactccctgacaagtcttccacaccagtattggtagggaaggagagctggtctgggcacatgtggctacaaacacttcaaaaaaacatactgattctctggaacttctagactgaaaacttcactttcttttcatttttagatgagaacagtatccctcgcctggagatcaggtaatgacttcatctgaattagataccttaccatcttgtaagcaagatgatagatgtcctctgtacctatgtccctgcattgcttttgcaccaataactaaagtcaagttgcagcatgttctaactgtccctgctatgagtagaaaaggattattcccaaaaagaacagcaggatatgccttatagtattggcagcaccaggaggacatgactgaggatagatcttgattatgttggaaggggttgaagggagaaaagtacatcttaccaagagtttagtggtatggagatactttgtcataattgtggccaggacacctggagttgattctaaggtactgctggattattccccaaaggttgtgaaaaacagtggcctataataaacaaggtgtaggtagtgaaagtgcctggacagggatttgaagttaaaggtatatagaagtgggcattttagcatggatttcttatgtatgaccagagaaaccatctattagttttgttcctcaggagagcctaggtagcactcccaattctgaagcaatatagaaaggtgcaacaagaggtgctctggtatcattgaaaagttcagtgatggctctcctcaccaggccagagtagagggtagtgaatgttgctatgaaacttgtgttccttagtgtcaatgtgagtggaagaattctggattcagaatccaggtggaaatactccaatatcagaggcagatggatgaaatgtatcatagcaatcagcaaaaaacaacgtcaaataagctgctacgaagtgcaaagatctataaggatggctatccaaccacggtgttcccaaagcaaatacagaaaggcagccaagaaggctattgctggatttatataatctaaaaacatcaaaatcaggtaaactaaagccgcatcattgtgttctttcctgtgattaatacacatttgaagtatgagttgcttttttattgctgcagtgatttggccaatattaatagctgaggacactgactattctgactttgtccagaaaattgcacataacatcaattccaaccaagaagttcatctcatggcaaagttaggtgcaatcatatgcataggaccactggatctgttggcactaatatacagtaccacccagcagtgctgacctagtagaatactggaaaagcctcttaaagatagagctaaggatgaatttgggaatgaaatttttcagggccacagaaggaatgaccattgtatggtacatttttcttgataagaagactagatggaaatgacaaatcaagggttcagggtgggaatggcctctctcatcatcatcttgactaacccatttgggaaaggcatactttcgtccttgcaaagctaggctctgctgcactagagatcctggttttctgaagaccggggtgatgttttcactgagatgacatagtaagggtcccattaaaccaatatttatggttagtcagtagaaattattggctctttatgccaacaaatcacaaagtacagaaagaaatcactacacctatgaaaatagctaaaatttgatgaaaaagatgagagagcttgctctgctaggtatcaagactgtatgtaaaatcactataattgagacagtgtgctattgctgcaagactagactaataaaccaacacaatagaatagagagcccagaaacaaaccctcatacacatgtatatgggatttatgataatatgtattgcgagtcagtgggaaatatatatatttatatagaagaaaacaaattatactcccacctcactccacacacaaaaatcatttcagatgataaacctattacgaataacaagacaataaatctttaaaaagcaggtccttcatgacctgaggaagtaggctattttttaagcaaggtcaaaagaatagtaacacttacaaaatgatggataaatttgataatcttaaaatttaaatctgtgtgtcaaaagatatcttgcaggaagtgaaatggaagctcgagaatgggagaaatgtttgaaacatatataacaaaggaggggctcatttctataataatcaaagaactcccacagataaaaaagaacattcaagaagaaaacacatttactccaacagataaataagaaactcaaataggcatttcggaaaagacgaaattcaaaatagtaagtaaatatatgaaaagattctcaatgccattagcaaaatgctaatcacgatcataatgcgatatcactgaaaccgtaacaaggtggctcaaattagaaagactgacataccaagcacacagacaggaaccatgaccaactctcatatacaactcttggcatagttactatggaaaacaatttcgcatttccaacaaaattgaatagacacatgttcataacatagagaaactcaggcacatgagcgccaggagaaatgatataaacatattcacagcagcactgaagataacatcctcaaactggagagctctcaaacactcatcaacatgagaatgtgaaaataaattgtggcatagccacaaacagcaaataaatgaatgaacaggtagaaatgtggctgaatagtaaaaagttaaatatgaatgaaagaagacagatactaatgcacacacactctaaaattctgtttacaggcttcgaaaaaagacaaaactaaactataatgtttataaatgcttacttagatggtaaatgtgcaacaaaaaaacccaggaaattaacatagtggttaactctaggtggaggaaagcaattgcgcctgagaaggagcatgaagaaagattttctggtgatgcattctatacctgatttggacttacatttatgtttactgtataataatatactaaactgtacatttatctttaaatcacttttgtgtattacattttttttcttaaagtttaaaggacaagagttggtcttaataaaaatctccggatatagctggaattctttctgtaaaaccaagttggttgccaagcttattcctcaggtaggcaataaagtccacgtaagtaattgtagtgagttataatatttgtagagaaggaaaactgaactgaactaaagtgaataggtcatgaattttcatcagtctataaaacagaagtgcaatttgtataaagtaggatctcataaataagtaatgtagcattaaaatatatagctagatagatgtagcaggggtttgtgaggcaaaattacttggtattgcttcttggatatacattaaataatttaaatggggaaatggaaaacacaatttcaaatacatgaccaaataggctgatagcatgtctgttatacttttcttccatgtagtttttacgcctgggaaatgccttcattatctttgcctgtcccatgagtgggtaaagagatgtgctattttttccagtaccaactataaatttcaattgttctttgcattcacactgctgtgtgtggtggggggtgggggtgataatcacttttttttttttatttcaacttttatttagattcatgcatggatggtacatgtgtaggtttcatagaagggcatatcatgtaatgctgatatctggggtactaataattctattgcccatgtagtgagcatagtacccaatggttgtttttttcagttttcaacccttgtgcccctcccccagtctcttctctagtagtccctagtgtttattgttcccaactttatgtccatgtgtacccagtgtttcagtcccacttacatctgagaataggtggtattcggttttctgtccctgcattaatgtacttaaaataatggtctccagctgtattcatgttgctgcaaatgacatgatttcattttttatgactgtttagtactccatgctatatatgtaccatattttctttatcaaatccaccattgttgggcatctaggttaattccataagtttgcgattgtaggtagtgctgtcatgaaaatacaagtgcatgtgtctttttggtagaatgatgtattttcctttgggtatatacccagctataagaatgttggttcaagtggtagttctgtttttagttcagccactgcagaaagcagtttggagatatccacatttacatttccaccaacagtgtatatgcattcccttttttccacacctttgcaaacatctgttatcttttgactttttaataatagtcattttgactggtgtgagatggtatctcattctggttttgatatgcatttcttgatgatttatgatgtggatcattttttcatttgtttgttggctgcttgtatgtcttgagaagtgtctgctcatatcttttgccaaatttttaatggccttatttcttttttgtttgttgaattattttaagttctttatagaatcaggatattagacatctaaaagctgcatagttagcaaatattttctcccattctgtaggttgtttactctgttgatattttattttgctttgcagaagctccttagtttaattacgtcccacttatcaatttttgtttttgtggcaattgtttccaagacttagtcataacttctttgccaaggctgatgtccagaatgatatttcctaggttttcttccaggatttttatagttttgcatcttacataagtgattagtgcatcttgacatactttttatacatactgaaagggaggagtgcagttttattcttttgcatatggatagccagttatcccaacatttattgaataggaagtccttttctgattgcttatttttgttgactttataatcaaatggtttaattctggggtctccattctgttccgttaacctatgtgtctgtctatgtgtagcctatactactgtaggcttgtagtatagtttgaagtaggataatgtgatgcctttggttttgttctttctgcttaagatcgctttggctattcaggttcttttttgtttccatgtaagtttcagaacagttttttttttttctaattcagttaaatggtactggtagtttgataggagtagcattgcatctacagattgctgtgggcagtatggtcattttaatgatattaactcttccaatccatgagcatagaatgcttttccatttgtttgtgccatctatgatttctttcagcagtgttttgtaggtctccttgtagcaatcttccacttccaaatttagatgcattcctaggtattttattttcacttgtgactattgtaaatgtaattgcacacttgatttggctctcagcttgactgttatttgtgcataaaaatgccactgattttttttaccttgatttttgtatcctaaaactttactgaagttaccagtttcagtagccttttaatggagtctttagggttttctaggtatagaataataatttcagtgaggagagatattttgacttcttctgttcctacttggatgtcttttatttctttctttgcctgatttctctaactaagatttctggtaatatgttaaataggaggggttagagtaggcatccttctcttgttccagttctcaaggtgaatgctttcagcattttcatgttcagtatgatgttggctgtggatctgccatagatggatctgattattttgaagtattttctttcaatgcctagtttcttgtgggtttttatcatgaggaaatattggattttatcaaaagctttttctgcatctattgtgatgattttttttttttttgagacggagtctcgctctgtcacccaggctggcatgcaatggcgcaaccttggctcactgcagtctctgcctcctgggttcaaacaattctcctgcctcagcctcccaagtagcttgcactacaagcacccgccaccaagcctggctaatttttgtctttttagtagagatagggtttcaccatatttaccaggctggtctcaaactcctgaccttgtgatccaccctcctcggcctcccaaagtgctgggattacaggtgtgagccatggtgcccagctttgtcattttgagatactttttagtatgctgtgaaattcagttaggtagtattttgttgaagatttttatgtctctgttcctcagtggtatgggcctgtagttttccattttaactgtgcatttaccagattttagtatcagaatgctggcctcacagagtgcgttagggtggagtccctcctactcgaagttttggaatagtttcagtaggactggtgccagctcttctctgtatgtctggtagaatttggctgtgaatccatcctttcaagggcattttttgatcggtagatttttcattactaatttaatttcaaaactcattatttttctgttcaagcttttgatttcttcttgattcaatcatgggagcttgtgtgtttccaggaatttatccatttcatctacattttctagtttgtgtgcatagatgtgttcataatagcatctgaggatcttttgtatttctgtgaggttaattgtaatgtcatcttttgtcatttctgcttgttcttaattggatttcctctctttttatttgttaatctagctataggtctataaatcttgttcatcttttcgaagaaccaacttttggtttcattgatcctttatatagattttggggcctcaatttaattcagttctttctgattctagttatttgttctcttttgctagacataaggggttttgtttgtttgtttgtttgtttttccctagatcttccaggcatgatgatagagtattaatgtgagttatttctatatttttgatgtatgtatttagcactatagactttcctcttaatgctacttttgctgcatcgctgagattctggtgttgtaacactgttttttaaatcaactgtattgatatggtttggctgtgtccccaccaaaatctcatcttgattgtagttcccataatccctacatgtcatgggagggacctggttggaggtaattgaatcatgggagcagttacttctatactgttctcgtgatagtaattgagttctcaaaagatctgatgttttacaagcattttttctctcccttcactctgcatttctctgctcctgctatcatgtgaagaaggatgtgtgtgcttccccttccaccatgatcgtaagtttcctgaggcttccccagacatgctgaactgtgagtcaattaaacctctttcctttgtaagtatccccgtctcgagtatgtctttattagcaatgtgagaacagactagtacagtacattggtaccacagaaagtagggttgctgtaaagatgcctgaaaatgtggaggcaaatttggaagtgggtaacaggcagaggctggaacagtttggggggctcagaagaagatctaaaaatgtgagaaagtttggaacttcctaaacacttggaaggctaggaagacagaaagaagtgggaaactttggaactctctagagacttgttgaacggctttgaccaaaatgctggtagtgatttgtacaatgaagtccagctgatgtggtctcagctgaagatggggaactcgttgggaaatagagtaaatgtcgctcctgctatgcaaagagactagaagcattttgcccctaccccagatacctgtggaactttaaacttgagagagattatttaaggtatcttgtggaaatttctaagtgccaaagggttcaagagaaaacagagcattaaagtctggaaaatttgcagcctgatgatgtgatagaaaataaaaactcattttctggggagaaattcaagcctgctgcagaaatttgcatagataacaaggaaccaaatgctaatcaccaagacattggggaaaatgtctccagggcatatcagagacctgcacagcatcctttcccatcataggcccagaggactaggagagaaatggttttatgggtcaggtccagggcccactatgcagcctcagtacatagttccccatgttctgcctgcttcagctccagccgtggctaaaaggggccaatgtataggtccaggtgttgcttcagagggcacaagccctaagccttggccgcttacatgtggtgttggtcctgtgggtgcacagaagtcaagaattgaggtttggaaacctctgcctagatttcagaggaaatatggaaatgcctggatgtccaggcaggagtttgctatagaagtggtgccctcatggagaacctctgctacggtagtgcagaaaggaaacatgtggtcagagcccccacacagagtccccactggggcactgcctagtgaagctgttagaagagggccaccatcctccagactccagaatggtggatccaccaacaccttgtaccatgtgcctagaaaagccgcaggcactcaatggcagcccatgaaagcagttaggaggggggctgtacccgccaaaaccaaagggttgaagcttcccacggctatgggagtgtcactcttgcatcagcatgacttgtatgtgagacatggaatcaaaggaggtcattttgaaactttaaggtttaatgactgccctcttggattttggacttgcattgggcctttagcccctttgtcttggccaatttctctcatttagaatgcatgtgtttatcctacgcctgtaccctcattgtatctaggaagtagtaacttttaattctacaggctattaggtggaagaaacttgccttgtctcagatgagacttaggacttggacttttgggttaatgctgcaatgacttaagactttgggggactgttggaagggcataattgtgttttgaaatgtgaggacatgaggtttgggaggggtcaggggcagaatgatatggtttagctgtgtccccacccaaatctcaccttgaattttagttcccataatccgcatgtgttgtgggaggaacccagtgggaggtaattgaatcatgagggcaattacctccatgctgttctcatgatactacgttttcacaagattgatggttttctaaggagcttttccccgcttcgctctgaacctctcctgcccccatgtgaagaaggacacatttgcttcctcttccaccataattgcaagattcttgaggccttccaaactatgtggaactgtgagttaattaaacctctttcctttataaattccccagtctaaggtgtgtctttattagcagtgtgagaacagactagtacatgtaagtatactcttacacatactgaaattctaaaagtggacatatatccaatatcaaagctttttatttatttgtcaagagaacttatttatgtgtttgtatgcttgtgaggtaagacaaatatgtatgtttagatgctgacatatactttaccggttctctttttacatttaggaatcttcattacaaaactttacttttagataattttatgtcattaaatttagtttcatttcatgtatgtacatacattatgcaagggctaagccaagcgttgggctatgtagtgaaatttctaacatcaatctctactttcaagatgtttagataaatagacaacataaatatactctagcaattactatcaaaatttgtacacagtattacatgagaccatgaatagaaaacaccgagggtataggaaagttcacaaaagattttctggaaaagattatagtggctaaattttcaagtatctgagttatctttaaaaaatggagaaaaagaaaatcaaggtgggggtataaacagatgcaaagagacatatattagcaattgtgagcaagtgagtatggctagagataaagttgtcaaagtaatagtgtgaggtgggtactgtgttttgtttgttctgtgggtaataataaccatattgtgtacttaagttatttgttagttagagacataattccagaatttacatcacagataattataaagtgtcaagaccagtatcaggataactaactcacaggctgtagcaatagttcaagtgagaaataataagagcctgattatggttgttatgagagagagaatgtgagaaaaatttgtaacatgtaaaatgatcaatattggtgattacttggatatggagagtgagagagaaagaggagacttagatggctccttagcatttggcttggggaatagttaattgaggtacagaattcagaaggagccctttctggggaagacgaaaataagacttcaatcttaaaaatgttgaaatttagatgctttctggaaattcaagtggatattttacagatatatgtctatttgaggctgtagcttaaaggagtagaaggaaaataagcatctcaatgtaagtaaagctgtcggctttaatgtaattgcaattgataaaaaaggaatacatagagtcaaaagggcaacttagatgatactttcaaaatccaaagtttaaggagcaaacagataaggggaagacagaattagatgtgcttaaacatgaaaactagcagcaagcaggtagtagaatcttaagaaaaaagagagacagagagagatcctatagcaatagagcagtaaagtgacttagataaagataacatttaaaagcacagtggtcatttgtgaccataaagtggacacagatatcattcattgtatagctgggatttcacaactataaatatttacacatacacacacacacaataatgtgtatttttctaatagctgatattaagcctaaacattgctaaaggggtaggccctaaataaatattgtaaaaatatattcttaaaattttctaatctatttatgagctgctaattgaatatctgaaacatgaccacatttcaaaaatagtcacagacattaggtagatttctattgtaaatattattatgtagcacatttatattgacataaccaatttttcaaattgtgtgggcttttttctttatcagaatgagttacagggtttgcattatatagtttggcttaaaaagagaactcataaaattccccacttgcagcccacttaaaaaagaattattacagttttaggcactgttgagtgtcatactgagctacaaaaaataagaaatcaccataatgctctccaccttcattttagttttagaaccccacacagggagacaactatagtaatcagagttaggccactgaggttcagatttattttgtttaatattaaattgtatagttgaaggaaacatcatttttttaatgactgtatcactacccttccaaacactgtagtttactaatgattttaaaacttctttaagtgcttaagacagaaacattcctacaatatcttagctaagatttagcatgcaggtctcatactgggaatacatttgtgttttaagttaaataaattcagcctcttatttagaactggaagaacatgttgtagacttatggttctatttttgttacctagacctcaaagaagtcagttcagtagaaaaatttatacaaggtattacatggaagtttactgggaatcagcttactctatattatacaatgctgagaacattgtttaatctttgtttaaacattgtttaacaggcagtatagtttccaagtgtgccttctctaatgcatttgtgcaagcatttatgcccagggttgctatgaaaaacagagataaataatttagtccttaaacttgagaattctgaccttagcagactcctcaatgagatactcctacaaaggccagacacctctgatattagctgaaagccttcctacctccacttccctcccccctcaacctccatccacccatgtctcacatacagaaatgcactaaagcatatagtgtgataagtgtgctgaagtaaaaggccacctctttttcttttatgctgaattatgttaataagtacaaagaagtttttctcatgatcatgtatcttagacagaatttactgaaatagatctttatcttctcactttctaacccagactgatgattgaattcacagaacattagttgagaaaacaaatgaaaatgacagaaaccatgttgaactatgcatcatgttctcctacttctgatgacatcaggtttataatgagaccagattcatctgtctgactgttacacattagcataaattattcccaggaaatccttcaattctcttttaggaataaataagattctgagaggcacatccaagtccattgttgggattatgccatttttaattgatatataatatatgtacatatttatggggtacatgtgatattttgctggaatgtgtaaaaatcaaatcagggaatttggggtgtccatcacttagagtatttaccatttctgtgtgtggacattccaagttctctcttcaagccacttgaaaatatacaacacattgctgctaaccacagttgctgtattagtctgtcctaatgttgctaaaaaaggcatacctgagactggataatttataaaagaaagaggtttaattgactcacagttccacatggctggggaagcctcgcaatcatggcagaaggtgaatgaggagcaaagtcacaccttacatgatggcaggcaggagagagcttgtgcaggggatctcccatttataaaaccatcagatcttgagagacttattcactaccatgagaacagtgtggggaaaactgcccccatgattcaattatcttcacctggcccctcccttgacacatggggattataattcaaggtgagattttcgatgaggacacagccaaaccatatcatcccatccccagcccctcccaaatcccatgtcctcacatttcaaaaccaatcatgccttccaaaagccacccaaaatcttaactcatttcagcattaactcaacagttgaagtccgaagtcttatctcagacacagctagttccttccgtctatgagcctgtaaaatcaaaagtgagttagttacttcctagatacactggggatacaggcattgggtaaatatacccattccaaatgagagaaattggccaaaacaaaagggctacaggccccacgcaagtccaaaatccaatggggaagtcaaatcatgaagctccaaaatgatctcctttgactccatgtgtcacatccaggtcatgctgatgctaaagatgggcttccacagctttgggcagctccacccctgtgactttgaagggtaaagctcccactcctggttgttttcatgggctcatgggctggtgttgagtgtctgcgacttgccaggcccaaagtgcaagctgtcagtggattactattcttggggctggaggacagtgaccctcttttcacagctccactaggcagtgtcccagtggggactctgtgtgggggctcccacccacatttcccttctgcactaccctggcagaggttctccatgagggctctgcccctgcagcataactctgcctggacatccaggcatttccatacatcctctgaaatctaggcagaggttcccaaaccttaattattgacttctgtgcacctgcacgatcaacaccatgtggaagccgccaagacttggggcttgtaacctctgaagccctggcctgagctataccttggccccttttagccatggctagagtggctgggatacagggcactaagtcatgaggatacacacagcagaggggtcctggacccagcccaggaaaccattttttcctcctaggcctctgggcctgtgattggagggcctgccatgaatgtctctgagataccctggagacatttcccccattgtcttggtgattagcatttggctcctccttacttatgcaaatttccactgctagtttgaatttctcctcagaaaatgaggttttctttactactgcctcatcaggctgcaaatttctccaacttttatgctctgtttcctcttgagcactttgccacttagaagtttcttctgctagatatcctgaatcatctctttcaagttcaaagttacacagattcctagggcaggggcaaaatgccaccagtctcttgcatagcaagagtgaccttaactccagttcccaacaagtttctcatctccatctaagatcacctcagcctagactttattgtccatatcactatcagcattttggtcaaagtcatttaataattctctatgaagttccaaacattccctcatcttcctgccttttgagccctccaagtctctaggaagtaccaaactttcccacattttcctattttcttctgagccctccaaactgttccaacccaggcctgttacccagttccaaagttgcttccatatttttgggtctctttccagcagcaccacactctactggtacccattcactgtattagactgttttcatgctgctaataaacacatacctgagactgggtaatttatcaaggaaagaagtctaattgactcacagtttcacatggctcaggaggcctgctttcatggcagaaggcaaatgaggagcaaagtcctggcttacatggtggtaggaaagacagcgtatgcaggggaactcccatttataaaaccatcacatcttgtgagacttactcactatcccaagaacagcatgagaaagacctgccctgatgattcagtcacctcccacctggtcctttccacgacgtgtgggaattatgggagctacagttcgagatttgggtggggatacaaccaaaccatatcggtcatatccccaaaccatatggttggggatacaaccaaaccatatctgctatctaacattagaacatatttctttctttctttctttctttttttttttttagaccaagttttgctcttgttgcccaggctggagtgcagtggtgcaatctcaactcactgcaacctctgcctcctgggttcaagctattctcctgcctcagccttcctgggtagctgggattacagagatgtgccaccatgcccagctaattttatattttcagtagagacaggatttctccatgttggtcaggctagtctcaaactcccgacctcagatgatccacccgcctcggcctcccaaaatgctgggattacaggcatgagccaccacacctggccagaacttatttcttctaacagtatgtttgtaacaactttcttcatcagccccatcctccaccaccaccactcttctcagcctctggtatctatcagtctactctctatttccatgagaacaactttttcagctccagcctatgagtgaggacatgtgatatttgtctttctattcttgatttattttacttaacataataacctccatttccattcatattgctacaaatgaaaatgattttcattatgccacttttaaacatgaacatttgacaagaaattgacttatttattattgttatgtaaagtaactagtttaggctaaattgggtctactgttgggagtatgcacaataacagtaatacaataataattatgcataaccccaacaacagacccagctttaccctatttatcttatataacaataagtaaatacataatacataaaagaattttatatttttcctctaacacataatatttctttatctcccttttcctttttctctctttcttacatatacacatgcgcttgtgcatggcacaggttagtataaaccagaatcaatggcagagctcactaaaacacagatttctggccccaacactagggtttctgattcaatctctgtggtatagagtatagcagtctgcatttctaaggtgtttctattggtgctgatgctgatgctgatgctgcttttccaggaacaacactttgatagccacctaacgcatgtttgtattttttcagttcagatacgcatgagcaagtcacaggaagcatggtcattggagaatcctgtatagtagagtggttaagaccaaacatttgaaagtaattcaaatatgtacaatggaaagcatttagaatagttcgtggcacattgtaagaattcaaaaattgatagtcattattactgattttttactagagctgtcagtctatccaatatgcttctttcaatgcaagctccacatatcccactagctggacttattttaagatgaataaacaaaaatacaaaaatcaggatcgcaaccatgagctctattttgataataacaaatatctttcatttcctttaaatttctaaaatatcctacaaatgtgactatatgcatatatatgttcatgtactaaatgttgatttgtacatttgttattatcaaagaccaagctttggctaacacacttaaaaaggataaacgctgtttataatctgactgactatgattgtttgtagtgatgcagtagaagaaaatcatttatcaacttaagattttatagtttcttaagaacagtacttccattaaaatgttctctaaatatggtaatattaggcaaatgcaagagtgcaactaccgtatttcgaaaaatcataaacaattgtttgcatttagttcatagtgttgtaaaaaatattactttctataatatacgtagccatactttataaattatttagtatttaacataattataataaaaattaagtgcatattagcttcattccttattttaaacctgtacatatattatgtgtatgtattaatccttcaaatcactacttgagatgaattctattattatctccattttgcgatagcgaaatccagtcccagagaagctaaattagttatccaagattgcattagttattttggcaagtcaaatttgaactcaggtagttttattccatggcccatattttaagctgttcattaagttctccatcttgttgggatgctgggtctggattcatggagtcacgtgatctagtgacaggatgaaccaagtgaccagggagtggtcgtctcattaaagtatgtaaggagcataagaggtgagggttgttaggtaagatgagaagtccgggatccctgtgtggtgagtctagaagtcacagtccagtataaaacaggcttttaaaggtaagtggctggaaagctggacactgatttagtagactggcttagagtcagtctatctaaaggctgaatggaccttcacagaagttatatcatgctctgctgttgtatattcccaaatgcctattcctttgagacttgaggggtccaggaccaggcctgcagatttgatcagaatatgactgcatttgggggcttctactggcatctgctcccccaaagacttgggatcatctgagagttctgcagttgagtatgaggcctctagtaagaggcctctcatatctgagacccattctaaagatcaattatttgcatgcttgtggtccacagtcaagatatgcatacaaatcctctagattctatctcctgtgaaatactctcaaggatactaggcaaaatattacactaagtcttcatatcattcactatttcattaggccccatctgaactcaatgtatttttaatcatttttccagaactcctttaaacagctcttccattattgtcagaatactgacttagagtcctcaaattgcttcttcagctggattatatttcatattacatttttttggctggtatttttatttccttttttttttaaatttccaacaaagatttcactaatacattgaaaagaaccaagaataatctgcttttctcatgaaccctaacctggccacctcagtctattataatgtctctttttccttgcagtaaagaatttatagcacccatttgacacttgacacagagtatatacttactgtatttactaggttttgagtatatcttttcatacatattgttacagttttcaattctaaatgcacaaggtataatatgataccttgtgaataaaaagataaacattaaaaattgttgattggtaggttattttttaatatgctggataaaactttttgctatgtataatccataaatttgcttcaaaagtattccttagttattatttgttactacaacactacctttaaaaactaaatgaggccgggtgtggtggctcaggcctgtaatcccagcactttgggaggccaaggcgggcagatcacctgaggtcagaagttcaagatcagcctggccaacatggcacaaacctgtctctactaaaagtacaaaaatttgctgggcatggtggaggttgcctgtaatcccagcgactcaggaggctgaagcaggtgaagtttgaacctgggcggcagaggttgcagtgagccgaggtcactccattgcactccatccagcctgggtgacaagagtgagattctgtctcaaaaaaaaaaaaaaaaaaaaaaaaacaaaaaacaactaaatgaaaactcccttcagcattttaattcaaatattggattattcatattaaaatatcaatagaatataaacacaaagttgataactcaaattcagtatagtaattaacaatatgtatcttggttttaagtcttaatagtttttgatgacaattaaaattaaattttacaagcagagcatgagtaatttagtgaaattaatatatgatataattatcattaggtagcaaccattatgagcatcaaaattccatcctataaacattacactgtgcagaatcagttagatgcagcctgccttggatgtcttcctcttcctttttgctttcaacatcgttttagtttttatgaaaacaagttattgcctaaagaccaggctaaggtccatatttcaattttaaaaactgaaataaattatagaggccatttcttatcaaatttaagaaccaggagacaacaacaaggttaacacaataattcaagaacaaagaatcactaggaaaagcgggaaaaaaaaaataagaaaaaaaggaaaagaaatttaactaaaaactaatcatcatgttgatgtctacttgtgtgtttttagttatatattccatctgggctttatctctccaagctaaataaattaagaaaatgggaaagatcatttttgtaaataatttcaatgcttgtttgtttttaactgaatagttaatatatatatggctaagtgaagtttttcagttttcagcaatgtggcattttaaactgacaactgtaatataacttaattatcattaataaagacgattacattagttcaagcctcatatgcctggtttattacaattgcctcctacttctgccttctggatttagaatctcccatttcaatatatcaggagtaatttttataaaatacaaatcagatgttgccatacctcagaccctttagtggctcccccgtcaccttctacaacatggtatagaaaagtgtttatgacatggtacgtcttattcattgtaactatgctatgtcacactctgatttctctgtgcctttacttatacaactaactttccctaacagattccaacttctctcaacttctctcttacctgtgttcttccttcttgagtcaacttcagcatttctcctttgatgataatttttgcacatgcccctgttatagactttattaccttgttttcttggtgtagccaaacttgtcagtgtcctatgcatgtccctcagagcatttggtatgctttggccaacttccacctcctggtattgtcactggatcctaagggtgttgcttttccagccagaaacctctgcgggtggtggcgcctttgcccaagttttgctcggactagctgtgtttgtatcacccactccacctggcaggctgtgcttggctcatgctactgggctaaatccgacactttgccagggcaagccaggttcagagcagcgatgggtgcatgagcgagcaagtgcagggtcttgtcactgtgcatagccacgcacgctagctgctttggcgggacgggtagctccagccgccctctcccagcaaaccttagattgaatcagatacagggcaagagccttctgctgtgagcacccgcgtctggatgaggggctccctgaagagccgcaactcttctctcctttttgttgctcgccacatggtgaggggggtggcagctaaacaaggttttagccctgtttgtgttaccgctctttcattcctgccatttggtgggtcccgagtttttggcccacatccaggaagaatgaggtacgcgcacagctggagagttaaggtggagaggaactttacaaagctacagaacagctctcaagagaccgaagtgtgtagctcctatccataggcaggttatccccataagtgtccagctctcagcagagagaagacccggaataggtagttcctttctgcagaaggtggtcccaggagacacgaagaggaaatctcctccctgcagctggtattcttgatgtctgtgtgaggctggctggctccagggtttttttgggctcagaaaggaggaagtacatgttgattggtccacgggtggccatgggcaggcccggtaaaagcaccgtaagttttcactctgggccacggactccactggaactgatgggctggtccccaggcttcaggccatccctggcttgaaggtggggcttcaccagggacaccccactttccacccaggagcctgtcttctgctgccatcaatcatgttgttcatggtgcccaggctgtttatgaggagaagtgcctgcaggcccacagtgagcagccctctgtcccctcttggcctccctcctatgttcattggcgcccaaagttcacaggaggctgaggtggcagggggctggcatgtcagcaccaacccaagcacgcacacacccagcctggttgtgacagcacctgggctcggcctgaactttgcttcaaaattggaaggggtgccaggagctggaagaggtcaggcagggggaacaggcacttccgactctgtgggggcaggggagcttcctggatccctgagagcacagagatgcctaggtctgcagccacagctgggcagctggagctacacccaggatggcagggctcccaccctgccaacttggaagggggttaggttcctgcctgctccttgctcccaccggctccctggagcatttagcccaggtcatacctcctctgctgtagctggtgtctttgcagtggctgctccagatgggccactgctgccatcagtatctacagcctgactcagtgcccttctatcagattatgctgagggaatttgactacttgcttctactggaggcaagaaaatccaaaaacttggcagcccattggccaacattgcagctaattactctcaggatttagtgtatatgttttccagttccataacctctcaggaactggacaattaaaactatcaggacagataactctgatgcatgagtttgcatctttttctagagtttgcccttggagtgaagtttcagttctccttatgattgctggtttaatagcaatcttgttactggctaccttctcttctttgcctcactttctcacttccttatcactgttatctacacttctcaaaaaatatttatacatgaatattttgtgtccagattttctgttggagaatccacagtaagccattggacaccagaggtactacagtgtggggagcagagccttcagatgggatgctggagttgaatcgcttgttggccagttggtatcaagaccagttggcattttataacatcacaatgaccaagattatcccctatgtgaattgggatggcataaacatataaggttatgtatgccttatgcagtatttccagaatttgagatagtgacaatgataatgataatgactgtggagttggtagttgcaagtattgtcagtgatctaaaggaaaaaatgacttttaaaaaagcttcaactggtcaatcaaaatctcaggacatggtgtgaacatcacaagatctctataacaccatttaaagcaaccctctccttttgcagtttaaaggagattgagctaaaaatcagatcttgtgcctggttataagaatagcagaacagtagagaagcctcacttgaaagcaccagcacgccttctgtggaaaagtcagaaccttcacagggaaggagtaggaccctgaactctgggtttggaacatctgggtggctcacacctcactaaaccaagattctttcctcccctgaagaccacataaacacctcatctgaggttgatacttcaaattgtgcacatcttcctccaatttttttcttctttgtgacttctagaccaattattatgttcaagaccaagaatggcccaaatgaggaagtactgtctctgttttaacaataaaggaattattcatcaaatgaaccacagacaccggctaatatgtccaggtagatccagaagcacttagaagaacactaagagtaagtttactacgagtaaatcttctgagtgctggaaaaggtgtgtgtgcaaaatattagaaacacacggtagactctaaagatagtatttacctaatgtaatgaattcaaatctaaatatatatattttgaggtctaaatgtccacatccatacctagtagtatacctaattacatgtttctgtaaaatgttttaatttcagaaactaaaaatatatattaaattagcatactatcacattaatcaatgtttaaattatacaataattataaaatgtaaatctgtatccttgaaagttaattaaaatatataggatatgattcattttttaaagtcttgaagaatatccagcacagtcatttaacagattacattagctgagtttcttttgagaattaaaatgtaataaacttacactctttgaaaaactacatataagatctatataaatattccacttacttttacttgacccacaaaggcattggcttcttcttccaccacagataaatttcttggcagataaggatcaaacactggagcattgtcattgacatctgtcaccactatgtttactgtggcagttgaggtcttaaagaaaaacacaagcattaaatgtgagaggagctatttttacttagaattcatttaagtagtcattctggcatttgtctatctgaaaagcatctcatttttctttctaatccttagctttccaaaaaataaaaataaaaaaataaaaaaattaaaaaaaagaagcttgcaaagaagcttcccacctcaaaaaacagatgggaaaagcaaatgatgatattaaagggcaaacatctttttggaaatgtcaagtatttcctggaggaaaacggttttacctttatcttgttcacattttatgggtggcaagcttttgtttatacacacgtacactgctttatctctgaaatgtgccatttctgtagtttttgctgcttgtatgtttgactgtttaaaaataaaaccagtacattataaaatagcatggtacatcaaatgagcattttctggaaagctcatgctatcgaaaaatgctaccttaataattttctaggtgtacatttaaaccaagagtttgagtaccatatactaggcatgaaatgattatcttataagcatacagcttacggaaatggtatgcaggtaaacctaccagtagtgtgtgctacctagttaaaagttaaatccctggcctgctgcagtcaatattatgtaggtcaatgacttctgcacaatcaatgactatcttcataagtgattcaagctggaaactgctctctctaatcaaagcctgagtacagcacagaacctctacctagctctgtcacagtgtggggctgatcacaaaaggctgagagcaaaggtacagagagaaagaatattaacctggaaagtaagaaacctggtatgctatggtattaaatatttagtaactataaataaaaaggaggaggaaaaagcaaggtgatactgtcatgagagaattatccaccttttgtttaaaaaaatgcaagttccattaattagtaagtgatttgtagtgagaggctaaaatcctgagcactaagaagtgacttgagtgaagctgaaaaggttttgcagcagtcatggggctaaggagtcaagtgattttttttattttttatttttttttatttttttagctattaaagaggacagatcttggtaaatacccaatgctttctgttggggtcacagaagttctataccatgcaagtcatggtgcttgggaaaaagaccaaacctccctcaaatgtaaacccagtattgaaactctgattggatttaggtgatctgcccttattttaacagaagcaaaagcaaatactttttttagtaatgtaactttatcccaagcctctataaattttttcatgcacagtgttcagtagtcacttaataattaccatgcatagcagggaattcctgggtattagtgatggcttatttctttatttgtatgttggcttaccctttgaaaatttatgttgctattcatatgtgatttgcacacatttttgtatttaaagttaaataaaatttttatttaaagacacgtacaaagatggtcagaacatcattatatagtcaaaatctggaaacaacccaaatgtccatcgatagtagatggttatacaggattgtgttttatatatgcaatggaatcatatgaagtactgagaatgtacgaactactgctataagtaataacatggattaatttcatgaacctaagtttctagaacataaataacacatactatatgattccatttatataaacttcaaaaacaggcataatccctacatggtgataaaaattagaatacgggtcactttgaagaagaagatcgaatagcgacagaaatgatcacaaagctgagcttctggagtgctgattaatttctgttttttgttatgagtagtggttacataggtgtgttctctatgtaaaaattcattaagctgtagaattattgtttgtgcattagtctgtgtgttatattttcttaagattatttactttaaaagatgcacacacacaaacatacacatgtgtgtcgatatatgtaagtatgtttaaagaaattcaagtgctacttgactagatggaatccagatcatttcattttcctcgttacttttatatattttctaaatgttctcccaaaaggctaccatgctttcatgacaaaaagtattttaacaaatattatttctttaaaatttgccttagaattgaaagcagtaaagaagatgtgttttttacagttgcggtagttcccaatttgcctgagggttaacaagacattgaaatttacagcctggatccaaaatctaagaatggtgaccctggagtttgctggcttttcttcaaattgcctgaccccctttacaccagcctgtctttacctgtcaatccactgtttttctcatcctattctttaaaatttatattcatgttttcagagtattctgtatcctcagtttaagactgtaactcttaagtggataatgaagaatacaaccagatcactaagtaaactaagaagtcaaataacaattccataattttgtgctaataggggatgatatttatgggacatgcaggcattttcttcatttcttactgaattttatatgacatgaaaaaaatccatgtcttacagaaatgtacagtcacatctatacatagaataatttccagtttatatatttcttgaagttttttaataccacttgcttcagaaatacttatgtaaaaatgaggatttcagggctatccattaggtctattgactattgttctgaacctatggaaatatttataaattagttaggtgtaaatcatatttatttaatttttcttgattggttcagaaggatggcaacaatatgcttcaatgtggatctgtgccatagagaatgtttatgtcttattaaggaaagacttcttttcattgttcaagcttaaaaattagcaaatgaaaacagatcactttaattaattgttaggaccatatgtcattaacacatgttcacaattaattttaaatatgaatatatatataatgccagttaaattaaaaagatctcaaactaataaacctaataaataaaaagttacgtattttccatcaacggagtttgctcactgattatttcctcaaaagttgtattaacttataattccactagctggaaatacttgcatgttagtactaaatactgtaattgaacactttcatgttcattatttaatttaaatgtgtcttagaatttccttttgtaatatcatagaagaattttcaaaatatatgtctcattctcaacaatgcaagatatttctgtttttgtttgtttgtttgttttgagacaaggtatcactctgtcattcaggctggagtgcagtggcatgatctctgctcactgcaacctccgcctcccaggtttaaacaattctcctgcctcagcctcctgagtagctgggattacagacatgtgccaccatgcctggctaatttttgtatttttagtacagatggggtttcactatgatggccaggctgatcttgaactcctgacctcaaacaatctgtccgccttggcctatcaaagtgctgggattacaggcgtgagccatcgcacccagcttactgttgtaatttgaatacacatttatttttataaactagtatggctctgaaagaaggatattaatatagcatctttttttattttcattgttgttgttttttttgagacatgtctcattctgttgcccaggctggagtgcagtatgtgatcatagctcacagcagctttgaactcctaggctcaagtgattctctcacctcagtctcctaagtaggtgggactacaggtgcacgccactatgcccagctaatttttatttctttattttatttttgtagagacagagtctcagtatgttgcctaggtggtctcaaacttctcatctcaatcccaccttggcctctcaaagtgctggggttataggtctgagccgcgatatccagctcatcttttgttttttgttgttgttgttgttttttaatagtataaaaaaagtgagttataaagccatagtcaaagaaagtagtgtaaattcatctatcaatacacaatgcattatttgaaattcgtgagaacatacattaagagtatcttatttattctcttctagtatttcctatctcaggaaatgacatggcaaaataattaactaattttctaagtcactttatctcatacatgcaatttattagtcaccaagtcctgttaatttgaccttgtaaatgcgccttgtattatacagttttgagcaatggataaataatacaattttcatttcctgagtaaatagctggaagtcagataactgggttttctgattagcatatgtttagctatgtaagaaaaccagaaatgtgttttgctcaataatttaatgaataatttttaatacattttcttgttaatcaacttaatgaacacttttaagggcagtgtgtaatactacgaatttaataagcaattttggctttaatcctagagaggataagagaagggatgtttgttttttatttaatcacaaaaaaatgcatttttttatcatttaatttttacatcttttgacacaaaatttgttaaacatttcatggctagaaaactatttctttatattttgtgtgcatctcatagcacagccatttgttttgtgctattacatttatattagatgattgaaattcaatgacattcaatacatggtttaagaaacatgtatgcttagaatttatctgagcagagactcatggtatgtataggaatcagtcaggaatatttcaatttgttcattaagaaagcagaaaacattatcagaggtaaggtaacactataattatggagcacttatcatttatctatttcttaaataaaaacatgagtgtttaatttcaaaggtgcaatttcttttctatagtcaacaagattcactatatattctcagaaataataaagacattattttattaagaaatgtgtctaacgtgtttactaatagaacacacaatgtcagctcaatgaatatttttagatactttaaatatctatttttattataatttgtactacatgctgaaataaattaccttataacttattttatttaaatgtctgaaaaaagaagagctagaaagaatattgaaaatttccatctgtgagaaaacacaagaaatgttatttatagaacacaaagttttcctatctgaataaaaatcttcactactatatctaaaattcttttcaataacaatgggacaatgaggatttatagtttagaattcaatcattttttgtttaggccaataaaacaagaaaaatacatattcaataataagtatagtatttagagaatattaatttaaaacattttcatccttaagcgcaagtcatcttgttgctacacagttcagagccaagccaacttcattcagattgtagagtttcattcatgatgtagagtggaggtccttcctaccattaaagattagccaggaggctttctttccttctgaaggaaaaaaatatacataaaatctagaatttctttgagaaagagaaaagggaagttccttctattatgaattacgggaaggagaaagggagacacagaagagacatgaaggcaggaggcagaggtcctcctcctcatcccctactgccactttggacccctccttaagtgaagaggcactggagaaacattttggaagaagggggaaatgatgactgggaaactaagagaaatttgggtgaaataatcacagtagttttcaggagtatgtaagcctccagaaaatttccacaggttccatgggaggtcccatctaataggttatggcactgaatatacagcaatggcagagagaggtgtcaagagagagaagccatactaccagcataaaggactggtaaatacatgttacatctagaccacaattttagaatgaagtcagggaggagaggtttggttggcagcttaactagtgagtatttatattgtcttaaacagataatgctgaaatactgttctaagaaacttaagtgtgacccagattacatctattccctacctgtccaaacacatatttatacattattgtctaagtaggaagattgcatcaggtataaaaaataaagaagcttttttttctctgtgcacatctgagtgtagtgtgtaaagattatatatgtatgtgtgtatgtatgtatacacattttatgcaatcgtgcatgtttttatataaatatatattttcaaaaatatcagaaagtatttatagtatacctgtatactatagtatatataatatagaactatagatataaatatttatatatttgtacataaacattttgcatgttacatatattgtaaagattcacatatatgacttaaatgtttaaagttttactattctataaccatacgtattgtgttctaaaatattaaatcaactattttgaaattcaaagttactttaacttcacacattttctcacgcatgtatttttgcttttgttaaagtttcctatttgattatgaagttaaatgctcaacttttaaatgttaattgttcatttatattgccatgtttcaaagaaatttaggaaataatattgcttcaagacaaaaacaaagatgctaagtcttctagcaatctgaaattgtgaaatattacaagtgttcagactgaaagccataactgagtaattcaatccagtaattcaagagcattttacagaaatcaaaccatgatggaatcaagttacctattgtatcaattaaggaggaaaataatattgctgaacacacggaatctggtcagaaatatctaggctacagaataacttcacattttaaatgaaaaaaattactgatcactgttcgcatatttatttatatctttcactgtgttattggttgattaacacagctgcaatccataagccctacttcctagctatttttctacccactgttgctacttacagataagaatatctaaaaggaaatctgctagatggggtttctgaaaaaactttggtgctttgttaaaataaagcaggggtgcagactcttctggcattcatctttatactttgtctggtatagagaattgacgtctagagttgcagaagatgggaatgaaagtagacaataaaaatggcaaagcagaaaatagccagcaggcatcctcaatggcactgatgtgcacctgcaccatctcttcactgtccacctctagattttttttctgtatttgtttgtactatctcaatttttaaatgtaaaatgttgtggtattaagtatattcatattcttgtgcaaccatcatcactatccatctctaaaactcttttaatctagcaaaacaaaagctctataacattaaacaataactccccatttctcttttctttatcctctggcaaccatcattctactttgagtctttgtgatttttgaccattctaagtaccaaaatataagtggaatcatatggaatttaacattttgtgactggctaatctcacttagcataatgttctcaagatttatctgtgatatagtgtatgtcatactttcttccatcttaaggccgaatgatatttcattatatgtatataccacattttgtttatatattactctacataaacatggaaaactgggttgcttttacatcttagctattgtgaataatgctgctatgaacatgggaatacaaatatctcttggagactctgctttcaatttttttgatatataaatgaaagtgtgattgggggctcatatagtaattctatttttaattttttgagaaactaccactgttttccacagtggttgtaccattttacattctcaccaatagtgcacaagggttccaatttttccacatcctcatcaacatgttatgttgttgttgttgttttgttttgttttctgtttgttttttataatagcgtctctactgggtgtgaggtggcacctcattgtggccttgatttgcatttccataatatttagcaatgctaagtgttttttcatatgtttactggtcatttatatatctcctttggaaaagtgtctattcaagtactttgccaattttgaatcagtttgtttatttttgttttctttaaaaaattctcgggctgggcgtggtggctcacacctgtaatcccagcactttgggaggctgaggcaggcagatcacgaggtcaggagattgagaccatcctggctaacacagtgaaaccccatctctcctaaaactccaaaaaaatagccaggcatggtggcaggtgcctgtagtcccagttactcgggaggctgaggcaggagaatggcctgaacccgggaggcggagtttgcagtgagccgagatcgcgccactgcactccagcctgggtgacagagcaaaaatccatctcaaaaaataaaaaaaaagatctatatattttgaatattaatgacttatcatatatatgatttgcaaatattttctcccatttttatgttgcttttttattctgtgtctttgacacccctttacaaaatcacaaattccaacttgtctattttttgttgttgttgtctgtgtctttggggtcatagccaataaatccctgacaaatgcaatgaaatgatgcttttgccctatgttttcttctaagagttctatagactcagttttcattttaggtcatgaatcacttttgagtttgtttttgcatatgatgttagataaggtccaacttcattcgtttgcatgtagaatgatcatagcacccatcttaaaaattatctgaccaattaagtgaaagtttatttttggattttctattaaattacattggcctgtatttctgtttttatgctagtactactctgttttgagtattgtagctttgtagttagtttgaaatcaagaagtataagttctccagctttgttatttatttttctttttggctatctggggtcccttgaaattttaaagataagttttagaataagtttgtttttttaaaaaaattatttctacaaataacatcattgggattttaatagaaattgcagtaaatctgtagattgcttgggagagtattaacattttaacaatattaagtcttcccatccatgaacatgggatatttttcaatttagttatgttttatttaatttctttccaaaatgttttgtagttttcattatacaagtcttttatctccctggttaagttaattcctgagtattttattcttttggatactattgcaaattgaattgttttcttaattaactcattcattttcaatctatgaaaatgcaaatgattttgtgtgctgattttgtactctgatactttgcaaaatttcttagttccaacatttgtgtatgtgtgtgcaaacatgaaacatgtgtatggaatcattaaagttttctatatgcaaactcatatcacctctaaacagagataactttacttcttccttttcaaattggatctttctctctttctctctctctcttttctttctttttttgcctaatagctctggtgaggacctctgatactatgttgaacacaaatggtaaaagtagacacccttgttctgaatcttcaaaaaaaaattagaatcgaaaaagtatagttttatctgtacccccgatagctaaaaaaaaaataaattacatgacacatgcaacttatacagatttttcaacaatcattaacaaagaaaatttagaaaaggacagtcaaatcaaacttcctccatactgtctacaaataaactcacaatgaccaatagaatgtgacctcttatctccatcatccccattttgagatggtagaaaacgtgtattctcatgatcaaattttcaaactcatcctggcaatttgtttcacacaaattgcttgttaacattttcatttcaataaattccatccatctgtctgtgtttattaaatatctgttttaaaccacatgattcttaagtttaaaaggttaattttactgtaattactaaatatttagataagaaaagtgctattaagacgtgagaatattattgttatataatcactttttttcttcaggaacccactgtgtatgcctacatataagtatatccgtaaaattatataaatgatggaattaactgaataaacttttgtttgaaatctaaatgctttctactctactgatattctcattacaaactttacaaatgaacacaaaatttactcagaaaatcagaattttaaagcaaaatgaaacctgagtgattatatgaggaaacgaggacctagaaatgctaagtgtcctgtccaaggagaattaaaatatacaaataaattactgaacaatgaactagaaagaacaaaactactgattttagcccagaacttattttggttttaagtagtcaaaagtattattagtagattgtgactattttccttccatctgtttccttgtctaagaaactttaaggacagacttaaaatgttctagctaatattactgccattagtttctgatttataatgtggcatatttcaaagctatgtattatcctttctttttttcctattttattggttgacctgaatgctttcttaatttcacttcactgtaattatacctcttaatctatgctaaataatttctccttctcctccttagaatattttctctcacttattgcctagccgagttaccctctaaactttcatcataagtcaagttcttcaattacttcctccagaaactctcactgacttctttacatacatctaacacagacatactgtaataatttagggcaggctgggcgcagtggctcacgcctgtaaccccagcactttgggaggccaaggagggtggatcatctgaggtcaggagttcgagtccagcctggccaacacggtgaaaccctgtctctactaaaaatacaaaaattagccaggcgtggtatcatatgcctgtaattccagctacttgggaggctgaggcaggagaatcacttgaacccgggaggctgagtttgcagtgagccgagatgtttccattgctctccagcctgggcaacaagagcgaaactccatctcaaaaaataataataataattaggtggattgcttatataaaaattagccataggttttatttacttttctatcatctaagtacctattatcctcactgtttactacaactgttctgtatattttattatatgtataagtatgtttatttatgtaatgtctgaaaaatgttaaatagcttactatggacagactgcaattaccaaatttaattatttctatttatctcacttttagttaagatgagaaaactattcaggtatcaattttatatttttattataataaaatctcagaaatcctcctaaaataaatgtgaagatacatttattttacatttattattacaataataaatacattattattgtatactttcagccaatgtagtatatagattaaatagatcatttcaaggagccaggagatatgttgatatttaaattgagtgagccttgcttatcaatctgtaatgggtttgaaattatttctagacaatagcactgagttgacacataagcacctgattgaaaaaaaaaagagaatcacctaacacatggcatagaaatggtgaaaataattattaacaatggtaatattacaatacatagaaagcgggatgctggcagttgtgaatgagatcgttcaaataacacagacaagtgattttaaagcagttcagaatgtctaacaattttttttttttaaagtgagttttaggtccaaaggaaatagaatttatcttctttggaattataagcccatttaaattatttagataaccaagaattacttatgattcttactgctacttacaaatgcctgtggaaacaagcaaatcactttcctaagtgcttaaagatatttatccacaaaatccactcttcctccctgacccttaaaaaaatgacgctaagtgtaacaggttccaacataataaactgccagaacacatttcatggtgcagtgcaaatgacagacacaatggaatacctgttagaataaagtagatttcattttccctacaagttaggtgagaatgctgatctcaagtatctgttctgtcaagtcaaaggttgcagcacaatagcaaattcagagtataggtgcatgtattaatagcctgttgaagaaaagagcaacacttctagtaattataagaagttgctccagatgaaaaacattaattcatgtctgtgatacattgtttaagactctctcagttgccttaatactatttttaaaaccccttcacagggagcatactcaccccatctggcctgccatctgaagctgtgatgatcagaatgtagcgatcagtgctttccctgtccagtgctttccctaaggttagaatccccgtgctagtgacaaaacaaacaaacaaataagacaaaaagagatattatgtcacaaggagagtcttcttagtatagtgaattacttttgatagctttttttcccctctcagtaatcacagcttgagtattttagatgtataatactaagattcattctgaaaattgaaaacagcttttaaggctgtcaaatttcttagcagtatccatgaaactgacactgagctgatttcctaccttccaggaaacaaaacataacaaaactgtgcttaattcattccaagaagaacagtatctatcttgttttcgattatttcaagagaaaagacttcattattccttagcagtctcagaattctttgaaacaaggaatggtttcctataactaatgtatatcacctcccaatttatgtcatatgtatgtccattatgaaaatgcaaaaacccatctaaatgttatctctgacaaactctatggataaaagtttttcttttttcttacttttaaaataacagagacccattgtacaaaattagaaaatagaattttttcaaattacagaaattatgttttttgtaatgtttctttttgtactttattataaccacatttaaatatatgattgtttcagaagaggaatcattctgcatattttacattttttaagaaaatataattgtattagaattcatgttctcattttataatttgtttaaaaccccttttgtggctacactaacaattttagtattttgttattctttggaaatttagctgtttcttaatttaactgatgtataatgggagattaacagcacttgggaaaattattgcacttacaatatttttaatacctactccttatcttttcactgctcagaataaatgtttccaaatatttaagactttattcacccatgtaatttattttataacagtttggcttgctctctaatgtaggttctacatttatttcttaaattttacatctgatattgtacacattttaatcgagcctaacaagtatccactgtgtagaagagtttatctgaatataataacacattaaaatatatgtaccaagtccaaaacataaattgtttctaatggataaaatgctttcattttaaggtaagtgcttttattgtaaagaaaatttaaacaattcatatcacatatggtagttgagtacagagagtcaaagccgatgaatcaaaataagaatcacagttactcaatttgcttattatgttgtaatggttgacgtggactttttaaaaagttctgaacatatggcatgcccatgaaaaactgactttgcttcctgtacattttaaaaatgttttgtcaaaataattgaaaaccagttcccagagcatgttcacaacaattaagtttggaccagcttcctacagtacagaaggtccagataatcccattttaaaattacattaaatgagaaaagtaagacatgtatttcttctgaggcttattcacaagtatcttaagaaacaggaaagctgaaaacctagccatggtataataagagaaagaaagaaaattgagttaccattttcattttgtttcttccctcagttaattatctatattcctccttgtacattaaattagaaaattactaaaaagtatattgtatatttacgatgaattacaaaactcacgtgataactgagttgatttcctaccttccaggaaacaaaacataacaaaacttcgcttaattcattccaggaagaaaaatatctatcttgtttttgattatttcaagagaaaagatccattattcctcagcatgttcagaattctttgagacaaggaatggtttcttataaataatctatatcgcctcccaactgtatatagtatttggaatatatatgtatactctatatatactatttaggatatataatactatatgtattattccaaaaatactatatgccgtgaacaatatagtatacagtatattcatacttagggccattttaaacacaaacagctaattgtctatggtctggtgattattatagaggtagtttttatgtaatacgcgggccttgcgactcagtgttgtaggcagttgtgtggtatatttgggcaatgcagaaggggagaaacacaggcagtgtattttgggattcatagctgaaagactagtttatgggtttacctgtgcatccttttattaaatccgagaaatagctcacaaaaagtcttattaccagctagatggaggctatcaggccaggatacattggggtacacttagtaatgcaatacaccttataagttcacatattaaaaatacataagcttcttcaattgataaagcatcaataacactgctacttatacaggattgaaaatacatttcccaggagtgatgtcagtggaaatggagaagacagccccaagagatggtctcgccacaaaacgtcaaaaaatcacaattaagcagggaccttcaacagcaaatttgatgaaactctggaaaacagtcacaggtttatagcaaccagatgaaggcagaatttgttttaaaaaaaggtaaatcaaatctggtagaagaactctgtggcattttgacttgtctttatcctaccatctcactggctcagagtggccttgaaaacatcagtgaacattcccagtgtgacactatggtctttgtttctggagggagcgagctatccttattcataaagaactgtgggggtctattctagtctgtctggagactgcctgaaggagtgattcatggcacttatctttgtttcatcaaacttggaaatcactcaaagcagaaaagcagtgggcattcctcagaaatattgtaaggcaggggatagcccacaaacacttgaggcgtataatagagtgccaaaaacttgccaggaaagtctgggtaaatagtttcatggaaaattcaggcactcaaaagtgtactggggaatacagaataataaatataattgagaattcataaatatacccacacatctacagtcatctgattttcaacaagaatgccaagaccattcaaaaggaaagaatagtcttgtcaacaaacggcactggaacaaatggaaatctatacgtaaaagaattaagttagactacttcacttcatacacagctattacctcaaaatggatcaacaatttttctaaacacaagaattgaaacctgtaaacaactcttagataaaaactagaggtaaatattcataatcttggatttggccatggattcttagatatgacaccagatgcacgggaagcaaaggaaaaaatagatatactgaacttcgtcaaaataaaaaaaaaaaaaccttttgtgcatcaagggacattatcgagaaagtaaaaaaaacaacgcatataactggagaaaatacttacaaatcacatatctggtaagagtcttatttccagaatatataaaggattacataacttaacatcaaaaagaaatcccaatttaaaaataggcaaaagactcaaatacacattttttccaaagaagatatacaggatatacaaataatcaaaaagcatatgaaaatatgtcattagtcatcaggcaaatgcaaatcaaaacccacaaccaagtatcacttcacactcactatgataattatatttaaaaaaagaaacaaccaccattactaacaacaacaacaaaaaataattgttggcaaaaatgggaataaatcagaatcctcatatatttctggtgggaatataaaatgcttcaatcactgtggaaaatatttgacagttcctcaaatggttaaaaacacataattacactattccctagcaaatctattcagtatatacttaaaaaagccaaacacaggtacttaaatacacgtacatatatgttcacagcagcggtatttgtaataccgaaaggtagaaaaacagcttaaacgtctatcaatttatgaataggtaaacaaattgttgtatatgcatgtaatggaatattacgtagccatgaaaagtagggacctacttgcacatgttgcaagacagacgaatcttggaaacattaggctacaaaaaagaagctagacacaaatagtcacacattgcatgattccatttctgtagaatattcaaagtaggtaacttgatgaagccagtacgcagattggtgtttgccaggggctaagggaaataaggaatagggagcaattgctaaatgggttcaggtttctatttggagtgatgaagctattttagaactagacagagttggtaggtgcatgagttctgaatctcctaaacaacactgaattgttcactttaaaatggttaattttgtgctatgtgaattttgcctcaattatataaattatattgcagagtattttccatcaccaagcttttgggctacgttcctgaaacatattatgcttggcatactcaattattatagaaaatagggtttgcctaactataaaaatggtgttcaaacataatttaaaaatttggccaggcgcggtggctcacgcctgtaattccagtactttgggtggctgaggcaagaggatcacaaggtcaggagatggagaccatccatcctggctaacacagtgaaacactgtctctctctttttttttaatgtgcacttttttttttttatttttttgagacagagtctctctctgttgcccaggctagagagcaatggcatgatctccgctcactgcaacctccacttcccaggttcaagcgattctcctgcctcagcctcctgagtagctgggattacaggttccctgggagcttatttaaaagctctgtgccatcagttttcccttctgtcaaatgggaaagtgaaaccccatctctactaaaaatacaaaaaattagccgggtgtggtggtgggtgcctgtagtcccagctacttgagaggctgagggaggagaatcccttgaacccaggaggcggaggttgcagtaagccgagaccataccacagctctccagtctgggagacagaacaagactccatctcaaaaaataaaaaaaataaaaaaataaaaattatcacctgtagtcccagctacttgggaggctgaggtgggaggatcacgtaagcctagacttttgagactagcctgggcaacagagtaatacccagtcttaagaaaattcaatgatgtaaatagaaagtagcagaggatatctacttccaaacaaaacaagctaccgaatttaaaacctgcttctataagtaactgtttttcaaaattccgttattaggaaataccgatgcagcatcattataaactattatctcacatatttcatgatgtataggctttgcttatttaaaattttgttaaaaattctacagcttgtgactgaacatttacacttggaggtgtctgagcctttgacagatttatcacattgcttttgggcactgagtttcaggctttacaatgatatttaaagagattagagtatactttaaaatgtacagttgcttcaagtttgacatggcatttcatattaaatagcaattagcaattaacaaaaacctactaataaagggagctaggtattgacagcagtttggggaaaagatgatggtggcatgaactaaggtagtagagtgaagtgtgagaaatagtttgatttgggtttaatattttgaaagtagagctgagctgtcagggaataaaataaatatctttcttatatattatttaattttcaatataatcataaaattcaaactgatatgaaaaatataattgagcattacatgtaatgtcaaaacaaattaatcaccaaagaaaaaattaaaatgcaagtgaagaaaaaaaattttaatagaatttggaccagagatggagataatttttgaaattctcttatttagcactgattttaagtgttggcatcacagaccccatgcttcagtgataacaatccataaatatttgagagatggcatttcctcaacctcccttaataaataactataccattaggccatcatatttataagggaagttgccatatatcttatttaaatgtgtacttatttgtggatgattgctgagtgaatatttgctaaatcatatgccactatcaagacagacactatgaaaagatactagaaaaatgcattatattagaatcatacagatatggccacttaatacatgacactgaatgatttgtattaccaatgtttgtgatttttaaaaaaccaaggctttttctttaaagacccagtttctttcttggctgtgtgactaagccaatttattaaaataataattcagtactttgtaaaaccctactgacattaagatgattattcattactactaattttttaaaagaaatacaagaaaattttggcatacttttatttcattaaaggaaagtaatggtattataatgatgcgtattgagagaatttgcattatagcataaaataatatggtatttaaagtatacaatagacatgtaaatattttttcattttgctttaagatataaaatataacccaaatagcatatattgaagtgtctgatgaggtagaacattgtttatttttttagcgtacctgtcttagtccatttgtgttgctataaaggaatacttatggctgggtaatttataaagaaaataagtttatttgtctcacagttctacaggctgtataagaagcatactgccagcatctgcttctggtgaggggctgagagtacttccactcatggccaaaggtgaaggggtgctggtgtgtgcagagatcacatggtgagaaaggaagcaagaaaggaggggtggtgccaggctccttttttacaaccatttgttgtgggaactaataaagcaagaactcattcattacctctggtaacaagccattcataagcggtctgcctccatgacccaaacaaatcccattaggccccatctccaacatgagggatcgaatttcaaaatgaggtttggagtgtcaaatatccaaactatagcagtacctggattgttcatatccttgaaagttatagagaagtggtagtgcaaagttttgaacatgaatctcagaagtttcaaagaaggtggcagttgaaatgtcagttattgttctccatttcaaatgcattgaaatgtattgctagtggttcaggctactctataaatatcaatgagaacaacagcattgaggtggtggaaacaaagtgaccataggatagaaggcaaagggcccagtgtacaggaccctgaatcaagaatgatcatcaaaagggatcacacaaccattatagggacatgttctgctttagctttcctggaagcagtttgtgtcttaaggagatgtctgtccaggttgacctaagagctttaacattaagaatcatggtcaatttagactaaaaggattttgcattgacataatttacacctttaagaacctctgtgacccagccattatctttttcattccaaatgcagagatgagaggagcactagagatataggaaagcagtgcatttagataatttatttggcaaaactagtagctcactggatttcacaatcagcaattgaaaaatctcttggcatcaagggaaaaacaggaatagaaattcttaagagacctgggcttcctgcttaccagagcaggtgaaaacttcattgttgtctttttcttttgttgacagctttgttaacattttaattcagatatcataaaatccaccaatttaaagggtacaattcaatggtttttagcataatcgcagagttgttcaatcatcactgtaatcaattttagaacattttcaacaccatatctattaacagtcactccccattctctcccactcctcattttcaggcaatcattgatcaactttttatcttatagatgtgcctattatgaaaattttatagaaatgaaataatataatacgtgctctttttgcaactgacttatttcacttagcataatattttcaaggttcatacatgttgtagcatgtttcagtacctcattaccttttattgatgagtaatattatattattacagacaggcaacattttgtttattccttcctctgtagatggatatttgacttgtttccacttttgtaccattgtaaataattcttttatgaactttctttgtgcaaactattatgtagatgcacgtcttcatttctcttgcatatgagcagaatgctggcttatgcggtaattctgtttaccatttggagaaaaggccagttctccaaagtgtagtcatagtttgaatccatgtccttgcccaaatctcctgtcaaattgtcaccaatgtaggagataggacctgctggaaggtgattggctcatgggggcagtttctcatgaatggttgagcaccaccctccttggtcctgctctcttgatagagttcaggagatctgcctgtttaaaagtgcgtggcacttcccctccctctctcttcctcctgctcaggccatgtgaagcgctgactccccgctttgccttcagtcatgacttttaagtttcctgaggcttccccagaagcagagcaggtgccagcatcatgcttcctgtatagcctgcagaaccgtgaggcaattcaacctcttttcattacaaaatactcagtctcaagcacttctttatagcagtgcaaaaacgaactcacacatgcacattttacatggccacataaatttacgcagatttcagtatctccacattcttagtcatacctggttttgcctttctttatcactacagacacaaagtatgtatgaagtcaaatctctttacagttttaaattgcatttctctaatgacaaatgaacagtgatcgtgatcatatttccatgtgcttgttggccattcacatatccttttttaaagaaatatctattcaaatattttgcccattttaattagattatttctctttattaagttgtaacagttctttatgtattcttgagacatgtttcacaccatatacattattttaaaatattttctctgattgtaggttgtttctcactttaggatggtgctccttgaaatacatttttaaaaattgacgagacccaatttatcaattttatcgttaatctttgtgcattttgtgtcatatctcaaaatgtactgactaatccaaataatgaagatttacttctgtattttcttctatgtggaatgcagttttatctcatatattgcaatttatgatccactttgagttcatttttgtgaatgatgtgagataaaaattgaaattcattctcttgcatattgtcccagcttcatttgttgaaacaaagttctttcctgattggattatcttgacccctttttgaaaatcaattgaccataaatactagagttatttctggattcttaagtctgtccaggtgcttatatatctatctttatgctaatactacacagccttgcttaaagtttttaacatttttattttctttaatgatgattgtaaattgtagctaatttttgatttctacatccctatgagataaaaatgaaaacagttaaggctttttatttttcaaatagaagtttacttatctgtggaaaacactgttcttgtctatagtttcccaggcattactaactcatgtttgtaaaattctatttaacgtgaaatttcaggtatttctgggaagactaattgaccagcacatggttctcttgttttggcattatgccccacatgttcctgagtctgatgtggcaatgtattcatttgtcaaagttttaactttataatcattggccaagtttacatttctattccttctgaaagtaaaactattcacaggtacacaggaaatatcagggaagagccaagctctttagaaaccagccacatgtgacagcagaacagctaccttgctattgcaaaagggaagcatacagtctctctgaagccctaaatgcctccttttaatgcctgctcccagttttctcaatagttatcattagcaatatctcagatgtattcagagagataagtagaatgacactgatctagacctcaaagaagtttggcatgaacacgtattttatttcattgtgctttttttcttaaatatacctatgttaatctgaaattgaaggatgtgtttgtaacacatcttgcctacaagcctccctttgaatacacagtttggtgctaagtaaccctttgtagtaatgtccttgtcattatcagtagctgacaacattaaaaggatctaattaatcccagttgtgccttccaatgaaatgtttccacctcagtagattttacctagtaaaaatgttaaaaataaacagtctcctgggtaatatttctgggctcagaattatcctcccagctaccattagcattcatagaaaacagaaagggaagtacaactacaaacagctgaaagcctctgattagaagtctgctttcttactaacagtacgttgctgtacatttttttaaagtaggaaatcatttttaacttacgtttctgaaagattaaaaactctctgaggatctccattctcaatggcatatgttattgagtctccctctcgatcagttgccttcagagagaaaacataattcaattatcaagtaattgatatggcgcccactcattacagagtaatataaaagcttgaaactaatagcacagaatgtccatgacactgttaaagaataaagattaaagcatggcctaatggcaaggtgtaaaatcaaacatttcgtatctgatccatttctgaatatgtaatcctacctgatgtggaaataatcattttcccaaggtttacttatttaattaacttaattaatgaatttaatttcaatgtctgtttataatttaaataaaagctgctggctgggcacagtggctcaagcctgtaatcctagcactttgggaggccaaggtgggcggattacctgagatcaggagttcaagactagcctggccaacatggtgaaatcctgtctctaccaaaaacacaagaagttacccgggtgcagtggtgcacacctgtaaccccagctacttgggaggctgaggcaggagaattgcttgaacccgggaggcagatgtttcaatgagctgagatcatgccactgcactccagcctgggcaacagagcaagatcttgtctcaaaaaaaaaaaaaaaaaaagtgctaaactatgtttacagtgtcgataaagtgtttaatgtatattcttttctttttctgttcagaatatatcaagacaataattcaaatcagtctaactttctggttaaaaatcctgaatttatagccacaaagcatgacttcaaaaccgggctccaattgtcctatgtgattatttctgtgtatccatttctaaaacgaggactatacaacaatacaaatgttaatagatgttgagaggtttaattgaaataatatatatcaaggcacatagactaatatctggtacattgtaagctttcaataaatattaacctttttgttggtttttcttcccttcaacacccaagtcggagaagaaaacatatagtttgactttgagttccgagtttctcttgaccaaaataaagatgctcttgttttatggcactgaggtctggagttttaccttaaaaaacatcaaatcagttctttttccagtgagtcattcgatcctcttataaaagacatggataaagaaagaaatttggatgctatcagagagttgacagaatgatctgcctaagcatgatgctacagggggggatatatctgataaaggttcagatgtattttatttttaggtgactagcctggcagaaacaccagcctctccacagacaggaactgccctggagtcagcaggattctgagagaggaataagtatgtgagtttctgtcagtgactacataataactgtcccagccataagaggctgagtgtgaaattccctgtccagacaggcaggaacgtattgttcttagtggtagatcagttggctttgacatggattacacagtcctgctcacagaacgtccttatcagctaccacaatggattgatggccagaagcctctcttggaccacaaaaactacagaatcaagggaaactgaaaataatatttcagtcagtaataaactactgaatattgactatgtgctaggttctgtaagaaaatctttgcaagattatttaatctgtctctcataaaagtgatatacttccttcgcatggctcctatgacatcatattgtcctgctttcaatcctcacattatcaatggtagttcctcattttcctttgctgatttctcctcattttataagacttattttatattggattgttccaaaggttggtccttgaacttcacttatttagtcaactcattcaacagtgtagctataaatactgtctatctgctgaagacggtcatatctctaggctagccctttcctctggatttcagatgtgtatccaattgcctacatggatccacattagatgaataataataagcctccccaatttaaaaggttaaaagccccaaatctagatctcctttccatcttgacgtacctcaaaaaataaaagaaattcaaacaataatctattgttttcactgcttcatcatctcagtaagtacctgcaactccatcctcctactttctcagggctcatagctacactttgagggctcactcttacattccaatgcaacccatcagcagatcccaccagatttacctaaaatatctgctgtatctggctgtgtctgaatttcttctctgccaccaccttcctcatggattatggtagtaactattttactaacgtgttgcttcttcccttgtatcctcacaatagtcaattttcaattcagcagacaaaagtacttgtttttccaggccaattcttttatttctttggggtaaagtctattgctttctcccccagctccccaccctccccatgccatacacactaaaataaaatggaatcaaaaaaagtaaatgaagaagaaagtaataaattagccagggtaaaatatttttgaaacatcccatgttagtcaaaatccaaaattttatatttcattgagttagtcataatggaagcctaggagtagaaaaaaaagaagcaaacaaatttctaagaatacactcaataaaatggatagtagacgcttgatatttttcccttgcattctgttctttgctagataggaaccacaaataatgatactcagctaacattttgaagaatcagagaattatatctggagactatatcttaaccccaaaaagcttacagtgaactttttctgttgtttttctctcggtcaataaatttttcttattatgttgttatagatatgatcatgttcttttggtttgtttattgatatgtggttgctgttttaatttttttcttgagaaacattttataatcttgtgtttcataaaagccagaagaaatgcattctgaaacaagatagcttcatgtaaacaattttaagaccagattaatatcgaatcttttattatatcagatctactctaatatttaatatcctttatgtaagatgagaacactgtatttatatttattatttttatgttaattcctttcaatcccagaggtagcttgaaatatttcttcagttttatttgaccactcaaatacctcagtcttttaaggattgtgaatgtcaacaatttgcctacttcattcttatgtgaggttatgcccatattggaaactttgaagacttaggatttaaaagaaaattcttatttgattcctttcttcatttttatcttttcacacaatcctttattggtgttccagggtcgagggtggtataataattaggaagtatttatagtttttcagccaagaaagcaaaaggaaatggtgtaatctgtatcaaagttctgcaatctatgcattacatgagttagcacttgtatagacaatatcatctttctttgtcaatgtccaaaggtgagaaataatccataaaaagaaaaattggaaatatcaacagaagcatttacccttcaagtattaggatttgattatgtgtgtatatgtgccctaaacatatttctatcagcaatatttaaatgttttctatatataaatctaaccagccatctcaaaataattgcttataatgtgtcagaaactatattaaaattttgcatgtcttgtctcatttaaacctaatagtaactttactggtaaatagaaaatgcatatgacttcaattatattactatttctgccatcattccaaccagatttctctgtactttaattaattgaaagatgcatcttttttatctagagatagtaataactgtatcatcttgaaaatgggagcatagtgttattcagtattttccataatataagagatataaattgcttctttttagtgaaaaaacattttatgtgcttatttttgataaatcaagtcatatccgagtcccttcttcaaagcctgagaaaagtatgacagcagttatctttctggggcttattttgagtttaacgggggagattctggagccagctacctggattcagcctcagctatactatctcttctcagacaatgcactcaagtacaaaatgagaatactactactactacttaatcactcattaattcaacaaatatttattgagcatctacgctgtgttaggcactgaggctgcagcagtaaaccacacagacaaaaatcctgcccttatacaatttacatggtagtggaggaaaatgaagttaaaaattaattagaatattttgttttcagatctttatacgcgttgctcaactacaaaatatttcacaaaggacatatatggagagcagggtgaggatttacacttatagaagtgatcatgacagacttactgaaaatgtgaaattttggcaaatgcttgtaaaaggtgaaagagtaagtcacgtggggaagaacattccaggaagagggcagagcaagtgataaaggccgtgaggtgaaaacaggcctggtgagtttcaagaacaacaacgaggttgtcaggtctggaggcaagcagcatgtggaagaggagctcctcagtgtacttcgaccactttaatacctcaggttaaacgaataaatgatgtgtattttggatagctggcaagtaatgcactttagccactggtttgctaatatatggttaataacatggttaagattaaagccaatctttcctttaatttttatttaatttaatataattttaattttgcctgaagaacaaatgattcctttaaaaatcaaagcaattactctttccagtccactcaaccagattacttgcagcatctgacttagagtccctgatttttcagaagcaccaatagggaaacaaaagtatttatccaaggaagcagtgttcttagacactggcaaatggaaaatttggaaaagaaaacaaattttctctaaactaatcttctgttcatgttaaagatgaatacagccatcaaataccgtctgatagagtgcattttatgtgcaaggaatgattctacacatttcacaggacattaagacaaagtaactgcccttagggattctaaaatagataaaaatcaatggatttggatgattttctcacttaggcaaacaagttctgatttatgttattaaaccacttgagagcaacaaataaagctttcaattcagtacagcagtgtttcaaaaaatgtatacattcattcctggtattacattttttggcctttaacaaaatgttataatatttaaataaaaattaatgaatatattttattcatgtcaagtactgttattttgtcattcataatgataatataaaatgttattttgaagtaagtgtaagtaaaaggtcagttcattaaatattccaaacaatataaaatgaataatattatatagaatatacatataacatatatgaaacttggaaatgtagctaaatctacaatgacaaaaatataaatatgctcaaaaataaaagaatgttggaaaactgcacacaggagagccataaaacagctctttttcttacaatattggtatggattaatgatcttttgcccaggaagcaaaataaaatgccttatgctaagaaggcatagcagaatcactgctggtagtgttgaaaataaatggcatttggaagtgagcataaatttatttgtcacatccagagaagtgtctgtaaattaagaagtccttaataggaaaaatacctagacttccgttagatttagggatactctatgaaggcttagtcttaaaaaaattttgttgtacaaaatgggtaaccttggaatacaaagagatttaatcaattctaaaataagcctgcaattctaattttgtctagggctcaaggaacaatcaacaaaataaacttagaactaatgtaaatattcaaaatgacgcatccaaataatggttaccattatgtattaagcacttttaatatcccatctcatttaatcctcaaaacaatcttctctggagagcactacaatccctattttacacataataaaatcttaagcttaaaaattaaataatttgccaaagtttacaaactatagaatcataattcatattctatgccttttgaaactcattttctatcactagcaaagtcccctatgtcctaaacttatctcgagtttcccttcacctgcttgcttgaaccaacaccaagttcttcttaagaaccctaatttcccagtatcccttttgattggtgagcctcagagtagccttcttgtttctcaatgtcactgccagattattcttctggaaatgcatcagctttaattcttataccataagcattatactgcattaactgctactcttcattgttaaagtcatactctacactatttatcatacttcctgttttttgctcattgtcagtctctctctttgcctgtcattgctgtcattgtcaacttaatccaatatcaaagtttcaaataatatgtaaaatgctaatgacttcaaaattgtatttcagttctggggctgagagattcaagatcatggcactagcagatcccatgcaccttttgtggtctgcagacagctgtcttctcattctacacttacatagtagaaacagagagctctggtttcttcattccccataagggcactgaatgccattcatgaggactccactctcatagcctaagtatctctaactaccaaatgtcctacttctaaataccatcacgttggggattttggcttcaatatgtgaattttgggggaacacaaacattcagtccatagcagatgtcaaaaagtcttttcaaatacagtatggccaatattgaattactctttctctaacagtcttttaattttggctaatgacaaatcaatgtttccagttactcaagctgtatcttaatacctattcttaacttctatctccccttctatatccaattcattaacaaatcatgtagtttttaaccaccaaaatataaccagattgaaatgacttctcattatttctggaaagatcactccaggcctagaatgtgctgacagagcatatcaacaactctccataatttttcccaggcttcttccacagaccattttcaatgcagcatccaggattatcctttgttaaatttggttgattatgtcactgctatactcaaatttttaactgtacctaatttcgtgcagagtaattatatctatccctctcctattactgaatgatttcatctctactactgtctgtttcttttactttactctgtaaggaggagtatttttcttcttccttaaacatatcaggtgtgtctaaacttcggggtcttacctttgcacctgaaatacttttcctcagatacaaccatggctcatcctctcaccttattcaactatttgctgtaaggtcactttctttgtgaaataatcactatcaaattgtattttcccatgcacttcctctctagctttccttctttcattttccccataacatcttctaaaattccacataactcacatatattttgttaattttcttctctattagaatggaaccttcataaaagcagaaattttgtcttttttatttactattatatcctagcatttttagttgtgacaccataagaagttaatatttacttgtcatttggtccttgcaaagttataagccttaatgattacattataatgagaaaaatgaatgaaagaattttggaaaaatgaaaaaggaaggtattaagtggacacaggtctctccctgctcctgttttcactgggaggcaggaaaatgcacacctcaggaggggagggcatgggacattctggcttctccctgatttattagactgcaaggataaactaagtccaggaaactcagtcagagctctgttctgtatatgcacattcttcctcagtatcataaagggccttcctttgtacttcctatgactgggagcctaactttaatatactgaaggaagtacagcatttcaattgtatctggtacttgaagcaactgaatttacagtaaaacaaaacaaaacaaacaaaaaaagaaaccccacatgctttttacctattgtatatactctgtgtgtctctattaattgcttccaaacttgacagagaaaataaagttgtgtgtgtgtgtgtgtgtgtgtgtgtgtgtgtgtgtgtgtgtcctattctacattttcagaatacctgtcctaggttaaacacattccaaaagactgttagggaacagtttgttctgggcacactgatataaatatttcagttatctttatttataattattaaaaaatttgctatcaccttcatgaatattggacatgaatattcattgctaacatgaatggctcaagataaaggaggttatatgaataaactatatgaaaccaggaaggcttttgtcatctggaatgatgctgaaaagatgattccataagtatgaatttagcccaattattcttagtttttattgcccaatactaactgtaacattaccctgagagctgtctctagaatagtgtttggtttgcctaaattgaacttaaagaaaaatgttgtcaggcctctgaaaggacaaatcttacttgctaataaatatactgtgcatagtagtatttggcctgagacaaacttttccaacctttctatgaaggttgtgacagagaatcctagccctcttttactactacttattcgtggctattgatacttagaatctaattattgtggaaagacaattggctttggtcagtttacagccctcaacatttaatgacaaaccaaatagaaaaaaatcagaatcaacatttctgtcattaaaaaaatttcttcatgatacagctcttgtccagatttatataaatagaagtttatttgttctttgttttagaactatgaaaaactggacacctacgaagcaatttacttaaactcttagaatttagttcaaggttttctcaaagctttcctcagagcctactcacttttctaactagttagatttctcagccttcactagataaaaaccagatatgtaaaataataaagttatccggacacaggcaaacagtgaatgaaatcagtacacagtgaatggcttgacagctgtgagagaagtagacagaaagtgcaccttaaaaacaatagacacaggctgggcgcagtggctcacgcctgtaatgccagcactttgggaggccaaggcaggcagatcacgaggtcgggagatcgagaccatcctggctaacatggtgaaaccccatctctactaaaaatacaaaaaattagctaggcatggtggtgggcgcctgtagtcccagctactcgggaggctgaggcaggagaatgtatgaacccaggaggaggagcttgcagtgagccaagatcactccactgcactccaacctcagcgacagagcgagactccatctcaaaaaaaaaaaaaaaatatatatatatatatataaaacaaaaaacaaaaaaacagataaaacaagcatagttatcaaagatcaattgtccattaagccccacacatcacagcactacttatagataaaaatatgtaatccaatttaggaactattaatcacacaatattctgaattaaatagacaaaaacaaagcattaatttgatgcccattataaacaatatatgtactgctagaaatgagaaataatataaaactattcaatatagcccctaccttgagaaaatattaatctttgtgaaataaacattgagaaatagtgttcactatatgctggttaactgtgcatttgtaaaagtaatccaggtctagtatctacaagattaagaacctagtcttaattctctcacttttagccacctagggtctagggaactagcatgtatccctagacatctattctaaatcataaaatgaaataaaaaatacttcaagcatctactttatgtagtagatatagaatcagatgaggtaatagatatttaatacacttcagaattccattcaaatagaaggtattgctcagtggtcgggcatggtggctcatgactgtaatcccagcactttgggagcccaaggcgggcagatcacgatgtcaggagtttgagaccagcctgaccaacatggtgaaacctgtcactactaaaaacacaaaaatttgccgggcgtagtggtgtgcatttgtaatcccagctactcaggaggctgaggcaggagaatcgcttgaacccgggaggcagaggttacagtcagccaagatcacatcattgcactccagcctgagtgacagagcaagactccgtctcaaaaaaaaaaaaaagtattgctcaataaattaatttaatagttaaaatcttaggctttggagtgaaaagaaataggaatgaaatgggactctttcacttataagccacatcctctttgagcaagatttaaggtatttatatctcagtgacatcattctgatactcagataaaatggcacaaggctgtcatgatgatagaatgaaagagttcatatctagaattcagcatagtgcttagcatgcatttactaaactcttactattgatgttaatatttagaaagaagaatgcacaatagaattcaggcaaaaaaaatcgatttgtaaagcagtgtttcttaaagagactacaactctgttatcaataaaactctcacttctggaatactcagcaacatatagtaagtgatatgataccatattagcagagatagtacatcaaattcccggcaaccacttaaggtggggggggatttttttttttcctattcttagatacaaaaattttcatctgcaaggttacatgtatactttaagcactgcttgctcttcatgtccactttatatactgataaacagaaagaaagatctccagttaaggtctgaaaatgtgtctaagataggtagatattggttgatatggcttgtctgtgtccccacccaaatctcgtctttaattcccacgtgttgtgggagagacctggtaggagacaattgaatcctgggggcaggtcattcccatggctattcttgtgatagcaaataagtctcatgaaatctgatggtttgaaaaatggtagtttccctgccccagttctctccacttctctgccgccatgtgagacatgcctttcaccttccaccatgattgtgaagcctccccagctacatgaactgtaagtccaattgaacctctttcttttgtaaattgcccagtctctggtatgtctttatcagcagcttgaaaatggactaatacattggtcaactatattggcagtggatggtggggaggggaacataaataaatgtttataaacctggccatcaacactttgagctaaaaaaatgacaaatgagtgaaatacacaattcacaactaatacttagcatgtattattttgagcaaattaatagatcaaacactaacataaccccttagtatattttcagttgatacatatatcaaaaagtaaaaataagcaggattggagcatacagcagagacacttctccaatgacaaagtgaggagctacactgaccatctcccagtaaaacaatcacaactgctaaaaaagaaaccttaaaaattaaagtctcagctaggcgcagtggctcatgcctgttatcccagagttttgggagactgagaccagaagattatatgtggataggagtttaaaaacagcgtgggcaacatggtgaaactcatctataccaagaaaaaaaaagataagaaaattagctgtgtgtggtgttgtgcaactgtagtctcagctacttgggaggctgaggtgggaggataacttgagccctggaggtggaggctgcagtgagccatgaccacaccactacactccagcctgggcaacagagtgagaccttgtctcaaaataatattaataatcataatagtaatataaataaagttttaaaatagtctctaaatactgttctaaagacatatggcaagtggaaaaaatatttattcaataaaacctactaaatctcactaagaattgtgaaaactgttcttagtgagttcactaagaacagcctgtctttctccctttccaaaaacctattcagcacagcataatgcaggcatagtcaagaacatgggaattcttcctcacagcttcagtctgaaactaggctatctgcccatgaaggcaggccacacaatttcttatcacccccagcaatgtgctgcagtggctgagaagtctgatgtttccggtgggccttatggacaggaatggagaaaaaggcatttgccaagtcaatggctgtatatcaggtaccaggagatgtgttaatttgctcaagcaatgaaaccacatctggtacggaagctgcaattggagtcaccacttcattaagcttacaatagtccactgtcattctccaagatccatctgttttatgctcaggccaaataggagagttgaacagggatgtggtgattaccacccctgtagctttcaagtccttcatagtggcattaatctctgcaaaccatccagggatgtgatactgtttttgatttactatttttctaggtagaagaagctctaatggcttccatttggcctttcctaccataagagccctccagtcagggagccaatgtgggggttctgccagcttctaagtatgcctatgccaattattcattccagcactggggaaatgaccacagcatgagtccaaggacccactggataaccactataagacagatccgagctgaaaccccattaattatctgacctctataagcccctactttaactagaggaccacagttttgggtccccaagaatcaacgtcagctcagagccagtgtccagcagtccccaaaatgactgataatttccctttccccagtgcacagtgaccttggtaaaaggcccgaggcctccttggagaaggatggaagaaagattaacagcataaattggtgggtagtgtaatgggattcttcctcaaggggacctggcctccccttcattcaaggagttctgggtctgtaaactggctcaactctggaaattgactgaggggtcatgattctctgtttttataattcaaattagtcttttgtccattctacatagaagttttctgcttaaattaagtaggaatgcagtaggcttcctattaatttcacttctaggaacaccctgattaattagccaatgtcagagccttacatgagtcagactactctgatgctgctttgcctctgctgtccattatggtaactacacccaccttgcctttgatggttgagcgccaccacttggcccatgccaccttgggatccaattactcctattgtatttaaattttgtagttgagtgactgtggttcacactgtttgatctgacatacagagaagagcaattatagggctcttcaaagatgcaggtgctgccctcataaatctcttttgcaaagcactggtcaagggtatatcttcaggacccacccagcagggatgagtaggtctaaagtgactagtccactccaccatcccaaactccctaagcctttagatccctttctctgcattaaaccaagagagatccggcatttccagcaagctcagagttggctctcttttaatccatattttagctaaccagacaaataaattattataacctttttttaactcctgaagctgcaacattaaatgcagaatccctacttggtgggcccagatcaataaattcagcctgattgaactctatgtttcttccaccattatcccatacccataatatccattcccatgcctgttctccagatttctgcttatataaattaaaaaaacataacaaaacaaaataaactcgagcagttcttttcaagtgtagcacacttcctcatgggtcacactctgaacttacctctaggggcccacaaggactttagtctagttatagattcagaagcaaacaggagtgttggggctggctcctgaggagaatcaacattatttttcctggcaactgccttaggggaggccatcactgttgcttcaggcagtgcaaggtttctctcctcagacaaaagtggaaaggctgatggcagcatggattagagagaggaggtttccacgactaggaatggagaagccatttcttctgacaaaaaagtttcatcagagtttacaagctcagtgtccccagccttatcagggtcctcccacacatccccattccaagttgcagggtcccattcttttccaatcaatgccctcactttaacaggggacacctggcgaggctgtgattacacctgttgttgcaggtcagccactagcatgataagagtttgtgtctgattttccacaattttagctctttctctacaggagctaagactctcactcgggaaaatcttagcagatttgaggctcagtatctgcttctgaagccaggagttagaatccctgagttcagccgggcgcggtagctcacgcctgtaatcccaacactttgggaggccaaggcaggcagattacgaggtcaggagatcgagaccatcctggttgatacagtgaaaccccgtctctactaaaaatacaaaaaattagctgggcgtggtggcgggcgcctgtagtcccagctactcaggaggctgaggcaggagaacggcatgaacccaggaggtggagcttgcagagagccaagatcgcgccactgcactccagcctggctgagagagtgagactctgcctcaacaacaacaaaaaaaaaaaaaaaaaaaaaaaagaatccctgagttcatccttttctttcatcactttgtccagtaaacttaggagcaaccaaccaacttcatagtcaaaggtattatgtatagagtcactaaactctttgcctctcacaagtggtgaatcaggagtgtcaaatgcatttattttgcataactgtctaaataattcagagcaaggactatcattgttcaccatactattagaagtaaagtacttagcattttttgatctaatcatattaaacagccaactccagaaaccccaaaaccaatgaaagaactccatccttaatattcagttcctctagaaccactcctggcaccaaaatctgtattagtcagagttctctagagggacagaactaacaagagatatagatatagatatagacatatagatggagatatatatatatatatatatatatatatatatatatatatacacacacacatacatatatatacacacacacacacacatacacaaaactaataggatatatttaggagtttattaagtagtattaactcacacaatcatgaggtttcacaataggctgtctgcaagctgaggagcaaggaattcagtctgagtcccaaagctgaagaacttagagtccaatgttcaagggcaggaagcatccagcacaggagaaagatgtaggctgtaaggctaagccagtctagtcttttcacatttttctgcctgctttattttctgattagatggtgcccacccagattaagggtgggtctgcctttcctagcccactaactcaaatgttaatcacctttggaaacaccctcacagacacacccaggatcaatactttgcatctttcaatccaattaagttgacactcagtattaaccatcacagtatcatataacacagcaattccattcttaggtttctgctcaagagaaatgaaaacttatgttcacacacaaaaatatatgtaaatattaatagcagtattattcataatagtcaaaaattagagacaatccccatgaccgtcagctgatgaatgtataaagtgtagtatatgcagacaattgcacattattgagaaataaaaaataatgaaatatcaatatatgctagaccatgggcattaaaacgttaaactaagcaaaagtaaccagatacaatagatcacacattgcatgattacatctaaacaacatgtcagaatagacaaatttaaagacacagaaagcagactggtagttgcctaggactggtgactctggagtaaatgaggagtataggctttttttatggtgtgatacaaatattctaaaattgactgtggtgatggttgaacaactacgtgaatatatactaaaaacattaaattgtgtactttaaattggtagattttagggtaaatgaattatatcttaatatagctgctaataacaagcaagaattattccacagagatgatggagttagcacagcttccttgctgtccacactcagtagcaatctatttgttttcctggagctaatgagcttcttgtggcttacagacagggaccagagagaaacacagaaagtgtcaggtcatgggatgtcttaacacacaggtatcttcctaagggaaatgttaacataggtggatcctataggagtgagtctggtctttataaagcccaaaatcaagaaacagctaaatagaatggatatggaaagcattcctcctgttactgaagccacaaaagtataacgagcataaaaaacagacttgcttcaagtggtataggattagacaattaggttcgtacaatatgaagtgtggatccacacacataagaaaatttcacacacaaaaaagagagttgacagtacaactagttaggaaaaagcaaagtccttcatatatgatgctgtttggtgtttattcagacagaagaaattgaaattgatttcaaatttcattatatacacaaaaatacatgttatatagcttgaaggcttaagtgtaaaaaataaacagttaaaacattggaagattattttgtcaaatacacatataatccaggtcaagagatcagtttattcaagaaatattgaatctggtgatatgaagatatatttgactctatgaacttggataccttgcctatcttccttccttcttccttctttctcatctatctcagctgtctatctcctagaaccagtaaccaaatgtttatacatggtattaattttcacgtattaatattttattaatagaatcaatagcattgatagaattttctattttgttatgttctgttctcttatatactacttgatttcattaacaagagataatattaacaccaaaaattgattttgtgatccaaagtatggcttgaaaatctgctgtagagactttgaatgtttgcatctctttagtgtcataaatatatgtatgcttcctgacttcttccttcctgattttcttcttgaataagtaatttcataaaccattacaacgcttagtatgataaccgtttgctcctattgcgggtatgggctgtggtctggtagagagaatcagaaccccagagggggaggaacatgcagtagtatttgtggcagcaacgtgcacagcaggaagtattagagccttagtcaaatgagaaaggcatctgagagggtgggaggcaaatgtggccatgtttggaagatgaaatgttttggggagccaaatggactggcagtgaagggccagcaagaattgttaagagtctaatgagggtgagtagggcatgcccatgaagtgggggacagcagcagtgtaatttggggtgtcctagactgagtgatatcaggctatctgggctgggtggggtgttgtggaagtgatcaatgtaaagaatcagagcctgggtggggtttcagaaagtaaacggtgtcaaaaccttggaaaagggttgccacagcagcctggcatggggtcatcaaacccaagagaggaaaaggaggtcattcaagatgtctggaatgggaggtcagaacccaaagcaggtaagcagaatgtttaggactgggtcagaatgggaatgatgatttggtgtgatttcaaagcccaaagatggttacaagggcatttgtgtagactctcatatgtgttgagttagggaataatgagggtaatcatggtgtctgcatgggaagggtgtcagtaggacagcagtctacagtgggatgtcaaagcaagagtggagagagtggagcaagatggtcccccagtaatcatcccctgaaacaaacaactttcataacaagaaaatgtcaggtgagcactcacagtacctggctgtaaatacatatcactgaaagagtcactgatgaggataggaaagaaagtcttgaattgctgatgccacccctcccccatcccctggcagaagacacatggcaagaagagaggatctgtgcacttgagagagggagagtgcagcaattgtgaggctttgcattgaactcagcactgttctgtcacagcagaaagcaaaaccagaatgaattcagctgatgccggctcacagaaggagtatataaaccaatcctatccagaggagaataacccaaaccagcagttgaaacttaagttccagccagccttcccaccacaggctaaagggctctggggttctaggtaaacttgaaatgcagtctaggccacaaagactgcaactcctatgcaagtactagtgctgagctgggcttagacccactggactaggatggcatgtgacctacggtgacaatggctggagcagctaagggagtgcttgtgcaacccctccctcaaccccaggcagcacaactcacaggtcagggggatactctttacttctgctgaggagagaagagggaattgtaaagggaacattgtcttacatcttgaataccaggtaagccacagtaggataggacactagtcagtcatgaggctcccatttcaggttctacctcatggctgacatttctagacacatcctgggcaaaaatagaaacctctgccttgaagagaagaacccagtcctggtaggacccatcaactgacgcaacaaacaaacaaacaaacaaataaacaaaaaaccttggtccctgaataaccagcagtgatacccaggtagtacactgtggtgagatttatgagacttgctggcttcagatgagactcagtccagctgtggtggctatgggagagactccttctgcttgagaaaactcttgcatgctgttcgtataaatgtaaatcagtacaactactattggcaacagtatttgaaattcctcacaaaactataaatagaagcatcatatgatccagaaatctcacttctaggtataaacacagaaggatgaaaatcaaaatatggcagagctatctgcactccgtgtttattgcagcactattcacaatggccaatatttggaagcaaaataagctcaataaatggtcctgggaaaactggatatccatacactgaagaataaaactagacacttatctcccagtatataaaagaaaatcaaaggcatcaaactctgaatctgtcatggtaaattgtgtatgcatccacaatggagcattattcagccataaaaagtgacattctgtcattttcaaaaacatgattgatctggacatcatcaaattaagggaaataagaaaattaagggaaataagccaggcacagaaagacaaactttgcatgatctcatttattcatgtgagctgaaaaataaaactattgaattcatgaagatagagagtagagggatggttcccaaaggcagggaagcgtaatgcaggtttatgggggaagtggggatagttaatgggtacaaaacatagttaaaaagaatgaataagacttagtatttgttaggacaacaaagtgactacagtaaaaagcaatttaattgtatgtgttaaataacaaaaatagtataatcagtttttttgtaacataaaggatagatgcttgaggtgatggataccccattatcctgatgtgactattatgcactgcattcctgtatcaaaatatctcaatatcaccccaaaatatatgtacccacaaaaattaaaaatgaaagaaaatttaaaaatacaagtacaagtggaatgaagaaggcaatagtttggggtatggtatttgtggcatgtagtgtgaagtgttggactttgaacttggtaataagtttgtctgcgtggttgtcggtggggtgagggctgcatctgtgctgcgccagtggcagccaggcgtgtggtgtcaaagcatgagtggagtgaggagaccatttgtatggggtcataggcaggagattggtttaacccagtgacatttacttagtacataaatacaatgaaggtaagaagcaggtttcctatcagagaatagagacaaaagtgtggaaagattaaaaaaaaaaaaaaaactagagtaaatggtatgggatcagattggaattgaagttttagtgtgaactcataggtatatatataagtaaacaaaggaaaaataagtataaacaggtctttttagcctgctatttggggcattacactgtgaatttttcatctttactcatgaagacagcttctgattccaaatcactcagcacacagtggttaaattaggacaactgtagcagcaatcaagttttgctgtgctttctaaccatttatttatcaaaatccgaatgaactacctttattttggaggagggaggtaaggaatggctcagtccacttctattgctagataattgtgtctttgtgtctgaaatttatgttttttaacctggagctttctttaaaaaaagctttgttcttatgtgtgggtgagacaagtgtatgactgggaaaatcagagacgaagatgacattttttcccttattttcttttaaaaactggttttggatttaatgaatctatggtttttaaaaaagtatttgaaaccacgagacatataattgaatttttcagttttcttaataactcttccaatgtaaatattctttacttttcaatttaaaatacattgttttcttagctccaaatcaactaattcttggtagttaagtatagaaacaccatagggactttgcaggatcagttgagtctcccattgttctcactagacaactgatacttattagcagtttattgagtatacttcactaacatggtttttgttcctttctatttatcaaaatctcagaaaaattacagcctttatatacttacactttaatcaacaatagctgacagcatgtgaagcaataaatagcttcaagacatgcaataaactctgaggtttatttacaaaacaacacagtgagaatcatttattgccaagttactaaaggtaatagtgattactgctattaaaataccagaagctattaaatagttgcccaagcaaatagtctacattcaaacccagaattcaaattagtcttttttcatttaactttagaaaaacagaatagtttaactctgttcaattagaaaggaaaaaaaaaataaccaagaaacaacaaaaattctccaattcaaacaggtttagaaattgtaagcttttctttgggtcatacaatgggcttttggcctgaagcaaatggaagttttcactttctactatagtcataaacttttgctgataggtcatttataagaaggaatgaataaaagtaggtctctaccatttccataaagatagactaacagagaacatgcagtatcagttgattatcacttaggaaactggaaagagtgtttcttggctttaaaagagacatgatagaaatctaaaagcacagcagataatagggaataaaggtctatttgaagtgtctcttccccagaactccaaaatacacctttattatgacatataattccctagtgattgcctataaaattctattaaagataaagatcttggccaggcgtggtggctcacgcctgtagtcccagcagtttgggaggccaaggcaggtagatcacttgaggtcaggagttcaagaccatcctgcccaacatagtgaaaccccatctctaccaaaaatacaaaaaaaaaaaaaaacaaaacttagcttagcgtggtggtgggcgcctgtaatcccagctactcgggaggctgaagcaggagaatcacttgaacccaggaggtggaggttgcagtgagtcgagatcatggctactgcactccactgagtgacagagtgagactctgtctcaaaataaataaataaataaataaaataaagatcttctattctacctcattcctctggcgaccatattcctctaagtcggggttcctcagtttggtaccaatgacatttttgaactggaaaattctttgttggagaggggatttcctgtgcatttagggtgttcagtagcatctctgacctctatcccttagttgtcagtatgatctagtccccagtcatgataaacaaaaatgtctgcagatattgccagttgtctccaggtggggggtgggggcaaaattgtatctgacagagatccattgcttttatcaatctcaaaatgcattatctgtcatagagtccaattaaaacaacacatagtttttgaaattgagactatctcataaaagctgagacatatgcttcctgaagtcagagttattgtaaccaaccacttgttactcatctcaaaacacattcactgatttctacagtcctcccctgctctgaggatttggttttcaggcaggtggagacataaatactatttaatttctaatgcatcatttcccatgtctctcaaaatgttcccaatagaggtcacacatttttacatataagaaaaaaattcagagtgaaaatccacacaattttaaataataatatatttaaagctaatctaaactcacaataatcttggggatatgaaacctggggtaacagttcattacagttcaagaagtctcatggatgtttgaaacttcaaaggagagcactattgctgattagttacgtagactgaagttttcagtctcttgagaaaagtttggtatttcaaatctgaaaatgatttaagcttactggggaatgaaataaactgcaaaacctttctagcactctaaatcctgatatcacagagattacatctgatattagcatattttgtggtgcctaaagcagttttaggagctgacaattgccagggaaaaagagaatttccgggaagtttggtcctaggaactggacatgtgtaggcatttctccaaattcaaattcaaatatgtataacaataacaataggcatttgtataatagtgtacatataaaacaaatttatagttgaggggatatattttattatatttgtagtacagaggcagatactatattaccgaagatgttttgtttactccagataaacaataactaattcagcacgtttaagcattcatcttgactctcctcactttccaactctacatcattctctgaggcagcaaaacatgtacactcagtggcctcactacagcagtctctccatcttagaacagtgtgaatgtgctctgggcaatatctgtagtgtgaagaaatgtggcttgagtttgttaatttgtaccgtgtcctcatatgcacactttctcaaagggagagtcccagagtccccataacagtcttttaaataaatcttgttctttatactgtgttctgcacttctctaccggtccttctcccaacacagacacacacacacacacacacgcacatcttaatttagaaagaatagcaatcattatttgtaaagacaactgttgggacagcaacaattctctggagaaaagtctaaaacatatcttcttaaaatgtattcctttactattaattatatttgtattagtttttttcacactgctattaaagaccccaaactgtgtaatttataaagaaaaaaaggcctccacatggctatggaggcctcacaatcatggtggaaggcagaggaggagaaaggcatgtcttacacagtggcaggcaagagagagagcatgtgcaggggaatttccctttataaaaccatcagatcttgtgagatttattcactatcatgagaatggcataggaaaatctcgcccacatgattccattacctgccacctggtccctcccacaacacgtggggattattacaattcaaggtgagatttgggtggggacacaaaaccaaaccatatcaatattctgtctgctttttaaatatttttttattttttgaatttctatagtgtatttattatacttcatcacttgggtttctttttattttagaaaaccctgaatccgccatttcctagatgtcatctcaaggctacataacactaagtcctcattacagagttagtaaaaaacaagatggttatcataactgtcttcattacagaggctgcttgaaaatgaagtctacacagagctaaccaataagaagacagtagaaagcaacacaccaaggcaccatttgaaacctcagttgcagcctttcttaaaatcagatccacatgatagtcaacaattttttattgattacatagtatattccaggcactgttgtagttactagggatataatagcaaataaaacaaactctcggtgattatggacctaatataatacttggcatgacaatataacacaaaataagcacaagtgcatataggattacagcaaagaggataaagttaacagaaagcacagcatgttggaatattattattttttataaggtgggtaggtaagaccacttcactccaaggaaatgtaagcaaagtctgcaggaagggaaaaactaagtcatgagaatatctgaacaaggagcctttcaggtagtggaaatagcaagtgaacggttccagaggtaggaatcactcagtgttccaggaggtcagtaaggctagagtggaatcagtgaaaggatgagaagtaggagatgaggtcaggtagctatcagtacaacatttgtttttatcttaggtaatctgagaagccatgtcaggaatttaacaaaaatgtgaagtcattttaggtaatttttttaaaaagtattattctgttgcctgcaactgaccacaaaagggcagggcggtgggctggagcagtccagtagggaagctattgcaataatctaagtaggaggtaggtgatggtggctaggattagggtgaaagcagtgggaatggtgagaaattgtagaatcatgtaaatatctttggaccaaccaaatttattgattcattggtgacaagggggcctgtggataaagagaaaggtcagggttcacttaaagggttttggcccaagaatttggaaggataaagttgccatttactgggtagggaaaatgcagaaggaccacctgttttcattaagataatggaaagtaagtgtcaagcattgagcatgggaaatactaattttgagatgctctgataaaaaacaccatgatatgcttcacacatcctccttcaaggaatgacgggattattcccttatacattagaaatgttgcacactgaaaggcttcagctatcagtcctattcagagaatgcctcatctgaggaaagcccaaggtcaagcagctttctgaggcaacctgcgtctaatgaatattgatgcagacatataaacagcctatctccttgtcacagccttacaaccctgaaggaccatatcacatccataattttccctgtaggcagctgaaagctttacttggactgcactgaagtttaacttctccatacatacaatactgctttcttcccctcccttcaataggagttgataccccaaacactccctaataaagatcctgtaattgaatcttaatttcaaagtctgcttcccagaaaacccaacctacaaaagatgtttctttagtaaccaaagggaaatactgttgttacagattgacatggatctatagttttgagacagagagctaaactagacatttgaattagaagttatgagcatataccacttaaactcattagatctgttgaaataatctttggagtgaatggaaataggaaaagaagaggttaaagttgaaagaagggtgtttcaatttttaaaagtcagggaagttaaggggaagaagtatcaaagaaaacaaaaatagagcagcctgggagtatggaaaaagtcccaggagattggggtacactgtaggtcaactaattaaatttttaaataaagaagaaactatcaattctgtcacatcatgaggatgggttgagtaagatgagaaattaagttgtcaatggaatgggcactgaaaatgcaaaaaaaaaaaaaaaaagccatttgagtggattaatgtgactgaaatcctggttacaatggagtcaacagataatcctggaaaggagaataaccacaactttcttcaggccagtataaacaatatatttgagaagtttccacagtgaagggaagcacagaaatggataaattgctagaaggtttacgggaccaagagaaattttgttgttgttgctttgtgttcaattgcaagatataatggcagtattgcatgctgatggaaatgatcaggtagagcaatggatgcttatgatgtaagaagcacatagggaaattatgaagcaacatccttcagagtagacatacatggaatcagtagaattcaatcagatcagagtcagagtaaagagcccacaattagaaggtgtgtgttttagatttgcattgggccttgccaattacatttccagtcctaagtgctagtgaggtccaataaccagtgtcattctgcaaagtgattatggatcatgatgagacattaaatactgagttgtgtttagaaaattttaaagtgatttgacagtaattttatatatgttgaatctaacagttaaaatggctttcattttacatcttttgtatttcatttttctagtaattcatttaaatgcaccctttataacagaaactttaagaagcactgatctagcatgcaagtgaaagaaatggtttatacagaaatgaggagtgcttatttttaattactgaagtacaagtatcacaggagctttggtgttgcttcgccagctggaaacttctgcggccaatggcaccttctacctgaggattgcctgtgactgctgggcttgttccacctatgcagcctgacaagctgtgctcggtttgtgctactggcccagatcccacatctgccaagtgtgagccaaaagcagagtggcaaaggggtgtgaaggtgagtgaatgtggggtccagtcactgagcacagccaggcacactggctgctacaagagggcaggcagctccaggtgccagtataggaggaaggtccatgtaagcctgtggttggaccagatgcaggcacctgcatctggatgaggggaatatggtggcttgtggaagcttggagatgccaggaactgcagaaccccaaggagggtgtcacagccctggtttggggagcccttagatctgggttccataaagggccacagctcttctctccttcctgttgtctgcattgtggtgtcggggatggggtgcctgtttccgtcctgtttgtgttacagctcttcttttagtcctgcccaaccagcaggtcctgagtttttttcctacatctaggaagaatgaggtacatagacaaatggagggtgagcaaggcagagaggagtttcactgagtggcagaacagttctcaggagacccaaagtgtgtagctcctttcctcaggcaggtagtcccaggtccagcttgtcagtggagaggagatccacagtgggtggctcccttctgcaggaaggtcatctcattgtctgtgaagccctcgtggagaggagacccagggtgggtagctcctatctgcaggcaagttgttatgtcatttgctggagtctggctgagtctgggggttttaatgggcctcataggggaggaagtacatgctgattggtccatgggcagccaggggcaggcccaaaagcagcaccctaaattctcattctgatctgccgaactgacagctgggcccccaggctattactataaagctaccaatgtcattattcatagaactagaaaatactattccaaacttaagtggcagtgaaaaagagcccaaatagtcaaagcaatcttaagccaaagaacaaagctgaagccatcacactacctgcattcaaattatactacaagtctacagtaaccaaaacaacatgctactggtagaaaaacaaacccatatactaatggaatatattggagaacacataaataaagccacacatctgcagccatctgatcattgacaaagtacacaaaaataggcaatgaggaaaaactccctattaaatcagctggctagccatacatagaagaatgaaactggattcctagttttcatcatataaaaaaaagtaacccggctgggtgtggtggctcacgcctgtaatcccagcactttgagaggccaaggagggcggatcacgaggtcaggagatggagaccgtcctggctaacacagtgaaaccccgtctctactaaaaatacaaaaaattagccaggcgtggtggcaggtgcctgtagttccagctacttgggaggctgagtcaggagaatggcatgaacccaggaggcagaactggcagtgagtcgagattgtgccactgcactctagcctgggcaacagagtgagactctgtgtcaaaaataaataaataaataaatattaaaaaaaataaattaacccaagatacattaaatacttaaactaaaaactaaaactataattcctagaagaaaacctaggaaagttttatttttatttttttttgtcaaaatgatgaattagagactttggtgcgcctcagccacttgaaaatagcaaaataaatcataaaaatgaactctgtgaactttaagaagaaaaacgggaatccaatggaattatgaagaataccccagatcctggagaggaaaacaccagcaaacagctcccacgatggtgtccagttgataaaaagaaagaaagaacaaagaaaatatcccacctgcatgaaaaagttacagaaattaaaaatcctagtgtctccagataagaaaacatcagtgcaagaattctggcatcatgaaaatctgaatgtagtgataccaccaaaggattccactagattttaagcaatggtccctaaccaaaatggaaactcagaaatgacagataaataatataaaacatggattgcaaaaaaattcaataagatccaaaacaaacttgaaaattaacacacaaaaaaattctaaagcaattcaggaattaaagaaaaagataaacgtcttaaaaagtaatcaattacagcttctggaatcaaaaaaactcttgaaaaatgttaaaatatatcaaaagctttattaatagactggatctatcagataaaagaatttaagagcttgaagataagccttctgaagtaacccagtcagacaaaaataaagaaaaaagaattttttaaaatgtacaatgtcttcaagaaataaaggattatgtaaaacaatcaaacctattaattattggcatttctgagagagaaagagaaaaagaaaacaacctggaaattacatttgagggaaaaattcaagaaaatttccctgatcttgccagaaaggtagacatccagaaacaagaaatcaagagaacatctgtgagatactatataaaatgacttcactagggcatacagccacgtgactgtccaacatcaatacttaagaaaatttttttttttagcagtaagctcaaaatagcgaatttcattgtttttttaaattattattattatactttaagttctgggatacatgtgcagaacatgcaggtttgttacataggtatacatgtgccatggtggtttgctgcactcatccacccgcgatctacattaggtatatctcctaatgttatccctcccctagctccccactccctgacaggccctggtgtgtgatgttcccctccctgtgtccatgtgttatcattgttcaactcctacttaaaggcagatagagaaaaaggaaagatcacctacaaaggtaaccccatcaggctgaagcagacttctgatcagaagacttacaagccaggggagcctggggatctattttcagcatgcttaaagaaagcaaattccaaccaagaatttcatattccatcaaattaagcatcttaagcaaatgagaagtaaaatattttcctgacaagcacgtactaagaatatttgttaccactagaaagccttcaaagaaatcctaaagtagttctaaacatgggaaccaagaaccatatctgctaccacaaaaacatacttaagtacatagcccacagaccctataaagcaacaacaaaatagaaactacaaagttaccagctaacaacttaatgatagaatcaaaatttcacatatcaatattaacctggtacataaatggcctaaatgccacccttaaaaggcacagagtggcaagttggattaaaaacaaaacaaaaccaagatccatatggctgctgtctccaagagacccaccttatatgtaatgatacatgaagtaaagtaatgatgctcaaagtaaagagatggagtaagatctactatgcaaacagaaaaggaaaagaacagggattactattctcatatcagataaaacagagattaaactaacaacactaaaaacaaaaaagaagaaagaaagaaaggaactacataatgataaagggttcaattcaaaaagaagatttaactatctagaacataaacacaccccacattgtagagtctagattcacaaaaccagtactctagacctatacaaagacttagccacacaataacagtgagggagatcaagaccccactgacagcattaaacagattgtcaaggcagaaaactaacaaagaaattctggacttaaactcaacacttgagcaactggatccaatatgcatctacagaatactccacccatgcaccacagaatatacattcttctcaactgcacagggaatatactccaagatttaccacacgctgagtcataaagcaagtctcagcaaatgaaaaaaaaaaaagaaatcacagcacccatattcttggaccccagtggaatgaaaatagaaagcaataccaataatatttctcaaaaccccatgattacatggaaattaaacagcttgctcctgagtgacttttaagtaaacaacaatatcaagccagaaacataaaaaattatttgaaataaatcaaaacagaaacacaacataaaaaatctctgggatgttgcaaaatcagtgttaagaagaacatttatagtgataaatgcctacctcaaaaagttagaaagatctcaaattaatgatctaacattatactagaggaagtagataaacaagaacaaactaatcccaaagctagaaggaaaataagacaactctaattagagttgaaccaaatgaaattgagacccaaaattccacacaaaggataaatgaaaccatagtttcatagttggttctttgacaggataaacaagatcaatagactgttagttagattaataaagagaagaaaagaaaaattcaagtaggcacaatcagaaatgacaaaagtggtgtaatgtcacagccgatcacacagaaatacaaaactccctcatagacaactatgaacatttctatgcacacatactagaaaatctagaggaaatggaaaaattcctggaaacacacaacctctcaagattgaatcgggaagaaattgaaacactgatgaaaccaatattgagttcaaaaagtgaatcagtaataagaaacctaacaaccaaaaaacagtaataataagccccagtccagatagattaacagctgagttctaccagaggtccaaagaagagctgatagtaattctattaaaactattccaaaaaatcaaggaggggtgattcctaactgattctatgaagccagcatcacctaatatctaaaccgggcaaagacacatacacacacacacacacacacacacacacacagagacagacacacacacacacacaatgaaactactggcccatgcctctgaagaacacagacacaaaaattctcaacaaaatacttacacgtcaaattcaacaacacatcaaatatttaatttacgatgatcaggtagggttaattcctgagattcaaggttgtttcatcatatttcaacatatacaaatcagtaaatgtgatccgatcacatgaacacaatttaaactaaaaccatatgatcacctcgagagacgcggaaaaagctttcaacataattcaacatcccttcatggtaaaatccctcaagaaactaggcatcagaggtacatatctcaaaataataaaagctatctacaacaaacccatagccagcatcatattgaatgatcagaactgcaagcattcctcttggaagtggatcaagacagagagatcttgtctcaccactcctattcaggacaacactggaagtgctagccagatgttaaactttttttttcatatatttgctggaggcaagaggaagaaacaaaagcatccaaatagcaaaaaaaaaagaaaaaaaaatcagactatctgccttcactggtgatatgattttatacctagaaaaccctaaagactctctcaataagttattagaactgatcaacaattttagcaaggtactaggatacaatcaatgaacaaaaatctgtaggagttctatacaccaataactaagagccaaatcaagaacacaattcaatttacaacagccacaaaagaagtaaaatacctaggcataaatctaaccaaggaggtaaaagatctctgcaggaagaactacaaaacactgctaaaaaaaaaaaaaagggaacccttgacaaaaataagcactgtggaaaggactccctattcaataaatggagcttggatagctggtgagctatatgcagaagaatgaaactggatacctaccttttactacatacaaaaattaactcaagatggcttaaatattttaatgtaagaactaaaactataagaatcctagaagaaaacctaggaaacactattctggacatcacctttggcaaaggatttatgattaagtcctcgaaagcaattgcaacaaaaatgatcattgataagttggacctaattaaactaaagagcttctgcacagcaaaagaaaccatcgacagagtgaacagataacctacagaacaggagagaatattcccaaaatacgcatccaacaaatgtcttatattcacaatctacaagtagcttaaagaattaaacaagcaaaaacaaaaaattccatcaaaaaatgagtaaaagacattaataggcacttctcaacagaaagggatacaagtagccaagaaatatatgaaaaaaatgcttaatatcactaatcatcagagaaatgcaagtcaaaaccactatgagatacctactcacaccagtcagggtggctattatttaaaagtaaaacaacaacagatgatgggaggctgcagagaaaatagaatacttatatactcttggtgggaatgtagattagttcagccacagtggaaatcagtttggagatttctcaaagaactaaaaatagaactaccatctgacccagcaatgccacccaaaagaaaataaattgactgaaaagacacaggcacttgtatgctcacagcagtactcttcatgatagcaaggacatggaatcaacctaggtgcccatcggtggtggagcatataaagaaaatgtggcacatatacactacggaatactacatagccctaaaaaaggaaattgtgtccttcttagcaacctggatacagctggaggccatcatcctaattgaattaacacagaaatagaacaacaaatattacatattctcacttataagtgagaactaaatggtgcatacatgtagacataaacttgggaacaaaagacactggggagtactagagggggctggctgagagggagcgtagcaaggctggaaaaaccaactgttgggtgctgtgctaactaccttggtgacaggattaattgtaccccaaacatcagcatcatgtgacatacccatataataaacgtgtacatgtaccctttgaatctaaataaaaacggaaaaataaagaatggcaaaattaaaagaaaaacaaacaatacattttgctaaatgaaataagtcagacacaaaaggacacatgctatatgattccacttatataaggtagctataacagtcaaattaatagagacagaaagttacatggtgggtgccaggagctgtgggctggtgtttggggagttagtgtttactgagtacggagtttcagtttgggaggatgagaaagttctggaaacagacggtgatgatgttgcacaaaaatgtgaatgtacttaatgccaaagatggttataatggtaagtatcgtgttccatatttttattacaactacaataataaaagatatgtaggaatttgccagatgaacaagatgaaaaagggcattgccatgaaataaacataatgaatctgaaaaaaataaaagcatctttgattgcaaaagagcaaattgcaaatatccaaagtaatccttgtaatacacgtgacattataaattttacgatgcagtgcctatgattcacgcacactgtacctgaaccagctgtgaaacattcatgaatcataaactcctgtatcatcttcagagcaaaaatgcatcctattttacaagaaatattcatcaaaaaagggaaagagaagtaaaaaccctgaaatttctagaacctttcaaagatatcagaaaaacaaatcaatacctctgacaggacctgttaattcagagggtcatgctgtaagacagcttgcatttaattcaaactgttttggaacaagatcaattctgtagtgagatcaaggcagcagaaatttttcctcagggctaaaaataataattccttgaggcccagacattaaattccatggcttcttgaaactattcaaaaatgagaagaatggataaagattaaaagaaaacacatgctgcaagctgacaaaacacctttttagacttacacccaattcgttcattagtcaaatgtgtggttttttttttcccttcaggtaactggaggtgtcaacattcaacttcttggtctgtttctcgtcattttctattttctcctgctatttgtctctgagctgttatacctgttattgcagtttccaacaagaaaaagccaggaaaaggaaagagaatcaaagcatcagagcgagtcacctcactgggaggtggaaccagaagttttaaagcagtagcaaaatttgtatgttctgggtgtcagtggacactttctgtataataattttattttacttttgttaagaatcatgaagcaaccacaaaaaattaaatcaaggcttatcaagtagatgtttgaaagagaaacaatgattcaccttataggtagatgtactttgctattgaagggattgtgggcaagtctaagcaaagctgaagggaataaggaaatttcattccttagagaagacagcatagaataatagtacagagagtgtagggtagaacagcttgcattctaatcccacatctgcaacaggattctctttgacataggaaaagttacttctgctttgttgggagtattaaaaatggagaagttttcaagtgcttagtgtagttcctggcttatgatagcatcaattaaaattaggtattgatgctattattattaatattgatctcttagccatctatatcttcagcatccaaagtgtcagtttgttctttaaattgcaattgacccttttttctcaatagaatagctagtaaaataataaagtggaatttcttggaatgtatccattctcctcttttacatttcatttttttattcattatttcaaatgcccagtaccttcttgttcaccctaaaatcttttatgagtttatgagttaacaggaaaacagattccttttagaaaattggaataaaaagaattaccattttttttttttttttgagaccgaatctcgctctgtggcccaggctggtgtgcagtggcatgatctcagctcactgcaagctccgcctcccaggtgcaactgattctcctgcctttgcctcccaagtatctgggattacaagcatgcaccaacacacccaggtaatttttgtatttttagtagagacagggattcaccatattggccagatgggtctgaaactcctgacctaaggtaatccaacccctcagcctctcaaacacttttttctacatttcaaactctttgcaatttacctgctatctcatttaatctcctcttccctacactgaagacaatcaacctccctcctattaaccaaccacttatcctgcctccttatgtaccttaaatacgaaagataagatagtccccattattttaataaatatttattgaatatattcttgacaagtaatcctgcttgtatttttagctagctaatgtgagatacatctttgacatggttaaatgtatgatcccttaattaatttaatataataaactaatgctacattataggggtataaacacttttaaaaatatattttctattttaaagttggctttatacttaacataaatataatggacactttgtttatttttgaatgattatcaatcattcaaaggtcagtacatctgacctttcacaaaaaaagtaaaaggtcaaatgtaaaaattgtaggttttgtggttcacatatagactctgcatattattctttaatttttgtttttggttccatatttttgtttgtttatatgtttcttacaaaccttttaaaatacaaaaaatattctatcttacttgtctctcaaaacataggccatttaacccaggaactgtatttggtcaatctgtgcttcactgtaaatgttctttgttattttaaaagcaatacggacatatttcaagtaaattattgttttcactaccactcattttcagatgtaagtccacaggttaacataaataagaaagtagcagccaaaaacaaaaaaaagagagaacagtaagaaaaacattttaagtcaaaggaaaattgccagcttttatcttctcctaaatcccaatccttcactcctaaaggaacacattaagtgcaaagggggtcatacttttattccattgcaaaaagggtcatacttttattccattccccatgtatacatttgttatccatttggcaaattgtggttgaatttctcttgggatgacctcgccagcagtaggtgaatggatcatttgattcaacactagttcgtaagtgattgttcttttcaatcaggcacacactcactgctgataactgcatattttgactatttgtagaagtgttaaaggaactaagaattttatcgtaaataagccatgttggaacaaatatcaaggccttgagaataatatactttatacctttgctcaacatataatgtaggaaaatatccaattaagagtctagaaatggagtgaggaagggccagctgagtattttgtttaatttttaattgttaactcttatagtaccttcataaagtttccaaatcttttcctttttcttgcttttgctgtaaatacaaaagtccaagcctgcattatattatactcagtttgaataaggaatatcagctccttaagaataaaatgaaacagttttattcttcccaagatcttttcaggcttttatattgatcatcttcatttctgctgtgtagctggcttcatcaatgatgtctcaatttatgtctataattgttattttgcaaaactgtctcattttaattaatatgatgccttactcattatttttaaattattttcttcattattttaaaactaattttatttctaaggactgggaacagggtgggtggatgtgataatctcacacatgttcttgtcttttttccttttattttccctctggtgctgggatagagaggatgaagaaagaaaaatgtattcgttagatgaattatctgtattgaggttgttctaggattactgtgctagaggaaggacccccaataaattccaccattaagaggctcaatatcaagcaacaatcctgtgatctagtggcactgtatggaattctaacgtatcttttagctaatgtccaggtggtagtctgtgttacatcttgatatgcatacctctcttcttcacatgcttcagtatcctttattttatttataattagaagcacaaactctgagatttacggatccaggcaggactgatctcacctacaatactgggcaagatcttcaaggggacagttgatgctttcttgccaactgcccactccaccaccacatttctctccaatgttctctcccttgttttagttgtactgactcaaatctaagcagctatttgattagagtattgaatggtgatcttccctgttttgtgtgaatttctttgggattttcttctctcaatccttgccagactttttttgtaataacactggactagcaacaatttcaacctcacctatttataaaataatgttatctagtactatttgagacctctcttacttggattttttggagtattgtactcagaatcaggaactttttgagataaaatctgagaaatgaataacttttgctcaattgtgctttattcaggttcttatctgtattctattctataatctccaagtgaggaaaatagtcaattcatatttctctaaagtgtttcttcataagagccttaaaataaattgtatatattttaaacattagtacatttaccccaatataacatcacaaaattaacctttggaaaatacagaactaatgtaatacaaaacattcccatccctccaaaaacagataaaataaaatataatagttctctacagcctaatctaaaagaatgtgatgtaatggatagagcactgatttattaatcaaagggagaaaaactaatgtggctcataaacctttccatttctgagtctcattcttttcattttcccgataataatgataataagatcgacctgtttgttagggtcaggttaatgaccaagtgaaatgatgcgttatacatatgtcaaagaaatatagcctcttaaaagaaagttaacgcagctgacattcagtaacatatctcggtttgtaagtaaaaaattagaaataaactcaaataaacgatcaatacatattatagtaaaaagtaataatttgaattaagataacttgttgaacactgatttatcaaactctattgaactaacccattttttaaatttatacttttgtttgtttgttattagaaaaacatttccctagatagaagctgctccactattctgaagggaagtagaaacgatgaaaagcagaactggagatgatccatgatggacatatagtgtgagtaagaaatatatattatttgttttaaatcactgagattttgagtttgtgtatgtgtccataatatgagctaactatccttaatgataccataagtaaagaatttaaagtaaataagatgtgcctgaccgcatattaagtgccacactaagtgttaattatagctccctggcggtaaacaggggactggttccagacttctgagtatataaaaaatccacacatactgaagtcccacagtgggtcttatggaaccctttgtatacaaaaggttggctctccaaataggcaggatttatattatatctctcaaaaaatctgcatataaatggatctgtgcatttcaaacttgggttgtgcaagggtcaactgtgttactattttatgggatgagacggcagagatgatacatggaaattttgtgtttaaaaaaggagaaatatgcaaatggtggtggggtgggccaaatggaatgtgagttacatgaaagggtaatttggaaggaaacaacgcttttgtgaagaaaagaaatacttgaatatttgagtataaaacatagttttatttagtacccttgcctcatctttagtatgataaaaatagataaaaaattcagacagacaaagagggaggaagctgcttgagtgaacatactctgttgatgtaaatactcgaggaaattagctctatattgggtggtgtgctgatgaatgcttaacaaaaaaactttgaagtgaaaggcactgatttgttgtatttgatgatttctgtggcataaatatgcccaccatagcaatgtttagctggtaacatgacatagctgcacagagtcaggaagagatgcacatgactggctctcacgatttcggcgcggtctggctccagcatttgactgtgacaagtttcactggccggtgagaacgctggaggaaaaaaatctacctataactgacccttattagcataacaggtttgagaaagcagagccctattttcctcaagtgaatgccatcaatacagccgtcaggcaaaactgcattcatgcactgaggaaaatcactgcttctcaaacaacttttggataccataaaaggcccgttcttaaaaggggaagtgggaggaggggaaacaagaattgttgcctgaaaagaaacgactttgatctccatcaaaacagattagtttgaagccaatttgctgctatcttcaaaactatatttcccctcaaattctgtcttccaaattgagcagtgcgtcagctgtaggtagtgctagagtgtgaaaaggatgaggatggaggcagccagggtacctccaatgcatcttgttattagaagacttttgaagagtaatttgacgggagcttttcaacttttaggtcactagtttaaatgtagtctcagttgatcatgaacaaaagtgggtggttagtggcctatgaaaagtaccttcatggtattacccttgttctttctaatagagactgccactacagttggcatcctttcttttccttctaccagaagcacaaagggtgaatagaaatgtcatttcaagtattttttcagcctttgtaccagagaaatttgaaatatgaaaaaggccaacttcttttcatctttaactcacaggtagaattattgaactataatatgtttcctagatcttcctggattttattaaaatgaaacctgagccactttacaagtaaaattatgtcttacttcatagaaagttaaattacataaaggcacatacttgacaaatatttaaatataaaatgtataatttcttgacctgaatcttacacatgtaaaatttattttgttttccttttctttctcttatttttttcttgcttcaataaatgagttcccatgaatgtaaagacaaagatcttattactccattaaatgaactatcttaatatttgattttttctattctttatcattacaatactttgacttttttttcctcctaaagagactgtaggttttattccctttcttttaattatttcatgaaaatcctccaaatttccatattactaatatctctaccttcatataattttgtttcaatattaaatgatcaattaaagcaaactttctctaagtacctggagaaaagcaacagaataaatattagagtagagacacaaagtagtacttggtaatgccaagaaaatttcagcagctatcagtaatcagtaggatataacagaaatagccctgttttagaagtgatgaaaactcaatcaactgattttaagcagcagttactttctatggggttagctttccacatctcaaaaataagattgatgtgttatttttgcatcattttcaatacaaacattctatgaaatcttcacttttatatcatccgaatttaagtgacagggtgttaatattcgaatgggatttaagcgagatgtagctgtgccttatgtcacgtcagctgatggtaaagattgatgctgggattttcctgggttagtcatgttaaaatctcccctaggctttaaggccagcttcatgaattctcatatcagcaacttctgcaattaccacataacaccagaagataaactctgttctctgaacattcatatagaaaatagtacgtcatcttatgattcttatgattggcatagcaaagtgaaaatatatcaacaccgtatttagcccaacttgaagctgcatattcagtcaaagatagagcttttcctggccaaagatactttggtcagaaatatataaacagtgaacaccaagctatcatcttgcaagtaacacatatgctcatgaatctctagctacaaataaaaatatcagctaaaactacccccttcttctaaaggaataaaaaccacagcaattacaagatttgcctatggccataaaatgaagtggggtttgtctcagaattagaatgcctaccatcagcctttgagtacaaagttaattcccctacacaagactgcatcaaaaataaatccagctggacaaaaggcatacaagacagaaaataatagtcagctgcagactctttggatccaaagtataaaatattcaagtatgtgtttccaatcccttcattctctcctgtaatgattgcagctaatccctgcctgccaaacgttagttcttcaattgtggcgatcaatagaatagattagctgtggaaaccctccatccatattacccttgctttcctttccagatggaattttcattcactagagtggaggcaagcatgtgaggtttctccctccatacacaaatataaactcattaaatgccaagcttgtcactttagaatttatacacacacacacacacacacaccaaggaacatacctgtagatttaataaaacagcaccaaccctcatggcttcactaatttcaaggctatacatcagctgtgggaagcgaggagggctttgattatttggtggaagcacttcaatatacacagtgcagatggagttcctgcagagaaagagaggaaaagaagatggttacgaatctgcatcacatttaatgttagactgcattgtttattcagttgttgggtttacaggagaaaaaatttccaaattttatgaaaaataatacaatcaaaatgaaaggatagaaaaaactaccaccaaagtataatggttttatgaaattatcttagtaaaagtaattgactccagtatctgtttttcctacttagattaatagtatgaattaaaatggaatagctatacaaataaagctaataaattaacttgccttgacttctgactttgtttttaatgcttctctaatagcaaaatcattctataaacatctggtaataaaagctgtccttggggcttttttgctgttaaaccagcagagggagtattgattacaataactcacaaaacaaattatgggctgcgttttatcagttctgttgctgacatcaatggcttaatgtaagtgcatgtgaggagtcaggatcataaagaatcctacgtaaaatagttgcaaacaaaactaaatacgttttaaaatcttctctaaaaagcaatatatgataagctaggaattagatttaataaagcccttataatgacaggagcttttcttgaaggacaagataccttatcattacaaggaaaaaaaattagcattgacatagtcaacttctttgatatctctgaactttgaatttgttttataaaacaaaaactgaagaagcatgttagtcaaggtttgtaaggtggaaacattagctgaaatatatcaatgagatctgaaaatacataaggttagccctctatcgtgaaaaaacatatatatgtatacatacacacacacacacacacatatatacacatatatacacacacatatacacacacacatacatataacattttgtacaaacataccaccactgcctaagatgtatgctttgaatttaacaaagtcatgatttagttcaaaacacatttgttataatttctatttggggatgagaatctttatttatttatttatttatttatttgagacggagagttgctctccagcccaggctggagtgcagtggcatgatctttgctcattgcaacccccacctcccgggttcaagtgattctcctgcctcagcctcccaagtagctgggattacaggcctgtgtcaaaatatctggctaatttttgtattttcagtggagatgggttgtgccatgttggccaggctggtctcgaactcctgacctcaggtgatccaccctcctcaacctcccaaagtgctgggataacaggtatgagcaccacacctggcctagaatctccttaaagtagtcccaaactctttataagatgcttcaattaaaagacatggtcaccaaaaatatttgtctgagtttattaactacaacattctacttttcaaaaccttttgaaagaaattcaggctgggcacggtggctcacacctgtaatcccagcactttgggaggccgaggcaggtggatcatgcggtcaggagatcgagaccatcctggctaacatggtgaaagccggtctctactaaaaatacaaaaaattagcttggcgtggttgcgggcgcctggggtcccagctacttgggaggctgaggcaggagaatggtgtgaacccaggaggccgagcttgcagtgagccaagattgcgccactgcactccagcctgggcaacagagcaagactccgtctcaaaaaaagaaaaaaaaaaaaaagaaattcagatcataggcactaaaatttcgttttatagcttgtcactttataatatacctaaattcaagttgtttctgagcatatcatcagtagatagataccaatagaatagtaagcataaaagctacagtgacttttaaaaatttcatggttgggtgcggtggctcatgcctgtaatcttagcacttttggaggccaaggtgagcgatcacaaggtcaggagttcaagaccagcatgaccaacatggagaaaccccatctcgactaaaaaacacaaaaattagccaggcatggtggcctgtaatcccagctactcaggagtctgaggcagaagggagaattgcttgaacccgggagacggaggttgtagtgacccgagatcgtgccattgcactccagcctgggtgacagggcgagactctgtctcaaaaaaaaaaaaaaatttcatgcttacatttatcatgatattgttctaaagtaatctcactttaaattaaaatattttaaactttcatagttaaaatatctgtattcatttctgcctctgattttatctatttagtatcaaaatttgccaatacagttaatcagattatatttcttaaatgggttcaaactgatgatgaaatgttgcttatatacttataattattaatgtaaacatgaaacaatgggaagttacaaaatgtattgtatactgcaaagattcccacttccgtgttgtgagaacaaaagaatcgtcattctgaggtagacctaacatccttccaggtggtgatctgactccagaagcagccccaagatgtaaaacattttccctgatattacccttgaagatcttggcttcttttagggtctgttgttgatcaagtttttaaaacattttatgaatctccttcttttctctgatagcacattctctatgcataacaagtcctacaacgttattggtaataaaagtaggtgagtgatgttgaacacagaatttgtaaccagatattcctgagttagaattttgacgctgccctcaatgatctagagcaaattatttctttcagcttcattatttccacataataagtgggaataataataacatctaaggtcagcataaagatgaaataagtttatatatttgtatatgtaagtacatgtatacatatatatgaaacatacttttataacttattttaataaattactcaaaataaggcttaaggtttcttattccactctatgaatagtgcaaacgatcttgcattttccttagctacatcctttataatactgtagatattttaattgaatcctttcacttggctaaattcctacaaaggcttgatactccttcacccctcctgagcatggggtatgttggtgttagaatttgagcatgttgtatcataatctttagggtaggatacaagaatctacaattttcacaaatttccaaagttctacttatagaaactagactttgaagaccactgcttcagaatctcatgaaaagtacaatatgtagactcacctgttttttttaaattacctcaggagaaaaactctacaaagtcacttaacgtcttcaataaccctggatccaagagacttcctcactgtttaacatttttttttttttgacctggaacatatctgtactgcagattcgaagctttctttcaaaagctaggccctttctgcttcgatattctttagatcttcagtttactggtcaagaatactttataaaggttttacaagaatatcagtgtcttaaagcttgtgaaagtatagttaaactacacttattatactttttgtatttctttattcctttccctttcattatcttcccattgtagagggttaaagtgagacaatgctacaataaggaccttaaactcgtatgagttacttggatacttgtcacagagtcgaaaactttaaaatgctgaaacaaagaggactctagtctcagacaaaacacagagacaaattttagcccaacatgaccgtctccttgatccgtccttactcctttgcttcctctgttcctttccacaataattcaaaagctagaattgctaattgtgttcccccacccccttggtcttgaatgttagttatttggaggagatcatatattaaggtcttgtatttttcatcttcaacatcctggcatgtccctataatgtgtttaaataaccaccaggcttcttgagggttactgccttttaaaatgctatctcctttttatccctgatgtcagcacagtgtcagagttagcttttctaaaattaaatacccatagtattaacaataaaataatagtatttatgctgtaataaatagtagtatttcaacagcatcatttaagcacttaataaaatagggcagtcactatataaataacactttacgcaagcattttgtattcatattttatcgctaaatgcataaaactgagcatctatataagaaaaattttatttttgtaatatagccagtatgatgcagataaatctccatttctaaaaacgaatctcataaagctttattatatttcacctggtaataaaggtcaaagtagcacaaaagaggtaatatatttcttatatactcttgaaacctacccaatagttccataaatataaatacatatatacttttttttgataaacatagaaattgacccttctggtcttaaagcttgaaacttaacatttgttttatctgagctccttcctcaggaaacaaccttcaggcctcccaaaaaaggtatcaaagaactgaaactcaccagatcaccacatccgatgagatgccagacccgtcattcattatgattgcttcctagcccctccctagttcctgttttcttacatattgttacatttcttccctgctatgtaaacactaactgtagtcagtcagtgagttggatttgagattgtcaccaatttccttagctgcagcaccagattaaaatcttcttctttgacaattgttgttcagtgattggctttttgtatgaccagctgcagaatctaaactgaacccctggtgttcctgtgacagattttcgttacctgaccaagaacacattgcttgtgtcttggctgccttgagccaagagtcttagaaggcctcctaagcagttgctcacccaattttcactggaggtgttttggtttttttctggccccacagcagctacccccaactacattcctgattgtctagtcagaacagcatttgaaatttgacatctgcacccggataggtgagtgtcaggttctttgtgggcctggacagcatgatcccctcctctcagtttgagaattttttaaagaaatttttatttgtcagttgaacaagcccaaatgactgaaagtgggaagcatcctgtgttagtatggacactttttgggggtttcagtatgaacactcttgggggcttgtttgtaattgtgaggtgtgtgtgtgtgtgagcaagtgtgtatcttttgtgggactagacagtgggattggctcctctcaatttgagaaattcctaaggaatttttctttgtgggttggtcaagcccaaccagtagaaagaagaagcaccccgactgtttcagtttggatgctcttagggctcgtttattgtttcagcagtaggattgtgttggcgattgtgtgtgtttgatatagtcatagcaaagtagaattcagtaagctaatattttctgaaacactgtttggctccaatattctttggaatctggagtttgctattgaatgggaaagcatgacagagttccatgtatccagacttttgtgctactgctctaaccatggtcaggcctggtcagtatgtgatgttctcttgtgatgctgtttggttccagtgttctttggagtctggggaggtttagcctttaaaaagcaaattgccatgaaaactattctacccaaaattttgattcacagccttcaatggattacctactgaggtcaagaaagtgtggctatgtaaaccagtgagtttctattgctatatcatggctataattttgaggtaaaatagattggatctttatgtgtgtttatatgcgtcttaatggtttatgtatgttcatgtattacgtttttttttgtctaccaaattggtttataaataaaagaatacacataagtaagcccaaagtatttttcaagttcaaatgagttaagtcaaccacaataagcaagctggctttaacatttttgataaaataaaaataaaaatgcctttagaattgtcagcatacatttttgctgagttttatatatgtctctgctagatatgattgaggtgtcatggtttggcatagaaggttatagaactataaacccagctaacataaaatgatcttggtttgtgtaccttctttgacaaatgagactaatgtaatgttgttagttgattcttgtgagttaatggcaaaaatacccatatctttaattttaagatttagttgaggacctgacattcatcagctattaaaaaaaaaagtaatgaacaaggaaaaagctaactttaaatgatggtgtctaatatttcagttttcagaagaaatctggataaactattaaaatgaaataatcaagtacttgtaaattgaataaatgttgtaggtacactttttgtgtaatataaaatttttaaattgtttttggtgctcattgggtgtctgggtcatttccaattaagaaaaagttatggggaaacatatttctaaaaattgtggaatggttctcatctgtaaaatgctaatatctgatagtcagctcagaatttcttgcttctcagatgttcactaaagttttgttcactaaaatttaaggctactaagaattctaaagaagatgtgtttttattgagaaaacgaatctgtttgtctagttcagaagttatctaaaggctaattaaaattatgggcttgaaatggttagttatgaaacaaggcagaagaaaaccaataagtagaagaaagagatgtgtaaaaagttatagatacgaaaatatattttaggaaggtgataatgaaaaaaataacaatttttataagaaaagattttgtatggtgaatgtttgtccaaaattaaaataactggttattaaaaaaagaacagaaagaaaatctaagacaaaacaaaagtccaagcatgtcatggatggtctgtgtaagtcatatgccatttttcctgtttctctgtgtgtctatcttcatgcctgtacaaagaaaatacaaagttgaaaaagcttagataataaaatatcctttaaaacttgataaaataggaatgctttggctaattagcattgttcatagttaaagctcatatcttaatgaatgtaaaatataaattattgtaaagaaatacattagcagtttggcaattttttaaatatagttaagcccaaagctggatgtaacatggagccaaatttcatagtatatttgctattctgcatcacatacctaaagtgaatttcttagttacagaaaatgtatagtggtactgctggacttaaagacagtaaatatcaaaaaactgaatcaggaataaaatatccatcaggttaattttttttggctctgggtaacactgtaaagccaaagttaattgagtagaagataaattgagggttggactactgtttatttctgcttttttttttttcttgagacagggtcttgctctgttgccaggatggagtgcagtggagtgatctcagctcactgcaacccctgcctcccgggttcaagtgattccccttcctcagcctcagtcctcagctgggactacaggtgctgccacctcacctggctaattttttgtattttagtagagatggggcttcaccatgttggtcatgatggtctcaatctcctgacctcgtgatccactctccgttgtcaccaggctggagtacagtggcacaatcttggctcactgcaacctccacctcccaggttcaagcaattcccctgcctcagcctcagtcctcagctgggactacaggcatgtgccacaacacctggctaattttttgtattttagtagagattgagtttcaccatgttggccatgatagtctcaatctcctgaactcgtgatcccctctcctctgcctccccaactgttgggattacaggcatgagccaccatgcctgacctatttttgcttctaattttcatttatttgctatttgttctacttaaatatacaaatatatacacatacacatatttatatgtatacatatacacataggtatacatatatgtatatatatttgtatacatatatataatatataaaactattgatgctttttagtttctaatggaaagcttttatttggttctatgaatagtcattttgttttctatgtatttccaacaattcaccatttgttctgtttattgaaagttcctaaactacctttgtcaagcttcaaaacattgatgaaggacagcagccatttaaatttgattggtttttcttacctctgagtatattgatagctatgataattttaaggttcttggcaaaaatcttataaaagacttatttttatgagttctaaacacaaatagtacattatatattttgtaatttggaaaagtagatgagaatagaagtgtttaaatgatgtttatttccaatgtaattcaattcaatcaataatttcagttggttcagatcctttcctttagtgaagaaaaactgtgatatgggttaaaagttttaatgttcaggaaagactgggctgtttttttaagaaaaattttattgattgggatttctctgaaactactttcattgtgtttaccactattaacattaagtgacactcaattgaattaggtagtaattgctttaaaaattgtgacactttgttgtaatttttgatccaaatccatttatctctgatgggcattcatgtggtacttgaaaacaaaatatgcacaagtgttgcactggtttgaagagtttggtgtgaaagttacttaatcagttgtaagtactgtatctagaagtaaatcttagaaatgtgtgatgatgctcttttaagtagctgaagagagattattatgtggttttcactttgtccttgctttgttgtatagtatttaagtgaaatgagattgcttatccttattctgaatttccaaagctgatatttgcatttgccatttttcaataatggaaaaaaaaacaacattagttgtcttgctttcaaaagtttgtcaaaggacctatcaaaactttgatgcttttggtcacagttctgtcactaaaatgctagcaattagacatatggaatgagtaacctaactactttaacaccgtggtcagaagtgctataagtagtatctgctaagctccaagccactgtgttttaatttgtgacattttagaataataggctttctgtagtataaatatcctattaactaatccttgtgctgttaagttacaggtctttgaatcctcagtctgaagaaagcactgacttctgttaaattttgagcattgataccagtcaaagcctcatcttcagacacaggagaaggtgacaatcaaaatgaactgctttcatgagacacagggccagaaattaaaactattcaatccctctagacccaggaactattgtggaaactgtaggtgtgtgagatggtgagggacaattttgagggacaaactcagttcagagtttctgtaaattaaacgttaatgtcaaaagcacaatgatgcaaggtcagtgtctgggcctatgtgtcagaataacagggttttcttggtgcattgatctgctctttaatagataatcgtaaaaggctataagaactttgtcaaactgattaaaattagatagatttgtttataaggttttattaaaattagatttaacattaataatataccatacaaagatacaattttgttttctcttttgaacaaaaatttcatgtaagaggaaactgcagggaaaaaaaggagaggggagagacagaataagttggcctcatgctatcttaagtattaggtcttattgcttaagaaacagagtctcctctctatcaaaaggtaaatgtttttgttttattattttggctaaataaatgaatattttatagtgacctgtgatcctattttgtgatatcgagtgtcttaaacctttgatactcgacagaatttccaacagcaaaatttcaagttctaaattcagtctttgtgaactcaaaccaacctttttggatattagttgccctgaagttcaagagagacatgtaaggcttattaggcttagttgttatgttagaattatgcaggagatattgtcaaatctgaggtggtgctaagtttcctttgggtgatatttatatggatgggttgttaaaatgtgtttgaggattatatgagattcctgtaattctgatatgtcttaatataagttgtcagtaataattatgattattatgttacattgttgtatgccacagaaataaccaaatttctttatctactgtgcctttaactatgactctcttaagacttttgtcatctacaattattgttttgctttgatccttctcaaaaagtgacttataatcagctacagtctagggattgcttctttggtgttcgtgaaaagaacttttcaatgcaggttactgataactttggagattgtgccattaggttagagaggaaaattccagggcactaattgaaaggctgatgtgttcataaagattgttaacccaacatgaagcagagcaataattgattgcatggactaaactaatgaaggactgaaataatttttgtggcttttatctttggaatattgctgatttttttgttttgtttttcagagtctggataattttttagatctacttataagctttaagttatgctttaagtatattaagtagagtatacttttgtaaacagaacttgaggcatattttttctctgcctattttctccggaattatattcttaattcatgtgtgttagtttgcatacatttaatgacaacttgttttcttgtataatgggacacaattggaggaagtggttattttcttagggctttgaactgaaatgggcttgggaaaggttccagaaaagccagtgtaggtcctatataaacaatgaaccttgttgcactttgggtggttaatcaggctaagtatatgggcctgaagcttcttttgcaagtagatttgtcctgctatgacttgcctttgttggaagttggggggctgaagagaaaatgctgtgtttcagaagaaaatgatactattagattagcctttgatttctgggtggccgtgaaatcacctgtagtatgacgctgcccacgatgcccctcctcagtattaagcagccagaaagactgacaaccagtttccccatgattgaaaattgataaatagaaaggggggactgaaaccgaccaaacagtcccatagatcactttttcgataaacatagaaattgacccttctggtcttaaagcttgaaacttttgtgaattgttttctgttttatgtgagttccttcctcagaaaaccacttgcagcctctcaaaaaagtattaaagaaatgaaacgcaccagatcaccatattcagataatgagatgctagacccctcattcatcatgattgctttcttgcccctccctagttcttgtttttttacacattgttacatttttttccctgctatatattcccataattttagttggtcgggaggatggacttgagactgatctcccatcgcctcagcggcagcacccaattaaagccttcttccttgcctataattgctgtgtcagtgattggctttctgcatggttagcagcaggacctagaccgaaaccttggtgttttcgtaataatcttataattgaaaaagatccttaaaacaatgtaatttaagtctcattttacaaaagaggattttaaaaatggaaaagatttgctgactgaatcaagattataacattaattagcaacagcagataaactaaaatacaaggcttctgaattcaaaatctgctttccatttctccctacgtcctacaagaacaaatatgtaaaataaactggagaatttttacttatctatgtgtgaatataaaacatttttggtttgtaataaaggatgttaccttacaggaagccataaattatttcaagtctgaggttcagactatgaagtcacaattttaaattattaatactgtgaatcaaacttcatctataacacttattgtaagaataacataaaatatgaataaagaagagggttggaaaatagacttaagatactttaagtttgggaatgatataattataaaaagacaactttttcatatgacaatagtaattagtagtaatgagataatgttgctagcttatagaggattgtattatcttattattattttctattatatatgtcaatatgtgctacaaggagtctatttgtaattctgcatttctagcttatttctaagatgaaggttacagatatttatattgctttttctggtagatttcagacagattaattactgtttttgttttcctttgtcttctaccaatattgtgctagaaaagctatgtttacagtttgatgttcacagattgtattctattatttttgaaatacatatagaaatctacaagagcaaaaacttcacattgaaaaccaatataggaggacagagaaaacttttctggagaagttacagggcagagttttaagatagaagatgtatttatatataaataccacagaacattaatagacagaggaaaactcacatgtcaatttacagaagattaaagaaaagaaatgtatgttttgtggaactaaagagaagggtgtaagtaaagcagtagtaagagttaaggtacagaggtgggactcatgggctatatctgttgatataaacttcatcttgacaatgaggctcagctggtaaagtttaagcagattagtgattataaccaaaagtgccaagtcattcacagttctttaacacactactttgttttgtttcttttgatcttcttgtttcctctgctgggatattccattatcattcttgcccaggtaaaactgcacttgtatttatctactgctatctgtctagatttacctgtgcctgcatctgaatcccatgtgggcagagatctcattttacttgttttatatttctagtacctccccaagagactaatatttgtgggaacttagacaatttttataaaaataaatgaataaataaatagcctcatcattttttactaatgataaacttagcatgtacatttgtcactagtaaaatgatcttttaaagagaaaattgtattttaaaaagaatgtataatcacaatgggaaaataattgtatttcaaagtaaattatttcatctcatattaattaaacatagccttgcattttatgaaaagaatgggaatttaaaacgtatgttagcccatgcatcagtcatttttatcgtaattttattagaagctatttggggagagagagtgtctcttattatctaattatcaaacagtagtgctttattcatgttaggatgaagtaaatatttacttaatttaattggataacgtaagtataagttaaccaatatacacgactaaagaatatcccaaaataacttaagtgttttttaaaagcttttggtttttatttcttctgtatgcttatcaaagtctcaaaaaaaagtaaaacaaaacactaaactatgtactattccttctctcactctctgaatctttagctggtttactaaattagaataacacagacatacgtatttcattcatattggacttattttcagtcaatattactacatttatggatgaaagctgtcaattttaaaataataatatagaaaactgtctaaattctgaagcctgctgtcattttttgatgttattatttagttagcttacatgccatggttgctggctgggtcgatctgtaaaaaaaatcactatatatatagtgtgtgtatacatatatatatagtgtatatatatagtgtatatatatataatgtatatatatagtgtatatatatataatgtatatatatagtgtatatatatataatgtatatatatagtgtatatataatgtgtatatatacaaatatataatatatatatttgttcataatctttaaatataatcttccttataaaagaagtctgaaagcaaagcctcataacttttcagttcattcatcaattcaatttgaaggattaactcctctccagaaaatagcaaatatgattatcctacagtgaacatgacattatctcagcaggtagaatggaagtatatggattttattctctgcaggtcccacttgatatttcaccaaacattctaaggtgagtttttagtatccaagacattatttaatgaaaataaatgtgaagctaggtcaactaaatttctgatgtcacagaaaagacgtgtatactcagaatctgaagatggcactttgttttctggcgtggaatacaattttacttaagtaaaaaacatttattgtattgataattatagacaatatattatccaggaaaatcaatgatatgtcttacaaatagaaactgagcaaaaagaggaatataagatctcattcattaaataatcaataaagtgatttaaaacacttcaaatgtaatatattggccacatatagatcagaccagatttatttagcacaacacaatcttcaatgaaaaatatgtatatataataccaacttgtggttggttttattttaatattcaagactaataaattaaaagtcttgaatattaaaagactttaataaaatcaaaataaaaaaacaaaaggtgactttgttcttataaatagcattattatcattgctactaaacaattatagttttcctccacaacagtaactacaaagattatagatatgaaacagtggaggaaaaagctttaaatctaacaactctgagttcaagttatggtcctactacttgtttactaggggagtggaagtgggaaaggggactgctgagccaagtcaattatcctatttcagcctcagatttctggtgtgcaaaactaaattatgcaaaagtcatgatgctattgttaatattagaaattatatatataaaggagctagcaaggtatctggtcctagtgtatgctcaataagtattatcaatcatctttaattcctcttcagaataacctagcacagatgaagctattatttaaaacgcactcaaaccttacttggctcttattgtagattctgtaactactcaatgtataaaagtattctatatatttcttctaagaaggagcccttagctgtttatcaggttcaggcatacagagtcctccctcagcatccatgtgggattggttccagagcccataaggatactaaaatctgcagataatcaaggccctgatagaaaatgagacagtatttgtatataatctatgcatattgtctcatacactttaaatcatctcgagattacttgtaatacatataaaatattaatgctaatagttgttatactgtagtttagagaataatgacaaaaaaagtctgcgcatgttcagtacagatgtaatgttctccccaaatattttcaattgttgcacttagttgaatctactgatgtggaagccgtggatatggagggccaagtgtatatttgctttttggatatattaagtttggccacatccaactaaatgtgtccaaaattaaattgatgtcctcacccaagccatgtgcacccctattgacatcaacatgacgtcaccttaagcaaaaccctgggaaatattttatcttatttttgacaaatctatttctctattcttcctaacatacccagttcaaaacattagcagtatttcctgtagactcttgtgcctctgctcccctaaaatctgcctcccacagagacaatcagatggattttacaaaaacatgttttctcacttgactttctaatttaaaagtctttccaagaattcctcctattgactagataagtctaagtttcttataaaagaaaattaaattttctgtggcatggccttttaattttccagccccaccttgaatcagtttatgccccagtaacactgactaataattatctataaacaagaagctatttcagacctttgaggctgtgcaaatagggtcacatacttctttttcatttggtcaacctcatcctcttattgtgggatgacttcttggtactccttcattatcgtaagttccccatcaataaccccagaaagcccagaatttaccttaatctcaaaattgctatgctaaactcaatttaatttatattctttatatactttactgtattttgggggctttcaaatgatggtactgtagttatctttgttttccagaatgtagtaaatggtagtatgtaataaatggtttgttgggctgaaaggaaacttttcctatcacagacacctgaaggaaatgaggccattgagaaatctgagaaaagatccatccaggctgagagaagatgaaaatcaagctcaaaagcatataggtagctatgatcctcagagatagagaggagactggtgccacaactggaatggactaagaaaagcagagttgagtaggagatgaaatgtataaactgttgacatgagggagtgtcctacctgtagtgatagctgacaaatttcactgagcccttttgaatttattttaatgatttgccttttactcagagtgaggtgtgaaagcactggaaagcttgagtaatggattgagatgttttccatgttaccaggatcacccaggctattgtgttgagaagagattgaagagagcacaggaagacttgtaattggaagaagttttcaacactctagactagagattgcagtggcttggactggaatgctaataaccaaagtggcagcagttgttgctttctgaatacatttttagagtagaacacagaggagttgctccaggttatgtgtggagttggggaggaagaggggcattgaggatgactctaagggtgtttggtcagagtgactgcaagatgggagacgccttaaacctcttattggatataaagtcaccaataagtttgacaggagtactgttgaaatgaatgtcaggcatgtaggaagtaaactcttccaagtgtgacttccagtatgtagatgacaataggatatgaggttagaaagaagaaaatttattgggaagagacctatcatctgtcgatgacagcaaggaggggtaatgggcgttataattattttttgacacgagattcaaaggaaaacaaactattgaggaggaggaaatctagtttaaaaatgtaaatgagaatctaatactccaccaaccgtatctctgtgattaatgatgatcacacaccctgcaaagtttagttacagtccatcaagtttcctacacctggtgtagtattgagttatctgacaagtttgatctcgtaagattcttgagacttccttttttttttgaactaatattagtaaactgtatcttttagaagaatcatccatttctgttttcaaattttgcatacatttaagcaaagttgtctctgaatcctactttttttctatttatatgtagtttcttcattagattttattgtatacagttttacttgttctttttttcttgattaggttagatagtattttatccaattaattatgtctttatttttgttgtttctttccagagaaccaaattcagtctcatttatttgttttatatatgtttataatacattcatgtctgatattatagttattaattattttgggggatttcttgtgtttttatttgtttcttttatgaagtattatgacaactatacataatcttgataggatttctcaaaaagaaaagtacagactaattttattaaataaaataacagcaagcatataatatcagcttatttcaagagaaaaaaattatgtcctaatagaatctacaccatggatgcaaaatagatccatctaagccatggatgcaaaataggagctatagtaagatcagtcattatatcatcaactcaagaagaaaagtcattactgtcctcatatatggtagctatttatttgatctgagaaaagcaccattactattttaaaaagtcaataaaatagaaatagatgagtatttttttaacatattaatagtttttaaaaccatagaccaatctaatggggaaacactgaggcagtctcattcaagtcacaaacgagacaagcatttttattggaagtataataggaaatgaaagtaaagaaagaaaatggaggccaggcgtcgtggctgatgccagtaatcccagcactttgggaggctgaagtgggaggatcagtagaggccaagagcttgagacgagcctgggcaacatagcaaaattctgattctacaaatttgtttttaattagctaggattggtggcctgaacctgtagtccccactactagtgaggctgaggtgggcagattgcatgagcccagagtttgaggcttccattagccgggattgtgccgctacactctagactgggagacagagttagacctgggctagggggaaaaaatgtaaaagaaaaaaagcctatttacaataaaaacaaaagatgtagaaatagatcaagtaagaaatgtacagaacttacataaaaagaaaaacaaaaagcctgctaaaaaacacaaaaaaatgcatggacaaatgcaaatgcaaaatgttcttggatagaaagattcaacatcaaacatatataatatattcctaagtaattaatatataaatctcttgtgttcctaataaaaacacagttaacaacaaaaacactgaactagcttatttaaagtcaaagagaaaacttaacagaaggagagggaacattttggagggaaaacagcattgaggtaagttagtagcaccagaggatagagcatactatgtaagcttaatcattaaaattgtgtggtaataggttataaaatataaataatagaattgaatagaacatttagatcaaaatcaaaacacataagaaaatatatgatataataaatgcaacatctcaaatttgttcatcattggatgaatatcacaatgtattgtgtggggaccacagagtatttgactggaaagaactatggctgcattaatacctcctactgtgtactaagatacatctcaaatacaataaagatttaaatatacaatatgaatccacataaacactagtagaaaacgtagaataactgtaatctgggcttaacataccaatataaaaaactgatatacttgcacatattcaaactgatgcatgttgagtgttaaatatttctccattgtcaataaaagaggataaatcgaaaagtttatcaataatagacttcttctacagttttatacttattaaggaatatgtttatcaataatagacttcttccatagttttatacttattaaggaatattacataactgtgaaaaaaataatctgaaggatttatctagtatctacatggagaggactccaggatacattcattgtgaatggaaaaaaaccccagcaaagtgaaggaatatattaatatttattcatattttcttggaatgatactgaaaatctggaaataaacaataaattaacaaaagggatttctcaggtgggagactagaaagatgcaattgtaatagcaggaaatcttttagcttgctgtgtgtgtgtgtgtgtgtgtctgtgtgcgagtctgtgtgtgtatacacatatttaaatacatgtattattttacataactattttaattacctatacactcagaagtgactttgaaaccctgagacattacatgccactgacacatctgttaatttctttgaagaaaagagcctttctctgtctgcagccttacttttccataataaatttgaaatatgcctctgatattgtcctcttcccaaaatttaaccaaatcagaatatgcatgcagttcctgagaatctggtctctctgattttctgatctaatttagatgtttataggataaaagaatacttgccgcgcttcttaaatttaattacagggttaaacgggcccgatgaaaagactgcattggttctaatataaattaccttcgctctgcaggaggagcattatccgctgcttggaccgtgagtgcgtaagtccgcccgactatcatttccacccctggagcgatggtgataagccctgttgttttattgatgatgaagtctccctgagccccaacaaggatttcatatgtgatctccccatttgacccttcgtctgcgtcgactgcagtgagctggaattgaaaatcacaacataaatcctcttgggtctcaacttttcaccaccatgtcgttttttcccccaacaaaagaagcttgctttcaaagaaaaaaacacaggaaagtttccttgacatatatactgttttttgttttttgtttttttaactgaggctactgtgtcctgttacaatactaaagcaatcacaaaaataagagtgattttgttttttgtgagagtgattaagaaataaactttggatcttgaaggcttatctttattttaatttaataaagggaaaaagaggaaagccctaacagaaaatctaatatccctataggaaatttatttttcctgtcttgccttgcattcttgacacataaactcatattaaaacagactgaacctggaaaaaatgaaataggcatagtcggcctttgttactcccaaccttccttttactctcatttttccttccataatgttctcctccctgtctcccagacactctcatctttgtgtcctttttgtttacaattgctctaggaaaggttattaacttgcacaccctgatttataaaggactgataagtcgtagagtattaatgtgtcaacaatcaaacaaatgcatctcccattgtagaatatcaagggtaacatagcccaagaaatgtttctttggggaaagaaaatctattcggagcccttgaaattaagcatgtaaacatctgtatagccaatttacatatatctataatcattttgaaggaactggtatctaaaagactttatttgggatattatatgaaaagataacaatgattaacttcatcaagcaacattaaagcaacagtgatttattatattaaaagtggctccttgacttgctgataaatataaattaaaggggaaaaagaatataaagggattctagcagaaatcttatagtaagcattttacatacatcaatagtattttctgtattcatcatacaaaaagtgaagaatgaaagaaagtggtctcaatttacacatgagggaatataattaaaagttttctgtggaataaagaaaacacatgtaattgtagtaaattaacctacctgtagaaatgttttatttacttatatttatattttcaatacattacttctaaaaatagtagtttttatagtttgcagactcctttgaaaatacagtaaagatgctggtataccttccttgatcaaatgtaaacatacacatttaccttgaaacttgaattcaatttcagaaacatcatattaactaatttcccattcaaaagttcatgtttaatatcctcaataaatgtaaacaaagtactttatacactgtactgtgctgaaggggttatattatgcatattctattttttattatatgtcatgcttagagtgataatgtccatagacatagcagcaaaaaataattgagaatgaaaaaggaaatgacattaatgcaactaagtcctgagactggctatttgggggtggacagatgtggttgctggaaggaaaggcattttatgacatgattctgcgacttgtataagcctgacagacatattcctaaaggcaaaggagaaacatttgcagaaacagtcaaaatgaatggcatatatttatagagagctattcaagccagacaaactaattctgttttgtgtatggataaaattagaaaattagaggatggggataacagaggagatatcaattttgattatacttaaatcacttaaaatgtctcaggaaatcttaattaaaatttagcacaaattggattcaatattaacattcttcctgggacttaaattggctaaaggaatgtaatgataaatggcaatgcatcaagttaagaaaaggtgttaaggagtgtgcttcagggatgtcagcattatagctggtcttatttaacattttcataaatgatgttggaagggaggataagctggatgataattacattgaagaaggtacccacctgggagatgctagaaataccaaatagtactgcaaaacacaggagacagaaacacccactaaattgcagagatagtcaaccacagttgagctaaggtattcagggaacacaattagctctgcagaaattattaggaggtagaaagcttaacaagtacacaaaataaggattctatgtttaagttacctagataacactatttttcagtcttttactactaaataataaaataatgggttatgagtcaatataatttgtttgcatgtatgctaacaaagatattttaaggaaattaatcgtagtccaccgtcagaaaaataagctgagacactgattctgaatacccaaatcataatagtgtcttccatgtaagatcccgaaaactcaagacctttttttttttaaacctcaacattagcaggagaattgcttgaacctgagaggcagaggttgcagtgacctgagatcatgccactgcactccagcctggcaacagagtgagactcttaaaaaaaaaaaaaaaaaaaatccaaaacctcaacgacattacacagtagatgtccccttctgaagtctattagatgatgttgaatggagttgtagttgctaattttggagctaacctatggcaagaatttaattcaattatagttcaatgactctgtgaccagtagatagtgtctatgagatggaaatatatgaagctcatttctaatttagcagggaaatctgcttcctaaatgaaaagggcatttatttacatggggaggccaatattttgcttacaagtttcagatgaaagtaaaaacaatactataactttaaagtgtttattgaaacattgtgatatctaaaaggtaagaaattgtgagctatttgttttttttatttcttttcgatgatgttttatagttctattcaggaactttagccctaccctttcataattccttcctctcagtgtttcaacatgtgcatattccaaatgtccccatctgtattagtctgttttcatgctgcttataaagacatacctgagactgggtaatttacaaagggaaggtttattggaatgccacgtggaattccacgtgggtagggaagcctcataatcatggcagaaggtgaaaggtgcatcttatgtggcggcagacaagagaagagagcttgtgcagggaagctcccctttttaaaaccatcagatctcatgagacttgctcactatcacaagaacagcacaggaaagacttgccccaatgattcaattacctcccactgggtcctcccacaacacgtgggaattcaagatgagatctgagtgggaatacatccaaaccatatcattccaaccctggcccctcccaaatctaatgttctcacatttcaaaaccaatcatgctttctcaacagtcttccaaagtcttaactcatttcagcattaactcaaaagtccacagtcaaaagtcccttccacctacgagcctgtcaaatcaaaagcaagttagttacttcctacatacaatggagatacaggcattgggtaaatacagcctttccaaatgggaggaactggccaaaacaaaggggctacaggccccaagcaagtccgaaatccagtggggcagtcaaatattaaagctccaaaatgatctcttttgacttcatgtctcacatccaggtcatgctgatgtaagaggtgggtttccatgctcataggcagctctgtccctttggctttgcaggggacagcctcccccccaactttgtttatgggctggcattgagtgtctgtagcttttgcaggtgcatagtacaagctgtaggtggatctaccattctgggctctggaggacagtggcactcttctcacagctccactggtcagtgccccagtagggactctgtgtgagggctctgactctgcatttcccttctgcactgccctagcagaggttctccaggagggccctgcccctcagcaaacttttgtctgggcaaccaggtgtttccatacatcctctgaaatctaggcagaggttcccaaacctcaattcttgacttctgtgcacctgcaggctcaacaccatgtggaaactgctgaggcttggagcttgaaacctctgaagccacagcctgagctctatgttggaccctttcagccatggctggagtggctgggacacaggacaccaagtccctaggctgcacacagaacagggaccctgggcctgcccatgaaacaattttttcctcataggcctctgggcctgtgatgagagaggctgctgtgaagacctctgacatgccctggagatattttccccattgtcttggggattaacattcagcttcttgttacttatgcaaatttttgcaggtggctttaacttctccttagaaaatgggattttcttttatattgtgttgtcaggctgcaaattttccaaacttttatgttctgtttccattataaaactgaatgcacttaacagcacccaagacacctcatgaatgttttgctgctaagaaatttattccgccaggtatcccaaatcatctctctcaagttcaaagttccacaaatctctagagcaggggcaaaatgccaccagtgtctttgctaaaacataacaagattcacctttgctccagttcccaagaagttcctcatctccctctgagaccacctcaggctggactttattgtccacatcactatcagcattttggacaaagccatttgacaagtctctaggaagttccaaattttcccacatcttcctgtctttttctaacactccagactgctccaacctctgcctgttactcagttctaaaattgcttccacattttcaggtatgttttcagcatcaccccactctactggtatcaatttactgtattagttaattttcacattgctgatatagacatacccgagactgggcaatttacaaaagaaaacaggtattgaaattacagttctatatggcggggaggtctcacaatcatggcagaaggtggtagcagataagagaggagagcttgcgcagggaaacttccatttttaaagctatcagattgtgggagacttattcactatcatgagaacagcaagggaaaatcttgcccccatgattcaattacctcccaccagatccctcccacaatacttgggaattcaaaatgagatttgggtggggacatagccaaaccatatcaccatcaatcacccatgtgaccacaaaataatctaagttgctcctaatgtttccttttaaattttggctgcagtttactactctctttaattgctctttcctggttctgataaaaaaaatacagcttgatataaaaggacaaatataaagatgattgaattgtgcataagctgaacaaaaacattcaaattggagtctcaaaaatgacacagaaagccacagttgatataaaccatatgcaagaatataaattgtaatgcaagagtgtaaacacggtattttatatgaataaatatattttttattagaagtgaattatgggccggaagctgtggctcacgcttgtaattccagcactttgggaggctgaggtgggcagatcacgaggtcaggagtttgaaatcatcctggctaacacggtgaaaccccatctctactaaaaatacaaaaatattagccaggcgtggtggcgagcacatgtagtcccagtgtttttgggaggctgaggcaggagaatggcatgaacccaggatgtgaagcttgcagtgagccgagattgtgccactgcactccagcctgggtgacagagtgagagtctgtctcaaaaaaaaaaaaaaagtgaattatggcttaattgataatgcatgaatgtgttgatcatttgatgtttttgcctcttgggcatccttggctcttgcttccagtaaaagtcccttattttcctttggggagcaattggcaaaaaaacatgtcaagttattcaagttggtatagtcaaggtgactcctagaactactgtaaaagagtgtttttttcttcctctagggctaaactggtaaatttatatctggtgtttctgctggctttccagtcttcattggatgtacctaagactgagacccatacagaagaagacatgtcaagaaataagcagaaaatatcgctcatgacatggtttctgcttatgcctgaaaccaaattcaccactttctgatagattaaaaattacatattttaaatgctaatttattttgaaattatgtctttcaaccgtaagaaccctaaatatataaaatagttttgatgcttaactactcttcttggtttgctttttgattatttttctaggattattgtgcttcgagattttggtttgagataccatgtaatcattaatacaataatgtaatatataattattcattacaataggcaaagatattgcttgaaagtggtagaattgtccctgtatagaaataatattgaattactcaataagtaaaaaaatacagataaattagctggtaaatatttccatcaagagaggacagactcgatttcagggaaatatttaaatgagtattgctttgttttttcttcttcataatttcatggatagaggattcattcttacatagatatgagcaacctcagcatacaatttttttcattattaagatgagaactttcacattttaacttaaaggaagcactttcatagcttctctttgatatatatgaattgccagaatcactactcctgtgctttgggaccattgttatgtaaaataagggtaccaccacaggtaatctaataacagagatagcttctaagtgactcatgggcagggagcatagatgtcctggagatgctggacaaaaggatgattcatgccccccccaacaagctggggacagagtaggacacctcaagatttcatcacactactgaaaatggcacaaaatttaaaactttggaattgttgatttctagaattttccatttaatgttctcagaatatagttgaccaaaagtaatagaaaccatggaaagcaaaactgaggacaagggaagaatactgtaaaaataaacatgaactgagagatttacctcacagcatatgtaaaattaactcaaaatgcatcacagacctaaaggtgaaagctacactatgaatactaggagaagataatataggagaaaatctttgtgaatttggttggcaaattttcttaaatatgacagtaaaagtatgatacaataaaaaataaacttcctaaaaattaaaagctttttctctaccaaaaacataagaacatgatacataaaatacagattatgtatttgcaaaatatttgcagatcatatatctgataaaggacttgtatttataatttatagagaatacttaccagtcagtactaagaaaacaaacacaaattttttaaatgagtgaaagatttgaatagatatttcaccaaagaagatcaataaatggctaataagcacatggaagtatctcaaattaatttgtcattaagggaacacaaaatcacaatgagatactaataagcatctgtataatggctttaacaaatgaactgacaatactatcagagaggatgtagtgggtggtaaaatggtacaagccactgttattaaaaagcagtttgacagtttatttaaaaagtatatatttaccatgtaatctagcacttttcgtaagatatctatatataacaaacagaaaaataaacatatatgtgtatatatatgtgtgtgtatatatatttacatttccaaaaagtgacttatatagaatattcacagtcacattaaactggaaacaactgaaatgcccatcaactggtaaacagataagcagaatgtgttttcacaagatggattctattaagtaactcaaagaaacagatatatagcattgattcatgccacagcatagatgagctacataaacattatgctatttaaaaagccaggtaaaataaaagtaaaagatacatactatgggactccatattttttaattcctagacaaggaaaacttttagaggcagaaaccaaaacagggggtgtctacagctgaaaatgggagtgagcattgactacaagtggtcatgagtaaagttttggggtgatggaaattttgggggtgaaagaaatgtatagaactagattgtggtcattgttgcacaactgtctaaatttactaaaaccagcccaactctttcatggaactgatgtttactggtctttgaataaacacagaaattgaccccccacccccaccccaccataccctgtcttgaagcttgaaacttacatttgtctcatgggagtttcttcctcaggacactaaccctcaaccctcctagaaaccaaggaactgaaactcaccagataactgtatccagaaaatgagatgccagacctctcatccatggattatgattccagtttaccaattcctcttccttaccctaccctaatatttgtttttgcacaagtattttttccctgctatataaacccctaattttaatcatttggggagatggatttgagactttatctcccattctcctcagctgcagcacctgattaaagttttcttctctggcaatatttgttgtctcactgattggcattttgtgaagcaagcagcaggacctagatgaaacccttgatgttttggtaatatacatacatgaggacatgtaaattataccttaataaagttatcgaaaataacaaagataattccacccacacatctgacctttttaatgatatttatccatttttttctgctacattatagaatgcccttcaggctacttgttcatgtattgtttcatcatttgagtaactttcttccttcttcctgccttcttatgcacctcacaaagtttagatcttgattatttgtttctttctttctcttttaaaccactgtatgttcctctgccttcagagactttactatcaactccatgaactccatgctacctttgtaaaactacttcttcctcctatgaatggacaggtatgaaagctctggcaagcaaagaaaagccagacccatggaagaaaagcagaatgtaatcagctaatccaactatgaaaggctgtctgtgttgagaaaagtaatcagtagaagagaaggtgaaattgtggaatatagaatggagagcacacaaacaaagatttcaagataagataccttcatattttcctctgagagaacattttatagcaagagtataatcttcttagcagctcccttcagatgtggtaatgattaatggccaatgctggagaattgcacagatttggcagaaatcaaggtacaagatatacttgagaactctactgggatcatttggggttaatgtctccttatgacatgccagaatatgagataggattgtatcacttgggcctttttcgttggttatatttatcctaattttacatttgaagccttgagttaaattctaactttgaccttatctgatatgcagtggctggcagccatagcttatacatgtatagatatgtataaaaatgacatcacttaaggcattcttcggtggtttcctagtatgacagagtcgatttttcttttttgcctcaccagatgtgtttaagtgtgggatgaaatataaacaaacgtttatggaatcagtattgtaaacaagaaggtgaacagtaaagttatatggtgaccccatatcctgatgatttgttcctagaaattctcaagggcaattataaggatccttttgcacactcaggttgaacttcacctagaagtagaatatgcctaatctacaagcttctgggagaaacaatacttctgtatgcacacaatatacttgaatcgtattcatatcatatatacttagaggaaatgtatcagtctattttcacactgctataaggaactaactcagactgggtaatttatgaagaaacgagttttaattgactcacagttccacaggcttaacaggaagcatgactgggaggcctcaggaaacttacaatcattacagaaggcaaaggagaaggaagcaccttgttcacatggcagcaggagagagagagagagcgagaggagaagtgccatatacttttaaaccatcagctctcatgagaagtcactcactatcatgagaatagcatgggagaaatttgcctccataatccaattaccttccactaggcccctactccaatactaaggttcacaactcaaggtgagatttgggtggggacacagagccaaaccaaaccgaggaacaatccttgagtcaccttaatcaacactggacataaagaactaagagggatttgaagttcaataaattagtttactgaatcaagtagagatggcttttaggcaaacatattaacctaaataagcagagtagggaacattctttttcaataacttggcattactcaggaatgattacagagtaatcaatgattactgaaataacaattataataaattctgatgtatttaaatggttctagttggctatactagaagatcaagtcaggagggacatatctctgggaactacggacaatctaaactataccaagatgtcatttgtaagtatgggcattatcaatcttctattacagtcatatttctatgaactaggaaacaaacatcttcttcatggtacctttggcgaagtttggacagactaagaatcaatgcattgctttattaaagaaaagtgactggtgtgctgcattcatatgcagaagctttcgctagtgaaagtttattcctaggggatggtttatagttatgctatcagaccagatgcagaattgtcggagaaagagtatctaatgactactctggtaatgtaaaatgtatgatatgtaggaaaagtctattttttgctaggaaagttgagaaaataatttggaaatattaaagtgtattgtgttaaatatttcatctctctgcctcagctctatcgtgtgataagggatttttaaattcatttatgtagttagataaaaataaaatctgagtgcatactgatctctaggacagaaagattatttggatgggcaacataaaacttacaactaggtaatccttatgtagaaggatttgccagagaaagaattgaatttacgtgtgtaaactaatatacccagttgaatgtatcaacacttataaaaaggcagaagtaatagaggataagggggaaaaattgtctttcaaatgttaaagaaatatcagaacagttaagtgaatctatctatggttgttaatttgctttgtagagggaattccaacttcttagtgtatgaaatatgctctggtgatagccagtgttttaacatctatttttaatgcactagatattatagaagttagtgtaacaaaaattttaagaagattcctcagaaatgtgtagcaagtgggtaacacataatgagtgcagatgacttagaagtcataagatattatatctaaagttacaagacttctactatgctattgccatagaagctatattgttgcctgcctggtatccttaattaaagctaaatcaacttggagctgtgtaaggtctactgggtctctccaggttggcattcagtctgaacctaaggctgctgctcattaaactatcactggaaattcactattcagtgtgatttctgatggaaaaatgatataatgggtttgcttttatgtttgttgatttcttcatgtgtcaataacattcaggaagttcttcaataactcctgctggccaagcaaattggggattgcaaatgtatttattttcagatttattctctgtggccttaatgtgaacaagtgatgctttaaagccaaaaagcataacaggctcccagttttcccccttctcttacgcatatcctagaataatccaagatgatgggcacctcagtagggtaggtggctggcaaatttatcactttggttgtataatttggaaaaagatattgataacattaataataacatgatcattaaatacttatatgaataattgtcaccgaagatgaatctcccatctatgcatttttcttcccaaaaaaaggcaagaaataaaacaacaagaagatgactttaaagcatttcttttcacagcctgactatttaaagggcttgtttcttttctgcagcaacttcatgatccttttgtaaaggttcattggttctaattactcaaactctgagactggaaactggaaccttaagtgctctaatgctatcaaattctctcatgcccaacttacactctcaaaaaaagatttcctcaaagttggcttccattaatttccatctcattagctttaacccatcgatttaaggacccagtctttcatacttcttcaagaaatctcacgttgtatacaatgccaaatctaaactactctacatgcaaggtagccatcttaaattaatttataaataattggatccatttattcagaccttaatttgtaccaaatgtctgactccgaaaaatgaagagtggaaaagaaacagaaacaataacttctgtcaaacagaaggtgctctaggaaaggagatgagagagaaacctatctttaaatgaaatgctgttacagaaacataaaaatactttacaaaagtacagaaaagcctgtcatgacaaaggggctgggagaataaaccaacatatatttgacttagtaaaagaaaagcaaatctttgagcattcagttcctcttctctccaatgccagttaaatttgtatctttaatgcctcatgaaattactatgcctttggccgtatcatttcatcttcaacatcatattatcttcacttgcctatctgagtactctaacagatcatcatccccactcacttttgatgaattctcgttagtgctcttagtctttctcatcaaatttaacaactcaataattgtgatgttttctgattatttcactgtgaagaaggattatttcttgcaaaatatagtcaactccttgaggattagggctgtgccttactcgttctacgtatttttcagagcacttagtttagtacgaatcacctaaaaatctgtgtagattaaattataatctagccaagaaagtaatacaacatgtagcatacatatattaggacttgcacaatagtgcttttgtttgtttgtttgtttcctttgccaaactggatgagcaagtttactagggttttaagaaatccctactgctctatttaaatgtttgttttttcccctaagatctcctgtatttgaaatatctcaatacccaactatttttattttactcagatgactatgcttggacattataactgtcaggcctctgagcccaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctcgctcatcctggctcaaaaagcacctccactgagcaccttgcgaaccccactcctgcccgccagagaacaaaccccctttgactgtaattttcctttacctatccaaatcctataaaacggcctcacccttatctcccttcgctgactctcttttcggactcagcccgcctgcacctgggtgaaataaacagccatgttgctcacacaaagcctgtttgatggtctcttcacatggacgcgcatgaaatttggtgccgtgactcggatcgggggacctcccttgggagatcaatcccctgtcctcctgttctttgctccctgagaaagatccacctatgacctcaggtcctcagaccgaccagcccaaggaacatctcaccaatttcaaatcaggtaagcggcctcttcttactctcttctccaacctctctcactgtccctcaaccactttctcctttccactcttcaatctctcccttctcttaatttcaattcctttcattttctgggagagacaaaggagacacattttatccgtggacccaaaactccggcgccggtcacggacagggaaggcagccttcccttggtgtttaatcattgcagggacgcctgattatacacccacgtttcaagggtgtcagaccacacagggacgcctgccttggtccttcacccttagcggcaagtcctgcttttctggggaaggggcaagtacctcaaccccttctctccttgtctctaacccttctctgcttttctgggagaggggcaagtacccctcaacccctcctctttcacccttagcagcaagtcccgcttttctacagggcaagaacccccaatctcttatttccgcaccccaacctcttatctctgcgccccaatcccttatttccgcaccccaacctcgtatctctgtgccccaatcccttatttccatgccccaaccccttatttccgtgccccgaccccttatttctgtgccccatcccttatttctgtgccccgacctcttatctctgtgccccaaccccttttcccacttttctggaaggtaagaacccccgaaccccttccctctgtttccctactctctcttttctctaggcttgcttccttgactataggcaaccttccaccctccattcctccttctactcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccaatgcaactcgtcccaaatcttccttctttccctcccgcctgtcccctcagtaccaaccccaagcatcgctgagtctttctaatcttccttttctacagacccatctgacctctcccttcctccccaggctgctcctcgccaggccgagctaggtcccaattcttcctcagcctctgctcctccaccctataatctttttatcgcctcccctcctcacacctggtcgggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatccagcccagttcatgacgtgtttggcagcaaccctgagacactttacagccctagaccctaaaaggtcaaaaggccgtcttattctcaaaatacattttattacccaatctgctcctgacattaaataaaactccaaaaattaaattccggccctcaaaccccacaacaggatttaattaacctcgccttcaaggtgtacaataatagaaaaatgttgcaattccttgcctccactgtgagacaaaccccagccacatctccagcacaaaagaacttccaaatgcctgaaccgcagcggccaggcgttcctccagaacctcctcccacaggagcttgctacacatgcaggaaatctggccactgggccaaggaatgcctgcagcccgggattcctcctaagccgcgtcccatctgtgtgggaccccactgaaaatcggactgttcaactcacctggcagccactcccagagcccctggaactctggcccaaggctgactgactccttcccagatcttctcggcttagcggctgaagactgacactgcttgatcgcctcggaagccccctagacaatcacggacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctctgaaaactccccaactctgttgccaacttagaccatactcttttaagcactcctttttagttatccccacctgcccagttcccttattaggctgtgacactttaactaaattatctgcttccctgactattcctggactacagctatatctcattgccgcccttcttcccaatccaaagcctcctttgcatactcctcttgtatccccccaccttaacctacaagtataagatacctctactccctccttggcgaccaatcatgcaccccttaccatctcattaaaacctaatcacccttaccccactcaacgccgacatcccatcccgcagcacgctttaaaaagattaaagcctgttatcacttgcctgctacagcatggccttttaaagcctataaactctccttacaattcccccatttcacctgtcctaaaaccagataagccttacaagttagttcagaatctgcgccttatcaaccaaattgttttgcctatccaccccgtgctgccaaacccatatactctcctatcctcagtacctgcctctataacccattattctgttctagatctcaaacatgctttctttactattcctttgcacccttaatcccagcctctcttcgctttcacttggactgaccctgacacccatcaagctcagcaaattacctaggctgtactgccacaaagcttcacaggcagcccccattacttcaatcaagcccaaatttcttcctcatctgttacctatctcagcataattctcataaaaacacacgtgctctccctgccaatcgtgtccgactgatctctcaaaccacagcaacttctacaaaacaacaactcctttctttcctaggcatggttagtgtggtcagaattcttacacaagagccaggaccacaccctgtagcctttctgcccaaacaacttgaccttactgttttagtctagccctcatgtctgcgtgcagtggctgccactgcattaatacttttagaggccctcaaaatcacaaactatgctcaactcactctctacagttctcataacttccaaaacctattttcttcctcatacctgatgcatatactttctgcttcccagctccttcagctatactcactctttgttgagtctcccacaattaccgtcgttcttgacccagacttcaatccggcctcccacattattcctgataccacacctgacccccatgactgtatccctctgatccacctgacattcaccccatttccccaaatttccttctttcctgttcctcaccctgatcacgcttgatttattgatggcggttccaccaggcctaatccccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagttcgaggatttgccccacccaggactggcaaattagctttactcaacatgccctgagtcagataactaaaatacctcttagtctaggtagatactttcactggataggtagaggcctttcctacagggtctgagaaggccaccgcaggcatttcttcccttctgtcagacataattcctcagtttagccttcccacctcaatacagtctgataacggacgagcctttattagtcaaatcagccaagcagtttttcaggctcttaatattcagtgaaacctttatatcccttacggtcctccgtcttcaagaaaagtagaatggactaaaggtcttttaaaaatacacctcaccaagctcagccaccaacttaaaaaggactggacaatacttttaccactttcccttctcagaattcaggcctgtcctcagaatgctacaggggtacagcccatttgagcggtatagatgctcctttttattaagccccagtctcattccagacaccagagcaacttaagactgtgccccccaaaaaacttgtcatccctactatcttctgtctagtcatactcctattcaccgttctcaactactcgtacatgccctgctcttgtttacactgccggtttacactgtttttccaagccatcacagctgatatctcctggtgctatccccaaactgccactcttaactcttgaagtaaataaataatctttgctggcaggactatgctgaatctccttaggcactctctaatcagatatcctgagttgtcccaattcttagaccttttatacctgtttttctccttctgttattccatttagtttctcaattcatccaaaaccgtatccaggccatcaccaatcattctatatgacaaatgtttcttctaacatccccacaatatcaccccttaccacaaggcctcccttcagcttaatctctcccagtctaggttcccacgccgcccctaatcctgcttgaagcagccctgagaaacatcgcccattctctctccataccaccccccaaaaattttcgccgccccaacacttcaacactattttgttttatttttcttattaatataagaagccaggaatgtcaggcctctgagctcaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgactttaccttgtgaaagtccttttcctggctcatcctggctcagaaacacccccactgagcaccttgcgacccccgactcctgcccgccagagaacaaaccccctttgaatgtaattttcctttacctacccaaatcctataaaacggccccacccttatctcccttagctgactctcttttcggactcagcccgcctgcacccgggtgaaataaacagccatgttgctcacacaaagcctgtttggtggtctcttcacgcgcatgaaaataacaaaatttactaccagtgaaagctgaaaagaaaatgagctcttttttggaaacaataggtgaataaaagctaaaattgatcaaagaaatgtttcatttattggacatatactaaagaaaatagtataaaatatattgtacattttgtttcttctagagcaatatcatatttcaagtcaaatatctagtaaaccagcaatatatagaaccataagtatgagcgtgaatatagtcaaaattaaaaatacacaatttacatgattgtaaaaacaatcacatacaaataagcagaagcttcataaaaaatgcaagcacctaagcattaattattgaaaccggaccatgaaattggacaactttcactatgacaaccaaaaaacatgatacagaaatataaaagtaaataattgtgtttacaaatgagttttctttaaaaagctacactgttaagtatatcaaggaaaggggataacgtctgaaaaataatataaaatctaaatattctgttttcagttacacaaattcaaaatgcaaggaattgtgattactataatgctagcattagtatttcttcaaatttatcaaatgggaaacctcagcctaaactacataagccctaaggttttaagagatactgaaatatgtgctaaacacttaataatgtttaatttgatgatctaagtcatatttgtcatgtattataaaaccaaaatataatttgcctttcttcattagtagtctagtaattacttaaggtcataaactatatgttgatagtttctttatttcttatgatttggcatcgtgcgcaatactttaaatgctctacacaataaatcattttcaaataaatgtgttaattattcaactttgcctctttaacagcatatatgattgacttatgttttcagtcagtttagcatctcaagagtctttttgaagtgattcttctgaataatcaagtttggaagtactacgttatagggatactaatataactgtagtttaaaatattttactttgtaaaaaatttaaaaatgaattaacctgaaatataagttatttcccatgactcataaataaattcctaatacatattttacctacatctattagttctttttatccatttattcatttaacaaataatatttattaaaggtcaatgtgctgggactgtgtaaggtgttaggcatacagtagtgatagaaaaagaagaaaagtatgcaaaaaaattgacaataattttattccatttgagcctataattaagtgagagaaacagatagtttaaccatataattataaatttttaaatgtgctgtgaaggagaaatcaggatgctccaagataataaaggggtaacattgagaagaggaaatcatggaagtcttctttgaggaagcggcatttaaattaagacctaaaagacggaaagcatatgaatgaaagttatctcatcactgtgggagcatcataacaaataagagaaagataaaatgctaagtgaagaaattgaacgctaatccagtaatacaggatatcgattatgggcttcatttttatagcagtagaaaaccattgaaggggtcaagcatgctaattatttgagtgatttcaaatgtaatatagcccactggctaatgaatgaagaagagggaaagaggagacataaataatactcatagaaggacatttcacaggtttaggtgaaagttgatggtggcagtgaaagaaaaattaaggccgggcgtggtggctcacacctgtaatcccagcactttgggaggccgaggcaggcagatcacgaggtcaggagaaccagaccatcctggctaacacggtgaaaccccgtctctaataaaaatacaaaaaaaaaattgccgggcatggtggtgggctcctgtagtcccagctactcaggaggctgagacaggagaatggcgtgaactcgggaggcggagcttgcagtgagctgagatcgcaccactgcactccaacctgggcgacagagcaaaaaaaagaaaaaaagaaaaacaggtagatgcattaaataagtatatgagaaaaaattggtaggaggtggtaatagattggagatgggagtaaatgagtatgtttcaagaataactttttccaatcaaatggaaggtgttgctattttcttttccttctttcttttttctttttcttttctttttttttttttttttttttgagacagagtctcgttccgtcacccagccgggagtgcaatggcgcgatcttggctcactgcaacctccaagagattctcccgcttcagcctcctgaggtgttgctagtttcttagattggggaatatcatccatttgaaaaaatgctgatagtgtaatcaaacttggaattcaattaaagtcctaagcatgagtgaataacctgtataagttcagaattacatgttggtgtatatatttcaattctaatacaaataggtttagccaagaaatggagtggtctttagaaaaaaataaaatgcttcaaatatcaaaaataaattaaaattgtgtactaatgtaaaaataggtccacatttttgtaagctttgctcatgaagactttatccggtatttgctgaaatactgaaccccctcaagaccttaagtaaatataaccctcaaactttaatcatgacattatacacacaaaccaaagaaaacaaaatcattatttgaaagaaattgtcgtctatggccataccactctgaaccctcccaatcttgtgtgaaataaattgtcaagagacattaaaatacgatgtagttttatcttaaacttgaatatttgaaattacaaaaacagaatttaatatgtaattttatatgttatgtacgtgtcctccacagagcactaaataacacaggacactcagaagtatatacagataaggtagcaacaaatattaataatcataagtgctttacataatttatgagaatggtacagtaataatagcaagttaccacatgcagcatttgctaagcatgcatgtgatagtagtttatatagttagtttaataatcacaacactcttttgaggttggtactattattatcaccattttaaagattggaaaactgaggtacaaaaggttatgtcatgtaatggtacaaagtggcagaaagaaatgcaactagctagcctgcctcccaattctattgtctttaaattggattctacttcatctctgtcacttaaaaccctcgttaatttggaacaatcatctgtcattatattaactcacatttttctataaaattaggctataaaaataattatgttcaaagttttttcctatgatatattacctatgatatagaataactacctatgatataggtatgataattacctatgatataggtatacctatgatatagaataactacctatgaataattacctatgatatagaataactaagaaattaaaatatttccaatttaagagcaggaaggggtagcttggctaaagctgtgaagttagagatcatctcgggaaaggactatgtgaggtgatacttagtgtgtgatagaattcttacgccaaatagaacatatatctaaaattaggtgttttctaaactcattgagggtacattagtcgagggaattaaattctatggacattaactgaattcctactgtgtgtaagtcattatactgaccactcgtggttagatcattaaaagtttttgtcttaaaggaacttacagatcagtaggggagacagacacgtaaaagttagccttaacgcaagccacaataaaacatgtgggagatacagttgatagctggtacgtggaagcaattaattttgacttgctaggaaaatatagcctttattaaagaggtaacaattgtactgtgtgttaaagattttcttttttaaagatacaacttggatcaaaccttcaacctgagagagctctcaatagttacagaataagaagaatattccatgctaaaaacaagtaaaacaaaaccctatatattattctcggattcataacatgaagggatgtagcaggagatgaaacaaatatatttaagagtattacatagatgtccttgactgtatgtgtggagctttcttccttccattggtaggttttccaggagggtgaggatctgttctgactcagtttcagaataatcatctgaaacagtgtggtaggaaatccattgaaatagccagattgcccaacatagtttactgtagtagcctaaattatggcagcacataggcatggaaaaggaattggtggtggaaatgggaatgcaaattggtacagtcaccttagaagacagcttctcagtttctaacaaagatatccatattcattctatatgatccagcaatcccactccttggtatttaccaaaaggatttgaaaatttatgtccatgtaaaaaaaaaaacttagcatggatgattatagcagctttattaataatggccaaaacttgaaagcaaccaaaatattatttcatggaagaatgaataaataaactgtgttacatctagataatggaatattatacagccctgaaaagatatgggctattatgtcatgaaaagacatggaggaattttaaatacgtattactaagtgaaataagccagtctgacaaggctacatactatatgattctaaacacatgctattctggaaaaggcaaaatcatggagactgtagaaagatcaatgattgtcaggggaaggaagcaagcaagggggagggaagcataggcagagcacaggatttttagagcagtgaaactcttctgtgtggttctataatggtggatatatgtcattagtacaaaaccataaaatgaagcaccgagagtgaatcctaatgcaaactacagactttggatgataacaatgtgcgaatgtaagttcattaattgtggcaaatgtatcactttggtatggggtgttaatattggggcaggtatgcatctgtggggacagtgagtatatgggaaatcactgtatcttcctctcaattttggtgtgtacctaaaactgctcaaaaaaaatctttaacaaaaaagatgaaatgatgatctacaaatacattctaaaatagaaattgcctaaactgaacaataatttggatgtatgcaggtaaagcagagggaaaacaaacaagactgcaaggtgcctatcctgctgcctgtggaacctaaagattaatggtgtgcatcatgatatagctgcctccaacacgactagatgcatgtttttgagtgtctgtgtttgtttattaaaataaagataattgattagttaatgtatttttggatatgtgcaatttgaagtgcttgtaaaagatctactttgtcatgtccagctgatatctggaatgtcagcttgctgcttgggaaagaggtcattacagggcatttaactttgggagacaagtatatatagaggtgatgattgaaaacttgagaacagatgaaaaagagaagaagtatatatacgtatttgaagaacgttaatttttaaagggtgataattgaacaaggggccagtaacatctctcagccaacagagaagtaggatgggaaccagggaagtttttcataaaagggtatagttgagagtttcaaaaagattaaggacttttgactttgacatgtagaaatagactgatgggatatctaattttatatgattttagtggtgtgatgtgagtgaaacccagagtatattctatacaagatagataaatacagatagaaatatagagatagatatagatcaatatatgtatgcaggcacttagattgatacatttttgtcgataaggaaaataatcagagtgggatagaagcatgaagaattatatctgggagtagggattagaccagaacctggggatgttaataatgttaattgggcaaagggaagggattagtcactggagagagattattgcatcaaaaaaatagaataattggtggagcacagaaattggaaggagtgcagtctaagacaggaaagaagagtaagaagcatcacagaagaagggaaggagaactaaaaaacaaaagaacaatgaaaagaagtggggtgaggatcagaggactcaactttatgtgggattccatcttaatgacttaagaagtaccagaatctacaatgaactcaaacaaatttacaagaaaaaaacaaccccatcaaaaagtgggcaaagaacatgaacagacacttctcaaaagaagacatttatgcagccaaaaaacatgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggattgtaaactagttcaaccattgtggaagtcagtgtggtgattcctcagggatctagaactagaaataccatttgacccagccatcccattactggatatatacccaaaggactataaatcaggctgctataaagacacatacacacgtatgtttattgcggcactattcaccatagcaaagacttggaaccaacccaaatgtccaacaacgatagactggattaagaaaatgtggcacatatacaccatggaatactatgcagccataaaaaaaggataagttcatgtcctttgtagggacatagatgaaattgggaatcatcattctcagtaaactatcacaaggacaaaaaaccaaacaccgcatgttctcactcataggtgggaattgaacaatgagaacacatggacacaggaaggggaacatcacactctggggactgttgtggggtggggggagggggcagggatagcattaggagatatacctaatgctaaatgacgagttattgggtgcagcacaccagcatggcacatgtatacatatgtaactaacctgcacattgtgcacatgtaccctaaaacttaaagtataataataataaaataaaatttaaaaaaaaagaagtacaattattcagtggtacttttaaaatattgttgtttaaaactgtaactctcaaaattggctgcatattagaactgtttcaatttcttaaataaaatctgtctaagtgagtccgttatgggtggccaaatcatttaaatacaaacatcttagaatgaagtgctggcatcaatactttaaaagttcctcaggcagaatgctaatagtcaattatcattgagaatcacagtttaagagaattgcagatgtttgcgaatagtgtttatggagcattaattggatagctagctactagtatttaaattgacatcttcaaaatattaaaatctgtatcctgtatagggagtaattgtcttttcaagaaaactagcaatgtgtggattggtattagtggagcatagtatttattagtttcaacctatacgattgcattgacatctgataaaacggtctgcatggaatgaaaaatgaaattatctcatgcagtaattttcccttaaacaaaatatgtgctaataatgtgattatacttcagctccggttacggaagatgatgttggtgctttaaggcatcactcctctaagtgttgttcatgacccatgtgcatgagaatcactccaggctttttgaaaaaatcaagtgtaagagacatatataaagtcagaagctcaatttataactgagaacttataacaaggatctggttaaaactttataaccaactcatttgctccttgcagacagggtagatacttaataagaaaaatatactgtacttaaaaaattgagtatgcactcacatcaggctaaaagagtctcatggctacattgaaaatgacaataattaaaacctgttgcccaagtgtctctttcctttaaagtgctcattgtcacttttgtttctgacactttcagtctttgacatcagtttactaaccacaaagtaaactgatgtatcctgtgtcaggtcaatggggaaaggcagggttgtgatgaggtgtagcatagggacctatgtcatgactcttaaagggtatatgtagatcagagttctgtatcaagtttctttgttttaaaaatattctctcaatgagaactagtttatgtctaggttcttggaggatgttttatagcgagaccattcttctaccacataccagaaataacattaaaatactaattataaagcttaatttgttgacttaaataatttttaaaattgtgggcatgctgacacaaacaacagtctatcttcataatctgcatagttcaggaaaatatataaaagtcttgaaaggcaaggaaatatctgttttacaaagagatacataagggaaattaacttttgtagacttcaaatgaggaaataagcctttgatcccctaaggcaaacatttttgagatacagtttctccatataattgctatgattttcttacttacactttgtagttccctgctggctgtttttctgtgtaaacttactttcatttccaattatgtcattatagagatgaaaatcagctctaattaaataagaacatgacaataattgtcattcatttatttatgtaaactatgatttttctacctgtgaaaaggtgatttagcaaagaaaaatgtagctctcatggtccatcaattgactggaactaatagtcatgtatctacagcttcccattctctcatatctttattcattcaatattacttgtctaagggtcttcctttctttcatcttcaaataagcatttattaagtagctacactatatttattttattttataattttaacttttatttcagattcagggggtacatacgcaagtttattacctgggtatattgcatgatgttgaggtttggggtatgattgattctgtcacccagatactgagtatagtacacaatagttaatttttcaattgtctcttctccctctctccctccatagtagtccccagtgtcttttgttgccatcagcagctaccgtattaaacatctactatatgccatgaactatagatacagatgccacagatacagaaataaactagttacagttttgccctgaaatcaaatgctttaaaacacattcattttattaatgtgacaagtaccataccaatatattaaaaaatttaccatagcagtttgaaacgttttttctctctttaccaaatacacagcagaagctatttacacatagaataaacattccggtgaattcccagtccccaggctatcatgtcaccccttctatagaactcaagaaagcatatcttaattcataaataaaaaataatagcattgaatgatttcttttttctttcacattttgcttgtttgtttgttttttgtgtttttctttttaagacggagtctctctctgtccccaggctggagtgcagtggcgccatcttggttcactgcaatctccacctcctgggttcaagcaattctcctgcctcagcctcccgagtagctgggactacaggcgcatgccgccacgtccggctaatttttttaaaaatttttattttagtagaggtggggtttcaccatattgcccaggctggtctcgagctccttagctcaggcaatccgctcgcctcggcctcccaaagtgctaggattacaggtgtgagccgccatgcccagctgcattgaatgatttctaattttaattaacaattaatgcaaagttggtgatgatttatccttggaataaatatttactgcatggctaatatgtctgccatgtgctggcattacagtggcaaacaagacagccaaagttgctaacctcctgagttttccatttggagtaagggaaagaagaaaataggttaatttcagatatgggctatgaccttgatgagagaggaaaagagagaaaaaaagtgtgtgtgtgtgtgtgtgtgtgtgtgtgtgtttgaaataacttatttaagtgtaataagcacagataatggtaaaaataagataaatcaggaataaagatgttgcctgacttacatgttttcaaagttaccatttactatctaacttaaattttctctgctgtaatgattatattttatctaggtaaccaatatctagtgggattatgcatcaatttactaaggcagttttttgtatttatctccaagtgaaatttaatcaatttctacagtagtgaaaagtaatttgaagatttaatatattcagtattttaataaaatataaactggtcaaatagctatgcttttttttttaaagtaacaaccaagcatttattcacttactacaaatagctatgtttacctctaataaccagttaagtctcctttagagtccatatagatatgcttttatttgtttttggttttttgtttttgtttttgtttttttttgagatggagttttgctcttgttgcccaggctggagtgtgatggcatgatctcagctcaccgcaaccttggcctcccaggttcaagcgattctcctgcctcagcctcctgagtagctgggattacaggcatgcgccaccatacccggctaattttgtatttttagtagagacagcgttggtcaggctggtctcgaactcccgacctcaggtgatccacttgccttggcttcccaaagtgctgggattacaggcgtgagccaccatgcctggcggatatgcttttatttgaaaagtaacagaaatttaaagctatttaaactaattatgctatacaataagtgtgaaatcaatttctgtttcttaagtaatttcttcatgagcatatcgtataatgcacatgtaaataacagctttgagtgtacacttatattatgtgagtagttacctgtatgacactgtccccaggtctcatgtctgtataaacatacacatcataggatatttcagggaaggttggcgtgttatcatttgcatccatcacttgaatattgacgatgactggctcactttcttgtacaccatcaaatgctgttatctttgggaggagaaaaatacacttagtagagatgttctgcaaatataagtagtacagagtttgctcttacagtttaacaagtttcttacaggtaatcttacaatttgaaagggtgcaaaaatattttgttgataaaaggacgtaatagagacgtaatattacatatattaaaagtgttctaatatggtaagaagcaagtattgaagattttgttttaaggtattcaactccaggcatattttaaataatcagatatgcaaaatatcatttaaagtgggccaataacattgctgactcttagggttaactacaatttaatccttaaaaacttaattggaaaatattatttgcatttacatattttgtatacaatagttccttgtacagtcaatgtgtttataccatcaggaaggtagacttcctagatgtactttgtatcacagtaattcacccaatggcaattttcaaaggactaagtggtatcatttaattgtgatattttatactttatcaatgttgataatgtatgttatactttatcaatgttgataatgtacattatcaagattttaacaattcctgccaaatcagtgctacagcaccaccatctttgtctaaatccactttgtatctaacttttaacaatcacataaactttcctggaagttctgatctttttctatgtaggcttctccagaaataatttctacatatcttgtttaacttgtgctttctcttagctcatctttctcctgtgactgattcaaaaattgggatataattagaagttacattttttctttatccaactgtcaaccctactatacttgttatttacgtgtttgtgtgcatgtgtgtgtatgtttatgtgtgtgtgtgtatttccctatctcatgataaatatttacaatcacaactttaataacctttactttttttcccccttgattagcctaacccatgatttatctacctcagtgctattgacaccttgggacagataactctttattgtgaggggctgttctctgtattacaattagcagcatcctttatgtctacctactagatgcctatagtaactaccccttcacaattgtgacaaacaaaaatgcctccagatgttgctaaatgttcactggagggaaaatttattccctcttgagaatcactggctcaaccttatgactaaataaaaaatgcaagaacaacaacaaaaaaggttaggaaataattctttatacctcaatttaagacaattatgactgtttagtaaagactgaaattctcactttcttttttttttgaaaagttttttcttctgtgaggaagaatgttaatatagctacacaaattacaaaaaaagagcaatacatgtaaataatttttcattgatcttctctctggtattgaaaataatgtatttttcccccaagtcattgattttttcagttttaaccagacatctctttcagttccatacaaacatacatacatacattcatacatacatatgtatatttacacaaaagctctttaccgaaaaggtgtaagtttgctgttcttccctgtccactggttgaagtaaggtgaggtagcgagtaataccagtctgtgtgacggtgaagactgaggtgtagtcattcagaaaaaggtgaagctctgggtcttttgtctttgaaaaaaaatgacatcgtttcaaacgttgaataaataatgtagctattagttcattacctagaagttaatgtttgaaatttatagcaaaaatccacgtgaaagtattaagaatttctaacgataaaagatatttaactagatatttactcaaatgatctaaactattcaaaagatggtgacctatatcgtggaatacaaaatactgaaatacaaacaggtataatcaatgtgggaaaaaaggaaaaataatagaaaaacagaaagaatataaaaactcccaattaaatatattcttactgattatttgttatcaatattttccaaaatagcattggactggagaaataagaaataaaagcaagaaaagaaaattgcatttcaaaattttagcaataagactttataattacttcatttatagtaataaactgcatatatacatattactatcttgttcttacttataatgcaaaatagaaataaaattggttatgtattattcattacctataaatatcatgcttactctttcttattttaatgctgtaaaattttccaaatggaaacatgtttactttaattaaaatatttcagataatttgatttaaaatatgcataaatttagcaaatgtgtctgatagaaaagtctagaaaaaatgatatatacttaaaaaggaagggatttcaaaattcaagtctgagagacaatcaacttagcattgaagaccctttgcaatttcattgccacccctgaaacagaagacaacatactctaatttagagaaagaacagcaatataaagtaagaaggctagcactgatgtctgcatagtaggaaagaaaggcaggtggagcgaagaaaaaaggaatattcagagagtggactattatgaaggctttgaaaaagagagaaaggagtgatacagggaggtaaggtgttgttctagattatactatcttttaaagtatgcatagcatgatatgaaatggatttaatatcataaaacacttctttaagtctgatgtcaaggactgaggcaagagcaaagaatagaaaattgttaaatgtgtttaatttgaaaataatagaactcataatttcaaaatttctatgtaaaatacaaaagttgtaatgcacactactataataaaatgtgaacatgatttgatccacaatatacttgaatctgcccatcttttaaacattgtgatatgtgtagatttcaaataaccttgaaataaatggtttcatttgaacctaaaacaagttatgtattcataatatctcattctgtagtagcttctatgttcaggattttgacttaaggtcactgtgctacatttatcctggaacaataagaaagtaatactacacataataattccaactggcgtatttattataaaatgatcaaaaatattgagaaaaagttcaagaggcttcacactctgatattttcaaacaggcacttcagttgtttccatttcagtgtcatgaacccaattactcagataactagaaagcgggatattctaaaaaatctaacatgttagttttaaaaataaattatgtatttttaaaagtcaattagaaaatgcatatgtctattctgaatgatattttaagcattcttattttacactttagagtgaattgtgattaaattcaattattagagttgataaaaaagttttagttaacatgcagtttcagtcaaagaaactctaagtatgaatgtctgccatttgttttgtgttcatcctggatttacctaatcactgggcttttaagcacatatacacttctctaaatgcaccaacaatggtgccatctggcatgccttaatttattcggacctttaaaccctaaatgcaagctgaggaagttttgctatgtaccttgtttaccaaatatttactttgttccttttgttcaaatctcatcattctctacttcctttataccttaattctctcaatttattttcttcctttcaaccgtaacctctgttaataaatttgttaggtatattcactcatatcttcacatttttaagcatttttgtgtgtcaagtatttcgataatgcaatatttcaataagtattgagttgtcaactagtgtgtccaaatgtgactgtagtataatatgtttgtgtcacaaagagcacttactttttaccactttcaagaaaacctctaggttttgtttgtcaaatgcttttcgtttgaagataatgcacacatcaatactccataaatagacttccttatattggataaacagaaacattaaagatcttttgttaatttaactgtctcagtttcttgagtgcttttataataactagctggagaaagataacatttcccagaactacagtgtatttgctttttgtgaagaagataatctatcacagaaagctagcactatacatggcatattatagctcattctgttttgtttagttaatctctgatcaaaatataacatttacatttatgtatatttaaaataataatcttgtacataaatgctactggtaaatatcctcgtattaatttaagtaaaaaaatttaggaagccagatttggaaatgttcaacaaattgtcactcaatgtttaataatttatattcatttttaaagatagtgcaagtttcaaatgttgtgtatatatttatgttccaaatattacagcatatcattttatgagttttatgaaaattttaagtaatatcaacataaaatgttaatagatacatatcagtaccaactaacctattgttttgattgacaatatttacagttcaaggttttgctacccttcacaagaaaggtgtatcaaaggtttggtaagaaacaatgtgcatttgaagtcaaatatccttctctaaatctctttataaacttaaattccttcttgtcaagctgcattccgatacagtttgaatttcacaaatatatttgaattttgcaattcctaaagagtaacttgagtcaacacttgtatatttgcaactcttttaatcatgttagagttaatagcttataagtttcatagactaggatgtacatggacaaataatgctctggcttaatattccaataggggtagcagactttaggtagctgttgtgtctataagtttatttaaaatgaatttaagtgttaaatcaataggtacacagagagttgattaaaaaccgttaattttcctctgacattaggtaatatttattttaccctaaaatatccagtcagtatataccaaaagtatgatatattaattcacttatctgcatattatattttgagatggtaaaataagctctgacatgcacacataaaaacagaaaaaaatgcaaaagtaaatgcatatgaaaacacacaggtaaacaaacatatgaatataaaataaacaagcattctatcatataaaactatgttcaaagatgagagtctactgtttaaacaccaacttggggtttctaatgggaataaatataggatatcacaaacacacaagaccatatgcatgcacatatataggcacatacaacacagacatgtatagacatatgtgcacatatatatgtatgcatatacaagagcatacatataaatgacaaagcataagagaaaaatgacaaaaaaatgttatctcctcagccagttttaattacttggtagtagttgcctgagtatttagttcaaaaaaattcaatttcaaacttacaatgttttagaaaaaatgccatgataaattaccaatgtttgttgtggactgagaaaacattaataattaagcagtctttgcctcagttgacaattaaatttggattttacaaaatttcatagtactataaacaatagattatgtaaatatttttaccttttttaactttaaaatatttttaaattttaaaccaatgaagtaagtatatttaaatttatataaagtatttgtagatatccttataagggataatgaagtaatacctacgtgttttagtgaagaaaaaaaagaacaaggaaataaaccacagcaattaacaaaagaacaatcacaagcttaacacctagtacctacaggaactccactgggtggaacctatacgcaaattaaacatgaaataaatattgtaaatgtaaatgatcacaaccgcacatatgaagaaaaagcaaaccacttccagcacactagactgacaatttttttcagagtatacaatttttttattagcattgtgacccacatataatggaataacgatatttatgaagcatataaatacttaactgctttatgagtatattgaattaaatatcaaagatacctcttcatagtaaaataacgttaagcagagaaacaaatttacatgaagttataaataagtatctttttacaagccaaatgagtaatctttattgattattattctttgtcattttttatgatcagcattcaataatcaatttttagcatctctgacactgaaaacctggtggtctcagacatgcctcttaacaccttgtgccttacctattctacttatattatgggttattttgaaattatgatgtggtacaagtactctaaaaggcataatgtataaactgatatggttcatatatgtatacatgcatgtgtatgtgtgtgtgtgtgtgtgtgtgtgtgtgtgtgtgtgtatgggtatatgtctacatctatatagcaataaaaagaacactggtgcaaatatttcttttcctttcttttcagtattactgtggcccttggaattctttctgacttaaaatctacactgtgaatactatcacaactcacattcctggctattgtttcttaaaatgtggcttcactttccactaaattaaagggagaaacacaacttaaattttacgcaaatggatccaaacttgtccccttcttggcatttaccatctggaatagctatgcttgaagcaactcttgagagccaagccctgcaatgacaacttccacttttatgcttgaggcttaatctctaatactatgctgatattgtatgaggtggcacactgtctctctcaaagagtttatccctataatgatgattgtcactaattctgacactcaaaagcaacaggattttgtttcattttgttgaattagggtcccaatttgtcatctagcctgcagtgcagtggtgcaatcatggctcactgcagcctcgaaccagtgggctcaagggatccttctgcctcagcctttcaattagtgagactacaagcatgaaccaccatgcctggctaagttttttgtttatttttgtagagactgcatctccatatgtagccaaggctggtctggaactcctggcctcaagccatcctccagcctcactctcccaaaatgctgagattatgagtgagccaccacacccagccaagagtggcatgatttaccttgaagtaaaattcatgcccataaactaaaatggctttaaagttttcttttcataatacagatcttttgaaaatcccagaaatgaactaatttactttataaaaataaatggtgctcggtctataaaaaacagatgtatcagaaggacataaatccatcttctaatatatgaatgactatttcatagatttattttgtgtgctggcaaatggaagatttaaggaataatagatgaattaaaagaaaactggtttcaactcagtatgaaaaacagctttctaagaattagagttgttcaaacatgggataggccatcttgtgaaatacttaatgcaacatcattagcatctttgaagcatctgttagataacctaattcattcaatagtgactgaatttatgagtttattgaagagttcccaaaccctattaagtgctggaaactgtgttagttcttcagcatacaaaagttgctaagatataggacctattctcaacagatgtaaactcatgagggagaaagacattattttcaagttggaagtatagaattagagaaatgcactgagggaggcatgcaactaaaattggataatgaataccgtggaaagattctcgaatgaaggaatgcctgaggtgagctctaaacactgagtataagttatccaagccagcctgtgcaacagatgaaagatttcaaagcctagaacatgtaatgagcaaacattagacaagatgtagcttggcacatgaaagaaacgacaagcagttgccaaatgttataggtgaattaggaagtttccaaaactcaggccacaaaaatgttcaggtatcaagatacagaaaattgtgtgagcttaaattttcttctctagaggaataggtgtcataaaagtatatcaaatagaaatgtgggccagacgcagtggctcatgcctgtaaacccgagcaaggtgggtgtatcacttgaggtcaggagttccagaccaacctggccaacatggtgaaacactgtctctacaaaaaatgcaaaaaaaaaaaaaaaaaaaattagctaggcatggtggtacaagcctgtaatcccagctacttaggaggctgttgtgggagaatcacttgagccagggaggcagaggttgcagtgagcctggattgtgacgctgcactccagcctgggtgacagagagaaactctctcaaaagaaagaaaagcaagggaaagaaaaaaaagaaaagaaagaaggagaaggaggggaaggaagggacggggggaaggaaaggaagggagagagaaagaaaaaaataatgaacggagagaaggaaggaaggcaggaaggcaggcaggcagaaggaaagaagaaagaaacaaaggaaggaaggaagaaagaaaaaaaaaaaagaaagaaagaaagagaaagagaaagaaagaaagaaaaagaaagaaagaaagaaaaagaaagagaaagaaagaaaggaaagaaggaaggaaggaaaaagagaaagaaaggagagggagagagggagagaggaaggaaggatgtagttagatgttagatttgagcttttgaataaatcactctaatggccctgcagaagatagacttgagtaagaaatcaagagaccaagaacatcaggaagtaattctaataacagaccaatagggtggtggttataaggatagagagaagaaaagagattaaataaataattaggggacaaaataggaagatctggaagatttcttagttgtggcgaataaagaaaacataaaaatcaagcaagacttctaggattctaggttgcatagcacaataaaacatctatcaatttctgggaaatgggttttaggagaggatttcatacagtactggaagtttaaactatttctaatattctatgagcttatttatattttatatatagaaactacatatgatatttttaaaaattttattactagaagactaggcatacttgttcactctctggacacctaatgacagtcactcaccatagattattttagaaagggggtgagtctaagtaataaacaaatgatcagttttgctgattaattacttgacacttttataaaagttatgaagcatgccaccctccatgtacatggcatcatctcagggaaattttctctccatgccctttcctaccagtcccaactaaagacacataccaaggcagcaatgattgctaccatatagatgactggacaagagggggcacctgatgagtatgaaactcacaatgttatacagctattacatgacagaaccaggagtcaagccaagatctgtctaaatccaaagcccaaactgccaaaaacacttcagagcatttcatagactaactggtactgtacatctccaagagttgaattataagtagtgtttctcaaaggttttagacccctgagctctctccactttatttcatcaatgccctgtgagtactactgtcttttacaaagttccttggaacacaattttaacatttgtaatttaaaagtgaacagacaatccagacaagtacggggtcacataggcaagcatagggcttagtgtgtaaccaatagataatatgaacacactgagaaggtataaatacataaattttgctattgtgtaaacttaaaactacctaactttagatttagatttttctaaccaccagttctattaaggtatgacctaagctatcatacactttcaaattgattagtcactacttaaaatatgagtatgtattcaattgaaaagcaaaatccgcactaaaatttgtgggacattagtagatctacaaaatacatttgctcagcctggattgaagttattaaggtgactctaggtgttttctagtggggattcagtagagacttttttcctgtgactcatgaaacccactatacatcagagaatccctaaattctcttgactggcatatgaaactgtgtatagattaatgtgttcacttttctaggaaaagaacctagagcattcttcagctatcattatagtcagactatgatcaaagtatataaaatatagagtgcttaaaattgagaactttgttttccataaaccttggcttaaggtccatttctactgtttactaacactgtgatcatggtaaggcatttaaactagctttaatatccctttctgaaatagggataattgcatctatcatgtttgttgtgagatttaagggaattaatgcaagaagaatttactgtattgtttgacatgtactgagaactcaatgacagatattgttaaaacttgtggtttaagaagacactaaatgtgagagaccaggaaagattgaaaaaaaaaaaaaagctagaatggaaaaagaaaacaaagcaaagagaaacaaaagaataaaataaagcatctggtgggaagaggtggagtgccaacaagaattgtcatagcctctgtggagtgttacaaaatttatttagaaagagaaaaaaaatctgaaagtgccttcctaatttcctgaagtgattataaagctatgtgtaatgagatattagggaacattctagagctctgctgccttatgagtgacatgtatttatatttaatttcattaatattaagcaaaatttaaaagttatgtttttagtccagttaaattttaagtactcaatagctgtataagactagtggctactatgttggacagtacagttacacagtaattccatcatcacaaaaaaatccatctatctgagagcaagcactgttaagggagaaatgaatgaatcaagaattatataacagcaagtaagaaatccaactatcttttacatatagttatgcttataatccaaacacagttgtatttacttgctgttttatatatatgtgtgtgtgtgtgtgtgtatgtatacctgtgtatatatctctatctatctatctatctatctatctatctatctatctatatctgtatgtgtatgtatacctgtgtatatgtctatctatctatctatctatatatatacacaaaacatatgtatacatatttatgcagtgaggatactgtggtagttcacaaactcaaaggaaaatctttgggaattagaatacctctggggaacttaaaacttaaaagacaggcactcaatgggactctcttttctgtgtgtatctctcaggcttcattctctcccactgataattggctttctcatgatgtcagcaaatgtggctacaaaggtttcagattcatttccacttctctaatacatgataccaaagtctttcagcccttctgttctccattgtaaattcctgggaggattctggctagcctggtatagattttctgtccctttataacattcactctggctaaggaggtaaagtgttctgatttgctcagcctggaccatttcccactcatgtagatagtgtgagtacaagaaaaacaaaagacaatgatttgtggagtgaagcgtaagcatccacatagtcactggcagaagtatgaatgggtcagctgcctcaaatatattttaataacgatgccctcagacttgaagaaaagtctctgagaatcacaatctaggggtgctttcatgattttttactcatgtagtaacaccattatttttgctttatcaataattatataaaacagttctcaacatatgttaataaaaatattgccctcgtcattaaataaacatcaagtaaaacattcattttcttacatatactgaatatctgcaagctgaaaaggaatagttattgaattcaaagatactttttaaaatatccttgttttggaattaaattataacactaaaactcacttacagtgacttaattctctcttctctagcttatgtagccatatctttgtcatatttcccattaatggaaatatgagatttgttacacaaacaagagcaaaatatgtatttaacttacatcttctatgtccttgtccagagctactattcttaaaggtgaagtcaaattgagactgtccgaaatggttgctcccactggggcagattccaggatatagccttgataactgggcattgtaaaatatggactttgattgttttcatccagtatttcaatgtgtagaccggcaaaggcaggaagaggatgaccattgtcttgttcagcctaaaattgaaaagaaaagaaaatatttagaaagtatatgtcgtgctatctttttggagtttcacttttcatgcaatatatagggttctctttttaactaatatcatcacataaggaaaaaatacgttaaagggccatttgaaaatataaatgaggaaatgaaaatccagtgaggcttaattgcttcagtcttctgttttaaaactcagtgtatattttaaaaattcactgtaataaattattattattttattttatgtttttattttttgagacagagtcttgctctgtcgcccaggctggagtgcagtggagtgaactcggctcactgccagctcttcctcctgagttcacgccattctcctgcctcagcctcccaagtagctgggactacaggcgcccaccaccacgcatggctaatgttttgtatttttagtagagacagggtttcaccgtgttagccaggatgctctcgatctcctgacctcgtgatccgcccgcctcagcctcccaaagtgctgggattacaggcgtgagccaccgcgcccagccaaattattgtaatttttattgaatgcagtaggagaggtaattgtgtttaaatacatttagtcagaaaattcaaatggagatacttgagtgtaccgctgataaaatatttaaataaaagaaaaaaagtaacacaaataaagaactatcgtatcgactttgtctcttctgtgtcttctcattttacactaatgtttaaatctctgctatggtctctgctgttgtaccccccaaattcgtaagttgaaattttaaccccaaaggtgatggtattaagaggtgtggcatttggaaggtgataaggtggtgagggcagagccctcattaatggggtgaatgcccttatagaaaagggtctagagggctccttttccccgcctcccaccacgtgagaacaagtaagaaggtggaaccaccctctgtgaggaagtgggccctcactagaaaccaaatttacaagagtcgaatgtccagcctccacgactgtgagaaataaatgttccttgtttataagccatccagtttatggtgttttgttattgcagctcaaagaaacgtagacaattcccaaataattcgtaattctatataaaattaataaagttatatttattgcccactgaccgtccccaaaagcttcttaaaaaggacagaaataataaatttcattgtaatgttgtagaaactgtgaattgcaatattatttaactagaaatgtttttcaagtaaaattaatattcttatgtataaattttcttttttttctcccattaagtttaagaagttgataaaaatttctgtttctaacacattttcatacaaaatctctacatggtcatgctgcacataggaaaatactaaccatagattttctgttttttaaaaaatatatattttattatatgtgtattggaaggtttaatttaaaggaagatttcatcacaattgacttctggaaaatctcctccaacttttatgagaaaacatggatataatttaatagcatatacatttattaaaatgaattcaaattctatctttaatttttgttatgttttccccattgggagaaaagttgtatttttaaatcaattaaaatgaaaataaaatatttgatattaaactctggtgtgattttctagatagatagtgacagtactttgtaagtagctcagctagagatctctaactgttaaaacgtgaggaaagaaatttggtctccagaagacaatttttcacttccttctaatagtaatttaacattttcatctgttaaaaaggtaggtaacaaactacagtgatattggtagggattgctgacttttcaccaagaaatattacaatatattttccttcatattatttatattgaagatttgttgaaatattatttatgtcaattactaatgtgaaattatgctaattaataaacccatagggaggtaatgtcatataatgcattgattaaaaaacttatatttgatttttaatatattgatatctctatttagataatatgctagattttcttagtaatattacatagtttaccttatgcatttaacttttcatttggcagcagaatgtcaaattagcccatggcacaaaacgctttaagatcctgctcagcactaagaagaacagtactggaataatgtttggtcctgtctgggattatgtatccatctcacataaccaggcatgctgctaataccatcagtatggatgaggtctttctgcatccagcagttgtgattaatttgtgccgagcgatggatgttcttttaggagttacccctgtgacacacatcaggctttctggagacagctgaccagggcaagaggtagagtctacgcctggaaaacattgttttttcactgtttaaaactaattggtccatatgggcttccaacccaatgaccttgaaatgatttaagcaggaatcctctgcttcactcttacaggctcagagcagttcatacatgcaaggcattttgaacagatttttttctctctttcttgtatctctccatctttctttaatatctaattattcttttttttttttttttttttttttgagacaaagtctcgctctgtcgcccaggctggagtgcagtggcgggatctcggctcactgcaagctccgcctcccgggttcacgccattctcctgcctcagcctcccaagtagttgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaataaccagcatgtcatatccaggacataaaaatgctatgaaaagtcataaattctacaacttttcctctttccccgatgaacacacccaaacacacacaatatataggtggtgaggaggatgaaaaaagcaaaattgtataataatgaaataagcttacattttacattcagatcatatatcattagtttttaccagcagctgtgaagccagtaaaaatatgtattatttgcatgatgaaaacaaagtgattcaatgaaaagagaaataaaattcaaatcagatctatgaagataatctaattcttaacttcctcatatctataaaaattacatataaaggctctgcccatttttactctaatattaatttagagttaataatgattaatatttttggattgctactatgtattttgttctatttgaggtgtttcaatttgctgaccagatatctgtctccaaagcccactttctttatgccatttatctgtccagatgtgaaaatgtgtatttttgaactgatggaaaaaaagaaaggttagttttatattcaaggccacataggctgtaagttacatacagaacatgggcccagactcaggtctcctgatttttaagaggctacacaggaagattcatcatatgtttctcaaatttacagaatgcaaatgaatatcgaaaagcaagagagatgggacaaattaacagtaggaaaaaatattgagataaatacttctgttaagtaagagttaaaatgttgaatttaaacaacaacaacaacaataataataataataataataataatatactttgctcgttagtgggcccatgcatcaaaactctgatacaattatcttttcttccatacaatataaataagggttctcaaaaatctgaattattctgttcccctgaaatccgtggtggatgaaatgagaaatattttaaaaacacctcagttggaataaggtggtattttaaaaatcatttactttcataaggtaaccttatttatatttacagagtctatagttacgagttaaacattatatttaagtgctaggttttgtttgaaaagcgtctgggcatgagtctcactttcagtaacgagaccaaagtaaaactgaagccaaaaaaaatgaagtataaaaagcacaccattttgttactttggaaggcaaaacattgaaaaagacaaaccactccatcttcaatattgaaaaaaggaaatactgataatttctgagcaccttgtaacggaggactgagactacagaataactttgttcttcctaactggtggcaaacaatttaacaatttcataatctctaatatgaaacctttcaagtagattcaacaatttaaaaaagacaatggtaaagcttatcaaattatttatcatttaaataaattctaggatagaagaaagaaatcatgttttccaggaattatttattgtgcatctacagagcccactttttttttttttttttttttgtattttaaattctgggatacatgtgcagaatgtgcaggtttgttacgtacgcatacacgtcccatggtggtttgctgtgcccatcaaccagtcatctacattaggtatttctcctaatgctatccctccctaggcccccaccctcgacaggccccggtgtgtgatgttcccctccctgtgtccatatgttcttattgctcaactcccacttcttagatcgcaagtgctcaccttcatctgtattcaccctcccaagttttcttaaacccacttcaatcatacttttgcctcagccactcaaagccagctgcttttgtcaaaatcaccggtgccttttacattgctaaaagcaatatttattttcagtccttatcttacttgacctatcttcagcattattcactatcctttcacggcaacagcttctcggttctcttcctattttactacccattttttctcattctcgtttggtggtttccccttttctcccctacttaattttggagtggcccagaagtgaggagttattcatcttttctttatactcactcccttgctcaatctagtctaatctcacaccttaaaaatgtcagtactattatgactcctaatttcaatctccaacctggatttctcctttgaattccacagtccatatccaactgtgtacttcgtaacactgcgtaagtatctaacagacgtttcagatataaatacctgcaacaatgaaattctgattaccctgcacgaacctcctccactcatggtcttttccacttctttaatggcagctacatagttacaggtaccgaaaacaagaaacttggaggcacctcttgcttcagtggatagatatggaaaaagtgaaaaccacttttttgaaaattgaatttgaagttccatcttctcatttcacaatacagtattagcagattatatatgccaagaaatattctatgttagtaaacttgagatgaaaaaatactcttatgtcaatgtagtgaattatggtcttatcctactgaagcattaaaggtaaatattgcaattttcaaagttaaggtaataccacattttaatttggataatattataaatttatgaaatatttttctatatttataatatgtaaaaatagaaatataatcatattgcttgtatagtaaattccactgttctatgctattgtaaacctaaacctttcttgtaattagtctgaatctcatttttcattagatttttaaattccatgagcataaacactgtaaatgtatcagtttcattcactgctaaaatttcggacaatccctggtatatggaagaaggtcaaatatatatttatttttacttttctgtatctttaattttaataggctttaaatatttttttaaaaattaagtgattgtgacatcattctaattcccattcgatagatatttatggatgtttttccagtgtgtgtgtgtgaacgtacacgaagtggaaattaattaatgtgaatgtacaacatgaacaccttagattatagaatgtctttattcacacattttaaaggtttgtgatatctgcaagtttacctatgggtaattaatactgatgcacattcttgccagtcttatgaatgggcctcacccagccccctcaatcatcaattatgattctatatctatagggatggtgctgtgaacagaataacgtataatcttctagaaggtttatgcatttacatgtaatatttatgcaaaaaggcctatttatatgcatttttgaatggacagtggcttaaagaatgagatgttagttgtgactttgctcttaacacatggcttagatacattttattgtcagaatggtgcaaattgaggactttagcatgattttgactgtgtgtactcttccagtccactcaacacattttaatttattaatttaatttacttgctttacttactgaactatagcttttaatacctagttcttagaacctgcttggccaattttcgcaaacattagatatcttaggaagagaaaaaaaaaagagggagggaggaagaaaaagagggaataaaggatggatagagggagtgggtaaggaaaacaaatggcattctcctttcaccagaggtaagggacagataaatgttaaaaatcatggcaaccacacaaggcaatcattctcaaactctgatgtacctaagaatagaatggaaggcctaataaaaagcagattccctgggccaggcgcagtgtctcacgcctgtaatcctaacactttgggaggctgaggcaggtggatcaccagaggtcgggagttcgagaccagcctgaccaatgtagagaaaccctgtgtctactaaaaatacacaattagccgggcatggcgctgcatgcctgtaatgccagctactcgggaggctgaggcagaagaatcgcttgaacccgggaggcagaggttgcagtgagccaagattgcgccactacattccagcctgagcaacaagagcgaaaccccacctcaaaaaaaaaaaaaaaaaaagtagtttcccacaccctatccacaaagattctcgttcatatgttgatgttagaggcaaggaatctccatttttatcaaactgtctgtggtggttataatgtgagcagaatgtactttcacagacattattctgggtgtggctactcaaactccaatttttagagaatctttctttttagccctattggttagggctattggttagccctattggttagtggaccagtctttactaatggatagtccttataatctggagcaaaaactccagataatacagtgcatccaagagccaatgttgtcacgccagaagatttggagtctagtaactgaaactgcatgcaattatacaattatcaactgtgtaggttcaacaccactaaaattgtcatgtgactctagcattaccaaagattgctcgtgtgtcagtgggaatactctacaagtaataagctcagtcttagctagtattcataggtcatggtcaaatcctcttgacattccattattcataattaattagaatttaggtatgttggtgtatgtgtgcacgtatgcctgtgtatacacagtatcaatatagttttgggtgtaagccaccacttttactttatcatttttaaataaaggaacctcagattgagaaaaaaagcagagagaaggtaatttgacatacagaaagtttttggtttctagtcagagtcagagaaagacaaacgcatatagaatgtacccggaaggcagataatgacaacattctgagtaatagtatattcctgttgctagtgactaaacataggatataaggctactatgtaattcaaaattttcttcttcctgtgttcccttcctggacaccacacctcttgctaaacagctcttcagtaaagccttcaatatacaagggtgtaatttttccaagtttcttcacccagcaaggtgcaggctgcatattgatctttatatgaggatgattctgaaaaacgggcaaattgaccgaactaccaatgattcacgcatatccctttattcctttattttcaattttaaattcaactctcaagtagacaaagaagattgtttgctttggttaattttgctggagggctaaattatatatcctgtctttctttatggatagaaattgcatttgcttaacattttaaaaatcactttagacagttaaaatatgtttacttaagctttcaaccaatttattttttggcaataacaatattattagtgtataaccttcaaatagcctgacatttggacatgtttgtcttgggattcaaacgtgaattacttgtacttttattttgaaatcaaaatgttaataaaagtctcagatttttctttagcagacaattcattgccattgaattttttcacaggtggaaagtatatggttgtggaacatatacatcctgagttggttacagtacagaaaaatagaaggaatcataaaactcttaagaatctgattaaaaacatcaacatttaatccaattataaagtgttgcaaaaaaaaaaagagaaaagtaatctatgctgttagaatcctatagtggaagtttgtggttgtgtcaggtggaggtaaggtgattagtgactaggaggaggtgtaggaggcgtatgggatgtttgtagcatctttttttaacaaaaatctggttgttagttacatgattaacttcactctgtgaaaattcatcaagatatacactttcctgtatgtcagcagcatgtcagcatttcaataaaaatgttactaaaaaaataagctatgaacttgctccccaaaaaagtgtacatagactatcccttcctctcctatcacagtaaactaggatacgggcgctcaagtccaagtggtaatttaatagcagctgccctaggaagtgacatggaaaaccaacattatgaagatacgtgaaaattaaagatgctcccctcttcaaccatctgtgttcattaaagatggaccccaaaagtaaacttggccttttgcactttcccactaagtgtttcccaaatactgtggtttccaaagccctgcttcttatctgctgccttaaaataatctaaggtaattgttaaagcaaattcccaggggctcaaccaaaatatctgacatgtatctgctgtattgcttatttgttttctttattagtttaattttatcatatcttcctaagttttcaagtaattttaatatatgacttgctctcaaaatttagcatccgaaaatcacatgtaaatcttgattctgtagggagagccctgaagtctgcctttccaaaacagccacatcccctggtcctggatatgtagaatcagtagtcgtttgggatcagttggatcaggcattttagcttctctcacacaggcttataggtagctgttacactaaaaaagcctagggtgagcagctgaggccaactctgttctagccttttatgtaagtcattatcactcttcttcactttcagcaaagtctcttaatttggacttagttggaaactgaatggaaggaattcatttatgtaagggaattctctgtaggatcctgcagctcactgaagctctacaaaagctataggtccaaagcaacagtaattggtaacaggttatcaggttatatttcctttgtgtgtgtgtgtgtgtgtgtgtgtgtgtgtgtgtaaaatgtcttagggagggatgactgtgaataacctgtgctccatgaatcaatgaacatattatcaactgactaaaaattattaggtttttgccattaaaagtaatggcaaacaccacaattatgtttgcatcatcctaataaaaataagaatatcccattgattcttgaccctacttataaaattaactgccttaaaacctacaggagcctccttttattcaaaatttaatactctaaaaattaaaggatgcatatacagtttgactttaagccaatttattactattactaaacatactcaaaaacttataaataaattcaaaaacctataaaattcatgagataaaatacaaataactgttgtatgctgtaaagtttgtttgcaaggctatacagcaaaagagtatattcttggttggaaacaaatacctttttttgtatgacaaaaaggaaaagaaacttcactagatagaatataggcagcacatattttataaagccttgtaatataacgacgaaataatactgacacatttcacacctagggaatatttttaataaaacgaaatactttctatcttcacttcaagtaagaatatgcccattctgtttataacttgttacaacgaacacatgaatcctcaaagctcttgtatacctttcaatgataaaaatctttctttttgcttagagcatgagatacaaatcgacactggaatgactaaaaggattttgaatgatttaaagaaaaaataaccttgccactctggggaagaccacagattctgaaaactctcacttatcaccgacatgttgaactatttagctggtgtttggaacgtgagaatcatcttgggtataaacagcaaggtcagccagatataaaattctgatagtgataaaggggtaactttttttctgtgaatcttccaacttatgttttatttttattattttatcctgccttttgccttccaaccagcaaagccatcttatcctacactgaggtctgatcccattcccagttttttgtcaaccaagagaaaaccacactaaagtaccttctatgaattagccaaccagaataatgtattttgtaataagcaaattttaaaaaatcattaacataaaaattatatctaaatcgtttatttttcagagcctagaaggtattgagggtgagaggtcaatatttctcctccacctactggaccgttcttgagacaaaaaataacaaagagttttagcctacaagtttttcaatatgctctttcattgttatatttctatggaaccaagaaacctatgaagaacgattactcgggaacatatgtgatagagtgctaaggatgtttatgtgtgtggggattgcagagtggggagacgtgacaagggttcagaaagtgcctttcctttgaacattttacaatgtttggtcttgctcttgtactcttacaatgacctttgcagacaagaaggccttggcaaaaagcaaggtactctgatgagaatggataaattgcctttcttcttcccaagcagttacaggtcaccttgtgaggaagaaaaaaggccaaataaaatgtcacctctgtgtgtcttttgtcagtttgtgctttttgacagccactatattcaactgctacattctatttctgttctaacactgctgcatgaataacgatatgagacaagaggacatcatacttcctttccttttattagcttccataattggcataatagttaattaatttaggccagtacttagaattgttagagacaaaccagtggaaaataaaaacacacggtgttctttctgaagaaacacaaatactgttttgttttgtgtgtgtgtgtatgtgtgtgtgtgtgtgtgtgtgtgtgtgtgttttggtattatttattatttcctagtaatggtagtgttgctcttcggcaatatttttgctttgattaaacttaactcattaaaacaaaagttgtaaaaggtaaagtttttagactgacttctttttgagcttctacatcctctgtgatgtatctcagtatgttatctgagtcaaattgttgctgttctcatgatgtgttgttggatatggtatcaggcaccctgtggaggaactctctggtgggaggtggtgtacaacgtcacactgtagcagaaaacctgaaggatactcttagctgccttctctggcatttgatcccttagttctatccaagtgtatcactttatccttaggcagattaaatttcatattatacctctgagctcatttacttactctgttacacttaaggtaaaacagatatagtcatttgtcttaaccattccctcttatttagtgatatgttcaaatttcctaacataaaggcttttcttcatcattaattagaagcattagtgatcttatatagagagtctcgtggaatatagttttctcccaaattcttcttggccctccatttttaagccagttgataacatccccttttgttagttggatgctatgacatatcatgacaaaaattatgctttgtgtggcaatctgctaagtttaaaaaaaaggagaacacaaaattaaaatacgaacacttagtgtatcaaaggtcaattgatttcagaaattgtaatatttgttggaaattcatggaaagattgctatttcattactaataacaagtaatgcctgaaatttctgtggggtgattttctctaaaatgtgtaagagatatttactttgccttaccttagagacctggctattggggtagaaaagataaacttattatattatttagtaacctactgaactgaggtgtggtgtgcaatggacttaatatttgtatctctccaaattcatatgttgaaatcctaatccacaatgtaatgcaattaggagaggtaattaagtcatgagaatagaggtctcataaaagtagttagtgtccttacaaaaggtaccccagaaagctctctcaccctctcaccctctcatcctctcatcctctttccaccaagtgaagatacaaacagaatttggcaatctgcaacccagaaaaggaacctaactagaacccgaccatattgagtatgaaattccagcctccggaagagtgagaaatatatttctgttgtttataatccacccagtcttttgtactttgttagagtggcctgaactgactagtacgtgtctgtgtgtgtgtgcgtgtgcgtgtgcatgtgtgtttgtgtgtgtttcattcttgccataagaataagagtaggaatatattgctagaatatttccagatatagaagatatgtcatttgtagcatttgtcttccttcttgtagcttggcaatagcagccctgatgttttttctcttgtcctaactctgggtcactatggaccctgttcaacctcaccttaaaggagtgccaatcgtttccatctcttgtctttttttttcctctctctctctcttttgtttgaaaactgatgatatacacattagagtagaaagaatataacttatatttcacatctccataacagatttaattaattttattagctttttcattttcacggtaggttccatctttttcattttgagaagtgatgactgatgatctttgacttgctactctgcctgacttagacacctgtgatctttcaacttgacaacatctctgtgggaaattcaggtagggggcaaattgtaaattggcttgaaggcaacatgcagcagcatgatctattttttgttgttttagcgatactctgttggcagtgtgaaaagatggacaagatgcacagaaatgaagcatgattttagagactgcttgtgtaagatcatgggccaagagaatgcgaaataaagaattgcagtagatgagcagagttgagatattcaagaggatttcaaaggtatcaggaagggattctatgagtgactgagtgggaacatacgagagaagagacctttgaggaagtggaagtgtctagcttgagtgggtgaccaactaaaatatgattaactgaaaaagggaatagaaaatagaaggtttggaatttttaaaggatgtatatagtttgctatatttttaatttgtcacaattaaataatactaggagtagttatccaaccaataattgaaaagatgtccgtaggcatcagaagtaaaatatgtctcctcagaccaagaaaaatgccaggcacctgagaagcattcaacaaggattagggaaattgaaaactagcaaatgtcatatgctttaaaatcattgaatcagggtgttctcttaaatttctatgaagtaaaatatgatttttatcattactcaaatagtgactaaacattttctagagttatgacattagtgattcatgtagggacaggggttgtagtagctgtcctcctcttagccctcaatcatttctcaaatgctgttttcctgtaactctcaaattactgaaggatgacaccttgccagggcatcaggcacatcagcactaagaatcaagctcactagttttaattccctggctaattttctatggcaaatatgtaatttttctttagaagaaacacattttttgacgcagtcataagtagctttagttgtgccataacaaaggtgtgacattttttctaggcattgaatttatgtggaaatctatttgctacatttgcatcttttttttttctggacagagatgcaagatcaaattgtatcaaatgcacacacattcacatgtaagtatttagatagagtgaagacgtaggtacacagattcagcagtctgaaaagatttactgtgccagggagaaaataattacaacaaatgtttattaagcagcttctatgtgctgtatataggtaggtgtaggggcatgggatgcagtgtaaataaatgttttgcaatctgccctcctgtaaaagttgggagaaaataaacaggtacattcaatagagtaattggggccactttaggggccaaaaggctgcaaaaaagcagcttcctaacagtggctatgcctttcgagggcaaatgtcttcttagttaaaaactgaaacatcagtttgaattagactgttgacaagaagagggaggaatgattcaggaagagggagagtatctctaaatgcttagatgtcagaaagagcatggtcagttgagggcactggaagcggtttagtatgtttggaacagagggtgtgcaagttaactagtgagagctcagggttagtgagctcatgagttggaaggaaaagaagttaaaaggcagcatgctagatagaataagtaggtcagtgagtaacaacatgaaaatcagaggaaacatgaaacaattatgcttctaatttcattgtgatctttgctcttcgttgttaattaaagggatttagattaaaacatgcaattgttatttgaagaactgagagacagtaaattattcaaaatttatccatttaattggccttaataattaatgactagtagctttgtattagatgcctgaagtataaatatatcaactaataatacttgaaaatatttcacttacaatactgaaagtgattttatggactttgtaatagatggtccacacgtgaactaattcactcttaccagagttcttaaatgtgctttcatatttttacatcacaggtggtttttattttatgagtgtagtgatcaaataacttatccaaactgggacatttaaaagagcaacagaggtattatgaataattacacaaagacaatggacataaacatgtactgccctgggtaaaccaaatctatgattcttgttcacagtgtatatcacattttaaagtatgcttaaatgattacaattatataaaatttaggatagtgttttggaatggaacaaactttttcaactgcatgttttaatcttttcatagtctaaagtttgtgaactattccattttgtcttccaagttacacctttacatttttatttgtcagcatgctgaataaatcactgggagaaaaagagaaaaaaatgaacatgagaaatctctaatttgtggcactcaccagctgttaaatacacacatagctttttaaagcagaattcttcttcaaaatgtaggagaagagacttcattttattttttctccgcttttgaaacataaattgggatctagtccaacaaaaacttttagggccaatgaaaaaatgaagtattattaaagtaaaaagagagagagagagaagaaattgaaagatttactatagaggagaactgccagattgtagcatttcaatggtcccctgaacaatgccacaatactcagttattattcaagcaggtggcacattattattacagttagatacctttgcttattatgcccttgacttcacacaaaacatagtaatttgaatctaatattgtctgttaaaacttccattaataaaagaaagtgctattaaaacaaaaaaaaaatctgtggcctattgtaattgattttttttctgtaattgatggactgagttacactgtacccaggtacaccaggacagctgaattcgataataaaggaaaataattgatttttggtttcacatgtgacagtttggaaacagtgctttgtcaaatttcttaattcccatagaaagcagcaccacaagagtcaggtagatccacaatagaaaatcagtacacattgtggagttttatatactctcataataattaacataaaatagtcaatgtaagaaggtgaatctcatgcatggccatttaatacaactggttaaagtggtgttttttgttgaataactcccaaacccttaataaatgaaatcccaggaaactgtagtcatccttcaggctctctccgtggtctgacgctatacctcatttccctgttaactgcttgtagcctgtgcattatgtctccaagcgtttacttctgtgcctccttatgttcaaacatcatttcccacttttattcattgaccatactctttcaatccagcaacatttagcttggggtgatctccagaaaatcttccctgagtttccagattaatttaaatgtccctattctgtgtgtcgttaccgctttttacacgtcttcctcttagcatttgatgcattttatctgatttatttgattatatgactgtttccctttctagactataagttttttcaaggacaaagatcgctgaataaacacaggttctgtgctaaggacatatctattaattgttaaactagacaaccatttctaagtatctgcatatttgtgaagtgaaaagagcatggctttagcgtatataaaactaaatttgaatctcaactctgccccttattagtaatgtaactctaaggtaatcacttaccttatccgaactttagtttccccattttgtgcaaatgagaatattactaaaattgcggcaacagttcaatgaaaaatgcacacaaagcagcttaaacaatgttcattctcagtaagcttccctaccttacttccttttcctttagtatgtttacatttttcaaaaggtaagaaaaataccatcgggatgcatttctagaggttttttttgcatgcttaaatatgagagagttatgtactatatacaaaacttatgctgaatctttgcttttgtcttttcttgtacttacaatgcccttttcccagtcccatctctgcctggcaaattcctgtttttccttcactgcttagattaaatctcaccatctcaatgaagtccatcgaaattaattagaagaatatctgcattttttcagtatctatttaatgattatattaaaatatagatatactattaaaccaaaagtgaaatgccaaatagattagcttagctttgaattatttcaagtctaagatcatctttcaatataaagaaaataatgagacatatattgaaagcatctttggataggcaagacctcttatttttatgttggaaaaatcattaaaaatacattagaatacaattaagtaataaaaatgaaaacaaaattaaaacaacatataaatcaagcacattttagatgtcttaattggtcatgtttttgtggtaaaacgctaattccttttagtagaaaaataatgttagaagacataatgaattgtgtagaattgtatacgcttgaccaaggcatttgttacatataagaatatttagtattttaccccatagtactataaaacgttattttagagaaaagcaatgccatgtattaaaagtgggcttcgcttattttctttttaacaaaaaattgactgactgctgtccacattaattttaattttataacataaaactgcctacagtagcgtctacagatttatctgattagcagttcataaacacaaggaaataagatattagcttaatttaccttaataaccaaatcaaatttctggtgaaagtctctgtttactggctccaggagactaagttctgctgtcctaggatgcatatggaaaaatcgtgggtaatcctcaggagtccctggaagacattgagatttcagtacataattgagaacaataagtaatatgtgtatctgctttttctatttcccttcatcagctgaggaacaaagctacaatttcattagtaaattaagtttcacaattatgcagttcagggaaagcagacacaaatgtggtatatagttattaataattagcatatcagtaagaaaatggaaaatgtttggatgatttttgaaattttttttattaagagggctctaattaatttgaatcttcatcacatgaaaatagacattaagtggagggagagtaaattttttattatgaaattttattttaatggtgcataaatcttaattataactgtttggtctttcaacatatattgtaataaatgattagtaatttgtaccaaatagtgagatgcttggaaattaatgtgaacatattttgttgcatatattatttcttaagattaatatcaagctaataatgttaatcatagtaaattaaatataggttctgatgatactcttaatgtctacacagggtatttatttatgtatttatttttgagatagagccctgctgtgtcacccaggctggagtgcagtggcttgatctctgctgactgaatcctctgccttcccggttcaagtggttcccctgcctcagcccccaaatagctgggattataggcgtgtgccaccatgcctggctattttttgtatttttagtaaagaaagggatttgccatgttggccaggctggtcttgaactcccgacatctggtgatacacccacctcagcttcccaaagtgctagaattacaggtgtgagccaccacgcctagccaagatggtatttcttaatgtattttaataatcaatatacatttcttcatgaagaaatgtcttctaattgtataatcttcctttgtgtactgcaacattcttttcccaaaatgaagaagtcaaatcataaaattgtatagtatatacatttgtaaaattaataaccataagagaaaaataatatagcttcctattatggaaacctactctgtgctaaatgctttatataactaatcatcaataactaaatcatttacattttacagatcatgacttgggagactggggagattaaatgacttatttaagttaaagggacaatctgaaacagagcttttattaaaaatccaggctgccagatgttaaaacacatccaaaaaggggcttattgttactacttattttcctcaactctgagacaagaagggaaattctactgggcagtaaatgagggggaaaaaaaacagaaacatatttcacaccattaaaaccgactgtaaaatctacaaatagtcaaaattatagatgaaatgcaatatatgataaagaagttatccctcctaataggagagtcatacagaaaatcatagagtttcatacattcttcatggaatatacatgagcaaaccccaaatgaagaagatattcataataataaaaaaatgagcactagtcatagatgaaaatgtggataaattttactctaatgtgagagtgagcaaacctttcctaactatggctcaaagtcaagaagtcaggaagaaaaagagataagtttaactatattgcaaaattgcatggtgagacacaatgaacaaagtaaaaccacaagtgacaaactgagaaaacatttgaaatttatgtcgagacggccgggcgcggtggctcacgcctgtaatcccggcactttgggaggccgagacgggcggatcacgaggtcaggagatccagaccatcttgcctgacacagtgaaagcccgcctctactaaaaaaaatacaaaaaattagccagcctggtggcgggcgcctgtagtcccagctacttgggaggctgaggcaggaaaatggcgtgaacccgggaggcggagcttgcagtgagctgagatcgtaccactgcactacagcctgggctacagagtgagactccgtctcagaaaaaaaaaaaaaaaaaaaaaaaagagaaatttatgtccagacaaaatgttcatatcccgaatatatatatataggtttataaattagctaaaaatagggccagtgagggatttaaaaagtgtggggctggctcggcgcagtggctcacgtctgtaatcctagcactttgggaggctgaggtgggcagatcatctgaggttaggagttcgagaccagcctggccaacatggtgaaaacctgtccctactaaaaatacaaaaattagctgggcgtgatggcgcacgcctgtaatcccagctactcgggaggctgagaaaggagaatcacttgaacccgggagacatggaggttgcgtgagctgagattgtgccactgcactccagcctgtgcgacagagccaaactccgtcacaaaacaaaacaaaatgttcggggctagagaaaaaactgttcacagaaagagaaaggcaaatgactctagatcataagcaaagataagcaaagatgcttatctcgatacataagaagaaaactacaaattattcctacattaagatttcattagtcacttagattagcagttgtcccagttggagactgtactctgttggcgagcctgcaggaaaacagacactttggacactggtggtgttaatacaagtgttgtaaaatttatgaaggagagtatgacataagctaccaaaataatattaatgtttactttttgacccatacatcccacatctggacattttcccatttataataacggaagataaatgaccacctaaatatacatcaatagtggtctgggtaaataaatggtgatacatcctaaagcagatgataattcaaatgtaatgataaatgatagatatctttagctattactatggagttattttcagctatattaagtaaaaaaaagcaatttggaaacaagggcctataatatgctaacctttaagaagaatacacatgcatatttacaaaggaatacatacacacatttaaaaatcgaagatagactgtaacataaaaaattgttacttatgagaaagagagggaacacgtggagaggataaacactgaaactaaatttcattacccatatcaagttttttacattttagagctacatatgttatatattattataaaactaattaaattcaaggacttctctaaaaataaaataaaataattcaatctaaatgtatatttagttgttggcacaagcacaaacaaaaagaactaccccaggtgaattttaaaagtagtactgacatcacacccacagtgtaatataggtgaagtaccagagaaattacaaaactcaaaaagttaagctatctacagtaatcatattggtggtatgttgtgattccaagatagttataggagtattttacaataaataagcacattattatgtgtcattctgattctattcttttcagtattgaaagctggattcttggcaggggatgataaagagatagaaattaaaaattaaagaggtaaaatagaacacctatggttttgattttgaattggcagtggaagtttaaactcaggttgtagtttatcttaagaaacaaaatgcatacaacacagctctgaatgctgaaacacagaactatatataatggccaatatagaagcgatgaatatttctaatgttcagactatggttttgaaatactatttaccaataaaagcacttaagatttctgagagagagagctgatttcaggtccagggcagaaaatcaacaaatagctgtgaaacatctgctcacactaagtagcaagaaagaattccgagactactaaactgatttgaaaagttttcaagagccaaaaggcttttttttgtttttttgttttttaagctaaagataagacaatttgagcatcaataaggatcatatcagtaatgatttgaaacagatcaaatatgtttaaattcataagtttacgagtgttgcaaaataacgtattgatcacttttggagcatgctagagaaatattttgtaaattagaaaataagaaaacagagcatgctttttccatatgagcttaacatggggtaaacaaataattgattaaaaagtgtctcattaagaaactatttcagctaataatttaagaagagtaatagtatcagagtgccatcattttacaacccctcataaatgaatggatcatggcattgagcactaaatgctgctaatatcacaaaaaaagagataaagccacatacataccactcaatagaagaattaattcaacatcatctgctatggcctgagttgtccccctcaccattaacaattttatgttgaagcccttactcccaatgtgaccattatagagagatagacccttttaagaaggtaatcagattaaatgagtctatatgggtgggctcttaaatctgatgggactggtgttctctttgtctctctttctttctatctcttccctctctctctgtccaagggcacacagaggaaaggccatgtgaagacacaagaaagcagctggagaagcttcatcaaataccaaccatgaaagcaccttgatctcaggcctccagaactgtgagaaaacacctttctgttgcttaagctactcagtctagggtgtttcttaatggtagtgcaagcagactattataccacctatgaaacagttttgagaaaacccaacaaagaaacaaacaaaatatgttatttgattaagtgtcaaaatttataggaaacatgggacagagtaacatgtaaaattaaaccaaggaaagtacaatcaagatgacgagaaactctataatataaacaacttgacttctcaataaatgaatcacaagaaaacaatttaaaaataaatggaaagagaaccactgtagattaaaagagacttagggctgggcgcagtggctcacgcctgtaatcccagcactttgggaggccgaggcgggaggatcacaaggtcaggagatcgagaccatcctggctaacatggtgaaaccctgtctctactaaaaaaaaaaaaaaaaaacaaaaaaaaaacaaaaaattagccgggcgtggtggtgggcacctgtagtcccagctactggggaggttgaggcaggagaatggcgtgaaccaaggaggctgagcttgcagtgagctgagattgtgccactgcactccagcctgggtgacagagcgagactttgtctcaaaaaaaaaaaaaaaaaaaaggagacttaggagaggctgggcgtggtggctcatgcctgtaatctcagcactctgggaggccgagacgggcagatcaccaggtcaggagatcgagaccatcctggctaacacggtgacaccccatctctactaaaaatacaaaaaaaaattagccaggcttggtggcgggtgactgtagtcccagctactcgggaggctgaggcaggagaatggtgcgaacctgggaggtggagcttgcagtgagccaagatcccgccactgcactccagcttgggtaacagaacaagactccatctcaaaaaaaaaaaaaaaaaaaaaaaagagacttaggagaattatcaatcccaacgtgtgaacttacatgaattctggtccccttgcatctctccctttccgagaaaaacaaaaacaaaaaaacagaaaagaaactaaaaaacaaaaataatatttgtgagaaagtgaaaataaacactgactgatatttaatattaaataaggattgttatactttttatttgtgctatgatattgtcagaatgctctaaaaatagttattttataagcataaattcaaatatttgtggattaaaattatatattttttcaaaataatgaggaaaaaaattgatagacatatatattttaataagtttggccaagtcttcataattcttgaaactaagtgatgccaaatggtgattttatttactatctcttattttatatatttttaaataagagttttcaaaaatgcaatataatttatcatttgctttggtttgcttttaccctagctttcatcagcatagaatggagcagggctcctggaagaatgaacccaaaatggtgaagataattgaataatagccgctgagctgggaaagattttcatttcccagagagtaatacttactagctgttaactagttactacggtgaaaatgttataatctctttatttgtaaatgatctatctcatctaagtttcaaaacaatcttatgggaaagatatttattgcttgatctgtgaagaaaccaacactcacagaagttaagtaaaatattctgaactctcacggctagtaaatgactaggtcagaagtcaaggtatctaaattcagagtgtaaactctttcctgttatgctatatagcctgagttcagtgaattagacactttggcttcatcggccatctgtttctggaaggttggtttttagacatccttacagaatatcaactcaacaagagtataactagcaattaaaaaatacatctccttagcactttgggaggccgagacgggcggatcacgaggtcaggagatcgagaccatcctggctaacacggtgaaaccccgtctctactaaaaatacaaaaaattagccgggcgtggtggcgggcgcctgtagtcctagctactccggaggctgacgcaggagaatggagtgaacccaggaggcggagcttgcagtgagccgagatcgcgccactgcactccagcctgggcgacagagcgagactccgtctcaaaataaataaataaataaataaataaataaataaataaataaataagtaaaataaatacatctccttggacaaagagtaaaaccaagtgaaatttatttccctgcatttcttaaaagtgtaatgcttttccagcgaggactaagaacacttaatgtttgtgctttcattatacacaatgtttacagtcaacctaaagctgttctttagaaacaaaaaattagccgggcgaggttgtgggcacctgtagtcccacctactggggaggttctttagaaacagctttgattgcctaaatttagatgtaaaattgataactatgtttattatcacaattataaataatacggtgaatttcagcattataattattagagccaacataattagtggttgccaaaacatttattttaatttttatatatgctaagaaaattctacgtttttcactttttcagtattatagaggaaatggcaacctaaattaatcccttggtgaaaagtttacaattttgaagattacgggttttctgtaggataaagaaaaaatgctacacaattatcttcatatatttaaaatgtagaattttaattacacgtgttgatcaagatagtatcaccatgactaagatagtaagcctatccataattgccagaaatttccttatgacaatgtctcctttctctccccattcatatttctcaccctatgcaaacactgatcactttctgtctgtcagcataataggaatgggatcatttatatagtatgtattcttttttttttttttaattttgagaaagagttttgctcttttttctagtctggagtgcaatggtgctgtcttggctcactccaacttctgcctcctgagttgaagcaattctcccgcctcaacccccagagtagctgggattacaggtgcccaccaccacgcccagctaatttttgtatttgtagtagagacggggtttcaccatgttggccaggctggtttcgaactcctgccctcaggtgatccactggcctcggcctcccaatgtgctgggattacaggcatgagccaccctgcctggccttacagtatatattcttttcgtaggtgtgtctggcttctttcaattagcataatgattttgaagtccatgttgtttcatttatcaatagtttatttatttctattgcctaggtgttattctattgtatggatatgctacaactcatttatctattcatacattgatgaacacttgagttgcctccagccacaaataaagatgctatgaactttcctgtatacctctctgaatgaatctatgctttcatttatcttgagcaaatatctaggagtggaatggctaggccatatgatatgtctatgtctaaatgttttattaagaatttttgggcagggaacaagtctgttaattttcagttacgtataggtttgtgtagtcaataccacaatcgggatatagaatggttttatgatcaaataactactttgtgttttccttccccaaagttaaatctttagcaatgactgatttgttcatcaccaccgtactttcatctttttgagaatgacatttagatggaattgtgtagtataaagatttggagactggcttctttcaactcagtataaagcattagagattcctccaagttgctgtgtatcaataatattatattttcattgttgagtaatgtttaacttttaaagaaattgccaaattatttttccaatgtgtctgtaccattttacattcttaccagcaatgtatgagcatttcagatcttccacattttcaccaacacttgatattgtcagtcatttaaattttggccattctggtgtgtatgtagtgatattcattgaggtattaatttgcatttcccaattagctaatgacattgagcaacttttcatattcttattttgtttataaatctgtaataatttgttaaaactttctgccattttataattgtctcatttttattaaattgtgttttcatatattccccaaacaagtcacttgttggatacatttcgcaaatacattctccttttctgtcagttctttttcagtctattgtcagtgccttttgaaaagcaaatgcgtttttactttgatgaagtcaaattttaaattttttcttttatagatttgcatttgttacatttaagaaattgttgccagccgggcacagtggctcacgcctgttatcccagcactttcgaaggctgaggtggggggatcacctgaggtcgggagtttgaaaccagcctgaccaacatggagaaaccccgtctctactaaaaatagagaatcagccaggcatggtggcacttgcctgtaatctaggtactcgagaggctgagggaggagaattgcttgaatctgggaggtggaggttgtggtgagccgagattgtgccgttgcactccagcctgggcaacaaaactacgtctcaaaaaaaaaaaaaaaaaaaagagaaattgttgccaaccctaaggtcataaaaatctttaccaatattatcttttagatgctttatagttttagctcttacattatgtatagaaagtctttcaagttggtttctatagatagtgtgaggtacggattgaagtttatttgtttacatatggctgtccaattgttctgcaatgttggttgtaaagattaacttttccttcttttaattgtcttttgcttcatattatttttgaagtgtttataccttaacagttttttctcatagctgtatttgcctatcatttattagcataatacttctgattccctacatatagtaaattgaaggaaatgtggatgcctgacctaaactatataattaccacttaatctttcaataatttttatttagagcaaagaatcagaagatggatgtacaatctgtaccacaaaaataatgggcatctagaggaaaggccctctaatccctcatcttgaaattcctgtttctgcttcttaaaatgttattgtttttgacagttccttgaattctggaagaaaacaaagtcctttcaataaatttccttaaacgccaagatgaacttaagttcacctctgtattttttacccaaagaggcccattcaggaaaacatttgtttttaatgcttcatacatttgaaaatgcacatctaatatacttcaaaggagcactacctcaaaaaatacagtatcaaatttttcccttcaccactgaaaatgtttatctttacatataaaattagtaagctgattaacacagaaataaaagagaacactgtcttctgggtgccatgaagatgtgtggtaattcctcagattttgacattgtagatatatagaaattatagtcagtttcaataaaacactgctaatgaaaacacccacaatttcctttggtagaacaaaaacaattataacatgtaacttatctctccaggtaatttttttgtgaaaaccttttaatgaaccatgaatgctggataccctgcagaagccaaggtattgaaatgtaaaaacattgtacgagaatagaaacacatgtctaagttcaaggtccctacagaatcccttatttatcccacttagaaaatgtaatataaactctatttagcaaagcttaattcatctaaaaatatagctgcttctgaaccatctctgaagctctgggttttatttctttttagtcattcccttatttgatcttgggattaattatattaatattccattcctctgacattaaattcacctgctaccccttttacataactaaaattttgttgataattttaaccattattttcatctatgccctaacaacacatttgtttttgtatcaagttatccctaggttcaaacatatattagaaaaattacctctaatttctcattattttcttccattaattttaactttagcactttttcttttcagctaatatgttctcttagtgcattctttgataattctaaatgcaaaaagtaaactacctttgtcctgcttttacagcttccaaaaatcattagttctaaatctgtctcctttgcaaaacttctttttcagctacttgttataaataacgaacttcattttcttatcgaaaatgtttttaataactgtgtaatagccaccaaaataatttaaatccatttttacatattattagggaaaactaaaattcttatcttagtagccaatatctcaacttcaaaaaatctttaccaaagattttattgggttgcttttcctatgcatatttatgacaatgcttctgattgtatagttcaggtatacctacactagaaagaccgagttcttgtcccagatcttctgaatcagaagctctgaaaagggaggtcaagagaatgcactttgaacaatctcactgaattcttgtatcctttaaagtttgaaaaccacctcttcatggtacatgatacgttcatatctgttatttaaacataaaaataattacaaaattcagaaactatgttattactaatagaaccaacattttttctgactacgtagattcaaatccccaagttactttcactagccagttctctacacattttccaagtgattcttccttaccttagaacgtctctctgatgtgttcctttttcatagtcctaatctcttaccttacttagacccttgtcatttcatacttgtaccacggtgatagcctcctaatatcttctgacattccattcccttataatcactgaaggaaactttctaaaacgctacttttattgcccaattatctagacaaaattttatctattgtgtactggggtaacccctaaaatagaattgagaataaaaggtataaatttatttttctttatgattgattcaatttacatatagtgaaatgcacagatcttaagctttaacgttttaggggcatagacccatgctattaccactcctattcaaactttatatttatttttaaataaaataatacaaaagtaaacttagctaatgctttatatactgactgacactgtgtctctgtatgttttagggacaagcaaggaatcttgagggagatgtgacaagtgtacagtgtgaagggataagcagcagtgtattattcagagttctttagagaaacaaaacaaataggctataaggacatattagtactgacagtgagaaagaaagagagagagagagggattgattctgtcaatcaattggctgattgattatgcaaatttgttgttttagtccattttcacactggtgaaaagacatacccaagactgggcaatttacaaaggaaaaaggtttaattggacttacagttccacgtggctggagcctcacactcatggtggaaggcaaggaaaagcacgtcacttcttacatggatggcagcaggcaaagagagagagagcttctgcaggggaactctgctttttaaaaccatcatatctcgtgagattattcactgtcatgagaacagcaacggaaagacttgccaccattattcagttatctcccacatggtccctcccacaacatgtgggaatttaagatgagatctatggccaggcatggtggctcatgcctataatcccagcactttgggaggctgaggcaggcagatcacctgtgtcaggagttcgagaccagcatgcatagcatagtgagatcccatctctaggtgagatttgggtgagacacagccaaaccatatcattctgcacttgacctctcccaaatctcacatcctcacatttcaaaacaattcatgccttctcaatagtcctccaaagtgttaacccatttcagcattaactcaaaagtccacagtccaaagtctcaccagagacaaggcaagttccttccacctatgcatctgtaaaatcaaaagcaggctagttactttctagatagagtggggatacgggcattggataaatacagccattccaaatgggagaaattggccaaaacgaagggtctacaggcccccaagtccaaaatccagcaggaaagtcaaatcttaaagctctgaaatgatctcctttgactccatgtctcacatccaggtcacactgatgtaagtggtgggcttccacagccttggacaactccacccctgttgctttgcagagtgtagccccctcctggctgctttcatgggctggggtcgggtgtctgtagtttttccagaggtactgtgtaagctgttggtggatctaccattctggggtctgtaaaatggtggccctcttctcacagctccactaggtggtgccccagtagggactcagtgtgggggctctgaccccaagtttccctcctgcactgcactagtggaggttcttcatgagatccctgcccctgaagcaaacttctgccttaacatacaaggcatttccacacatcttctgaaatctaggtggagcttcccaaacctcaattcttgacttctgagcactcacaggctcaatactttgtggaagctgctgaagcttggggcttacaccctctgaagcagggcctgagctctatgttggcccctttcagccacagctggagcagctaggacacagggcaacaagtcccaaggctgcacaagcatggggatcctgggcccagcccacagaaccatcttttctccccaggcctccaggctggtggtgggaggggctgtcatgaagacctctgaaatgtcctggagacgtttttcccattatctacaggattaacatacagctcctcgttacttatgcaaatttctgcagccagcttgaatttctcctcaaaaaatgagattttcttttctatcaaattatcaggctgtaaatattctgaacttttatgctctgtttccctaataaaactgaatgcctttaacagcacccaagtcacctcttgaatgcttttgctacttagaaatttcttccaccagataacctcaatcatctctcaagttcaaagttccacaaatatctaaggcaggggcaaaatgctgccagtctttttgctaaaacataacaagagtcacctttgctccagttaccaacaagttcctcatctctatctgagaccacctcagcctggttttcatcattaatatcattatcagcattttggtcaaagccattcggtaagtctctagagagttccaaactttctcgcatcttcctatcttctacagagccctgcaaactgttccaatctctgcctgttacccagttccaaagtcgtttctgcatttttgggtctcttttcagcaacaccccactcctgttaccaatttactgtattagttcattttcacacagctgataaagacataccagagactgggcaattttcaaaagaaaaaggtttaattggacttacagttccacgtggctgaggaagctttacaatcatggtggaaggcaaggaggagcaacccacatcttacatggatggcagcaggcaaagagagaacacttgtgcaggggaactcctctttttaaaaaaaaatcatcagatcttgtgagacttattcactatcacaataacaacacaggaaagacttggccccattattcaattacctcccaccttgtccctcccacaacacataggaattcaaaatgagatttgggtggtgacacagccaagcgatatcatttgttatgaatgctaagagcatctactctctgcaaattagagaaccagaaaaactggtggtgcattttttatcaggtccagaggcctaagaaccaggggagtcattggtataagtctcagaatctgaaagcctgagaactaagcactgtaatgtttgatggcaggagaagatggacgttccagttcaagaagagagaactcatccttcctctgcctttttgttctattcaggccctcaatggactggatgatacctgcccatattggtaagagcagatcttcttcactcagtcttctgattcaaatattagtctctttttgaaacactctcttagacagacccagaaataatgttttaccagctctttctacatgccttaaatcagtcaagctgtcaaataaaattaagcatcacaagcagccttctctcttgtctgtttgctttcaacacattgcagtgacttttagtttacatttggccagttaaagggatctgtattttataatattaattttacaccaaactaatgctcaaaaaaatgaataaatagctgagaaatatctctgcaaataaacctgagattaaaggtaacactaatgatatgtgtagaagtgaacaccaacagagatggaaaaatcccttcccattcctctgctaaaacagcttaatcagtcatgttattaggtcaaaaccgtggagatccaggcagaccggaaataaagtcagactgacaattttgatgtaattaatacaattatttataatgttgacttatatataatacaattaatcattttctatgtgatatatgaacattgaaaatttaatgactgataaaatacatgtataattcttaaatattagagtgtgtactcaaaaatattttttaattcatgggatgaaggatcataaaagttatgtattcattataaaatgtagctatcattaactaaatgatatggttttggctgtgtccccacccaaatctcatcttgaattgtaactcccacagtttctgaatctcatgggaggaagcttgtgggaggtaattgaatcatgaaggcgggtctttcctgtactcttctcgtgaaagtgaataagtctcacaagatctgatggtattaaaagtgggagtttccttcacaagctctcttttcttatattttgccatgtgagacatgccgttcaccttccgccatgattgtgaggccttcctgaacatgtggaactgtaaatccattaaacctctttcttttgtaaattatgtagtctcaggtatgtctttatcagcagcatgaaaacggaataatatactaacatacacacacaatcttgcctaaagttatttatgtcttaaagttcagagctccactttatgaaccctctcatctccttgaattacttgaattagatcaaagatggaaaacattttttgtttcctaacaagtaaaataatctttttttcccctcaccttaaatctgggcaggaattgtccttgctttgaccagtatatgatagtagattatttctactgattcagttctgggatcaggccttcagaagtttgatagctttcacttttgccttcttaaaaggcaggcatacatgcaattaaatggactattttaaataaattctataaagaacattttctttaaaaaataatttccaaaatgtagaagtacattaaaattagaagaagcattctagagaatggtaaggcatgaggaaaaatacaccttgggggatatatttaaggttatataatgtttgaaaaaaccacatgtgctcagctataagtgttcagttataagaacccagttgtgtagcacaaggatcatgaaacaaaagaaaatataaacaaaaaataagaaaacaaaaaaggaaacagaaaaatatggactctctgataactgtgaaatatgaaatacaaaatgaaatatggtaactgtgaaatatgaaatacacaatagaagaaatgttgggcccatgaacattttcatcccttctcaatgtgatatatgcattgaggaagggacaaaaaatgtgtttttctcttcacatttccaatatgagtatactgtatacttggccatgaaagtgctaatacttgataatacctaccacagttaatgaaggttgataaaaaaatttaaaccaaggtttctggctctagtatctccattcttaatcaatgggtgacaccaacattttagttgccagaatattcataatattattataatcatactttgaaaaattagaaaaaatactgttagcaatattatatttatgttttagtatgtaacatatatctcatctatatgatatttaatacatattacttttcacacattagctgctcatataagagtacttaatactacaagctactgttacaagctaaagtcagcagactttcttatattattagaaataaatacacattgtatgatatcattattaatgacagtgctgcaacagagcttgatagctgttaacatttacattaaaaatggtcagacttgataacacaattagaagcagaaatttcagctacatatatgattaaggggtctacagattatgcttttctttcagagaccttcatggcaggtttctccaccataggccttgagacttaggaggaaagaatggttttgtgggccaggaccacggctccactgccctgtgcaacctcaggacactgcttcctgcatccagccattccagctctagccatggctacatggcccccagatatgcctcaggcctctgcttcagagcatgcaagccatagccttggcagcttccatgtgatgttaaacctgtggacacacagagggcaatggttgaggcttggaagcctccacttacatttcaaaggatgtatggaaatgtctggatgtccaggcagaaatctgctgcaggggtggagccctcatggaacacctctaccagggcagtgtggaagggaaatgtgaggtgggagcccccacacagagttcccactggggcactgcctattggagctgtgagaagaaggcaactattctccagaccccagaatggtagatccactgacagcttgcaatgtgcacctggaaaaggcacaagcaccaaacaccagcccatgaaatcagccaatggggctgtactgtgcaaagccacagaggcagaaatacccaaggccttgggagcccaccccctgcatcagtgtggcctggatatgagacatgaagtcaaaggagattattttggagatttaagatttaatgactgccctcctgggttttggacttccatggggactgtagaccctttgctttggctgatttctccttttttggaatgggtgtattcacccaaagcctgtacccccattgtatcttgtaagttttttcaggctcataggcggaagggacttgccttgtctcagatgagattttggactgtggacttctcagttaattctgaaatcagttaagacttggggaactgttgagaaaggatgattgtattttgcaatgtgagaatgacatgagatttcagaggaaccaggggtttcatgatatggtttggatttgtttccccacccaaatctcatgttaaattgtaatctccaatgtaggaggagggacctggtaggaggtcattgaataatggggggaaatttcccccttgctgttctggtgacagtggtgtcagtgagtgagttctcatgagatctggttgtttaaaagtgtgtagtaccaccccttctctctcctgctctggccacgtaagatgcgccaacttccccttcagccatgattgaaagtttcctgaggcttctccagccatgcttcttgtacagcctgtagaactgtgagccacttaaacctatttttatttataaatcacccagtaacaggtagttatttatagcagtgcaagaacagactaacacagaagaggtattaaatattctctaatggtagaatttaccagtaaagcatctgatccagaattcttctttgtgggaagatctttttgattactaagtcagtctattaacttgttaaaagtctaccccaattttttattttttctgaagtcagtttgaatagtttgattccaggaatttgtccattgcatccatttgtctagttggcataaattgtatataatattccctcataacatttttttatttctctaagctaaatagaaggtcctctctttcattccaagttagtaaattgcatcttatctcttttattcctggtcagtctagctagaggtttgttaattttgttgatgatttcaaagaattgattttggcttcatttattatctctactgatttcctaatccctcttttattactttccactgtagtctctattatttctattgtgttgtttagctttctttctttttttttttttttttttttaaagagagtcacctccaatctcctccatcactcaggctggagtaaaatgatgtgatcgtagctcactgcagccctgcagccttgacttcccagacccaggtgattctcccaccttagcctcctgagtagctgaggccacaggtgcacaccactatgcccagctaattcttgtattttttgtagagacagggtttcgccatattgcccaggctggtctcaaactccaggtctcaagcaatccaactgtctcggcctcccaaaatgttggaattacatgtgtgagtcaccacagatggcctcccttctgctctttttctttagtttgcttaacatttccagtgtctttgtgacaaatattacattattgattagagattaaaatacatgttacaaagtattgttatttttatttgtctcaaagtatttttctgattttatttcttccatgagtcattgattaaagaatgtttaacttccatacacttgtgaatttccaaaatttccttcattataatttctaattgcattccatttttgtcagagaatagagtttgtattatttcaatcatcttcaatttaacgatattggttttatggcctaacatgatctatactgaagaacattctaggtgcacttgagaagaatgtgtattctgctgttagggggtagagtgttttgtagatatcttttaggtctagctgctttatggagttgttccatcttgaccttaagttactgcatttgcagagtttcaaggttagtcagagatgagagcttagggccttcccaagtgcttcctgagtatatatacagcttgcttttatctttttagaatcccagaaatatgttaaactttttaaaactccctatgaacatcattatctagcttttcctttaaagacttttggctagtcaataattctgccattgatgttcatgacagtagaaccattgaagaggttgacaacagcccttggatgacctcgtcatagacatcagcatccgtatcctcacatatagtaaacagagactgtctataacaaatggaagcaggagaggagtcgtccatgtggtaatttactgttagcttggagaaacacatatattcagaagtatttgtatggatttagggaaaattaagagttttgacaaagtacgtgaagtcagagtcatggatatccccttctgtgtgtgtgtgtgtgtgtgtgtgtgtgtgtgtgtgtgtgtgtgctgtgtctggtttttgtttttgtgtttccatttgtaccagactgatgtgacttaggtaacatgccttattttccttcctaatgctaataacaatgtcaactaaaatgtattgagcattaactttttttccaggcagcattatgtacatttacaatgtattggatcaaattctcacaacccttttgtacaaagatctatttttgttaatcctatattaaagaagaataatctggtcaggtagtggctcacgcctgtaatcccagaacttagggaggctaaggtgggaggatcgcttgaacccaggaagtcgaagcttcaatgagctatgattgtgccgctgcactccagtgcgggtgacagagcaagacactgtctcaaaagaagaaaataagaaggactaatttcaggtaaaggggggctaaataacttaaataaaattatgtctagtgtgagttaaagtcaggatttttaacatggacagtacaatttccagaggctacactctcaacccctacaattctcttccttctaaaaatgtaaatagtgtaaaaggatattattcatttaccttagctgtgacagcaaataattgtaagagtttatatctattgtttgggacaatccactatcctacggttgtaggctgatgaaactttccatcactgtgtcacttttctgttaaaattttttaattggctcctcatttcactcagagaaaaatacaaagtagataaataacatacaaggctctctagtttctgctctgttcttatctgtcacctttctacttttacctcactcacttctttccagtacttccggcccccttgttgtttctgaaacccacctggcaagcttcagttttgatctctgcctagaactcttcccggagatatcaacgagaataacttcctcagcttctgtaagcctttgctaacagcttaccttttgatgacacaagtgctgatgatactgcttaacactgcaacttctactacaatcctcctctgcttttccaatcccattcatatgatcgatttttcccatagcattcacaactttctaactttgataataaacacttacttattatagtaaatgtttattgcctatctcttctgccagaaaactggctccacaaagtcagtgataggggttgcttcacagggtaggtgatcgtttgttgagaaaaagaatgcacataacttttaaaagtgaaataaacttgaacaccaatgcatccaactggctctgagtatcataattatccaagtctgttattaaatttcatcctttggcttttgcacatgctgcattatctatatagataattgtctctctttttccacctggaaactcctgtctttctgctaaaatgacacttcctaagcaattctcataaaatgcttaatgctctcctctcatgagcctacatgtggttcaaactttatttagagtgccttaaatattgtattttaatttatcttttacgttgttttaatgttttttagccacagactccacgactccctaacctagaacattcatctctcatatttgtgtttttagcatctaataagagtgattgacatacagtcaagccttcagttaatgaaataaatgatgctttattatctacaccaagatctctatagacttaaaatagtttctgtttatgaaagttttttacaaatataaaagtctgagctctgcttatgatatttgtgtctttataaagaccaaaggcttgaaacagaattgcttgaattttctttacagacagcatttctaagaaggatacagtatgatatttgcaaatctaatatctgttggttgttgtgtatttgtatatgcacataggcttcaagtaagaggacagaaaggggttgagggctaatgctgaactccattaaagttatttttcaagcacacttcaaaagaagccctttctcccttaaaagatatatagcctgtctcacatgcatctgtctgtctagaggctatgcaaatcagcaacatccatatttcagcaaaagcaatctaagaagagcagcataatcaatttctcatcatttttgcttttgacacaattagtagtatatgcatagggatggattaggatggtttctgtggaatttttcaagaaaaatatttaccaaaggttaatatttcgtgttcccttgggctaatcgtgctctctcaccttttttttttaaatggctccaaaatagctctttttaaattcagtcatatattatcacaattatgtatagtaaccaaccaaaggtaaaacacgtgtaaaatgtttttcattttatattaaagctgaaagttggtgctagaggaagttttatatgataagttgatatgtagaaaaatactaatatgtaggttaatttcctaatattttgaattgctttgcttcttccataaaagttattcatttatcattctacacatttcagtccaacaaattgaggaagcaaatatcttgaattattatttttaaaatgtgtttatacacaaaagtaacaatcatgtcaaataataaactttgttatttaaaatatttccttggaattgagagaatttgttactgtaagattctagaataactgatagtgtaaaatgttatcagatacaaaccaacaaggatggaatagaggattcctggcctatctgatggcggttgaatattccggtcctgatcaatggcttggattggtggcgtaacaataatggggttcagttcttcctgaaaaaaaaattaagagagtttcattcagccgcattactaatacttcatgaaggattgagacagatgctttagtttggaaatctatataacgtctgagacagtaaactcaagtttcaacatttatgatctaataccttttactagttaattttgaatgttaagggggagcaaagtattctcaaagtcaaaatggtaagacatagtgattatgcacatagacatttatatcagtaactactcctaaaaggaaatcaaggaagaatgataatgcacttttaatcttctctagaggatttcacaaaagaaatagcagcctatcaaatagtttatgaagtaatgttttctctttgctttagacaagatttgtaagaatacttgtattctttccttgctaaatcattttttagtttcatacacatcaattatattaaaatataaataaagtaaataatttcataaaaataaaagtcacattattgcaaatttcatataattaaaattgattttaaatattgcaggtatttacatgtattttacaatggtctataagaaataatgtttaaaattataatatacttctttaatttggtgtttcccaatttaatgtccagtactattttgttgtgctatcaggactggcaaacatttttctgtaaagaaccagataataactatctttaggctttgccaaccatatggtctatgttgcagctaccctcaactctgtcattacagcaccaaagcccaagtgggcatggctctgttgcaataaaacattacaaaaacaggtggtaagttatatgaggttactgactactgtgatcataatagatatgctaaaaatacaacaataggtatgttgaaaaataataaaaagcttatctacacagatatgcttgggaaatatgatattaaatacagttttgaaagccaattaactgtactgcaaatcttttcagacttaattatgctaatctgcatactgactttctaagaaaagggtactatttgctcactttcaagaaacacccattaacctgtttttgaaatgatgcctttagaacacagtttgggaaacactactctaagttatgtagccctcatcccaaatatgtaagtggtaattctaaatgaaatacttctaaagggtaattctaaagggaaattccattacatatttgggctgagggctgtgaaacttaaactactgtttcccaaacatttagtatgtctcaatatctacaaccttacattctaaaaaattactgcaatgttctcatattatttcttctcaaatgacagaacattgaaatatgtaatgtacttttatacaaaaccagtagtttcagttctcagcaaaaatgtatagtgatggcatgctaaaaaaagagcaatgatattaaaacattatgtataatacttgattttatattgaagttataataaggataattattgaccaataatttaaacaccatagacattgtatggggtttctctcgagttcattatcactaataggtcctaagtagtctaaatgttatcagtattttcctgaaaataaagagttgttggtagtagcaacttactaatactctattctctcctttaaacgtggaatcagaaccacgaaaataccaaataaatatcaaaattactccattaaatccagaagattattgttcttaaaacgcaactctcactgaacttttcctcccatgctgcctctctctctctctctctcacacacacacacacacacacacacacacacacacactttcccaataatcaatttgcttggtatgcaatacctgtatttctccctaaactgaaaaaaaaatctgaagttctttgaaatatgtatgtttgagcacaggacttaagagttgacaagctctttctagtaatttcactgaggaatctgattgccatcagccaaagtcagcttatacttaagctgtatcactcctggttcatataattaaatctgcagtaatttttccaaaaccgaggctctatttggatcctgtaaaggcatttcaaatctgaggattttctgcagttccattctgcatctcatagtcagaaaaatattttcctaaacaatttttgctattataaaataagtaatttcttatctagaaattaaaataaaattgaatcttagcttttcgtttggaatgtaaaatgtaagcaaatcacaatatttgaggatatgttggctgatcaccttcatctatttatttctatagatttgctaagttacctacacataagcagttttagctttaattagtaatgtagtataaaatattctttctataatatatagaattgttgaaatgagcaacataatttatttacattgaattgttgtataagcaatgtaaaaactaaaagtaacacatcaaacaaaaccaagaggaagggagaaatgaaaattaaattcctcatcttacacatttgcctgtgattaaatatatatatatatatatagagtaagaactgaagaactaaaaagaaacaagtgtagtatttagaattatattaataattagaagatgaaaaactgtgagtatctcaggatactgagcatggaagtgagggtagatgggatagaaaatattttacataaagccatttggtactgtgtgactatgtcattaccatagcccgtactatttgttttaacattattaataaataaattatagtattgagaataaaagaaaataaactctcttgataaaggctttcacaagtttctgcaaatttaaaagaaatggtgtggtttaaataacttatcagaattgacattttatcttgtcctatagagactagcaacttattttacaatatttatttttccttctgctaccataaatgaaattgtcagataatctaggattaaaggtgaaaagaatgatttcttaactattatgtgtatgattacctctcaagtaaactgtgctccatgaagcttgaaatgtttaaatattattaatacatgacattaaagaatactaaaaattatgatttttaggatgaccttgttaaatatttaacatattttataaagatatgtagcattgaagtcagaggcagacaatttatatacattaattagaagaaacaacataaataacatgcattatgtttgaacttctgtctgccaacacaacctccacagtagatgaaaccaggcctggaaagggtattcatataagcaagaacaacccagattgaaatggttccttagaataagtgagaattttacagagagaacagaagtaaaataataataataatatgtacgtattcagttcaagtatttttttttaacaacagggtaaatccaaagaaaactgagtaaaaataaaatgaaaaaggaaaaaaaaaagtagtatatagtagtaaagtatccaatgctgatgaacaaaggaaacagataaaagaaatagtctttgattaccaagtgccagcatattactgtccttgaatttattgaaaaatagtatccttataatgaacctctttttccctaagttagtttcaggtcagttctctgactttaaacctagagtaccaatctaataaagggctaaagataagagaataacagatggtgtgttggctctcttagagacatttacttaaacttctaaattctgttatttattttcttttgctttttttttttttttttttttttgagacagagtatcgctctgttgcccaggctggagtgcagtggcgcgatcccggctcactgcaagctccgcctcccgggttcacgccattctcctgcctcagcctcccgagtagctgggactacaggcgcccgccaccacgcccggctaatattttgtatttttaggagagacggggtttcaccgtgttggccaggatggtctggatctcttgacctcgtgattcacccgccttggcctcccaaagtgctgggattacaggagtgagccaccgcgcctggccaattctgttattttcattgaacacagttacagctctatgaagagaacagaattattcttgcccatgaattgaaataatgtaatcatttacaggatttagcaaatagcagatatttaacataattttgccaacttattctgttgagttatccaaagagatcactactctctggtcaactttgtaatatccactagcagaaaatagtccatctgtggctactgccaggtcttccacagttccaaaaaggagattgattcagtgacttgtttcttctgaagaacagagtctcttcacatagacaataattgctgttgcttattctctgtcgtcctcatttctcctagtttttgactttactgcctatattacagaggaagtacggtatgtgttgaagaaattagaagtccacccatagctcaaatatgcttgggtatcctttatggaaagtatcaaaatgttcctctattttattacaattgctatatttatctttttgccaaaagctttattggtctgtgggcagaaattatcttatttgtacttacaaccctcagcctagtgcctcacagatttcaacaaatttttgttatcaagtcaagaaacacagaaagagctccccaaaccctggatggttcttttatactttgcctctgaagcaaagctgctttctttgctgtctcatttgtcttcaagaagaggtcatgtctcctgaattctgttccagttgataagcatatattagaagcacacaggatagcagatttgcatttcattgctgtttgaactgtcagagctacattccctgtcttagtcatggggacacataagtaaagtgaattaggtccatataaagagattcataatgagaaggtaatcatagaaacgattaaacaataacaaaaaaagtcttctgtgaaaatactgtgtaattatatggtttaagaaccttaaaattattattttaattttaagaaccttaaaattattctattttgaatacatgcttcctattcattagcttttctggagacacaccttctcttttgagcaatgttaagacaatgttttcatgcagaactgttgtattattctgagaggataacagtagccaattaacatttgatgtgagtgagggttaattatgcctcatgaaacctcactaccagattgaaaatgaacttttggtctgaattctatttttatatatatatatatatatatatatatatatatatatatatatatatatatatatatacacacacacacatacatacatacacataatcattaataaaaatatattagcaagcaatcccaaaagattaagaagcctttttgtagatttaataaaatctcagctttctggtcatttaggtgttcatatggttatcttgaacaaaaggtatattcaagagaaacactcagatttcagagattggatacattcactgtttagcttatatcaggttaacagaagtcatgatccatagaacaataagatttaacctattatatcatccctaatgttaaatgcatacatgatgcctatgattttcactgtttcatgcatgggtaggttgtctttaaaataatatgaaaccagttcttacttttaaaatacttctcacttcaccaatgaaaaataatatctatcatttacacaagttgatgggtcagtaaacttaaaaaaatgacatttcgcagactgattattaaagcttccagccttggttgagatagacataatagaagcattgttaaaatactaaatattctcaacttggcatttgaatgatgtcttcatctgagtaacgtatacatagtagtatactgaatgtgcccaagtatttcaaattaactgaaggcattataattatcttcaagaaagaatatgttctgatacatccctggaaaggtaatctgagctcatataagtacacagtttgctgttataaaagccaaactttgatgtattatataatattccacttatcattgcttagatctttacactgtattttaatcaagtaataacatcatagtatttggagaaaggttatgctaaaatagtaaaaatatgctgtaagtattccaagaccaataattaagtgatttgaaatcttagtaactatataatttaatacctaagttattgaatttattatttagtacttaattactttcactaattttgtgtgttctttacatttaagtaggtgctttttcaatatctattaaagtcattaatatttaatttgtacacttcctttaacaacagaaaatttctactacatttaaggaaagtcagtgtcacgcctgtaatcccagcactttgggaggccaaggcgggcagatcacgaggtcagggatcgagatcatcctggctaacacggtgaaaccccttctgtactaaaaatacaaaaattagtggggcatggtggcgggcgcctgtagtcacagctactagggaggcataggcaggagaatggcgtgaacctgggaggcggagcttgcagtgagcagagtttgtgccactgcactccagtctgggcgacagagcaagactcagcgtcaaaaaaaaaagttagtgaacattattagtctcatttcatattacattgcaaatgtactattttcctcaaagctcttgattattttcagccagattcttgcttgtttccatgtgttactaacatagagaattagaacaaatcaaaaattttctcaaacacattcatatagacataaatacaattatatgttacctttagaggccaaacaaccatttctgttttcactttgcttagttttgcttttttcaagggtcagaaatatcagattgtttgaaaaagtatcagacatatcgaaatgtttttcctggtgagattattttaaaaaatagtaacgaattggggtgagtagtatgggccaagccaattactttgaactttttgtattgttatggaagaaacacaggttgaacattcacaaacctctttgaaactgattcactgcatatatcaaagttcctcaaatggttttgacaattattatccttagaacagaagagtgaagagcacatttgagataggtatataattatgattcatgaaaatcataacaattcatgcctgatcactggaatttcgtatcacatattaaaacaaaaactcacttagctaacagaaaatacccttgttttattatttccatgagcaaattttatgacccctccaatatcatactctttattctaccaagtatgtgtaaatttaccttgtataatgtgactgaatttgtttccaaaatgtgcatttcagtatcctctcaattgcatatttgaatacttttactgatacttcccttattttcaaaatacttccttgaatgtctttgtctttaaagtttgtttacctgggattatatgcctccttttctatggatcatcaaatgatttctagacaggcaataaaaaccttggctggtggtaacccggtaattattttccatgaataaataataaaagcctgtaacaaaatcttgttggtaacaaaaggttggtgacttgttccacgctgtccaagtgacaaagtctgaagcattactgcaatcaagttggctttgactatcaaaaatcgttttccacataactcaaacctgagaatatgcatttcacagatgttgtaaggaggatacatagatcacagaaatatttcttacaaccctttctcacattcttatccatttctataacaactattctggttcctacttctcacactgccacagggctaactcaaaatcttctggttattcacctccccttcattcccatcgtgcacatcaaaaatcctccaaacgattttgacaagcatgacccactctggaagtcagaggaaaggaagaaattgagcagacagagtttgctttaccatgaagataaggagacaatcttgggagaatttatttgttcataattttagtctcattaaatttggatgaatatttcaatgataataatgatatggttcccattgtgtgctctcatcaggtcaggagacgactgtttttgtgatgacttcaattcattgtcaaatcacaattctatctaggacctccttgttagcagggactgtgtgagcactccctaggtttttcaccctcaatctctccatataaggcctccacactcaataggaaggcaataaaacaaggacaacaaatatgaaacatatataacaaagtaggccttttttattgatttgattttggagaaataaaatctgattttgcattatcagatgcagtagtttggtaaaagaacatacatttttaatttagataaatgaagcaaagtaatgtacagttttcccaagtggttttatcattttatatttctaccgagtatatgtgtaataaatgtgaaagttcaaatcaatgggagaaaatggatttttaataaagaatgattaaatattggttatcaataaatagagaaaaaaattatgatagatattgactttaccaaataaagctttggaagattgccagataagtctttaccagatacatctttggtcgattgcttatgccaaataaatttttgtagaacaaaagtgaatgtatgagaaaaacacatgtattagaagtcaacatagtagaaaataaggtaaatgattacttaaaaatattgcaaatgcttgcttagcaatgatttaaaacaatcccaaaaattggaactgttgaaggcatgaggagatgtgggcttttatatctgtgatggaaataaaaagcaggttaagttcaaggaaaaaaaaaatgaaatctatcactaggtttgacaatatgtatagtatagattaaagcatttcaatttgagctttatcttacataaatattgagagatatgctcggagatgtgttgagaaggatattcattgtacaatatacaatttgctttttaaaagaataaatttcttattcaagtacaacctatgagataccttcataaatcaatagttcacagtctgatgaattatcacaatgttataattataaattccaggaaaaaaattgatattttcacaaggtctgacaatatatgtagcttaaacttcaggattgcactttgagcttcatcttacataaatattgagagggacatacgctcagagatgtgttgacaagaatattcactgcacaatatataatgtacttttaaaaataaatttcttattcaaatataagttatgagataccttcctaaatcattagatcacagtctgacaaattattacaaagttataattcattcatgtaatcacactgtgatcaagaaatagaatattgtcagtatctcagaaaaccacttattaaattatctactcataactacccctacttccatcctagagatggcctgatttgtaatatgaaagatttgttttacctgttttaaattttctataaattgaattacatagtataaaaccttttatatatggctttttaatcaattattatgtcttatatgatatgtatgagtgtaagattcttgcatataattaagtgcagtactagtatactcatattaatggttatactatcatccattagatgaatacatcatattttatatgttagttttttttcaactggcgatgaactttgtacttcttctagggtatgctgtgaggataatgctcttacgaacactcttgagtatgtcttcttactgatatgattgcatttgtgttaaatagaagaataaagttgcagagtatgtatacattctgataggctagattactgtcagttttctaacgtggttgtatggtttacattctatcacagagtaggagaattctaactctttcacatctttaccaatttcagtctcttaagattttagcaaagccagtgaatatgtattattatcttatagttgctttaacttgaattttgatgatgattaatggggttgaacaactgtttgatgatcttggacatttgtaaagtgctgttccatatctcttgcctattttagttgaattgtctgttttccttaatgattcacaagagttcttcatatattataattaagtcatttatcagcttaatgttttataaatattacaattcttatggcttatatttagaccctattagtgttatcttgtcaaagaaaagtttctaattttaatatagttttatttatccctttctctttccatatatacctggctatttcctctacctgtacacatatcctgaatgtatgaagtatagacaataattttccttatctatttccatagataaaatattgcactcatccacatcagaatttatgtaaactgagttggcttccctacaactttcttgagagcaaagtgaaggtctattttcttttatatctgtaggaccagacagtacatatggcacacggagactcaaaaactttgaataaagtgtttctttgttgtagattatttagagtatttttaggctcatacacacttgccttgctctctgaatttctgtaggacatctaaatacaaataatgatgttttttgagaatctatttataatttcaatatctttgagcttcctaaattgctgcatttaactacaggccaaaataatctggtcataagagtgaatcatatacacatataggggctcacagcgcttcattgagatggccttttggggtagtacaataaacaatgtcataaacattccaatagaatgaacggtgaactcctatgtcctacaacaaaatatgccaagcttgccaataagtagcaataaagcttttcgataaactagtctcttagagcttgaattatgattttcaaggtgagattaataatatctacattacttgcaccactgcactccagcctgggtgacagagcaagactctttctcaaaaaaaaaaagaaatatgtatatatatatatctacattgcatgattgatgtgaggatgcatgaaagaatatatatatatatatatatatatacacatacagtaaatgacattcttaatatgtggaaattattatagttagttttttaaattgataattttaatgcttttaaattgtgtaatctgggtgttaaaattgactccaagttataagctagggagaaaaaaattttcatttgaaactagaagcttaattgataccatgtcttacacatctgtctgaaaataggacagtgatatgaattttgaaagtttatttagaattccatagttgatcaaataattgaggaagtaaaaagggattatctatctctgctatttaacttgaagccaagcttcaaatgagaaacttatgaattaaattatttaaaaatcgtacttaaaaataagatagtctgccagagagttgaatattcacttaaaatagttatcttattttgatttatttaaaggtaacttcagtgaaattattttctatagactaagacatatcatacttttatatccaataataaattcattccctacatttttattgtaaagagttgaagtgaaatttcttaatttgttaacattcagatgaattatataaatgcattaagcagttggcaggtaccaagaactctactaactgctcaagcagtagaaaataaattagacacaaattctggagatatgaaaaagctcacagtatcagggatggggattcaaagtgcaggtaccacaagttaatttagaaaatgttttgttagggcatttctcaatacatggtaagagaaagctctgataaaaaaattcatgctgtcaagtattaaaggtgaattataaaaaataacaacaaacagacattcaagcatgtgtactttgatccaagtatcaaatgtgatactgctagtgaaaaatgatgttcttgtctctgataggagtgggaaaaaagagtaacaaaatatagtagaaaatcatctagagacattttgaggagagtttctaaatcgccttaaaaatggaggagtttaattttcataaactgagttgccaatgaaaaacttctataggtaaatagcaaaaatatttattgtcttggtgattaaaaaatgatcctagagtatctttaaaagtatagttcagagaagcaaaaatatttataaccctaccacccaatgattatcatttttaatatttaaggtattttgtatcagtatttgttatctatgtatatatattgcttgtctaattgtccgtatataaacacatgtaatattttaccatgttccatatttaattttgttgacattttcatctcatatcataacattggtcttcatcaataaatatgcatcaaaaacctatttttgcaatagctttccaaacccactaatgtcataatttataaaatgatatatttcctcttcagtagtgtgtaaaaaagtctaactgcagatgcttgtcaatagtgagggagatatacatctagagtgttgctagttaagcataaagtataattttaaatttctttggtcactagcataatttacttgatatatttgtgtcttgcctgttcatttactttgcctattttgctttgttttaatttgggcattttaaaattttatttccatggcatatgtgaatagcatagaaatcaacactttgtcaccagccttaaacatattttcagtttgttgtttgccttttagtgttgtttttgacatttaggaggttggtgtttttatttactcaaatatttccctttccttttggatttcaggctagatactttaaaccatctgaaaattatgtgaatatcaaattatctattttttttcaagtactatggcttttttatatgtaatgtttcaatccatcaagaaattgaatagtaaagacttaatactcaccaaattataggtggaattttaatctttatcatttataacagaaataaaactagattgaaaaactatattttcccattgtatcttaaatggatatcttatttatttatttatttgagacagagtctggctcagttacccaggcttgagtatgatggtgcagtctcacaacctccacctcatgggctcggaccatcctcccacttcagcaccagagtagtagctgggactacaggtgcatgccaccacatccggctttttttttttttgtattattggtttcaccattttgcccaggctggtctcgaacttctgagctcaagcaaaaggcccacctcagcctcccaaagtgctgggattacaggcatgagtgactgcacctggcctataaaatgtaatctcattgcaaaactcaatgatgccatgcttctataatatgctattacttttttttttttttttttttttttggagacagagtctcgctctgtcaaccagttgcccaggctagagggcagtggcgcaatctcggctcactgcaagctctgcctcccgggttcacgccattctcctgcttcagcctgtggagtagctgggactacaggcacccgccaccacgcccggctaattttttcgtatttttagtagagacagggtttcatcactttagccaggatggtctcgatctcctgacctcatgatccacttgcctcggcctctcaaagtgctgggattacaggcctgagccaccgcgcccggcttattacattttttaacacaggttttctctagtagaagagagccatgatatttaggattatggatatgtgtgaaagctagacatttaaaaagcacacaatgacttgaaatatggaattgggtatcaaataatctggatttacggaaaactagtcacaaaattcatggagataaacaagatggaatgccaaacaagaaaagaccatgtaattgcatttgttaaatgtctctaatgtgttccacatccacttcccaatctctctctcacacacacacaacccaacaaaactgctttccttgtaaataaaatttgagggttgaaaaccaacatgtatactttttgcattacacatgtactttaattatcattttaaattcctatattaagttaaaaatacatatttagattaattttattggtttaattctttttcttcaacagtcaattgacagacgtctttgagtacttttattctgaagataatatgaatccttgtatatatgagaatgatgtttcattcttaaataaaaatttgattgaattttaggttctctatttacaaactttttctttcaatgcactgcaagttctacctaatctttgctttctttatgctttcttctttaaccatctggtagaaatttgcttttatcctagaaataaatatagtttaccagggattttccaagtatttgtctgtgctttaactgtgattcataattaacacttttgatctgcaaacacaggttctttatataacccttgagtgtttttgtctttgtttttgtttttccttacagtatctttgttattgtacttgcttacttctcctggtttattaataaacacaaactaattacatttttatctggctctctgatcttcgttgctttattctcctagtcagttcgtctgtagtctggaagatttttcaaacatgtaagagcatactataaaatcgtagagagtgctttttttaaccaggctgatgcagacaaagtcttgcctctcaaattagtttctgtgaactccaccttttgctggtctataaaataaagagtaatcttaccttctttaccaagaggtttgtttattaactgtggaaatgcttgtaaaacacctactaccattgtcctatcaagttctaaaaaaatatttgttattattgtttagagtcgcagctttgctttctgcatcttaaatcctatctttctgtcttaaatctcttcagtttaattatttcatttttcttctgtatcaatatctttatttaactttcaatatcatcctatatattccattcttaattaaattttatttcttatccaaacttttaaaaataatttaatagtgtttcttttagtcaatcttattaaatatatgctcccccctgcctttttatcttcagtgtaaaatgctgctctaatgttgtggaatctttcaagggattcaagtgtgtttgaaactgtgtattaagcgatgatcactaccttgctgactgcaaagtttccatatttctgtggtggagaggtagaaatctctcctttatccctgtctacatctcttttccctctactgctgctttcttacactagtcttggcaaaaatcgtacttagaccccttgtttctagtgttgatgcaacttgtcatccctttttgctgtctccacaagtacatcaatagggccatgagtaaaactaatgcagatactagtagctgcctgacatttcaattcagacctactctatgtatttcaatccaaacctactttaggttaagagatggaaaatgacatcacagaagaggtgttagttaaaactatgttttcaaagattgatacttcgaggcaaagccttctcctctaacttttccagatagaataatattgattatcctcactattcccattaaaatatgctttcctctgcattagattattaatcagaactctcacattcttagttcatcatcatatattttatagcagtccagtccagaggaaagcatgctgccatcagagccagaacgaccaaggtcttcaaaactcttctccacaacttattcattatgtaaatatatctttctaaatatcaacgttgtaagtgtataatagtaacattaatttacaacgattcatatatcagattagaccaattaatcctatgtcattttaattatagaacttttctcaggatttttttttttaaagtaacattagacggccttgcagtgactgtcccagggaacattcaataaatattagttttataatttcttattattctatttatgtataaatttctttctgatctgtactatagttatattgaagagaatgtctatttctttcatgttagtgccttacttggtgcctgacacattgtagatactcgattgccacttattgaatcaaagaaccaaggtattgattgaattatgggagtaaaataattacaacatgttataaagctgggagataggaaaatccaaaagaagagatacattttggggaaaacaattacctagtaaattcgattgaggattgggtttactagagaaatatcattttaaattcacaattcagaactggagaaaatttaaaagagtaagaaacagaaaaaatgaataaaaataactttgttttgatattaattttcatatgttgattgaaccttcaatataggcgagaatattaaagttactgcattttcctacagtttttttgggtatattctatatggaatgaacacagtggtttttattgtcagaatattcaaatattactactaatagcactatctgtcactgatcacattcactagcacactgtagaccctacatgtacatcgagaatattgagaaatctgtgacaacagtgagttatatattttattgacttcctctagttctgtatcatccagcatagaggacacataatactttacaaaatatacccttgctgtatgaagtaccaacatttttagtttcatttacagaacaaattctgaactttgtctctgatataaattatgttatacagcagcatttaaaagagatattagtgattagtgatttctttttataaatgcaatgtgaactttagtaatattaaaataattttgtcaccttactatatttatattaaaatatgcatatggtaatgcttgctataaattaaatcatataaataactgttccttttacagctggtttgaaaacattcttttgctgtcttttaacgtagattttagatctcaaatactgtatttttaatttaatagaacacatggccatttaatactaggaagaaaaagagatgttaatgtcattttccaatagtatttaatctaatatgttaaaaattttaaacatatacagcatttgtgcattagctttaggaaaaatacactagcagtaattatattctttgcagaaacatttctgaaattaacaaaatgaggaatataagtaaaccatttttaggcattgaaaaggataaatttatcctaaaagatgttgatttcagactcaaaataccataaactctatctgtttcttggtatttaaaattgaataaagaataataacatcctcttattaccaagaggacctactgtctcaccccgtggttagtgtatgtgacttaagaagcaatgattagaatttgtagagatgatgcaagtctcacattgacaaaaagaaaatttagaaaacagcaatgctaaaaatagaaatgcacaccaggatatactagcaacataaagttttaatgctttacagagctcatataacctgaattttctgagaatacaagaggagcgaaaataaaggttcatttttttgatagatagtcttggtgggattatgtctgcctcactgaacagtataaaacatttggcagagcatgtataataaccaccaatagcatggttcccaattcactcttactcaactcccacagctagcatctgaatcacaaacagaatagaagcttcccagaactcaaccactggcaacatttaaatccctcagcatactgaaggaccttgggagattagggtctttttgtggaagggcaaactgaaacacttggttttaatgtttgaaattatcatgacctaaatttgttttcacacttctgttttgtccttgtagtagaggtgactactttaaccacagcagggtactgttgataactctggatgctgatgcctgtaaggcactgatagatgcttcataaatctttttcaaatgacattcttgatatttgcccaccgggtctctggaagcatctgctaaacttctcaatttgtcttcagaatttcaacgtaattttttttctttctcctttctgcattggcaacaatttatgtcttccacataggatgtacttctttcacactatgtggatatttttaaaagtgtaggtaccatcacactcgcatcagaagcatctgttaaagtaatcacactggtgggggtgaccccagaaagcacatattctcataacaccttacaagagctgtaggtaatttgtattttggacaaacatgtcagactttttttatgtacaaaaaagatgtatacaaactataaccttttaaccctttctgataagccttcctatatcctgacatcgatttccttcttttacttgtttctctctcagtactcttcaaaaagagaggtggtgaccagtgttggaagagatgaagcagatgcacatcacttcctttgggaacttgctgaaataattctttgcattgcattttcatttacattatgctgaccagttctcttcacttagaactttcttagttgttcttttgattcttactgttgaaaaccaagattatgctcttgtgatgaagtgttttcaaatatcaaaatctgaataattgggcagcccactttcagaatcttatcatgaagtttatgctgcaaaatgtcagtttaaattgaaatattcaaactagtagcaaggtaccaatgataagacatccacagacccaaaagttaactgaattcatatgctattttttgctgaacttatctaactggtagccatacacagcaataaataggctggcaattatgcatgggggaaaatggagtttcaagtgtgtagtatcatgtctataagaataatattaatgatagcctgaaagcccactcagatatctcacagagcctatactctgtaacttagctatcatatataatctgtcctggggatttacaaccctggcccaagaattaccaggcatctatgaaaatgcgacctagaacaccagttgccctagagaaaaagacgcctcagcataggtgcaaatttcatagatgttaaaacaaagctaacccttacaagaataacttaaactccttatatgaaataaacatctgataattgaccaggactgaatacagatgtaagaaaggggaagacctccccaaattccgagaatagtctccggaaggataccctcccagctatttggtggccatgccaccagcctgctcccactgtcttgtaagagcactgccacaataaaccacttgggaatcaggtgatgtctaagactcatctttgaagcgtatcctactgaagagaagaagttgcctctggagaagatggtcagctaggctcacctaagaccctggagtgcaatggcagaaaagataaaaaaaagcatttaatgatgatctgatgactaacaaagcaactaataaataagttaacttttaaaggtaaagatgaatcagatggtcagctttacttagaaatatttgagataggttgtcctaattaattaaccaacaaacacttattgagagaaagtgagtagattggaagtagactaacatttattgatactctacttgcatctggttctgtaggtttaattttcacaattctactgttatagaacctatcaaaagcttcaagtaataagtaatatagattgaatcagaatctgactttgaatactctgttttttggatcaatttgactttccaccattatatgtgtaaggctgctgtttcctcacattacctacctgtcctggctgattgtacctcctactattgtgtttcccattccttagtatctctggtttatttttcttattaaaataagccaaaactttccttttccaggtttttcattggttatttctttagccttccatttatatctcacatttcaactcaaattctccttccttagagaagcttcactgaccactctagttaccaaagaatgctgtcttcttaatagtatgtatcagtgcctgaaattttttgttgaaattttaatttcctgtcttcttacactgaaatgtaagctccctgaagcagtaaaataacaatgtctatatccctagtacataaaacattgtcctgcactaaaagtctttcttgttcatgccttcattcactttctcattctctctctctcgatagattagatagatagatagatagatagatagatagatagatagatactgagatagagatatagtgtgtatgtatctataactgatggactgatttttttaggtaatgttccttgtcaaggagttgaaaatataattgtaaagaaagtttaactaatatatgatacaactaacaattaaaacaatgtatagtatgtggaactcacctactgaattactgagaggacagagggttgcgttatgagggaatctgaggaatacagatatcacttcacatttcgtcagaatttcacagtttaacatatattttatttcatttgtgcctcataggagctgtgtgaaataaagagaattgtcttctttttttttttttttttgtcaaagaagtcaaatgacatctcaatccacaaatccagtggtaaggcaaggttccctaaagaagataaacttgctaaaaatactaccctcctttgtttatttttcagaaatttaaattgctactcttcattgagaaaattagagcaaatgatgagattttttaaatctgctactgtgagtacgtgtatgatatttgatgaagttagcttgctgaaggcatcatagatcaaatccctaaaacaagaaacattttgtggccttacatgtgtaggattggagggtgtatgcatacactttcagtatattctagaaatcagtgagctacagtgtgatgtcatacagatatatttggccactgaccaaaaataaaagcatgctatagaagcattcgtcttgaaacaatatacttgccaaactgtctttacattggaataagccaatatttttatattttatatgtgcaggcaatcaataaaaaattgctaaggaacagagtctctattcacagtcctctgcatggggcacggcccagtacacattaagttgacctactgcatgatgtccagtcagtattaaaagggcttaacgattaaaaaaaaatcagatgtttaacatgtaaaagataattaattggtacattcaaagtctctcattcttttttgggatcatcctctgtgcttgatttttacccaatatttcagagccatttctgccagtgatgaaaaactggagatgaggttgcttagacacagcaaatcctgtatagccaaagggaagctgaaggtcaaagagtgaattagattgatgtcttgttcttgttgaaaacagaatttatttgttttgctgacagagaaggaaaatataaacagtcaagaacgggaagacatattattttgctataaaatgaattcaagaggaaataacagatataaggaaaaacacagtgaatattattataggaataattcattagaatagagagacaatgaacttaaacacttgctaattctcctgctgaaatggatcaagtgattgcttcgactggagaaaaatcctaaactaacctaaatataaatgagtgctagaggacaggcagaatcacatcatgacacagacttaaaggcagagccagaagtacaataaagttaagacctgagctctccatataaaacaaaccttgtgtaacaagtgaaccacccaggtatgtctttaaatttatttttgaaacattagtttctgtccttaattattttctaataaaaataaaatcatttgataaaagaaatacaataataatatccaacgtgaataaagtctgaagactcagagggaaaatatttttttcaataactgtaatcatcgtatttctccaaaaatctcatttgcaaataatattgtgaaaaaaacaattttcgtgatataactcacaaggcagaagtctgatataaaacataaaatgtccttttgtttttcgttttgcatttatttcttatttcatcctgataaaaatgaatgcatgcagttttcaatatgagcaaataagtttttttccatatatcctttaaaactgtcttattcacttcgaatcttataaaatatattcatttaaattatatttatagaaaatcttcttgagaaattatgaaacttctaaatttgaggagatagtgacctaaattactttaaaggtaatcttgatcataatagaatgctgcagaagggctcaaagtttcacttttagaaagtaataaattgcatggcatttaacaggcctactctaaataagccacagccttgaaaagaaaattgctttagacactggtcctcttgccaatgtactgatttctattattagccaacatcttctaccggcccctgtctggggtcaccttaggtctagctgaagctgtatcctcagggccctgaatggattcagaatcagcatgcaacatgcttgtggtggcagtataaaacagtctacgtgagagaatggtccatgagagcaaaatcaatgtaaggataaatgaatgtagatgggatcaccaatcccaaatatgttacaagaagagagtgaacaaagtgacacggagactaagagaagataagaaaagaagtagaaagcaaacatagggtgagtattatggaatagttcttgagtaaaattcagtaactataaaattataattactatggctctatctgttaatgtagtgggctatttaataagccaaagcagcaaaaactagggcattactatggattagttctctgtgtgtttcctgaaacctagagaagattgtaggatataaactcaattgtgtcctagaaactcattttctatgttccagtcttgtaaattctacaaggttctagaaatctgtagtctaagaggcaataaacctaattatgaatatactaagacttagtcccttccaggaaaaagataaagaaaatactagtgaagattatttccttatgaaatgtaaacatggccttaatctagactaaaatacattttttcctaagaattttagggattaagatagattttctgtggtagtaacaggagcacagccgctaaatttatgccactagaagcaaggaagatcataggaaagatataacctgtcaactttgattcattttgagaaatcagtactcatgtaatgacggtaatggtatttatcgtatgtaaaataaaaccataataagcttttaaaatagtttaaggtacaaaagagtattttaaaaacaatgaatttgatctcttaaaatttattatagttttgtcacgagttttattagaagattttccatgtgttctttctgggagaaactatttaaaaagtccattaactttttctaaatgtttaattttttttttgagaaggaatctctctctgtcgcccccaatttttatttaacatgagttaccaaattagggtcactgcattcttattaactatgctagtttaaaaaaatttatagaaactttttaatgcttaaatatgccatcatatcactgccaacatttgtctctttttaatcaatatttaaagtaactatttccagtttttcattttaatgatttatatagtctttaaaaacattcataatggtttcagtggaagccatctctgtgttgatttttatgcttttatgtttctttctttttttgagacagagtcttgctctgtcacccaggcaagagtgcagtggcgcgatctcggctcactgcaacctccacctccccggttcaagcgattctccggcctcagcctcccaagtagctggaactactactactactacaggcatgcactagtagtagtactacgactactactactacaggcatgcaccatcacctctggctaatttttgtatttttagtagagacggggtttgggcattttggccaggctggtcttgaacacctgacctcaggtgatatgcccacgttggcctcccaaagtgtggggattacaggtgtgagccaccatgcccggcctgatttttatgcttttaaatggcttttggtctcattctttacagtaatgaccgctgttggtttgataatcaaccttcataatgttcaaacagtttatatttctgcacatattttctatttaaatactgacaagtattgtggtcttagtctcttagagacaaaataatcataaaatatttgttaggataaaaaactgttaggataaagacataaaaatgaagttttagaaggaaatgtagataactgtttgaaaatgtaaaatcagtgagaccttatttattgtaggataataaatagctattaaaaatatacagatttaacactacatgaaaatttaaacatttttataaaaaagctatcattaatatgatcaatggataaatgacagattttggaaaaatagcatttaccagaatgatttgtaatacctataataatactaatgaaaattaataataataatacttcaaatagataagaaaaagcatattgctaattgaaaaagacaaagttgttaataggcaaattacagatgagaaatacaaatgacctgtaagcatttggaaaaaaaaatgtttaggttcattagaatttttgggtgtagtggatgcaagtattaaaaataatgtattagatttgtacctgataacctgtaggaatttcctacaagtggtttttaaagtaaagcaagatacattaaaatgtgtatacaagtattctattcttaacacacatatgcatattacatctattttttataatataaagaattgaatgtcagagtacatatcagtgttggaggaagagaataaggaggaagcacagaaagtaaaaaggaaaaataggcaccaaaaaagatttggagaatggcagatggccaaggagatgcagctgggaagtgcctcttccatggagaggaacccaaatatccagtaaaccgtcacattttaaacagatcttttgagagaaaacactgaaagttgatacagaggtgacacagacaccatggttgaagagggaagaaatggggcagtctgctcagagtcactagacaccaggactggcccatataccttgaacaaacccaaggaaggggtgagtgaaggaaccctgggacactacatacccacaatgtacttctgagatcctagctacaggagtttctacgacccccatagatctttggactggtaggagagctgcctcgagcacatgcagaggcacagtttgaacccacaccgagcccagaaggctttgttgtgcggtgcagctgcagcaaaatgcaaccctaggtgcccatcccacaagtctccatttcatactgagtggctaagttcctgctatctgccaggctgggagtgaaccgtgcctggcctgctcacatgcccaagataggccccatcacccatgctgcgtgattaaggtacatctggtccacatgcccccttgcctgtcaacgccttcccagacctcatgcctgaccactcctgcaagagggtgtccacagcacaacatccactgcccagcttaagtgttttgttaacagcctgggagaagttcaccaccctgtccccaaatcatagccagtgcttaaagcttagaggccagaggacaaatcagtgagcccaggcccgtgagctcagtcccgtgagcccagtcccaactccccaagactccagtacaccacgcagggacattgagctgagatttgtgacctaatctcaagtgaaggaggaggatcctccacagtcagaatgcagagaagaatgtggtatgggttctcatggggcatgggagctggacacccctccctttgcaagaccagacaacgaaaggtatggcctgatggtcgtagctttttttccagggagtatcctggcacagaatgcctggagtagctcaacaatgtgggagcagatggcttggggaaagcctagttggttgggcttgccgccagggcgagtgtctgtgggagatctgctgggttaggggagtgtgagctaggcagacaccatggttgccagctgggctgaaaatcacgggctgcaagctccatactggtgttgcacccattgtggcactgccctgcctggagatcctctacccttgaaatactgcattttctttgtctctacacttgaaatactgtattttctttgtctcatgttgtgttttgagacagtacaactcatacctaagttgtgtatcacagcaactgcggacataccctaaaacctgctctgactttggtaagcacagtagactggtgggtctctggagagttgtgtccctagagatgtaatcctcagtgtggaccactcctgagggaaggggagtgcagcctgccaaagcacaccatgagataaagaaaatgtggccatggcatcagccactaaaagggtcaccaccaaggcccagaaccagacttggagaaggaatcatgtcttgcctccatctccacttcccagtgcactgttgcggatgcagcagtagctcttcccataaggtcctagaaagtgtgcactgaaagaagttgtttctcatgatgctccagtgaggacaagcatgcaccaagaccccacctgccagctcttactcttaaatctgtctaccagattgaagtttgaattatagcatcacataaaaatacattgctaaaacaagcaacatctatgaaagccactgcaggaacctatctctaaccaaggaacatatatagaaacttcacccctgcaactacccagaaatgaagccaatgaatcacatacaccacagtcatactttcaaggagaataaaaaatataaaagccctgtgatggttaatattgagtgtcaacttgattgtattaaaggatgcaaaatattgttcctgggtgtgttttgagagtgttgccaaaggagattaacatttgagtctggactaggagaggcagaaccactctcaatctgggtgggcaccatctaatcagctgccagcacagctaggataaagcaggcaggagaagacagaagagcagacttactgagtctcctggctttcatctttatcccatgctggatgcttccagttcttcagattttggacttttgtacttacaccagtggtttgccaggggctctcaggccttcagtcacagactgaaggctgcacatcagcttccctacttttgaggctttgggactcggactgccttccctgctcctcagcttgcagatggcctattgtgggactttaacttgtgattgtgtgagtcagtgatccttaataaactccccttcaaatgtacatctatcctactacttcagtacctatagagaactctgactaatacaaaccccatctaaatgaagcaaattcaaaaacaaagtatcaactcccgcagatggaaaggaataagcacaagaactctggcaatacaaaaagccagagtgttttgtggtctccaaagcctctcactagctccctagaaaaggatcctaaccagatgtaaatgtctgaaatgagagacatagaactcagaagatggatggcaaggaaagtcaatgagacataagataaaattgaaatccaatacaaagaagccagaaaaacagtccgaatttgaaagacaacatagctatattaagaaagagccaaactgaacttctggaactgaaaaattcactaaataaatttcgaaatacggttgggagtcttaaaaacagactaggccaagtagaaggaaaaaattcatagcttgaagactgattcttcaaattaacccagtcttgcaaaaataaagaaaaaatattttttaaaaagacaaagccttcaagaaatatgggattatgtaaagaaaccaattctacaacttattgatattcctgagagaaaagaaaaaataaccaacttggaaaacatacctgaggaaaaatttcaagaaaatattctcaattttgttagagatgttgacatgcatacatcagaaatccagagaaccccttttatatactataaagacagccatccccaagacacatagtcattagactatccaaggttaacacaaaagaaaaaacaaatctcagacacagctagagaaaagagcaacactacccacaaagggaaccccatcagactaactggtcttctcagaagaaaccttacaatccagcagagattagaggtctatttttagtactctaaaagaaaagacattccagaaaaaaacattcatattcttcaaaactaagcttcataaacgaaagagaaatggagtctttctgagtcaagcaatcggtaagggaatttatcaccaccagactagccctgcagaaatgcttaagggagttctaaatgtggatgtgaaagaacaatacacacaaaagcagagttaagtacatagtccacagactctataccacagactctataaagcaactacacaattgagactgcaaagaaactagctaacaaaactatggcaggaacaaaatctcacatataaaagttaaccttggacataaatggcctaaatccttcacttaaaagacatagagtggtgaattggaattaaaaaaaaaaaaaagaatcatccatctgctgtcttcaagagacccatctcataagtaatgacactcatgggttcaaagtaaagggatagagaaagattaatcatgcaaatggaaaacaaaaaagagcaggagtttctattctatcagaaaaaacagatcttaagcctaaaacagaaataaggacaaaaaatgttattgcttaatgacaaagggctcaattcaacaagaataattaactatcttaaataaatatgcacccaacattaattggagcaccaagattcataaagaaatcactactagacctaagaaaagatgtagacagcccctcagtaataactggggacttctacacccaactgacagtggtagatagatttatcgaggcagaaatctaaacaaataaattctggacttaaatttgacacttgaccaattaaacctaatacacatctacagaacactctacccaacaaaccacaaaatatatatttttctcatcttcacatggaacatactctaagagtgatcacatatgcagtcataaagcaagtgtcaagaaattaaaaaaaatattaaataataccaagcatcctcttggaccacagtagaataaaaataaaaatcaatagcaagaggaactctaaaacgcagacacaaacacacacacacacacatacacacacacacagaaactaaacaaattactcttgaatgactttcatttgggtaaacaagaaaattaaggcagaaatcaaagaactttttaaacaaatgaaaacagagacacaatgaacaaaaacctctgggatgcaacgatagcagtttaaagaggaaaaattatagtgctaaatacatcaaaaagacagaaatatatcaaattaacaacgtaacattgcacctaaagaaattaataaaacaagaaaaaaactatatccaaatatagcataagaaaataaataacaaaaataagaacaggactgaacaaaatcgagattcaaaaatccatacaaaggatcaacaaaatgaaaagttggttctttgaaagtttaaacaaaattgatagactgctagcaagattaacaaaaaagagaagatccaaataagcacaatcagcaataacaaaggcaacattagatccagtcccatagagattcaaaagattctcagagactactatgaacatttctatgtgcacaactagataacctaggagaaatggataccttcctggaaacacacaacctctcaagattgaaccaggaagaacttgaaacactgaacacaccaacaatgagttacagaattgaataagtaatagaagtccgggactagatgaattcatagctgaattctaccagacatacaaagaggagctcatgccaatcctactgaaactattccaaaaaatcgaggatgagagattcttctctaacttactgtacaaaacctatatcatcctgataccaaaatatggcaaatacacacacacaaaagaaaaccctaggccaatatatctgatgaacatagatgaaaaaatcctcaacaaagtacttgcaaaccacatccagcagcacatcaaaaagataatacaatatcaagtgaactttattcctgggatgcaagggttgttcaatatatgcaaatcaattaatgtgatttatcacataaagagaattaaaaatgaaaaaaataagattatctcaacagatacgttaaagtatttgataaaatccaacatgccttcataattaaaaccctcagtagactaggcatttaaagaacatactaaaataataagaaccatctattgacaaacccagtctacattatactaaataggcaaaagttggaggaattctcataagaacaagaacaaaacaagaatatccacttttaccactcttattcaacttaatacttgaagccctagccagaatgatcgaccaacagcaagaaataatagacatccaaataggaaaagaggaagttaaattttatttcttcactgatgataggattctatacctagaaaaccctaatgattctgaccaaagacgcctaaagttgattaaaaatttcagtaaagttttaagataggcaatcaacatacaaaaagcagtagtatttctatacaatgcaatgttcaaactgagaaccaaatcaagaacacaatcccatttatgagagccacaagagaaaaaaatgaaatacttaggaatacctctaaccaaggaggtgaaagatctctttaagtcgaactacaaaacactgctgaatgaaatcatagatgacacaaacaaatggaaaaatattacatgcttatagattggaagattcaacatcattaaaatgtctttactgcccgaagcaatctacaaattcaatgcagttcctatgaaactgccaaaatcattttttacacagaattagaaaattgattctaaaatttatatttaactaaaaaagagcctgaatagccaacacaatcttaagctaaaagaacacagacaggggcaacacattacctgacttcaacctatactacaaggctacaataaccaaaatagcatggtatgggtacaaaaatagacacatagaccaatggaacagaatagagaatccagaaatgaggcctcattcctacaaccaactgatctttaacataattgataaaaatgcaatagggaaaggataccctattcaattaatagtgctgggaaaactggctaaccatattcagaagaatgaaattaggctcctgtctctgaccatataaaaaaattaactcaagattgataaaagacttaaatgtaaaactttaaactataagaagcctagaattagacctaagaaactcttttggacattgacgtaggcaaagaatttatgactaagtactaaaacacaaaagcaacaaaaaacaaaaattgacaagtgagaccaaattaaactaaagagcttctgcacagcacttgcatgttctattgcaaatatgaaatagcaaaggcatggaatcaacattggtttccaacaatggtggattgtataaagaaactgtgatgcatatataccatggaatactatgcatccagaagaaagaatgaaatcctttcctttgcagtaacatggatgtgcctggatgccattatgctaagcagatgctgggacacaagaaaaatctttaagatatgtcactgcttcttatcaataataatgttctagtgagtaacaagagttaagaacaccactaattatagtactgtaaatataattacagttctaataagacatacacacacagagaacaattttgtctggtggttgaggaaatcttcattgatttaagatattttttgatgaacaggatttttcaataactatcagacgaagaatgtctatgacttatttttaaaaactattttcttctctgccttgcatatctgacattttcatctcctatcttccttgaatacaatatagaacctgacatttctttcctttcaaagatccttaaaacatttcctacatttaatctgaatgtctttctcagtaatttttcttatacaagcaattatggctacattttcttaatataatcatgaaaaagtgagcaactgaaaatttaatctggagaatatatatgaaacatattcaattaattcaagttgttgttaggctgcatatgttcagctttcagtgaaggtgattgataaatgagaaactgaaagaaaacaaaccaataggtgtttttcagaaacagtattattaaaatgcatgtgctttctactgaatgaaagcaatatagactttttcctcgcattggtagttagtaaggtgtataaaaacgactttgtaaagaacaattaatataggttaatgaatcactgtgaagaggggataacactttattctagcaatgatctgcaaggtgttaaaagttaaaaaagatgaaaaacaattgaatagttatttcatcatagtgtttattaaattgattttcctgtatctgtcaagctttacagaaatgtcttcaacagaataacagtgttggaagccaaatgaaatgcattatgaaatatgattcttcacttggtatgcaggtatactctcaggtgttaactcaggcaaagagacaaattcaattttaaagttccatttgttaaaatttgatgattgtgattaaagacccataacaattctatctttgacattttagttttttcttcacagaagcattctactgcaattttcttagttttctttcctcttaactgtggtattacccataaatgctggatttctctgttttaagtgtaacaaacctacaatcaactatttctggaacaccacttcatcttaacaacaaggacccataaatattctaaaaattcaaagtgttttatataaaatgttaaatgatacacataataaatttctaagtagtaattatgattatgcccataattatacccataatttaaaaatatgttacctgaagtaaattattacatattttatgttggaagtattcatttatctttgatctcttttaacacactgtactaggtggtaataaaataaactgccttattgggtagtcatttatcttttgtttcatattttttactggactaatattccaacgctatagatagtgaaatataacattcaaacaatttgatagtagtcaatgaatccagtttttaaaaatgggatccattttctaaaattgagtatatagatacttcatgaaatgtcttatcatacatcctaaaccaaaccaacctcttcccttgactgtcttacagtgcgttattattttatccactgcagcaactagcacatttttcagaacctagtagatattcagtcattgtctatggaatacatgaacacattctaaatttggacagtcatcattcttggtgttttaaaacaaacacttcctgaattgcacaaactattttctaaatagccctgggaattcattgaaggaaggtatgggtaagttgggggtcaaactataaagatgtaggttctcctctcaaaacttcttcagcgtatcctcattgttgtttgtttgcttgcttgcttgttttgaaagatctagatatagtctaatgagagttgtataaatgtgatgttccacaatgattctaacttacatggtgcaaaataataaaatattacattctagctgtttgtggaaaatcagggataatataaaggatctagattttctctctcctctcctcctaagatttattcactcagcaaagttacctggtgactacttactgctagacactgttttagatacttgggctataacgttgataagaacagggcttgaattagtgaaaagtttattttaattagctgtatggcaaaataggaaactaacaaaaataaacatataacatgtcagatggcaatggctgcactgagaaaaatgaaggagaataagaagttctaaattattatatatgaccaatattaccaacatattatagaaagaaatgagttcataatgtttatcagagaatttcatgaaaatcactaaatttttccagaaagccaggcactgataagggaataaacaaacagataaccgattttaatttgatcttctcttacaagtgcagctatgatctgccattgtatataatttaaattttaaaattgtttatatttctttcacataattatgttcttacattttgtttgtttgtttgttttgagacagagtgtcgctctgtcacctaggctgaagtacaatggtgcgatctcggctcactgcaacctccacctcccgggttcaagcgattctcctgctccagcctcctgagtagctgggactataagcaggagcccccacgcccggctaatttttgtactttattagagacagggtgtcaccaaattggcgaggctggtttcgaactcctgatctcagattatcagcctgtgcctcagcctccaatagatgctgggattacaggcgtgagccactgtgcctggccaatattcttacatttaaagatcagacatctatcagattcccttctccctgctacaaacattgtatacttttccataggcacaagattttgttttcattcaggttggactcaacaagtattatttagcagttcattgcatttatccatttacccaatagaggaagtataaaagatacagatgaataaagtgtaataattcttatactcactatttgcccttacatcatgtaagtgctcaactgtacaacatgtttgtgttcccaaaacctaactggaagggataactcagaaaaatagaataaaagtattgtatatctcatacatcttcattttagaatattgtaggggtacagatcagtataaataaaatactttggtaagtgcccaccacatcatctgtttgtcatccttagagccagattataccattctcattaagaaagaaaacttactactgtacctcctacccagtaacatatatatgatatatatatatcatatatatatattttatatataatatattatatatatatataaaacatttgctactggttaggagtaacactcagaaaatcatacttaataatgtagtacaattgggtataaattcacctagtatttttaaattttatgtatattcatatttatatgaatcatcatttaaaatcatgtctactgatcctgatggcattaaaggcataagaggtaccgaggatattaatttaattttgtttacagctatgcacagatatttttagttcactcagatttaatccagtagtctattatttgattaattgtacagctatcaaatcattcaggactcccactgtttcaacaagagtggaaaaatattttttcatttatgtttatatgcagctatttgtagtctaaattaatattctggcaattgatggtgaaattaaaattatttctgtcagatatggtaatttgatgacagtggataagcatgggagtaagagaaagttttgaggaagaggggtactttttgtttacttaatgattattcaaaagatgttaagtaaacattctatagaatgctacagatagtggaatacaacattgaaacaatttaataatgcagtcaatgaatccagtttttaaaaatgggatccgttttctaaaactgagcatacagacacttcatgagatgctttatcacgcatcctaaaccaaaccaactccttcccttgactgtcttacagtgcatagggtatctctacattctaggaaaggaattatctgtttatatgccacttataaaatcatacttaataatatagtacacttaggcataatttcacttagcatttttaaatgtaaaatgttaacgaaaagtgttcttgaaaaatatttctgagaatattttctaaaaaatgaacaaatcgtaacacctaagggatgatatctttctagtgaattgattatcagagtataatgtggtatgttctgattatgttacataatattctgattagcagaacattttaaataagtgaatttagcaaaatatttagaggttaaggaaactgttttacactgactatgttttctgacccaaatgtgagaaagaacccaataaaaagaggcagccagataatgctgttgtttgtgaacttaaacagaagcttgcatgtaatttattgttcaaagaaaaataaaaatagaagttatactttatttagaacttaatgacagtgaaaattacataaaaaggaagactactgaatacagcaaaagctgaaattatataggaaatataaatataaacacacaaaataagtgtaaattataatgaagtaaaaatatatcaaagagaaaaaaggaagtagtacagtaaaaaaaaaaaggtgatgctttaaaaactgtaattaaatagacaaatttccagccagattgatgaccaagtaaagagaaaaggaaggagacagatcaaaagacacaagatgatgaatgaaaagggggtcagcacttataaatgtagtagcaatgtaagccataatgagcacaagaaaacattatcaacttaattttgaatatataaaatagagacacttaaaaaaactgaacaaaaacaacttactagttttaaaagaaaaaaaagtcatcaaacatatatccttccaaaagtatagacttcaaaagtatagccccagatgggtgaacaacttcaaaagtacagtcccggatgggtgaacataaaccacactttaagcaagaactctcagttataactgcttgcaattttagaggataacagccacactcctgaaccagagcttggcaccggctattccctctggaacacccttttatttccttctctaagcaaagacatggaatcaatctaaatgcccaccagtggtctgcgggataaagaaaatatggtatataaacatcatggcatactatgcagctataaaaaagaacaagatcttgttctttgcagggatgtggatgtagttggaggccattatccttagcaaactaccacaggaaaagaagaccaaacactgcatgctctaactcataagtaggagctaaattatgagaacacatggacacatagagtgggggacagcacacactggggctttttggagggtggagagttggaggagggagaagacaaaaaaaataactaatggttactaggcttaataccggggtgatgaaataatctgtacaacaaaccaccatgatacgagtttacgtatgtaatgaacctgcacttgtacccctaaacttaaaagttaaaaatgaatgaagcctgtcagaaccacccactttgtagtcttacattttccctagtattcccaaacccctttgcctagtcaacattttacaaagcgcttttcatcttctactgtgttataatttatatatttttagtgtatattttacacactttattagaatatgagttccttcaaggtaaggactgttgtttgttttgtgctccctgatgtattttcagagcctagaacagggcctggaataaaataagcagccaacactatgcgatgaaaattttttggtgggtataaatgcctttgattcgaaacaaaactcagtttaattgtgtgtgtgtgtgtgtgtgtgtgtgtgtgtgtgtgtgtgtctaaagtcaccctaagcacactgttaataaccctagaatgactgacgtgttcgtattatgcaattttttatttttttcatcatattgacagataaaggattctaattcctataccttttcaataatgcagaagccttcataacatttaaattccattcatggtaaagattcttagcaaataaagaataaattgaaccttgatcaattactttaaagtagttataaaagacctatagtgaatatcatacttcagtattagaagctttctctttaaaataaggaacaagacaaataattggcaacatgacttcttttcaaattgcacagcattagggatccaagccataaaagaaaataaaagacatgtggatcataaagaaaatataaaacgttacttacagacaataaagttgtctgcataaagattataagagaaagctaaaaactattacagtcaaaaagagacatcagcaagcttggtggaaacaaaacaaacaagtacaagttgtcagtgacctttcaacaaccaattaggaaaaaaatatatatatacgttaaatcttaacactgaaaagcaacaaaaatatggaaacagtgcttcttatatgccagattctgattgaaatattttacaagtttaactcatttaattttcccagtgattcttgaggtagaggccatatttttcttaactttaatagatgcagaaactgaagcacagagagcacttgacttgcctaaggtaaaagttaaaaggcggcagatgtagaattcattcacaacaatctagatccagagtatttcttgtgcccctgatgatatgccaattctctggactctatcactaactctattaaatgatcaagaacttgaaagaaaaaaatatttaaattagtccatgaacaggaaatgtccaagtcataaacctagtaatatttcccaaagataatgcttaatagtggtgtcattacaaccaaaatactaaaaaaatgtgcaagccaatctcaaatatgtgggagagaaaacccaatactaatttgaagaggataaaagagcaaggcatctcccttgctgacagaaaggcttcttataactacaacattcatactgaaatgctattatactagatctagcactgaaacaatccaggccactacaaatgaatgaaaaatgagtccagaaaaacacagatccatatatgaaaatttgttttataacagaaattgcattaacaaatcagaggttaaattttaaaaaccataaaatatttcagacaattaattatttatgtggaaaaaagtaaagttgactcattatcctgcccagtacacaaaaatcaattccaggtggacttaaaaacataatgcaaaagcaaaactttaacataattaccaaaaatgtaagtcatcatctttatggtatttaaataaaaaaaagacttctttaaaaagacacaaagaaagcaaaacccataaagagaaaaactgatactcttgaagatgttcaagtttaaaactcatgcaaaatagcaccaaaaacaaggtgaaaaggaagcttcacagaggtactagataattctgctatgtttaactagcaaataattagtatccagaataaataagaaagcaatacatcactaagaaagtgacacacaaccctatagaaaaatgggaaaaaatatgaattggtaattcacaaaagagaaaatccaactgaatactaaatattataagagaatgttgaacaagtcaaactattaaagcaatacaaattaaattgccaataacattattttattcccatcctattgaaaacaattaaaaattctgaataccatgtggtggtgaaaatgtgatttcatgagtatatagcaatttggacagcaaactgacagcatgtgagatagttgatgatattcatatgacccagaaattccactattctagaaaataatcttgtacatatatataataaaatctatataagaatgtatactgcaacattttaaaattcaattaaagattagaaaagctctaaatgtatcaaaacaaagaacttgaaaaacagattataaataaatttatacagtggaagtcagtaaactgataaatcacaaaaacataagtttgagtaacaacatcaagttgcagtagacatgttcagtatatcatttccacaaattaacaaaataaatagtgctatatttttatggctataacacataaaggaaatatacatatgactttctagataggtattatttcttgtatctacaagtagaaaatggggttgcgcagagagggtgatagctacaattgcttctgtaattattctctttaaaatgatctgactcacaaacttaagagctggtggaaattcagcacgttttttttcctctttttctctccctgaaaagcatggaggtgttgtcactctcttcctgagtccctcagtgagcagacgtagagaaaaataccctaactgatctggaagtggaagatttaagttaaataaccttcaggaaaaaaggccttaaactgttttaaggcactaatattaaggtggtttcattgttacaggataacctagcatacgctgactgctattagaattcctgccatgaatcctaaaatatatgatatagtcttagtgatcattgggtgagtggcaaagcaactataactaaagctgaaagcatggtaatacatcttccgcagtgacaggatatttgataagactttcaccagcaaaaatatggaaggtacatgacattcctaataaaattgtagttccaagagaaggatggccagatttagcaaataaaattgcaaggcattcagttaaatttgatttccagatataaaacagatattattgtttagtaaaatttccatgtgatattatactaaatgattatacatatttgtactaaagaaaaacagtgttgtttacccgaaattcaaatttaactggttttctgtgttttacctggcaatcccatcaagagggagacgttgtgaaatagaaaagtagcaatatttcttggttactataaaagttatttaacaagactttataagggaacatgaagtcagagaagggggcaaaacactagtcattttaaaaactaggtggggaaatttggaagtagaggtgaccagatttcacagaagattgtagggtgagaggagtatagaggaagccaatataatacatcaaggtttatggtttgaaaaatggaaagatggaatatcaattacctgaaatgaagaaaatagcacacatttgtaatttgagttgcttattagcacccaactagagatatcaaatagatagttgaatatctacatctttgaattcaggagagagattcaaactgaagacataaatatggacattgacagcatatagatgacagtatactaagtttataaagataaaatagtaataaaagctaatattaacctcttttgtgtcagtccttgatgtaaatttttttatgtgttaactcactgagtccccacaataggtcgatgtaattggttctactataactacactctttaaaaatggatattttagtaaaaagaaggactcaatttatactcaccctcaatttgtagccattggtgtcatctctaagacaatttttagtaattgcctagtcagtgaaccttgccatagtccttagttatgtaaatttattgtattttttggaattccttttcattagccataacgctttaataacatatttttaaaattttgactttaacatctatattgtagtgaatatttaaagaacttcctccaagtttaggatacagaaatgggtaaattatgtctactccctcatatttcactattaagatgatggtaaattagcagtccaagagatcatggtcctgaaagtacagagaaaaaaatagaacccagtgacccaacataactaaggagcatatttgagacattgtcattcttggtatttctgaagaagcactgggatggaagggagttgagatcattttgtcagctacagcactaaattttggtcatgaatatcaaagtgattccatctttatgaggagcctgtggagaatggcaacatgctatatgtatacattttagaatggattaattgccatctgcgtaccttttatcaggttattctatttgttcagcatgccccaagatctcttttgtactttacaaatctgcacttcaattcttcttagttcgagactcacttcaacctaccgcatccttagttttctgcacttacttgttgtttctaaaaaagtatacatgatattatacaataaacatctagaattatacatttatgtactatattcacagaaattggacttgcctttaagccctcctttttacatatattcctgttattgtctcactgctaagtaatattactggatggcaaaataaaccaaaaaacacaaattgattttaatgaaaaatatcaatattaaatattagcttaaataacacaaataagtaaatattgaaatagatgggcatgttaggctgggcagctttttgtgggcacaatcatacaatttcaacttcaaattccatcatataacaggatgttctattggtacaatatctccttgttcacatgaggaaattaagtatattgatattcaccgaacaccaatttttaaatgtatttgaaattaattattttaagtgtctctcaactctcccaatagtgcacaaatatgtagttatgctatatactaataattaaataactttggaaactcacaacttcaaaaaaatgttcgctgttgtggaaagtttccgcagtagagaagggaatgtgaatggtatcagtcttagataacaagaaaactactttactttgtttcaactctactcatttgccatccaaatatgatagaagatgctgctcattcctaacaaatatttccagatatcatgcattccttaaaggagatgatactgattgccctctctattttcactcactttcccattacaattagcagcagattcttttaattatccctgcccttcttaaagcagtctcagatatataaaaattaattgcctggaactcacatctttataattttaaccttttcatgcttcacttatttacggtgacatttatctaaaacacttatcaggtgactgcgcatggtagacatctggtttatcagaaaaggcaggagaaaaaataaatgtaggacattaagcttgctatggtgctttgagactttcctagaaatcgttagctcatcaaaacttgttttggcatggcagaaagacatgtcccattaaaaggatattaatgcaagatcaccattgtcattaaaccatcataccatatattacacatttatgctgaaaatgggttcaaactttttattcccttatcctttaattattagaagaaactttgcagattatagccagataatttaaaataataaaatcaatgtcacttacaaggtcacaggatttagtaaaaccctgctacccatttccttttaagtaacttcgcattttagaaatgaagactgcctattcatgtggcttctgtgattttgttaaacattaattaacaaaatttctagtttttttttttttttcttctagagcagttcagtggaatgaaagaccttttttatcctatgcctctaaccacaaccgggtgtctctatcttaaaagatatttatcaagtctctgcttcatatttccttctctacaccattacagtcctcagcaagccctgctatctcatgatcgcaaatcttggccctttattgttggtcttctttctttcattgctacatgttagaataaatggtgtaagagaatgcttttatctattcaatttctttctctttggctcctgacccactgtctttgtttcagaataattatcagtgcctatatattaccttcacatatgaggcctttgttcgtttcattctttccatctcaattttctgtacattcgtattctctaaagtcttcatctctgtcaattgttcccttatctccctcaagtggacactgtcggcttttcgtagatgttcctactcaaaagagatcttgcaagccagtattttacattaagtaattgttctatttctcgacttttgctggcctataaatataacacatataaaggtagccattgcaggcacagtaaattatttgtctatgaaatcacaatgtttgccccagtatcttaatacaactctcaaatttatataattttttaatttaaaaatttaaaaataactttgcttaaacaaaggcagtttgttttctaacttatctatgtgtgtatgtatatatacacagaaatgtatatgtatacacacatatatattcataaattattgaaagtttcatgcaaattttttactttgccaatatgccccaaaacttgatatgaaattaattatacgaaggagtacagccttgtctttaattagctagaaaaattctcagcccacttaaataaactgttcccaacttggggagataaatttaaatatcttatcttggcaacgaacttataacccttaaaaacatttgctatggcatctatatattatatttcccttgatgtgaaaaataagaaacatttcagaaaaacccacaattaaagaatatcacctggcatcatgtctaaaaatgtataacagtaaaatagaaaagatttgtggatatgacaacaattctgcttgctttcaaaattattttttgctttgttttttgcaaagcctaattaaattaatatatgaatattgagtctattaatcttctctcttaaaaattcaaagcactattttaaagtaaattatcttaggaatattatctaagaatgaacttcatgtggtaaataccagcataagtcattactaaatgtgtttagggtatacaatggaagcagagtctgctgctaggaaaaattgaccttttgttttacaatttataatttatttagtgcagtatttgaaaatcatatttagatataacaggtgacaagagagctctatactaggaaagataattttagtactaccatctataaaagagactaataaatatgaaatgaagatgctataattaaactgtaactcttgcccatgccagcccaacataactattataaaattgtacataactatcaggctgttaatttgaggtaatattgcaggcactacaaaaaaaattcagtaactcatcaaaactattttcttatgaaggtaataaaagctacaatacctgcccatgtcaattatttaaaggtgttcgaagcaaatttcttaaataatttaatttctggagccagacataacagttgactttgtgctctttgacatttactactacagactgttgctaagtccaggcttcaagaactctcctgcatttattctttttaaatcaatggtacaaattatctaactagctatatgtgacgacagcagtggttctcagtttggttttaacaccacctggaaacctgcaaagtctcaggtttcaccccaggtctaccgaatcagaaacactagggataagccccaacaatcactgttttagtaggatcttcaagtgatttcaatgcaggttaagtctgaaaacactggaaaagaggagagaaaaagagagagagagaggagagatggagacaaattcccagaccatacactgcactagaaatagagtgttaggactttacaacaggttcaaaattttagagatgaattatagctgacatttgaacacaaaggaaaggagcccattagtccagggaacatctctgattataaacaacttcatttcctgcttaggtattattcaaatgtatatttaacagtataatgcttctctacaatcaagtaaagctcaaacaaatttaagatgtctttttttttaatgttgtatgttgatgagatttaaactaatagaggcttagctcaattggtgattaaggtgatgagtctgccctggaggtggaaataaatatttcattagacttgtgatgaattctagataattttgacactactagaatgattttgaaagtctggatgatttttgaccaaatatagacccaaatacaaatattgtgaataaaagtattgctaggatttagaaactttaacaagttacataatgtttaaattcatgatttctgtgggtaatttgtggtcagtgctttggggggcagaatgttaaagagatttctatatgagattatgagtaaaactttgtgacaaacaatttgaaaaaatagttgaaaagaagaattcagtaggtaaagttaaaaaagtagaccttactatgaaaaaaagagtagggatatatagaaaatttagatattacgagttgaatgtgtgcagacttcccaagatctatgaatgctataaggaccactacagttgatagcgtagagaaactaaggcaatatttatgcagtgttttagaaggccacagctccattccattactatctgatgatattttagcaaagctggactctgcagtatccttttttgtttgaagaggaatagtagaaggagcatttgtcactcttatttcaccttcaacttctcattatttcccatacacgctcctgttacaattcttgggaaataattaaaataaacttacagccttttatatgggtaatttaaccatatttactagtgtttaaatgattcaaccactgctaggctgtgtagaaaatacaagtactggtagttgtgtgaaagttagctgagtttagataagaggtggcctgaaaagtcaagtctcactagagcactgagattttaaaactattctctgggaactagctagctagctagctagatagatatagatgtttctcaataacaacaataaagaaaattatttcttcatgtatttattacaataagcaaaatattgactaataaaaacacaagaaaggaaaaatactaacaaaaaacatcctgaatactctatatactaaagtgtaataccaaaataaaaattagacacttagcattttctgtgagataaaatagaccaagcaatgagcctcgcttgatgcttcatacaccaggagagctggaaggatgcacaggttcagtaaaaacatgccaaaattaacatgagaagacatgattttatttacttatttatttattttttagagacagggtctcactctttcacctgggctgggatgcattggcacaatcagagttcactggagcctcaagttcttgggctcaagcctcctgagtaactaagactacaggtgcatgccactatgcccaaataattttaaaaaaatttttaacagaaacggagtctcactaagttgctcaggctggtcttgaactcctggcctcaacccatcctttcatctcggcctccctaagtgctggaattacagtcatgagccatggtgcccggcctaataaatgattttcaataaattatatttaacaaaatggattagaattaaccaaaaaataaaactagtaattcaaagctttaaggagtggatgtaggtatgtatctacgcatggatgtctgttaattttgtttctttttaaatcagagaaaacaaatttgaaaagatgctttgaaagtagctgccttcttattgtaattgttttaccaaatagcaaagtctagttcttcaaaattgtcagaacctgttatttatactccatttattcttatgattgggcaatgtgtggcacatttaaggattattttccagtatatcataaatatattaacaatgtgacactttaaggatctaaggaggactgaaaattttatctgaggaattcgttagtctatcacagaggtagctctttgatacctaagtcatcaccttttatagaacgtaacataaaggttgaagttttcacagaataagtaatactgtgaattttcagatagagtgtaaactcctctgggttggctggcttttctgtccttacagagctgcccattgtggtcaaattgaccacatgagaagttgatgatgcagttatgccatgcatagcaaccgcagcaggccttcctcattccaatgtaaatattcattatatgaagcattatctaagacccttttgccttgaaagagagagtaaaaaattaatcaggagtagagtctctaaaatattcatttccctggttcatggagtcatacaagcttctttatcatctcagcattttagtctagtccaaaagcccaaagactaaataaagtaattgatacatggcatccatgaaaataatacaagtaaaatatggctttatgttgactatgcaaatttcatatgaaagaaattgtttccaagaaacttaactcaataaaatttaaaccataaatatttttcaccaattttattcaataaatacttactgagaacctactgtttcctggccttgttatacttgtttggaattcatttgagaagtcaaccatataatacttcatgacattggtctaggcacaggtttttttggataaaaacttaaaagcacaaacagtgaaagaaaatttaaaggcatcttaacagaaaaaaaaaacaatcagcagagtaaagagacaacctaagaacaggaaaaaatatttccaaaccatgtatcagataagatattaatatccaaaatatataaggaactcaaacaactcaatagcaagaaaacaaataacctgattaaacaatgggcaaaaaaatctgaatagatatttctcaaaagaagacatcaaaatagccaacagatatatgaaaaatatatttaacattactaatcttctgggaaatgcacataaaaaccacaatatcatctcatcccaattcgaatattatcaaatagacaaaaaataacaaataatggcggggatgtaggaaaagggaaactctattacactgtttgtgggaatgtaaattagtacagtgtttatgaaaaacaatatggaggttcctctaaaaattaacaatagaactaccatatgatccagtcattctactactgggtacacatccaaaggaaatgaaatcagtatgtcttagagatatccacttccatgtttattgcagcactattcacaatagccaagatatgaaccaacctaattgttcatcaactgataaatgaataaagaaaatgtggtatatatacacaatggaataccattcagccataaaaaaataaatcctgttattcaaggcaacataaaagaacctgaaatgaaataagccaggcacagaaagacaaataccacttgatctcactcacatggaatttaaaagagctgatttcatagtagagagtaaaacagcagttgctagagactgagaagtagagtgagaaggaaagatggagagagactggtcaaaaaattcaaagttacatttgcacaggatgaataagttctggtgctttattgcacattagagtgattatggtaaaaagtattgtattgtatgtttcaaaatacttagaagaaagaattttgaatgtttttaccacaaacaaaatgataactgtgtgagatgatggatatgctgtataccctgaaaagattattacataatgtatagatgtaggaaacatcacactataccccataaatatgcataattattatgtgtcaaaaacaaaatttttaaaagttaatcactctctaatgaaagtatcttttggctcctagacacctgattttttttttccattttgccaaaagtcaaattctacatactaaaacaaagaatttattgtatcctttcaaaacaatatattttaatagcatctatagattcatcaagcaatgatgtaatgaacacaataaaagcttgagtaatctaactactttacaatagaaattgtaatgtttttgtttttgttttgtacgttcaatcctctgaaaaacatgactcttcctgatttttttttcttttttgaaaggagtcttgctctattgctcagtctggagtgcggtagcacgatctcagctcactgcaacctccgcctcctgagttcaagcaattcttcctgcctcagcctccagagtagcttggattacaagcaccaccaccttgccaggctaatttttgtatttttttagtagagacggggttttgccatgttggccaggctggtgttgaactcctgacctctggtgatccacccacctcccaaagtgctgggattataggcgtgagccactgtgactggccaatattttaaatgttaatgtctatcattatattttctcattctcttttgctgtacttattaaatggtctattatcctagaaaataggtaagaagatgaaaaacaaaccagtagcataagatctgaaactgattgataagttatacattaaatatatgatttgatttgcttaagacctctagtatttctattccttttttaatttttagagtttcaaaatttcattataattttggttaaatttactgacttctcaaaacttctaaagtttaatgaactatatacccatcagtgtattaagcagaaaaatagtttagaaaattgtcaccaaagtatgcactttgtatctgaaaacaataatgaggcttctctctgaccattaatcttgggcttttatgacacacaacaattttactattttgtttatttgcttggtttatagtacatgaagacagaaatattatagtttctgtttcatgtagcacatttctttaaaaatgtgttttaaaatgcctttttttctgcaaaactgaattccagtacctaatttctctgttactttggtgggccaggagtcctgccgagaagaatattgatgtctctctcatcagaggtttttgataatgtcaggtttccaatatatcctaggggtatatttttacctttttaaaacaaaatttatttttgcctatttttttcgttctaaggctctttatgacaggactatttaaagcactgaggacaagacaagatgtttatatatacttcctgctgtttaatattcatgcaattctgacaagattaatatactaatttctctgtcattagtttcattaacagatattaattatatctgaatctaaatgccaaatgaatagacagttgggattcaattctatttaagataatcgaagttctctttacaatcatgattggggtggcatacataccatctattctggttagagatggactctggacgctagataaaacacttgggattaaaacacttatcctagaacttatcattataggcacttcacataatgggggaaactgaatatttacaataaccttttggaatagttgatgatgatgatgatgggaaagagagagagaaaggccaggtgtggtggctcatgcctgtaatctcagcactttgggaggctgaggcaggtggatcatgaggtcaggagttcaacaccaacctggccaacatagtgaaaccccatctctaccaaaaacacaaaaattagccaggcatggtggagtgtctgtagtctcagctacttgggaggctgaggcaggagaatcatttgaacccaggagggagaggttgtggtaagccgagattgtgccactgcactccagcttgggcatcagagtgagactccatctctaaataaatacataaataagagagagagagaggagagagaaacatccttttttctggtaaaatttagagactagattgtccaatgaagatggctgaataggaacagctccggtctgcagctcccagtgtgactgacgcagaagatgggtgatttctgcatttccaactgaggtactggttcatctcactggttgaatagtgggtgcagcccacggagggcgagccacagcagggtggggtgtcacctcacccaggaagcacaaggggtcaagggatttccctttcctagccaagggaagatgtgacatactgtacctggaaaaatgggacactcccgcccaaatactgtgcttttcccaaggtcttcgcaactggcagacaaagagattctctcctgtgcctggctcgtcaggtcccacacccacagagccttgcacactgctagtgcagcagtctgagattgaactgcggggcagcagcctggctgggggaggtgcgtctgccattgctgaggcttgagtaggtaaacaaagcagccagggagctcgaactgggcagagcccaccacagctcagcaaggcctactgcctctatagactccacatatttgggcagggcatagctgaacaaaaagcagcaggcaacttctgcagacttaaaaatccctgtctgacgctctgaagagagcagttgttctcccagcatggcatttgggatctgagaactaatagactgcctcctcaagtgggtccctgacccccgtttagcctaactgggagacacctcccagtacgggctgacagacacctcatataggcaggtgcccctctgggatgaagcttccagaggaaggatcaggcagcaatatttgctgttctgcagcctccactggtgatacctaggcaaacagggtctggagtggaactccagcaaactccaacagacctgcagctgagggacctgaatgttagaaataaaactaacaaaggaatagcatcaacatcaacaaagcagaaaggaatagcatcaacatcaacaaaaaggacatttataccaaaaccccatctgtgggtcaccaacatcaaagaccaaaggtagataaaaccacgaagatggggagaaaacagagcagaaaagctgaaaattctaaaaaccagagtgcctcttctcctccaaaggaatgcagctcctcaccagcaacagagcaaagctggatggagaatgactttgatgagttgacagaagtaggcttcagaaggtcagtaataacaaacgtctccaagctaaaggagcaagtttgaacccattgcaaggaagctaaaatccttgaaaaatggttagacgaatgcctaaccagaataaacagtgaagggagaccttaaatgaactgatggagctgaaaaccatggcacaagaactttgtgatgcatacacaagcttcaatggccaattcgatcaagtgaaagaaagggtatcagtgattggagatcaaattaatgaaataaagtgagaagagaaggttagagaaaaaggagtaaaaagaaacaaacaaagcctccaagaaatataggactatgtgaaaagaccaaatctacatttgattggtgtacctgaaagtgatggggagaatggaaccaagttggaaaacactattcaggatattatccaggagaacctccccaaactagcaatgcaggccaacattcaaattcaggaaatacagagaacaccacagacactccttgagaagagcatccccaaggcacaaaattgtcagattcaccaaggttgtaatgaaggaaaaagtgttaagggcagccagagagaaaggtcgagttacccacaaagggaagccaatcagactaacagtgggtctctcagcagaaaccctgcaagccagaacagattgggggccaatattcaacgttcttaaagaaaagaattttcaacccagaatttcatatctagtcaaactaagcttcctaagtgaaggggaaataaaatcctttatggacaagcaaatgctgagatattttgtcaccaccaggcctgccttacaagagcttctgaaggaagcagtaaagatggaaagaaacaaccaataccagccacctcaaaaacatgccaaattgtaaagaccatggatgctatgaagaaactgcatcagttaactggcaaaataaccagcgaacatcataatgacaggatcaaattcacacataaaaatattaacctaaaatgtaaatgggctaaatgtcctaattaaaagatacagactggcaaatcggataaagggtcaagatcaatcagtgtgctgtattcaagagacacatctcacatacaaagacgaatataggctcaaaataaagggatggaggaagatctaccaaacaaatggaaagctaaaaaaagcaggggttgcaatcttagtctctgataaaacagattttaaaccaacaaagatcagaagagacaaagaaggccattacataatggttaaagggatcaattcaacaagaagagctaactatcctaaatatatatgcacctaatacaggaacacccagattcataaagcaagtccttagagacctacaaagagacttagactcccacacaataataatgggagactttaacgcctcactgtcaatattagacagatcaacaagacagaaggttaacaaggatatccaggacttgaactcattcatttgaactcgcacttataaaattgaccacataattggaagtaaagcactcctcagtaaatgtgaaagaacagaaatcacaacaaattgtctctcagaccacagtgcaatcaaactagaactcaggattaagaaactcactcaaaaatgcacaactacaaggaaactgaaaaacctgctcctgaatgactactgggtaaataacaaaatgaaagcagaaataaagatgttctttgaaaccagtgagagaaaagacacaacattccagaatctctgggacacatttaaagcaatgtgtagagggaaatttatagcactaaatgcccacaagagaaagcaggaaagatctaaaatcaataccctaatatcacagctgaaagaactagagaagcaagagcaaacaaattcaaaagctagcagaaggcaagaaataagtaatatcagagcagaactgaaggagatagggacacaaaaaaccctccaaaaatcagtgaatccaggagctggttttttgaaaggaccaacaaaattgatagacctttagaagactaataaagaggaaaagagagaagaatcaaacagacacaataaaaaatgacaaagtggatatcaccacagatcccacagaaacacaaactaccaccagagaatagtataaatacctctatgcaaataaaccggaaaatctagaagaaatgtataaattcctggacacatatgccctcccaagactaaaccaggaagaagttgaatctctgaatagaccaataacaggatctgaaattgaggcaataattaatagcctatcaaccaaaaaaggtccagggccagacggattcacagcctaattataccagaggtacgaagaggacttggaaccattccttctgaaactattccaattaatagaaaaagagggaatcctccctaactcattttacgaggccagcatcatcctgataccaaagcctggcagagacacaacaaaaacagagaattttaaaccaatatccctgatgaacattgatgcaaaaatcctcaataaaatactggcaaaccaaatccagcagcacaagaaaaagcttatccaccacaatcaagctggcttcattcctgggatgcaaggctggttcaacatacacaaataaataaatgtaatccatcacataaacagaaccaatgacaaaaaccacatgattatctcaatagatgcagaaaagaccttcaacaaaattcaatggcccttcatgctaaaaactctcaataaatcaggtattgatgggatgtatctcaaaataataagaggtatttatgacaaacccacagccaatatcatactggatgggcaaaaaatggaagcattccttttgaaaactggaacaagacagggatgtcctctctcaccactccttttcaacatagtgttggaagttctggtcaggcaaatcaggcaagagaaagaaataaaggacattcaattaggaaaagaagaagttaaattgtccctgtttgcagatgacatgattgcatatttagaaagccccattgtctcagcccaaaaattccttaatctgataggcaaattcagcaaagtctcagatacaaaatcaatgtgcaaaaatcacaagcattcctatatgtcaataacagacagagagccaaatcatgagtgaactcccattcacaattgctacaaggagaataaaatacctaggaatccaacatacaagggatgtgagggaccttttcaaggagaactacaaaccactgctcaatgatataaaagacacaaaaatatggaagaaaattccatgctcatagataggaagaatcaatattgtgaaaacggccatactgcccaaggtaatttatagattcaatgccatccccatcaagctaccaatgactttcttcacagaattggaaaaaaactactttaaagttcaagtggaaataaaaaagagcccgcattgccaagacaatcctaagcaaaaaagaacaaagctggaggcatcatgtaacctgacttcaaactataccacaaagctacagtaaccaaaactgcatggtactggtacaaaaacagatatatagaccaatggaacaggaaactgggctcagaaataacaccacacatctgcaaccatctgatctttgacaaacctgacaaaaacaagcaatggggaaacgattccctatttaataaatggtgctaggaaaactggctagccacatgtagaaggctgaaactggatcccttccttacaccttatacaaaaattaattcaagatggattaaagacttaaatgttagacctaaaatcataaaaacctgagaggaaaacctaggcaataccattcaggacataggcataggcaaacacttcatgactaagacaccaaaagcaatggcactaaaagccaaaatagacaaatgggattgaattaaactaaagagcttctgcacagcaaaagaaactaccatcagagtgaacaggcaacctacagaatgggagacaatttttgcaatctacccatctgacaaagggctaatatccagaatctacaaagaactcaaacaaatttacaagacaaaaacaaaaaaacccattaaaaagtggtcaaaggctatgaacagattcttctcaaaagaagacatttatgcagccaacagacacatgaaaaaatgctcatcatcactggtcaccagagaaatgcaaatcaaaaccacaatgagataccatctcacaccagttagaatgacaatcattaaaaagtcgggaaacaacagatgctggagaggatatgaagaaataggcacacttttacactgttggtgggagtttaaattatttcaaccagtgtggaagacattgtggcgatttcttaaggatctaggactagaaataccatttgacccagcaatcccattactggatatatacccaaaggattataaatcatgctactataaagacacatgcacacgtatgtttattgcagcactattcacagtagcaaagacttggaaccaacccaaatgtccaacaatgatagactggataaagaaaatatggcacatatacaccatggaatactgtgcagccataaaaaaggatgagttaatgttctttgcagggacatggatgaagctggaaaccattattctcagcaaattatcacaaggacagaaatccaaacaccacatgttctcatagttgggaatcgaacaatgagaacacttggacacatggcagggaacatcacacactggggcctgtcagagggtggggggctggggaagggatagcattgggagaattacctaatgtaaatgacgagttaatgggtgcagcaaacaaacatgccacgtgtatacctatgtattcaatctgcacgttgtacacatgtaccctagaacttaaagtataaaaacagaaattagagacattttctgcctcaaatagatataacgcatgttactaatttattaagcagaactcatcaagatgccaaaagataaaaatctactaaatcaatgatatagttaccaaaagtcaccctgtataattcatggatttaggacatgattaagtacatacttagcataattgaaaggtgtccacctgaaagcaacagtaatcacacacacacagacacacacatgagtcaatctgtcaaaattacacaccaagcttttaattaattcatcaattatacatcagtgtttctggattattagaattattttgacacattaaaaagtaaacactcctaatttaactcatattatttttgataaaggcattgtggtatgccatcatttcataatatacactgaaacatattcaaataaaatgaaactatatctgagacatgcttcaagtaatttgggaagaaaggatgggagaagatatagttggtgcaagtatgcctatgaattggtaattgttgaaactgggtgataaattcatagtgtggtcatgatggtcttctgtttttttgtatatatttgaaaattgctatataaacatttttgaaatacaaattcttaggccacattccagtcatattgaattagaataccctggagttgaagcttcaagtgagaggtgaagccagctgagcttctgggccggatggggatttggagaacttttgtgtctagctaaaggattgtaaatgcaccaatcagcactctgtaaaatcacaccaatcagcatgctgcaaaatggaccaataagtgctctgtaaaatggaccaatcaattctctgtaaaatggaccaatcagcactctgtaaaatgggccaatcagcaggatgtgggcggggccaaataagggaataaaagctggccaccagagccagcagcgtcaacctgctcggatccccttccatgctgtggaagttttgttctttggctctttgcaataaatcttgctggtgctcactcttagggtccacaccacctttaagagctgtaacactcactgagaaggttcatggcttcactcctgaagtcagtgagactacaaacccactggaaagaagaaactctggacgtatctgaacatccaaatgaagaaactccggacataccatctttaagacctgtaacattcactgtgaagctccgcgcttcattcttgaagtcagcaagaccaagaacccagtggaaggaacaaattccagacacatttggcaaccacgaagggataatcaccaagtagtgagtaccatcggacccctttcacttgcaattctgttctatttttccttagaattcaggatctaattatcgggcacctgtcggtcagttaaaagtggttggtggccgggcgcggtggctcacgcctgtaatcccagcactttgggaggccgaggcgggcggatcacgaggtcaggagatcgagaccatcccggctaaaatggtgaaaccccgtctctactaaaaaatacaaaaaattagccgggcgtagtggcgggcgcctgtggtcccagctacttgggaggctgaggcaggagaatggcgtgaacccgggaggcggagcttgcagggagccgagatcccgccactgcactccagcctgggcgacagagcgagactccgtctcaaaaaaaaaaaaaaaaaaaaaaaaagtggttggcacggccactggaataaaaacacgggtgtcaggcattctaggaaagggctctcttacaacccctgactcttcggggttggaagcattgatttgcctggaaccagcttccacttttcttgtacttctgggctgagccgagggtagacagagtggaaagccattcagctccagggtcccaacaacaagttggttgaccctgaggctgagcggaactctcaaagacatgtcgcctaagggagactcgcccatctctcctatctatcctgacccttgcctcctgggtcctcatgcctgtcagacaaacttcctcttgcctctcttctctgaggctagtctcgcttctaaaaaccactccctgtctctggtgcttttctagtttctcgtataagaatgatttctagcataaactttaggactctattcccttctttaggcacccaggctcaccaatcagaaagacataatttttgcccaaagccccatcggaggagccagactatcttatctggaattttaggacccctcctcaggctagcaggcctaacaaaggctattcctgaagctaggatatggggagcctcagaaattgtatccttgctattcatataagtgaggacaaaaggcatcactcttccaaccctggagatctcttccctctctcagggtatggccctccacttcatttttggggcataacatctttatagggcatggataaagtcccaatattaacaggagaatgcttaggactctaacaggttttctagaatgcattggtaagggccaataatccgaccttcctcattcctccttgtggtctaggaggaaaactagtgtttctgctgctgtgttggtgagcgcaactattcccatcagcagggtccagggactgttgtgggtgcttgggcaagaggggtttctgctgccacgtcagtgagtgtaactattctgatcagcagggtccaggggccactgtgggttcttgggcagggggagaaacaaacaaaacaaaaccgcaggtggttttgtctttcagatgggaaacactcaggcatcaatgggctcacccttgaaatgcatcctaagccattgggaccaatttgacccgcaaaccctgaaagaaaggcagctcatttttttctgcactatggctcggccacaatattatctctctgttggggaaaaatggccacccgagggaagtataagttacaatactatcctgcagcttgactttttctgtaagagggaaggcaaatggagtgaaataccttatgtccaagctttcttttcattgaaggagaatccacaactatgcaaagcttgcaatttacatcccacaggaggacctctcagcttacctccatatcctagcctccctatagctccccttcctgttagtgataaacctcctctaatctcccttgcccagagggaaataagaaaagaaatatccaaaggaccacaaaatcccccaggctattggttctgtcccctttaagtagggggaggggaatttggcccaacgtgggtacatgtccccttctccctctccgatttaaagcagatcaaggcagacctggggaacttttcagatgatcctgataggtatataggtgtcctacagggtctagggcaagcctttgatcttattggaaagatgtcatgctattgttagatcaaaccctggcctttaatgaaaagaatgtggctttagctgcagcctgagagtttggagatacctgatagcttaatcaagtaaatgatagaatgacagctgaagaaagggacaaattccctactggtcagcaagccgtgcccagtatggatccccactgggacttcaactcagatcctggggactggagttgtaaacatctgttgacctgtgttctagaaggactaaggagaattaggaaaaagcccatgaattattcaatgatgtccaccataactcatggaaaggaagaaaatcctgccttcctcgagcagctatgggaggccttaaggaaatacactccactgtcaactgactcactagagggtctattgatcctaaaagataagtttattacccgatcagccacagatatcaaaagaaagctccaaaagtgagccctaggccctgaataaaatctggaggcattattaaacctggcaaccttggtgttctataatagggaccaagaggaaccggcccaaaaggaaaagcgagatcagagaaagactgcagccttagtcatggccctcagacaaacctaccttgctggttcagagaggacagaaaatggagcaggccaatcacccagtggggcttgttaccagtgtggcttgcaaggacaccttaaaaaaggttgtccaatgagaaacaagctgccccctcatccatgtccactgtgcagaggcaatcactggaaggcacactgccccagagggcaaaggttctctgggccagaagcccccaaccagatgatccaacaacaggactgagggtgcctggggcaagtgccagctcatgtcatcaccctcactgaaccccaggtacgtttaactattgatgaccaggaaattgacttcctcctggacactggcatagccttctcagtgttaatctcctgtcccagatgactgtcctcaaggtccgttaccatccaaggaatcctgggagagcctgtaaccaggtatttctcccacctcctctgttgtaattggaagactttgctacagatagtaagtatgcttatctaatcctacatgcccatgctgcaatatggaaagaaagggagttcctaacctctgggggaacccccattaaataccacaaggaaatcatgcagttattgcatgcagtgcaaaaacccaaggaagtggcagtcttatactgccgaagccatcaaaaaggggaaggagaggggagaacagcagcataagctgctgacagaggcagggaaagaccagcagaaaggaaagagagaaagagacagaaagtcagagaaagaggaagaaacagagagacaaagaggaggagacagagagaggaagagacagagacaaagaagaagtcaaagagtgagagagaggaagagacagagagacagagagtcaaagaagtaaagagaggaagagacaaagagggagtcagaaagagaaagacagacaaagaagagagagacagacaagaagtcaaagagagagaaagagggagatagaagtagtaaagaaaaaacagtgtaccctattcctttaaaagccagggtaaatttaaaatgtataattgataattaagggtcttctctgtaaccctataacactccaataccaccttgttgtcagtgtaaacaagggtgtagcccaaaagcactgaggctactgacaacccatagccttcctatcaaaaatccttaacccagcaggtttccaaacagggatctaaatcttaatgaattaccatacaaaggtctgaccagatctaggaggaactcccttcaggacaggaggatagatggttcctcccaggcagttaagggaaaaagacacaatgggtgttcagcaagtgataaggaaactcttgtagaagcagagttaggaaaatttcccagtgattggtctgctcaaacgtgcgagttgtttgcactcagccaaatcttaaagtacttacagaatcaggaaggagctatctataccaattctaagttaatatggactgaacgaggttttcattaatagtaaagaaaaattataatcccaaacttacaaggctttcaactaaagtttgctaaaagttaacagtgtaatatgtattatcctgctaccacacactcttaaaggaattctcagacagtttgcaagaaataacgaaatctatccttactctacaatccgaagtagactctttggcagcagagactctcctaaactgctgaggcctagacctcctcactactgagaaaggaggactctgcaccttcttaggggaagagtgttgtttttaccctaaccagtcagggatagtaagagatgctgccaggcatttacaggaaaaggcttctgaaatcaaacaatgcctttcaaactcttataccaacctctggagttgggtgacatggcttctccactttctaggtccggtagcagccattttgcaattactcacctttgggccctgtatttttaacctccttgtcaaatttgtttcctctaggatcaaggccatcaagctatagatagtcttacaaatggaaccccaaatgaactcaactaacaacttctaccgaggatccctggactgacccactggccctttcactggccgaaagagttcccctctggaggacactacagctgcagggccccttcttcgcccctatccggcaggaagtagctagagtggtcatcgcccaattcctaacagaagttggggtgtcctgtttagaggagggattgagaggtgaagccagctgagcttctgggtcggatgggggcttggagaacttttgtgtctagctaaaggattgtaaattcaccaatcagcgctctgtgtctagctaaaggattgtaaacacaccaatcagcacttggtaaaatcgcaccaatcagcactctgtgtctagctaaaggattgtaaatgcactaatcagcgctctgtaaaatggaccaatcagcaggatgtggatggggccaaataagggaataaaagctggccacctgagctggcagcggcaacctgtttgggtccccttgcacactgtggaagctctgttttttcactcctcacaataaatcttgctgctgctcactctttgggtctgtaccacctttaagagctgtaacactcactgagaaggtatgtggcttcactcctgaagtcagcgagaccacgaacccaccggaaggaagaaactgcagacacatctgaacatccaaaggaagaaactccagacagaccatctttaagagctgtaacactcactgtgaaggtctgtggcttcattcttgaagtcagtgaaaccaagaacccactggaaggaacaaattctggacacacaagttcctaggcttcatccaaaacattaaatcagactctttgaggtagagtaagacacatatttacaagctagttatgcaagttatgatccaggtaaaacactaatcgattgtatccaaaatataagtcttctatcattctgttgtacaaaatgaatgaaatctctaaaatatttctttaggaaccaacacaaagatattccattgtactaagtttgttttctggaaaacaaactctcaggtaaatttgcatgtatgatgtttataagggaattaacttttaattaattatgagaggggagttgaaaagaagtacaatccaggcagagacaacaagcccacagaatatcttaaaaggaatggcttcctgagttctcatgcactgaggctagatgactgggccttgatataactctctccagccccactgaccagccatttgatactatgcttccaggtgatgaatttgtgtgaaatggttgtctttaaatgaagggcaattcctcaggagagactcaagtaattttcactagccagcaacattcctagcatgtggggatgaaggtaattgagaggggagaattcattgcctcaatggttacacatgtaacacttcatagcacccaccacatctataagagctaatatattttttctgggaatttctttactgtcttttctcatttatctttatatatcccttacaagtcaacaaagaaatactgcagtggtggttatagtgactacactgtggttgctggctgtttttttagtgtttaaattaaataatattacccttaggaataaaatgtaaaaccatttttttaaaattcccatcaaaatcaacataacatactgtttgtgttagtaacagaaatatatttaactgcatagataataatgaatagcagtctggattttcaaataaattatttcaagatgatatttactaggttagatacatgtaccctaactcccacccattcacttcctagaaatgtgttttaggtgatgttatttaggtggtaaaatcaggtcaataactcctactgaatccttagatattatgtgttgtacagggaaaaggtagtataggtaaaacttgtgtgagacacactttgttgttttagactagactgtaagttccagctgtgtctgaatgtttgtgtttccccaaaatacatatgctgaaatcctaaccctcaagatggcggtattagaaggttgggaggtgattaggtcatgaggggtgttaacaatagttcccttaataaatgaaaggcctaagagagacccgtcgcacattccactatttgaggacaccactaactgtgagccaaaagcaggacctcctcagacatcgaatctactggtgcctttatcttagaatgccaacctccagaactgtcagaaataaatttttagttttataaatgcctagtttgtggtattttttatggcagtcgatcagactaaaacaaatgtttactctgttgtgatcagatagtttatataacttacctaacacataataggtactctagtaggtcgctcctcctttgacctcagacctttccatttgagaaattttacaactttatttcaaaatgcattccatctactttacaaagtaaaaatacaaaggcctcttatcatgatgtgactattaggctttacaagcctatatcaaagtgtttcatgtaccccataaatatatacacccacacatattaaaaatttaaaaagtgaatgttatacacctccccacttcctttacaaaacttagctcaattccatctggataataagaaaaataggaaactttattgaataatgagtcacttctatgtgtaatttccactgctagtatgagccttcagaagggactggctttaagaattggtacagttcttgactgagaggaacttccaccacctagcagatggggcaatagattacaagggcaattatcactcagagaattgctgataaggtcaaattactgctgtcactttattcttaatctctgtatgcatttttttttctaaaagaaaactgcatatacaattctacagaccaaaaatattgcaaaaaatatgagtttatatgtcctaagagggttccccaattatcacaattgtttcaaatggaaacaatttcatatcccatatgtacatatatataaaaatatatttatgtatgtgtatatatatgcatatatatgcacacacatacacatttctctgcagatgttagtatgtggaaatgtattgctatataatagggacaataattagaactcaaaatctagagtaatgcaactgaaagtcatatcatgcatgtattacaagtaagatactctgcaatgtatacaagagaatgtaatttttaaggaccaaatgtgtgttattaatcaggtatacactctgtaaacactacgtggtataaaattgcttctcaacacaggaaatatttataacctaagtatacagtccaagaagtactttatttctgacacttcataccaaagcaaccagactgacaaataagcattctgagtaaaagcagtgttttaaataacttttgaacccaatgcatgcatgcaaggctgataaatgcaaacccttttacataatactcaaatcatattaaagagatgcttcttgacagagatacacttaaaccattctacatttctcctttttgttctcctgtgtgaaaatgtcaccttaaaagcaattttttaagaaacaagtgctgtttcatttcatgtcttcagatacattgtctgcccatgttttagcgattaggaatttagaggtttttggatgtttattacaactctttgacttatcagtataaatatttatcataccaatcatatttattctttgattatcttgacatggcaaggttttttcaattttatttaaaagagccagctgttttgtatcttatttactcacccatatcattgtttcccgttaaattaacactggcataagccagctgcaagttgcaaggaaatcgcactgaaaacagagctactataaattgtattcgcctctatataccaacaaaaacaaataaaacttttttattaatctctatgactttgttgttgtttaaagcaaatctacattaggaagagttgtcaggaaatttgggaagttatattgtttcctgaaacctgatattgattgatgagagtataccaatgattgcaagttctgagaaaagagttttacacaaaatgaacagcaaaagcttgggcatgagaacaaacttagaatgtccaagggataggaaaaaacgtcctggcagcagagcagcagataggcaggaattgaatcatgtgtactttggtaagccatacacgggcattgagaattttattcttaccacagttggaagtcactggaatattttaagcaagagagtaacttgaactgatttatgcttttaaaagattaccctgattggctgtgtgaaaaataagcgatagggagcaaaagtagaaacagggacaggagatgacagtggcttatgtataagatttcttctaaggatcttgaaagcatcatgaactaacatcacttgggaagtagataaattcattgctgtgtccatagtctgtttatttccctttttttttgtatgtatttgcagaatatgttagtaaacaaagtgaaattcaaggaaatcactattagggctgcctacaaatcaagtcggtttagagctattatagttgagtagtaatattctttcagaaaaaatcttaatcataaagcccaacacttatactatggcttcttaaaagtgaagctgcaaaactgcttgtgaacaatcttacagctatttttataactttttaaagtgttatgtacataatttcttttctgatgacctcattgaattctaaaccatcttttagccacacataagccccaacagttaaaactattaaaatgcattagcatgtccttcattatttgttttaatcaagaagaactgaaataaggaatatgtaacataaatttagttttgctaacgaatacatcagagagaaatatatctccttagagaggaatatattttatctaggtattttttttgaacagtgaagcactttttaaaaaagtaatactgtacacagaattccaaaatataaaacagacaaataaattaaggtacctttatacaaagtcattctatgcagctattataaaaagtaaaatatatatgcattgatagggaagttttaatttattccatataagtaaatattaattgagcattttatatttgagccatcatcctaacagtttgtgataagatagcaaatgatatagggaaagtctctgttttcagatgtttttatattttgaaggaagtagacaaatattaatcaattaagtgaatatgcaagaaatttccacatagtaaactaatctgcagaaaacaaagtcatgaattatctaattcttgagggaacctattacagactgtgttattagggaagccttttttaaggaggcatatatgagggaaaatctaaataactaaaggagccagccataggaaaatagcagaagagaatattctggaaaaaaaaaatggcacacaaagacatttcacctcagccaaagaatatgggatgataaaggacagaaaaaagaccaggaagcaggaggaagagaggtagtagaagcagatgggatgaggcaaatgagacaagatagtgtaggaccttacaggtcatggtagaggaagacacttagatatgattacttaataagaagctatcatagcactgaagcatggaagagatgtgatctaatgtctatttttcaatgccattctgaccagatttcgggcaaacctggtagacacccatagtaagactccaggaaaaaaaaaatttgatggtttgattatatatttgctttaaacatttggcttttcagctgccttgcatccatttccctttaacaatttatctgtttttaaattaatgaccttttctattagacacactttcatcaggggccctgtattgattggtatcttccagagaaacagaaccaataaaatgtgtgcgtatgtatgtatatgtgtatgtttctcagagagagagagcgagagaaagataatttaaggaactggctcatgtgattgtggagttgggcaagttcaaaatctgtaggacaggccagcaggctggagacatagggaggaattgtcatagtttgtgtccaaaaatagtttgccagaatcctcagttttttgagggaggtcagtctttttacttaaagccttcaactgactggatgcagccaaccgatatcatagatccaaagtccagtgatttaatgttaatatcatctgaaagcataccttcacatcaatatctagatatatttgacagatatctgggtaccatgtcttagccaagttaatgcataaaattaactatcccaggctccattccctctggtcaaagggcaagcatgtgattcaagctaggtcaatcagttgctctctccctcaaatttgcactgggttaaaaagacaaagaattacatcctgtctatacagtcatgccaaatcacatgatccatctccaacccctaaaacacataggtatggcttttgttctcaaccttcagctcctaattcctttaaaaagttaccagtatattctgtgaggccacagtgaatcttctaatagtttacttttatgtaggccagagtcatttggcttgtttgaaattaaatatatatatatatacatatatatatatatgtgtgtgtgtgtatatatatatatatatatatatatatatatatatatatacatatatatatatgtgtgtgtgtgtatatatatatatatatatatatatatatatatatatatatatataaaattgcttcagtcaggctccaggtacttggaaagacattcatcaaattaataatggttatcctggggactgggctttgaggattgaggatttctgatttttaatatgtgtctaatctttttaaatgtttcagtataatttataattagcagccaattattttataattaaagtaaatcctgaaaaactttctacattagtgtgtggaaaaacagcacaattgccaaatttatagggcgaagaagtcctatgtttacctagaggggaaactctgaaccaccacagcccaacaggaggctctgtgggacaatttggaaaacattaccataatctattgtttttatatttatttagaaaagaaacaaagggagcaagatacctccccgtctgacatttaaaatttgattcactgatatattttggctcacagtatcaccttgtggcatttggcatctgctgctccccctccccaaagtcataatatactgcataattaattcagcacaagtagtgacaatgccaactctgtttatttaaaaagatacctcgactgttcttttgaataaatagattgcattcctttaaaaatccaaaataatactgaattaattagaagtagtgcaatcagaataaattaggtcctatctacatacaactcagttttaaagctagaaattcaaattaataactaatttgaattagctacttcttcccatgtgtctctgagtaaacaccaagcagacgaaaaatttccattgccaataataatagtaacaatagcaaatattgttaaactcttactatttgctggtaactagttaagcatgcttcataaatcttcttttatagtagtcatgaaaaccacatatctgagctattaccttcattttgtggatgacaagttcaaactgagttttagagacagtaagcaacatacccaacatcacacaagatttaaattcagactctgagtgcttacaaactatcttacgctgtgatggtaaacatctttgcaaattttccctcataattgagtaagccatcagagtttcagaataaatgtgtaggaaaacttataaacatcagggacaagcttaaggacttgacatcttttacttttgtgtgtgtttcatagaaaaaaatagctcaaaggttaatttaaagtaatactttgaacaaactccttaacaagaagagttagacttcatacttgttattcagcagaatagtgactttgttcatacaactaaactaacgaactcaattcctcctttcgactgtttcttttttttgcctccttaatagttattttatacctgtttcttattatttatttattccactaaaaatttcaatgtcttcacattatctataattggtgctatggtatattacagttgaatatagttgaacctgttcaaatacattttgaccaatgataaggagaaccaaggattcctttgctttcatattacttcacacatgactttttaaaaaatttactttaatttctgggttacatgtgcagaacgtgcaggtttgtaacataggtatacacatgccatggtggtttgctgcacccatcaacccataatctacattaggtatttctcctaatgctatccctcccctattccccgacccccagacaggcccccatgtcacacaccacttttagaatcacaatacaatttcacattcaggacaatacttgctgaattttagtttgtgtttgtgtgcgattgttgatgggaagaacaaaatggcagtcacatcatatgttgactctagatgtgttatttatcatttgtttcttcaaaatattttgacaaacgatcttcgcattaaaaggctgtgggcagtttgggagctaccacctgtttccctcttcattgatcactttgctggccccaaaacatatccacagaaaaaattttgaaagtgattggccaagggactcagtgaggatatactttaatatttagaacactattaaaaacaaaaggagacattattaacaatatgctgggacaagaattataacctgggactttctatggcaaatgggatatatgattacttgatctagactgtataaaataaataatatatttggataatctacaattacaataagtatttatacacacaaacatatatatacgtacatacacacacacacacacacacacacacacacacacacttcacatatgtacctttacaaccaatatactttaattgagactgagaggacaagagccatgattattcatatttatattcaatgacttattacataataaacatattttgaaaatttgatgagttaattcaattcaaaatatgcaaaaaatatcaggctgggcacggtggctcatgcctataatcccagaactttgggaggccaaggcaggtagatcatctgaggtcaggagttcgagatcagcctgaccaacatggtgaaaccctgtctcaactgaaaaaatacaaaaattagccgggtgtggtggcacatgctggtagtctcagctacttgggaggctgagagaggagaatcacttgaacacaggaggcataggttgcagtgagccaagattgtgtcactgcactgccttggtgacaaagtaagactccatctcaaaaaaagaaaaaaaaaatactgtatatctgctatgtgaagccaatgggtttcaagttaggatataatgacaaagaagtttaaagaattcatagcgtagtgaaagaaaaacattcatagtaaatgaacacactgtaatgaagagtttaatatttatagtaggaataaatgggatcacaaagagaaactattagttttgaggatctatcattttaggttaactgatatgaaccttcaataacaaatatgtgcttaacatatgaaacagagagaaagtagggtaattctcagagttgttcagggtcatatgtgatgttctgtgtgcctagacaagttgtactatgtgtgttagaagagatgagactggaaagtggtcagatataagttactttgaatgataagataaaagccgtggaattcatttggtgtatgatggaaaacactgaacctttttaaacaccaaaaaatcagatcagcattgtattgaaaaacaaaaacaaaaacaactttggctttattgtgatggtggttagaggagtgagagactggaggccggatgccgagtttagagtatgtctttaaatagatgttctgacagtgtaaatagacaggtgtcaaacagatttgagtaagagtatataggtaatgcagaaaatggctttggagattgattgagtttggaacggaggtcattgaagtctaggttcaaatcaataatgaccacaggagtaacaatacatagtaagtatggatacattagaattggatagaaagaataatgaggcatctgccagaaacacagttaaaaatatccagaaaaagacgagaaattcaaacttggaactcaagacagatttcaagttagaagacttatctacaacaaatacataatccctatttgaggaaaaatagaactctatataggtttgctcaactcaatcttagtaaaacaataagggagaaaaaaagaattacaaaagagagaagccttggaactctttaaaatttaatcataattttaaaataaatttcaaaataaataaaagtgatcaaagatttaagaggcaaaatccaaggccaccaagggaatgagaaaaaacggtacttccataaaaaagcaagagaggagagatttcccagactgtaatatatttaatgtgaggctatgccaagaagaaatgataagtgttgtagatcactgaaaatcatcattacttttctgataactgagaaagcttccccggagggagagggtttcatagataaaccagagaagctgtttttgacatgaaagctagattttttaagacaaagattgaagttgagatgtttgtcactagaaattattgggatccaatccaatggttttaaacagggggagagaaaaagatgaccatgttcagtgagcaactgatgttgaaatactgaaaaccacatggtgcaataattaaaggaaggtatacacagtaaacgcatagaaaatacgttaatatatcattcatttttctgtccagggataaataacactgcaaaagaaaaaacagccaaccaatcaagcaaacacataaatgtatgctactgttcaattgaaaaaaatgcataaggatttatcatggttttatctgtgcttcattagaaaataaagccaaggattttatactccaaattctacagacttttttcataataccagaaaaccttaactttacagacataataactttaaaagagttggaaattaagaataaacatacataataatatatctgggcaataatttatttcatcctacttgcctagcatcctcaacgtagtttggcatacattaaggtcctatagaaatttatcaaattaatactaaattagcagagtactatgaattgctttctacctttgtaacaccagatgtatatatttatgtgttcaatataatattaatcttagtgtttgtgaaaacattaatttgccaaagagagttgtttatattagaaaaccgtgtaatctacatttataaaatcagtgtatttctaaacaagtgactttaaattttgatataaagcgatttttatttttattatatcatagttcatgagataaatttattaatagactatatttttaaaagtttttctgaactgacaaattctgcatgtattataatggggttaggaatggtttctcaagtcaagaataccaccaaagtaaggaaaatttcacatcaacataggtgaacaggtggcaagtcttccaaaatttgaagaattctttcaagaaaggatcagcaagtatgtaattagagtcaacatgttctgtttagctgacattaatggttagctttcactctggagagcaagatcttattgaaatttcatgaaattttagcagaatatataaaggaaaatagaaaaagagacaatcaaaaagaataaaagtacagacataaacacagtaatttgaatgtgaagctcaaaaactaactccagtttttatacctagtgttctagaatggattcaaaataacaatatacataacaatgtacataaaaacctgatgccagtactaaggatgattttattttctaaagattgccacaataacattttcttttccatatgctcttcttataatgtgacttggacacccctcatatagggaggtggagtatgtttctaccccttgaaactggcagagatttgactacaacagaactgacccttcaaattccatagctaatttatgaaaatttctgcctaattctcttgggaagcttgttgtgacaacccactgtcttgctgtgaggaagccccaacagcctataagaggcttcagtggggtgaaaatgaagcctcagtcttcaatcctggatgagcaccagccaacagccaaaatcaacttggtagccatctaagttaatcattatgaaagtggcacccagccctcagttaaagtgccacagctgatgctgcatggagcaaagataagatgttttctcaagtcttgctaaaattgcagcttagtgagcaaattaaatgattgtagtttgagcccactaagttttggtggcctgttatacggtgactgataatctgaccaagtgcctaggcttacaagtaaatatatctatatttttgtacatgaaataaaaaaataaatatttgccataattacttaaatgtataaatcttaaattctcattttttcaaagtatgttaaggaatggctcaatctgttaaaaatgataaaaggatcaagattgatcattccagaatttcttccataatatttaattcaaaaagcaaggttttaaaagaaaataaaagagtaattgttcaaaaaaatatttattgatcttcagttaaagacctcctttttttactggcaagaatccactatccttaggatctttcatgctctttgcccaaacactactttacaaaggattcagagcataaaaaatttcctgacttatttcttcaccattagttcattattctccttatgttaggatatgcaatatttaatattggactgggtttgtcatctgaagactgaataagttttatccttggactagttctactttgagtactgatactcaaaatatgaatattatagtacaacaagggagatagtgaggcattctgaccaaaaatttgcccatactctctgaaaatacttttggatataaatatttttcaacaactatgtccacctacagagtgaatctccaacttaacccaggctgccagagccagaaaaaacctgctatcaatttttgcatgtagagctaggactcaaatgtatcttaattttatttactcttcctaaattgtatctatatacttaaactgtctaccagaaacgtttttgtgtatattcaacacatgcaaccagttaatatttgtgcagagcttagcatagttcattacgaacagaacattctatacaacctctagacattatgatcacttacgttattaccccaaattgaaagtataatctggtctctagcattaaactgcataggaatgagagagatgctcagtctgtaatctggagaggaaaggaaggtcaatgattctttgtaaaattaagtttgtacactctgcttttcaagcagcagtctctatcttcctttactttcctcaatgaactaactactagtaaacagtcatcagactgactcattgaattggattattgcggtttcaatgtataccttctcttggggtcccactggtacactagctgaatctattaactcggaaacataaattaatactaaaaatatatttttctttttccttttttatatttaaaaggattttaattggaagtacacacacacacacacacacacacacacacacacgcaatacagagtgccaaatttgtatggggatgattgaaaaagattattatcaagtattaaatatttgtttcagcatatttgttttttcactgttgtctttccgaatagaaattttcgaatgaaacaaaaatgcacattttaataccagcccaatatacttgatccttacatgtttaaatttcatgtgcaaaaaatgattagtcatagagcaaacccaccctcttgtagaaattttaaaagattttaatgccagcgtaatatacttgaaccttacatgcttaaatttcatgcacaaacaatgattagtcatggagcaaacccaccctcttgtagatattttaaaagataaataaaaatgaaacttttttaaaaaaagagttatattttaggttcaggggtccatatgcaggtttgttacataggtgaagtcgtgtcatgggaggttgttgtatagattattgcgtcacccagttagtaagcccagtacccaatagtcatcttttctgctcctctgtctcctcctaccttccaacctcaaatagacttcagggtctgttgttctcttccttctgttcatgagttctcatcatttacctcccacttatatgtgagaatatgcggtatttggttttctgttcctgtgttagtttgctaaggaaattagcctcccactccatctatgttcccgcaaaagacaagacctcattattttttatagctgtatagtattccatgtggtatatgtacatcattttctttatccaatctgtcattcatgggcatttagattgactccatgtctttgctattgtgaatagtgctgccatgaacattcatgtgcatgtgtctttatggcagaatgatttatattcctctgggtatattcccagtaataggactgctggatcaaatgggagttcttcttttagctctttgagaaattgccacatggctttccacatggttgaactaatttatactcccaccaacagtgtataagtgttcccttttctctgcaaccttgccagcatctgttattttttgactttttaataatagtcattttgactgactgtgcaatggtttctcattgtggttttgatttgcatttctctaacgattagtgacatttaactgtttttcatttttttattggccacatgtatgtattcttttgaaaagtgttcatgtccaaaagaaaacactttttgatgtttttatttaattcttgtaattttaaattcctcatagatgctggatattagacctctgtcagatgcatagtttgcaaatattttctcccgttctgtaggtggtctgttcactctgttgatagtttattaagctgtgcagaagctcttaagtttaattagatcccatttgtcaatgtttgcttttgttgcaattgctgttggttctttgttacaaaatctttgcctgtgcctttgtcctgaatagtattgcctaggtggtcctccagggtttttctagtttggagttttacatttaagtctttaatccatcttgagttgatttttggttatggtataaggaggggggggtccagcttcaatcttcatatggctagccagttctcccagcaccatttactgaataggaagtctttttgccactacttttgtcagctttgtcgaagggcagatggcagtaggtgtgcagccttataaaaattatgtttgtcatcattacttttaccagtcctttcaagtaaaatttttatgttcaccatctttaatagtttgtgtgttttttttgtttgtttgtttgtttttgtttttgttttttgggttttgtttttttttttggctgggattcaacaaaataacataatggcatataactttaggtattctacatctattttgtccagtcaagttctgattagcttttttgcctgcaaaaatacttcatttggctgaaaacatatttttatccaatgcacataactatttatttttctctccagctgttttttttattcatgcaagttaactggaccagtgatcattgctgtgagtagactcaaaagtgattctcagctattttagatctgctgtgagaaaaaccaatagatgtattaatattataacattggataagcactctggctttacatttaggaggcattcctgttctattcctcaaaatctcaaatagaggaccctcagaacttcagttctcatgtattttgaggaaaaaaagtcaagtagcttccaacaaattctaacactttgagccattttgggaacccagagagctgattgctttccagggaaatagcaaaaatactggttaaatggttaaatcctagaccacggaatttttaaaaacagaatatgtgtatacacacacacacacacacacacacacacacacacacacacacacacaaatacaccttttaggggagaaattgatatttttgcctcagcaggatatccatttgccttaaaattcttattcttaggtatgtacatcaatcatctggggaggtccaagctgtgaaatccaaactgacagaaatttatagctccattagcatttatcaaaaatacaggattaagtgtagaaaatatgtattcatgcttcacctttctatatctttactttaagaggtaagtatttgtattcagtatttgttagctcctaccttcaaacggccaaacataatctccaataacatttcagaattctactgggccaaaaatgtatcctattgacctgtgtgtcctctgacttacgactgcatgtttaaatatgaatttaagaaaatgctgcactgattatttggagtttttcagaatggctagtgaattccttggtgatttattggtaaaaaaataaaataaaataaccatgttggactgttgtttcataacatactttctatttggaaattatataattactctttgtgttaaaaatgtattcatactccctgaaaatagtttcggacataaatatttttcaatgtgcatatactgagttttgctattataaattatatgtctacaaaatacttgaacatgatcccattgggttttaaaacatgcaaataaatggagaaagataagagtatatttaccggagttctcaactcaggtatggcagcttgataagtgagtggacggcaatcacgagtgtttggcacaaggacacaaggaagaaacattggacccaagtcatctccatccagaacatccactgtgagagtggtggtggtggttcgcctctcattcagattttgggcacggtcctgttagggagaaaaacaaacaacaggtagtttatagaaattaggcacaatagccaggagcagtggcccatacctgtaatcccagaactttgggaggccaaggtgggtggatcacttgaggtcaggggtttgataccagcctggcaaacatggtgaaaccccgtctccactaaaaatacaaaaatctgggtgtggtggcaggagcctgtagtcccagctacttgagaggctgaggcaggaggatcgcttgaacttgggaagcagaagttgcagtgagccaagatcacgccactgcactccagcctgggcgacagagtgagactcagtctcaaaaaacaacaacaaaaaagaaattaggcacaatgtagacttagttttcattgaaaaaaaaaagattggtaaattaacttgcttaaaccaacagttttaagtggttgagtcaggatgtaaactgagatccaattgtcttcaaagcaactttcttgaaagtatgttacagtagttaagcttttgtatgttaggcctttacctaacagttcacattactagacagcctaaccataaaggtcactctcatctcattagagcatttactttagaaaccttgtaattgtaaattccttctctgcgcctctgaggtgttaatcttttataagctgcttgtcagttctacaaaccaggcccatctttttcatgccctggggggccatctctttgaaatgtaatagtcaaggaagaagcccgtatttcccagtttctgtgggaggttaggagcctgacttcctttggaggcttgctccaatttctaaaactactttctgtcatgaaaattcaaggaaatttattttcctttgggaatgccaattagtaaacacatctggtctgtgattcccccacacccaagtccactggagtgtttaacagctctccagccattttttctattagagatcagttcagatctagtctgtattctggtctctcttctctattgcaatagctgtgaatacagtcttccttatcatttaactttgtctagtgcaattttgctgtaggaatacattgttactaactaaaatccaaagtttctttagatttccttagtttttacttaatgtcagttttctgtttcaggatcccaatcaggataccagtttgcatttagtcataatggttccttaggctcattttggctgtgacaagttctcagacttttgtttttgatgacattgacaattttgagcactggatattttgcagaatgtcccttaatgggtgtttatctggtgttttcctcaagattcaactgcggttatgtgatgtatgtaggaaaaccacaagtcaactgctattttgacatatttatcaaaagtatatgattaatatgacttatcactgttgttaacttcatcacctggctgaggctgtatctagtcagttttctcaactataaatttcctctttcttgtttccctttcatttctttggaaggaaatcatgatggacagcacacacttaaagaatgggtagtaattttattagaaatgtaaattgtttatatttatctgaagaatgtttgtcataggacagaagaaaataatattggacctaagtcatttccatgaagaacatccattgtcaagggtggtggtggtagcatcattcattatgacagaatctggaaatgtttttactttcacagcatttagttattattttgaagaactattatgcttttctgcctttttgaattctattttgtacaacattgacaagtatacttgcatgcatgttcatgtagcactattcacaacagacaaaacttggcaaaagcccacatatttatcaatgaataaatggataaacagattgtggtatgtacacacaatagcatatgattcaagcataaaaagaaatgaagtactgatatatacaacaacatgaatgagccttgaaaacatcatgttttcaaataaagaagccagacaaaaaataaggtcacatattatacgatccatttatatgcaatatctggcagcagtaaacatattggtggctacaaggagctggggaggggatatggaaagcaactgcatgagtggtgccagctctttttggagtgattaaaatgtttgggaactggatagaggcggtggttgcacaatactgtgagtgtaccaaatgccattgaattgttcactttaaaatggctaatcttattttgctaatttatgttaaataatttttaaaagtaattatactaacagacctgtatttttttttttttgttcataaaatgtcttcctttgtgacagttcccagacattaatatttgccttccaattaaaaaaaaagtccctcttgttaaacatggttaatagtacattttggttaagctcattcccagtctggttgctcataaaaacttgtaaagcaatgcttgagggtaaagttttaggaaacacgaatttctgttggtggaattttgtcagtacaaccttgtctagaatgtaataactctgtggttccaggattctttgatatttttatacagtataagacagactgcgataaaattatagcttaaaaaaacacaaaatgtttaaattttcaaagtttcggaactcactcagatccctagaggcactataaagattattcaaacctaaagacatttgagattcaacaaacagaaagaagtcttttctgaacttcttttatgtcactaaaagcagatacttatgagagtgaggctgccatgaattccctctgccaagaaagtttatgaaaatgaagaaaaaacaaggaaatctattcttacctacataaacatgatcacaagctattttaatctcccctttgactcctagaaacctagtttttcttcccttagaagcctcctccctctcattgtgttaaatatatacaccttcttctttagctgtttaaggagctgtgtatatgcactcccatatgtatatcaacctctaggccagttgaaaagtagagtaggagcaacatgtggcatgtgagataattttggtggttcacaaattaactttataaattattcttaagatgtatgaattttgaacatgtagaaaaatattaatttaaaataagcgtatgtgtatattttaaattttaaaaaaaaatagctcatcaaacttgccacttttttaatactgatcttttatttaattgggttatagctatgtctataatatatgaattaatagacaaatgatgtaatgatttgttcagtcagcatatcctgagtagcttccaaggggcagattccaatacactgcttctgacggtcttaaaaaaatgatgaggacatgtttcctcatcccattattaagagagtcatttagtactgaaaattactaatgttaagataatgtgacctcataaagattagtaggttatattttcacatatatttccctttgtgttgcatcatccagtgttttaaatcattaagtaatctcatcttccatatttctaaagttatattaaagtttaagaactaaaacaaatctttaaatttctaaatatatatatataaactggaagcttctttaataggggtggtaaacttttgttacatttattaatgattttacatttgacatttttctcaataacaaataagttaataaaatgacatatttaatatgtatttgtaaatttacttgtggcactggagttaatatttgaaaatttttttatttataaaatatttatttatttatttatttattttagaaatgagaatctcactacattgcctatactgacttcaaaatcctgggctcaagtaatcctcgcacctcagccttctgagtagctaggactataggtatgtgcctggctttaacccaccatttaaaataatgattgcttatgaagttttaaaagattgaattaatctaaatttaatttataaaaatagtaaatagataataaatattaaatatttataatattttatgtgatacatgaatgtagcatgcagatataaacacacatatatatgcatatatacacatacatgcatataaatgccagaggcaatatttctacccttccatgtcactcagccttctttatatgtaatcatcaaatcactataataaacaaatttgaattttttaatgttatgttttctttcagtctgtcagcatcaaatctctcactattatctgcttctttgggtcattgtcactactccatagaatagatactggtgtgttaaagatagtgtatttacaggaagtgtataccaaaatacataataggagttttttctcatattggggaaagatattgcttacaaagtgttgagctctaaaatttgtatttttaagtgggaaataaaaataatcctggcaaaatgattgtgagcagagatgtagcaacaaaatctactaacagtttccacacgtgggaattctcccacattttatcaccaacacatatcacataggaaaatatataaaaatatgtctcatgcacactcataacttgtgagcccataatggtaatgctaattcatgatgttctcccaatttggaatcagatttgatcttaaaatatccatttaaaaaataatccttcagcaattgagataaaaatcaaaacaaaaacaacaaaaacagaaaaaacaaaacaacctacacttttgatctttatagtaatatactactgctcaaggctcttctgagtaaatgaaataacattctaaattgtgagtggtaaaaaataaaaaataactatttctataaacattccatataatttaattatgttttcatttacgttatgtgataatctaatatatattaaaatccacaaagaagatctcctttcttccctttcccattttcatctgcatttctcttcttttttaaaaaataagaatatatatttaacttcaattatttaaaaataacaggatattacattaagttaggaaactgtgattctagttggcaagcaagaatatcttttaaaaagttaaacaagttcaaccagtactctgaacagaattgtgtctcctcaacctcaagctagaaaatctagagtaaagtgatatgtttctggaaacacataatgttccaagatcgaatcaggaaactattgaaaccctgaacagatgaatattaagctgtgatattaaattagtaataagaaacttaccaaccaaaaaaagcactggaccagatagacacacagctgaattctaccagacatacaaaaattgactcaagatgaattaaagatttaaatgtaatacctcaagctataaaaatcctagaggaaaacctattaaaactcttcttgacattggctttagcaaggatttcgtaatgatgatatcctgaaaagcaattgcaacaaaaacaaaaactgacaagtagcacctaaactaaagagcttcggcacactaaaataaactgtcaatacagtaaacagaaaatggaaagaatgggagaaaagctatgcaaactatgcatctgacaaaggtctaatattcagaatctataaggaacttaaacaatttaagaagcaaaagacaaacaatcccattaaaataggggcaagggacatgaacagacacttctcaaaataagacatacatgcagccaacaaatatatgaaaacatgctcatcagcatttatcatcagggaaatgcaaatcaaaaccataatgagatatcatctcataccagttagaatggctattattaaaaagtcaaaaaattacatatactggtgaggctgcagagaaaaggaaatggttatatgctgttggtgggtatgtaaattatttcagacactgtggaaagcagtttgaagatttctcaaagaatttaaaaccaagctaccattcaacctaccaaccccattactgggtatatacacaaagaaaaatagtgcattctaccaaaaagacacatgcatgtctacattaattgccatgctattcacaatagcaaaaaacatggaatcaacctaggtgcccatcaatagtggattgcataaagaaaatgtggtgcatatacaccacggaatactacaaagccatagaaaagaatgaaatcatgtcctttgaagcaacatggatgaagctggaggccataatcctaagtgaattaatgcagcaacagaaaactaaatactacataatatcagtttttcaatgggagctaaacaccaagtgcccagggaaataaacctgggaacagtagactgtgaactgctggggcaaggagagagaatggatcaaaaaactacccattgagtactatgctgaccacctgagtgcaatacacccatgcaacaaacctacatatgtactccctgtgcttaaaataaaagttgaggaaaaaaataatgcttctatgaacattaaccagaggaagttgggtattctattgtcttgtaaacattttttgtttgagatatttgcctaatatttcttattttttatgcaaaccagtagacagaattatattatcatttatagccccaaatgctcatgtatctttagtagccaaacactcagtaaatattaggtcccataaaccatcacctgctatcctcccatttcactctcactcctcagaaaatgcccaagaaacttgcagagttaaaacaatggggttacaattaacactaattccacacatcagtaggaagcagaagtgagggaaggtcagggtagaggttatttctgaaaagttgtttacaaggttgaaatataaaatatagaaaattaattttacctatacaaacacatatgtttgcaatgcttacacattttatttgaatatttctgtccataaagataaaaaattgagctaataaagaaatagtaatattataattttaggaattatatcttgttaggaaagatagctagcatcccttctctagattttgctatttgagaaatatacaacacccttgctattcataaaataatttagaaattataaattattcttgccatgattctaaattaaatttaggccgggcacagtggttcatgcctgtaatcccagaacattggaaggccaaggtgggctgatcacttgaagttgttaatggtttcagaccagcctgtccagcacagtgaaactccgtttctactaaaaatacaaaaaattagctgggagtggtggcacatgcctgtaataccaactactcgggaggctgagttaggagaatcatgaacacgagaggcgaaggctgcagtgaaccgagatcacccccctgcactacagcctgggtgacagagcaaaaccccatctcaaaataaataaataaattataaaataagtaaatataaacttttttctttctggtaattaagaaatcttgattacaaaagtgttcttatatatttcactcaggataacaataatataaaagagagtttgctttgaagaaaaatgatatgtaaagagattactttgattctatgtgaattagggtaacatatcaaagttgaggttataataatatgtagtaaatttcaacaaaaagaaaacccatttgatctttctagatctacccccaaaatttttgtctggaattaatcattccttcattatgtatttatatttgaagtcaatagcatgggtgacaatattgcaaatattctcaaaaaaatatgtgacagggttttctaatatgggtcagtcaaaactcaattaccttaattacggatcataacatgtaaacacggataaaaagaaacctccaaactacatgtaatttgaaggattctcttcgaaaatcaaatatttttaacataagcaaaaccaggtcaaagctgggtaatgttcaataatttgtcatgatacctgtaattattcttttagaggccatatactttaaagtcaaaattgattgctcatatcttaattctccttatgacttcaagataatatattggtgcttaatgtacatgacttacattgtgcataccaccaacacaatataaaaaaccactgccaggtgcagtggctcatgcgtgtaatcccaacactttgggaggctgaggtgagtgaattgcttgaggccatgagtttgagaccagcctgaccaacatgctgaaacctcgtttctactacacatccaaaaattagctgggtatggttgcacgcatctgtaatcccagctactcaggaggctgaggcacgagaatagcttgaacatgggaggctgaggttgcagtaagctgagatcatgccactgcactctagcctgggcaacatagcaatactctcctcccctcccaaaaagaaaatccaggtgtggtggtacgtttgtggtcccagctagttgggaggctgaggcatgagaatcacttaaaccccgtaggcggaggttgcagtgagctgagatcgcaccactgtacttcagcctgggtgacagagcaagactgtctcaaaataaataaataaataagcaaacaaacaaacaagataaatgtaaaaaaaatggaggtacattttagatatatggatatcattatcatatacaaacaaagatatgttagacttatgttactattggtatatacaaaacagttaatgattaacaaccagctatcagataagtagccctgatttgtagcactggcactttccatactgtaaatgctcccagcatggctgcaaatgtgagatcactgaactcagagtttgaaagagaaacccacaattggccctcaagcaagtctcagctgactttccacctccaacaacccacagttttaagttacagatttaaaatgttgtgaaaatgagcatccttctttatcatttgtggaagtgtgatatgtcacaacactttgaaaaataatatagcattatctactaagattaaaaagtatgtgaatatatatgtacaaatacacatacacatatacacatatatatgcatacatataattttctcaaagcaattccatttttaattactgatttttaaacagtaaagtaccagtattttagtgatttatataatactgtaataatgtctcaatatatttcaagcattagtctaagtacttttttgtttgctaactagctaattgtaaccagaacaatgtggtatgttttattaatatacccattttactggttaggaaattaacatacaaagcatgccccaaatcacacagccagtaaatggctgaactgagatttgaactcaggtgacataattcactacactcactgcctctcttgaacatcatgagggtagatatcaatttggtgccaaaaacaaatgatcaaataaacaaaaacggagtattgttgaatcaatggtgatccattattattatcttacattatgtagctattaaaattatttgttcttaaaacttttaaaaatgcttaaaatgttataactttctatatttaacatttcattgtgtactgtatgacttaagtttataacaaaaactgttattgcatttaaattcaaatgttcattcgacttcttcctaatgctattccttccttttgatgattcacatatgtacttctgttttataactttatccctgaaatgctaaaaacttgtcactacctcagtgatgagtagtccatcatgttggatagaagttgttccagatgtctttataaatattttaaaactagacaccaattcagaatcttttaccttgcatttctattaaaaaattatatctttttaattgcatgataaaaaaactagcttacaaataccttccacagcaatctgacttcataaaaaagacattctaccttttcttcacatcttcagttaaatagaaaaaagaattttctgtgtttttgaaaaactctgagtggccctccctaatacattttacttttccccatatctacagttttcactctgctctatgttacatgacattaaaatatatacacacatacagacacacacataatacatataacatcttataatatataattataatatataaaataataaatcatttttaaaatctgaagaaatataaataaaagcttccaaacttagcttcaaaaattagatctatatgtctatctacatatttctatctacatatccctaattatatatctatctaggtatctatctatacacatacacattctgtgtcaggtgatatatctctaagaaaggcaagaaaatgacaagtttgtggcacattttttcatgttaacttcttcagaacagctaattgaggttattttccttttagcatcccctgctatctatctgttctgctgtatgagcaagattacaacgcttaggagtcattaaaggcacaggatggcttcagagtatagctgctttaaaaaagaaaaggctattaatttagagcagttttaggtttatagaaaaattgagaggaaggtatatacaccatgtctccacacgtgcacatcctccccacttacaacatccctaatcaaagttgtacattggttacaattgatgaatctacattgaacaatgataatcaccaaagttcatcctttacattaaagatcaccgttggtgttgtacattctatgggaatggacaaatgtataatgatatctatccaacttcatggtatcatccagagtattttcactgacctaaaaatatttcatgatccttctattaatccctttctacctgcctttaccaccatatccctgacatccactgatctttatactatttccccagctttgcctttaccagaatgttatatattggaatcatccagtatgtagccttttcttaatggtttattttgcttataagtatgcattcaagatttctccatactttttatatctttatgcctcatttcttaacggttatttcaaaaacgtaagcttgtcacttaatatgggactttttatgtgacctccccttctagcttttttctcaaggggtactcccattcatcttgctaagaaaagaaaaatgttttcaggtcatcagtgtgcccagtctcaggatatgaactatacatagtataattcagaagtgaataccgcatatccctttgacacatatggacttcctcaaccttcgttcctattatgctgacacaggtgatacaagtctagaaggagatgttggatgggagaaaactctgaagagagtatcttcccagataaaagaaggaagaatcaataaacgtaaaagaaatcctagttttgctaccctttctgcctgttgcattcagacttgaaatgcagttgtgatgcttatggccatggtacacaaatacctcccagctgataaggcattgggaaaataaccacattccagagaagagggaagtataaggatggaaggaacctaagtccctggtgatataattgaactgtcaaaccaaacattgagctgcataattccagaaattttattaaacttccactaataataactataataaatgtctatgttttataagcatataagcatgtctatgttatataagcatgtaaggatatctatgttttataagtatataaaccatgtctgtgttttacaagcatatgtttggatgtcctgttattgttatctacatacattagcataaacttcagttatgggaatattagctgatatctagtgaacaattactcaataaatgatagccatgaggaagaacacgaccaattaggcaatgattctttgcctttagtgtaccttagaattccctgaagagctaattaaaaatgcagatattccacttccatcatctgagatttttattcagaacatctgaggtagggtccagaaatatgtatatttaatacacacccaaggtgattctgctgctgttaatttgcaggatcctactttgaaaaatatttcagtatagtctaaaaaggttggataatggataatacatatgaataatttagaggtcaaagaatacagtgaataaaaacaacctattctatccctttctccatctataagagtattatatataaacaccaagggcaggagtgccctgatgaagaagtgagtggcacagagctctccaagagtatctgatacattttggatgagttttttacttcataaattcacagaagaaatttaaaagaaattgaatactcacattagcttggattatgacaaagtagcgagtcttatcttcatagttgagcctcttccttaacactatatttccagtcaacattaggggaatttcaaaggtgtcattggatgtctgcaaatattaaagatacagacttcagattatttgaatgtaagatgaattaataactcaatattttggattaatcctcttggaagttagagatgacatgcttatcatctgaaaatagaatgactataagcttcagagtcaatattgttatcatacttccaaacatttaattttgatcaatgggtttccccagagtcctttggtaataataaccagaaaatttgtttcttgtcatagtttttaatatattactagtattattcatcaacagtcttggaatagttctaaatcaaagtccaggtatctgaaaaacttccctgttaccacattatcttttcactgtgttctttaacaccaaagcattcaaacactgaaatctgttatttctacatagtatcaattgtcaacattgatatccattctgtattttaagtatttttaagtattatctggcattaaatacaaaaaaaaaaatacagttacgagtcacttagtgatgaggtacattccgagaaatgtgttgttaggtgatttttgtcattgtgtgactattatagagtgtagattcacaaacctaaaatggtacagcctactacatactaggacaagtgatatagcctatggctcctaggctacaaacctgtacagcatgtcactgtactgaatgctataggcaattgtaacacaatggtcagtattttctctataaatgtaatctaaacatagaaaaggtatagtagaaatacaacattataattttatgagaccaccatttgctatgtgatatatcattgaccaaaatgtcattatgcagagcatgactgcgtgaacttgaatcagttcattattgtggaaaaaaaaatccaggttatatatcatttttttcttttaggttccacaacttctgctcattagttaagttctctgccctgtctaggactgagttttttcctggtaacatggaagtcataagggcaacactagtgctctggtataagcagccctcagtgtaactgtattcacaccttaagggagtataatttataagataaatctcttattcttaagaagaccttatgtcacttttgtattttagtgccattttaaagaatgataaaattgtttctagtaggctcaataactcagtgttattttgttcactgaaattgtcttgtggttgttcagttgccttgtgtatttgtgcttgtgatttttttgtgaaatatttagtttgaatctgcattagattgctgcaaaaggaaggaaagagagggaaagaaaaatgagaggaaaaggcaaggggaaggagaagagaaagggaaggggaagtgtggaagaagaaaaaaactgtgtatgtgagagagaaacagagagagagaggaagagagagagagtgttcacaccctcaacttagtgtaagtgtattcctaagagtcacataagaagttaaactcaatgaaaaaaaaaaagctgattcaaatctctcagctcaggctcaatcaatgaaatgtgtgtagtttagccttccatgtctagagctgtgatctgtctcctttctttctttctttgtctctctatctctctttctctcggggatgcataaagacacacacactgtacattttgcagaattaatatatatttttaaatgattcattctgtgctcctcatgtaatgggccttgcaaatcgttcttggatgcagtcatttaaaagtaacaatttaaaatataaatacagaaaatgaaaatgaacaacacaattaaaaacagacatttgacattttccctaattttttgcctattcaactttgcttatacctatgagtggggctggcattatgacacaggagtgtgaaaatgattgaatctaaacatgtaagttgaatatgggcaaaaccttagttaataattgctgtttacactgttaaacttatcctaatgtgttgttatgaggttattacattttagtgactcaataatatagaaatatatattggtttctagcataaatatggaagatactgtggtcttaccacaaaactaccacatctctggactcagaaccccaaattagctcacatatctggtgacattgtgcctcagaggaggctatgtctctaaatgagatgagtcttgaatagtctagcttaaaaacagtaattccattctcttttaccaggaagtattttgcaaatgtacatgtgattccattttgagtaatgaaaaaatttctcttaattgcaaagatagagagaagctaaaaatcccttttcaggttatagaagtttctgtcaggatataaaatttagaacttcagcagccatttggggactattgataaaattaattacggagaaatagctaacatgctagtgatagcagagtataaaataaaaagagcccggatctgtgttgtctttgagttgctgagcaaatcttgatattaccccatctctgaaaaacttattatgatagataataaattacctttttggttaaatcatctttaatttagttttttacatatatataatatatatataatctatattatatattattatatataatataatataatctatattacatattattatatataatataatataatctatattatatattattatatataatataatataatctatattatatatataatatatatatagtaaattttctgcagctgaaagcactttgatacatgattattcctgtctctatgtgtttacactgtaggcctctctcttctccaaacaggccatggctcttcacacctgatatttgctcttatttttctcttgcttaaatatcccatcacttatttctctgtgtactaatctttgcaaactttactcagtgaaacctcttaaatgtaatttagacttaagtctttgatgtgatctcacattattttttccaaaaaacacttatttgggatcttctgttttgcttgacagattcctcaagggtctcagtctgtgatgcagaaataacctatccttaaatgtctagctaagcaacttaatgaatctttgcaatactttttttgttgttgacagttttcattggacgtttgtagaattattaaaaataatagttattagtgactttattgatcttcagagcactttcaattgcactgaattcttatcatcttaaatctatcctttagagattttatagattcttagattttaattttactttttatatgtatgtatttatttatttatttattgagatggatgcagtcttgctctgtcatccaggcttgagtgcagtggtgcaatctcagctcactgcaacctctgcctcctgggttcaagcgattctcctgcctcagcctctgagtagataggactacaggcatgtgccaccacatctggctaatttttattttttacttttagtagagatggggttttaacatgttggccagtctggtctcgaactcctgacctcaagggtatgcccaccttgcctcccaaagttctgggattaaagatgtgagccaccatccctggcctagattttcattttgttagcacttgtattctataaaatataagaataggatatactttatcatcaatggtgcttctgaaatgttgcatattgaaagccactgtattaaatttaatttattaattaagcaattattgagtattcattctgtctctaaaatgtagaataataatcaagaaaattagaagcaaaatatagatatctttggtatctttatgatagtcttctttttcctctagtaaaaagaatactggattagatcaaccctaagtaaaagtcttgctttaatgatatttctgaagtgtttacctaaaaagtttaaaaaaaaaaaagctaaattaagcaagggaaaaaagtagattttttaataaataaatacatgataaagccatgaaaaaaacaaaacaatacttagaacattcttaaagtttagaatgcacaagaatcataggcatgtatcattaagactgtagattcctagcatctattacccaaaattcccgaaattcttgggaatcggcatttttaacaaacctaccaggtgatcctgatgcagatgattcaggttttacttttgagaaaccactgtactacgtaagtctaagagtgactgcactctctgtccttgctatttatttttctcttctttcattcttagagatttgttccaccaatgaggcagaaaagtttgggaacagagcaatgcccatttacttaagcaaccttacatttctaaagccaggacattgccccctttctgatagtcgtggatattctctttaaaatacaaactaacattggcttttttgggtgataagaatttaagtgctgactacctgcactgtattaatgagaaaaatccaattatggttaaatgatttaatacccacacgccccaaacacctggcctccattaagaaaggtccactcactactttctgacagttcagtgacaacaactgtcaaataagggacaattctccatttagtaaaataagggcataaggcagtttaagcaatttatcactatcacagatatgggaagcagggtaggagacagctgtaacatccacgccacacacattcacattcaataatggagagagaaggaatgttgaggctctagcaactctgtgtttcccaagatgattccatccccccagaatcccctttactaatatgggtttgcaccagtttagataaaacggcagctctctgaaaggaggtgttgaatcctacagttaaagatgctctagaaatggaatatggggttattagcactatttcttctcagctgatagatttggtcattcatcatttttaggaaagagggaaagactccagcctttcacacctatgttgtaagcattgtttgtaatattctcttttcagctgtgatgactagaaattcagttcaaaagaagataatttctaaagaacacacacacacacacacacacacacacacacgtgtatatatattttctggtgacctaaagacagagacttagtacaaaagtgcctcaatgggcctgtaattgagaagtggcggaaatgtagataattacgattttctctttatctctgtaaattctcttgttctttgacacttttttttgaagtatcttcccttatctttgtgtctttttctgtacctctctcttctctctttgggtttcccccatttgttcacattgaatataactgtgagtctgtgttttagttccaataagcagcatcaactttgcccttatcaatctttagacagccttaagcttgtctctgattaagctcaggctactgtgccatcagctgctgaaaattctatgttattgtcattgtttgtgtgtctcctctaatctaatttcctaaagtaaaaagtggaggactaagtaaggctatgcaatttttgtccacccaagagggactgggatttgagcaggcaacattaactttgctcctaagagaaagtcccaacactctaatcattttttctgtttcatactgttaaaacatgtccctggctgacagacaaaatggactccctatgactaactgaagtaagttaaaacaaaaccaacaaaaccaggtggccatgcctgagtgacaaagtggtcgcatactctgtgttctcagaaagatgtcaaagcatcacaggatcttcctttctacaattgatatggtttgggtgtgtcctcatgcaaatttcatcttgaattgtagcttccataattcccacgtgttgtgggagggagctggtgtgagataattgaatcatggcatttccccatactgtttttgtggtagtgaataagtctcatgagatctgatgcttttataaagggaaatcactttcacttgattaaattctctcttagtctgcttccatgtaagacatgccttttgcctcccaccaagattgtgaggcctcccaggcacatggaactgagtccattaaacctctttttctttatacattacccagtctcacgtatgtctttatcagaagtgtgaaaacagactaacacagtaaattggcactggtagagtggggtcctgctgtaaagatatcaaaaaatgtggaggcaactttggaactgggtggcaggcagaggttggaacagtttggagggctcagaaggacaggaaaaggtgggaatgtttggaacttcctagagactttttcattggctttgaccaaaatgctgataatgatacggacaatgaaatccagggtaaagtgatctcagatggagatgaggatactggagtaaaggtaacccttgctatgttttatcaaagagactggtggcattttgtccctgacgtagagatttgtggaaccttgaatttgagggagatgatttaggttatttggtgacataagtttctaagtagcaaaacattcaagatgtgacttcagtgccattaaaagcattcagttttaaaagtgagacagagcataaaaattcagaaaatttgcagcctgataatgcagtagaaaagaaacacccattttctgaggagaaattcaagccagttgcagaaatttgcataagtaatgaggaaccaaatgttaatcaccaaggcatggggaaaatgtctccagggtgtgtcagagacatttgtggcagcccctcccatcataggccaggagccctaggagaaaaaagcggtttcatgggccaggtcctggacccccctttccgtgtgcagcctaggaactcggtgccccgtgtcccagctgctccagccatggctataaggagtgaagacatagctcaggctgcggcttcagaaggtgcaagccccaagccttggtagctttcacatggtgtggagcctatgggtccgcagaagtcaagaactgaggtttgggaacctccacctagatttcagaggatgtatggaaatgcctggatgtccagacaaaagtttgctgaaggggcagggccctcatggagaacctctgctagggcagcatggaaaggaagtgtggggttgaagtccccacaaagagttgccactggcgcactgcctagtgaagctgtgagtagagggccactgtcctccagaacccagaaagtagatttactgatagtttgcactgcatgcctggaaagcagcagacactcaaggccaaactgtgaaagcagccaggagggaggctgtaccctgcaaagcaacaggggtggagctgcccaagaccatgggaacccacttcttgcatcagcatgacctggatgtgagacatggtgtcaaagaagatcattttggagctttaagatttgactgccccactggatttcagacttgtatagggcctttagaccctttgtttttgccaatttctctcatttggaatgtatatatatatatattcatacccaatgcctgtacccccattttatctaggaagtaactaacttacttttgattttacaggctcatgggtgtaaggaacttgctttgtctcagatgagactttggactgtgagcttttgagttaatgatgaaatgagttaaaactttgagggactgttggtaaggcatgattggttttaaaatgtgaggacatgagatttgggaggtgccaggtgtagagtaatatgatttggctgaatccccacccaaatctcaccttgaactgtagctcccataatccccaagtgttgagggagggacccggtgagagataattaaatcatgggggtggcctccccagccacgtggaactgtgggtccattaaacccctttttctttataaattacccagtctcaggtatgtctttatcaacagcgtgaaaacggactaacacaacaataaagcaaaaacagatcctgttcttggtgccaagataaactacagctggaactacttccttttgccccctatgccatccctacactggccctttagcactagccctttgaaagaaacatctgacagaaacttctggtttggggcttggaaatcaaccaatcagagctcacctgaatcaaccaatcagtgtatagaacagtcatgactcatctgttttgaccaatcagaattaagcaaggatctatccttcatttggatgaagacagcttattgggaacctgggtgggaactatagctataaaaccctaaccctctctttgttctctgaaatgtgtcttagcttgaaaccacaggctgtatatccatggtttgaaaactgttcactgaaataaagtctctttcgtccaaattcctttccagagaacatttgcttacaatataaatttaccactctccctcacacaaatacaaacagattcattcacatttaatgatgcattatgattacaatgcagttcaacttatcttattccatccaacttccaaggaaactgtatttgtgtttggttgggttttgaaacttaaaagtcacagccttggtgtgaaaagactgaggttcgaagttttacacaaagaaggcctttacaccagtcttaattatacatgagtttccagtaaaatgagaatattatgaatttatggaggcatggaaatctcatgatataatgtaccctgaaaagtattattaaactacagtaaattttttagtaacctacctaggaataagtaatcactgttttagcttaaccttaaatattttattgacatctgaaatttggactttgacatatatacacacacacagaactacttcaggatggtgatttttttaaaaatcgtttgtccttaaaatgtggttttaacttcctgactcaggaaattcaaatgcttacacattacaaatgaaaattatggcttacattttctgaattatctcaaagctacggggagtcaaacatattacaaaagaaggacaatttactcaggaggacttgataaaagatgttaccacccactgaaacaccactgtaatacctcaaagaaagaagctgcttatgcatattgcttaagtgtcttcattttttttttctgagtagtaacagtagtgaataacaatgttatgctgcttcctcagtaaactggagactgctacaagggacatgtcatcagtctcctccttatcactttaggtcaaacttaaaatgctgaataaacatgcctccagtctggcattaaaataaaaaaaaagatcaaaaagacatgataattattgtctaaatagtcttatcaatcttgctaacaatgagatttaatatatcagaatacctatatttagatttttccatataagacaaattctcaaaaatgaaagttactgcagatcatgtgatgacaaattcttatcaatttcagagttcttcttttattttttcaaaacaaactaattcaagcttgtctaacccatagcccacaggctacatggggcccaggttggctctgaatgtggcccaacacaaacatgtaaatgtccttaaaacattataagatttatttgtgattttttattatcagctcatcagctgtcattcacgttagtgtaatttgtgtgtggcccaagacaattctttttcttccagtgtggctcagggaagccaaaagattagacagacacctctgaattagttcagtgcattatgaacactcttactttgtattaccatgaaggcattaaacaaaaaaaaaaatcagcagtattttacaataactgtgatgagtacactagaaattgcatagaaattaaatgcccctaattaaaggcctgacaacatatattgtccagtacatatttttacatattgtctactaccaagttccaacagataattcaagtggtacttaataaacaaaaggtgaccaaatgagaaaatgaacttatacaaaagaaagaagaatgcttcttcttctgaacaatagtgcagactgacaaagattctttgcctggccaaacttgatcaggcttctgaatcttctcctaggctcatctgtatacttcctcataaaatcactttttaacaaagaaccatactatatcactttaccaagaactcctctacctttgatgaatgatctatcttgaaaactcatcaggtttctcatcctgcaccaccccttaggtgatgtctgatcaccctgacttgtcttcagcaacaatcgtattagcgtgttttagccagaattcccctaatctctgatgtttcctcctagtaattttccatccagtgaccctgaccctgctccttggttataaagtcccacttgcccatgctttatttttagttgagtccaatatctctctccaactgcaagacctcattgcaatgatttctatacctattgcagtggtcctgaataaggtctttcttaccatgttttaatgtatcattaaataatatttttatttaacaattgtctagaggacttttagaagaagatatttactaaattatttttttctaaatacatcagccatgaaaggatagggaatgctgcaggaacaaacccttaaactttcatttttttctttacttttcatatctacatatctaatatgcatcagcaagtggtctctttttattgttgtcattggctaatgaatgtttctcctcaacatgtttttctctgatcacaacagcaggggcagagaatatgattacttgtatattggttctttgagtttacatttcattagtcaaagcaaatacttttctccaggcaagaaaagtacacctctagtatgaatcaaaagagaggaagaaccaaacatttttggtaaacagctcaagtgcttttgttaacagcagtgaatccatatgggtctgcagcaactcggtcctaacctcagaggaaagaatgtgatttaggggaagaagtaagtttaaggcagagggagagattgaggtgagttttagagtaagagtgagagcttattaaaaagttttagagcaggaatgaaagcaagcaaaatactcttggaagacggctaagtgggtgacttgaaagatccaagtgccttgttcatcccttcacttgggggttttctacattggcatggtttgggggtttgccattctcctcccttgatttttcttttggggcaggctgtccacatgcacagtgcctgctggtgcacttgggagggtcttcatgtgcagtatgtttactgaagttgttgcatgcttacttgaggcatttttgccttaccagtttaacattcccagaaaaaggtcatatactagtgaaattctgccattttgcctcttaacgtgcatgcttcagccctcttgcccaacttctaagctcttattgggaagctgctgatcaccagcttcaagtgttttctatctattgggagactatatttccctggcactggctgtgatcaattattcttttacagaaaaagtttaaaagccacctaaccatcacctgacgatcagctgacattcctgggggtggtcctctcctgccctgctcatatctgcctaaccatctagttgatatggtttggctctgtgtccccacccaaaacaaattacaatgtcaaattgtaatccccatgtattgagggagggatctggtaggtggtgactggtttatgggggcagtttcccccatgctgttctcccgatagtgagttctcacgagatctgatggtttaaaagtggcacttccatttttgctctttctgcctcctgctgcatgtaagatacaccatgcttctccttcaccttctgccatgattgtaagtttcctgaggtgtccctagccattcagaactgtgagtcagttaaacctcctttctttgtaaattacacactctcaggtagtatctttatagcagtgtgataacaaactaatacaggaaattggtactgggatagtggagtactgttaagatgataacctgaaaatatagaagcaactttggaactgggtaatggtcagaggttggaacagtttggagggctcagaagaaaacaggaagatgtgggaaagtttggaccttcctagagactttgtgaatgctttcaaccaaaatgctgatagtgatacggacaatgaagtccaggctgaggtggtctcagatggaggtgaggaacttattgggaactggagcaaaagtcactcttgctatgctttagcaaagagactggtggcattttgcccctgccctagatctgtggaacttggaacttgagaaagatgatttagggtatctggcaggagaaatttctaagcagcaaagtattcaagatgtgacctgtctttttctgaaagcatacagtcataggcatatatgaagacattatgtgaaactggaacttatgtttaaaagggaagcagagaataaaactttaaagaatctgcagcctgaccatgtggtagaaaagaaaatcccattttctgggggaaaattcaagctgggtgcagaaatttgcataagtaacgaggaaccaactattaatagccaagacaatgggaaaaatgcctccagggcattttagggatcttcatggcagccgctcaaatcacaggcctggaggcctaggagggaaaaatggttttctgagctgggaccagggccccactgctctgtgcagccttaggacatggcatcctatgtccctgccactctagctccagccatggctaaaatgtacagttcaggccattgcttcagaggtgcaagccccatgccttggtggcttacatgtggtgttgggcctgcaggtacatagaagacaagagttgagctttgggaacctccaccttggtttcagaggatgtgtgaaaatgccagcatgtccaggcagatatctgctgcaggggtggagccctcatggaaaacatctactagcataatgcagagggaaaaagtggaattggagtccccacttgggactgcctagtggagctgtgaaaagagtcccactgtctcctccagatcctagaatgatagatccacagacagcttgcatcatgtgcttggaaaaaccacaagcactcaatgccagcctgagaaggcagctgcaggggcagtaccctgcagagccacagggacatagctgcccaaggccttggaagcttaccctttgcattaatgtgccctggatgtgagacatggagtcaaatgagattatttcgaagctttaagatttaataactgccctgctgtgttgtggacttgcatggggcctgtggtgcctttatttgggccaatttctcacatacagaatgggtgtatatacctaatgtctgtaccctcattgtatcttggaagtaacaacttgtttttgattttataggcttatgggttaaagggaattgacttgtctcagatgaaactttgaacttggacttttgagttaatgctgaaatgatttaagactttagggaactattgagaaggcatgattggttctgaaatgtcaaaaggacaagagatttggaagaggccatggttggaattatatggtttgtctctgtgtcccgactaaaatctcatgttgaattgtaatctccatgaatctagggagtgacctggtgggaggtgactggatcatggggcagttttccccctgctgtttttgtgagagtgagggcattctcatgaggtctgatggtttaatagtgataattcccccttcactctctctctcctgctgccatgtaagatgttccttcctccccctttcccttttgctgtgattgtaagtttcctgaggccttcccagccatttggaactgtgagtcatttaaaattattttattataaattacccagtcttagttattctttatagaagtgtgaaaatgcacactactgtaacactttcactttaaattggatcaatcagttcagcaactatttattcccaaacttgttgcttctttgttttagaacaccatttgaattgcaataaaaagagttgcttaagttctttgtagatttgcggggggaggtgggaggggagagggacagcattaggagatatacctaatgtaaatgacgagttaacaggtgcagcacaccaacatggcacatgtatacatatgtaacaaacccgcacgttgtgcacatgtaccctagaacttaaagtaaaataataaaaaataaaaaataaaaataaaaataagttgaaacataaaaaaaaagatttgcaacaaaacagaaaggctcaatttaattattccaattttattcatatattaaataaaatagttatggtgaagaatttacaatattttgctttattgaaatgttattattttgactagtaaaagtgccacactatggtgctattaatgtaagcagaattactagagatttagtagtagcagaacataaaatttatcatgtattttctcacaggtcttacaagagaagaaactggtactgaggtttacactaattttatatgaagtctaaaagtggattctctccctaagattgtaccttggttaatccttttttccttcaatacatcctaagttaagtgtcatgatgtcttactattttttccacagaattaagagcattttagcttgctaaaacatatattatttatttttcttttttcatttgtaattttgaaaatgcatgtggttgattggtttatccactctgtagggagtaagagttacatattatattgtacagcaaacctacacttccctggaatggggaggcattgagacagaattattgcacagttaaaaaagaatttaagccttattaactgtctacattttaagcagaaagatagtttaaagtaatatatttttgctctcaaactatatctaaacattgaatatttttatgcatgcaataaatatctccctaaaaaacatggactagtcatttgatacttgctgggaggttttatttttacaccttggggagtaaagattagaaagtaaccttcataaaatttgagctagaaacatggcgcacacgtacaattaattctttaaaaaaatacctaaagagcaaacaaaataaatggtttcaaaatcgaatgttcagtcagctgtttctacatttaagaaaaagcatttctgctgcccttttctttgctgtttctttgctacttcccacttcatttcttatgtaacccttcatactgtccttctctgtcacattctcatcatatccccaactcttggttttattgtctctgcctaaaaaaaagtcctcttttagagaaacaaagcaaaaaaaaaaaaaaaaaaaaaacaagactctaaaatctgaccttcaccctgctaataaaatgtatatatatatattatatatatatacttattttccaaatttattaaaattttaacacagccagtacaagttttttttgtgagaacacaatagaggaagagtatactgaaactggattttacagttcagaagtagttttctaatatgacccaaatcacttcacttacgagttttctttgctatgcaacagagataatactacttttaactgatttgtgaggataaaatgagaaaatgcatccacaatttacttaacataatgcaataaatttgtgatgtagatcttactgtgagttctcagactctactatcccaatagagttttttgtttgtttgtttttgcttgtctgtctaaagtttatctacaacatacaatggtaaaaataagggcaaaatgttaacttcaccattgtttatatttctaatatttattaaacataaaagagatgcattcaatttgaaagcttatttaagtagtgcatttataattgctttggggggcccgtgggattttgaggagctgcctcaaagaaagtggggagatgtgaggcaaggcttccagctctagcttcagttaaaaaaaatcttactttgtctgtttttttgaataatatgtcattagaggaaatgattcatggccttaaaaaacaacatagaaatcttcttgtctatttgggaggccgaggcaggcggatcacgaggtcaggagattgagaccatcctggctaacacagtgaaaccccatctctactaaatatacaaaaaaattgagcttccagtgagccaagatcacgccactgcactccagcctgggcaacagagcgagactccgtctcaaaaaaaaaaaaaaaaaaaaaaaaaaaaaaaaagaaatcatcttgtctaatggaaaaaaaggaagaaaaacaacaaaataaaacagactatagctagtggctttgtcttgtcttcttctctatctttggtttaactggtggacggctagaagtttaaaggcttatcaactccagcaatacttggtgtgtgttcttgaggtatagcaacaatattggtattaatttatgagttgcataaaattcatgtttgacacttgttatctcatctccagtgatttatttagaatgctttggagaccacaaacataacagaaatttagtaaatgaggcatattatacctatgaatatattttaaaccttatctaaaaataccatcaaaaattagcttctagcaataaagcataaatattacaaataattcaattttgagacatttttaaataatagtatcattactaatctggttctggaagttactgaataatacaataactatcagctgaaaaaatcattaattttattccttttaagaaaattacattgcaaataggtatttacataccggatcatctggattatactgaataacatactctatctgtccatttggtccatcatctatatctgtagctccattgtctcctgaaaatcctgtgaatattgtggtaccaactggagtgagctgaaaggaaaaaagattttaaatatcaattttcattttatcaactgcacaccagaaatgttacagcataaaaatcagctctttattacctaaaggaagataccagttggcagcccacaaccacaaactgaagtgtttcaaaagaacagttttgagccttacacaggagttcttaaaatgtctgaaatgtccaactttgtgattcttgctatgggcgaagaagcagaagacgctgattccgtgttaaacacatttggaccaatttatagccattagtatgttagctcctgtggagaaactgcatctgttgtttctcctcaaaacccttgatgcaatgttacccacaggctagaatttaaactgtaagaaaaagttagtttaaaataaacgatttacgagtgagcaatgaaatccaggctgatgattatatgcaagtggcaagtttgagaaagagaaattggagacaatgaatagtctgtatattagaggaaaatactgggagtttcttgagtccttctgatattggttgagtagaacatgatcaggtcacagcagctggagagatagcaacatcttttcattttggattaaaacatcagaacttaatatgtgtggcatacaaaaccatgatttgatgtgtgacctaaattgctagtcttaattcttacttatgcccacaagagaatcaccgttatttttttttacctgtaggtttttgcgcaatgtgctcttataaccagagtaatttttttaaattttcccctcccagtttttaggttttagctgaaatactactcattagttaaatttcaacttaattagatatcagcttctcccataccacccctcaaatagcattacacacgccacatcagaagatgattccccttttcttgtgcttgcattttgcactttgttcctataatcattgcattgttagaggaactaaatgcacttcatcaataaacataagctctgtgcctctacagactggacgcttttaatgtttgctcagggatttgttctcttaatttttgactaggattccttgatggtaaaaatagcttaagaggcaacaaaaaagttgccttattcagttttactttcagaaactgaaaattcacattttacaaggatccctcaggtaatgtaaatgagtgaagcaagcatgatgagacggtggaaaatagatagaacatgccctctctgatgctactcagagagggtagctgctactagtagctgctactcaatcccagcaaattcttgccatcttggaatatggagcccatgctaccaagtcttctaatattttaattgtatataaaatatcttgatgctaagattgacaacagatttttattatttatttatttatttttgagatggagtctcactctgtcacccaggctggagtgcagtggcacggtctcggcttactgcaagctctgcctcccgggttcacgccattctcctgcctcagcctcccaagtagctgggaccacaggcgcccaccaccacgcccggctaattttttgtatttttagtagagatggggtttcaccgcgttagcaaggatggtctcgatctcctgacctcatgatctgcccacctcagcctcccaaagtgctgggattacaggcttgagccaccgcgcccggctgacaacagatttttaaacattaaaatataaataggtaaaataaaatatgcccattgcctcaacaactacactagtttgcaatctctgatttaggaaaagaatataattatgacttaaaaataaaccataagtacaaggaagttcaggatttataaggcccagtttcctagcaggcagcattgaaggcaaactttggagagctgagaatgaagtgagacgagatcgtttaagtagtacctatgaggacatcgagggaccactggggatagatttagtagaaatgttagtcagctaaattgcttccaagctgacgttcaatatttttcttttttaatggaattcctgttgcaaaagacatccttatcttttataaatattcacccattcttatgtagctgtactttgatatttttattaccaacttatttttaaatcaacatatagaattttgtatatttgttgtgtacaacatgttgttttaaaatatgtataccttgtgtgatggctaaaccaagctaattaacatatctattatatacttttttgtggtgagagcacttaaaaaatctattttcaaaaatagatagttattaactatagttaccatgttgtacaatagatttattgaatttattagttcaagaaatttaaattttgtatcctttgaccaacatctctcaatccatatcccagcccctagtaaccactcttatactgtctgctgcaattacttcaactactttagattccacatacaagtgggatcatgtagtatctgaatatctgtgcttggcttgtttcacttaacataatgtcttccaggtttatccataattttcaaactgtgaaattttatgattggatgacattgatttgtttccatatatctaataaacttaaaaattttgttgccaaaaaatactatgtcatggaggtagatataaaagcaaaacaaaaaatcaaaataaaacaaacaaattttaaaaaattaaacagtatcgtctgtggaaattttgaggaaataaagggggtgcccatgcctttcaatctgcttactggggtaatgtatactattggaccagatttattttgaagagcaggatcccaaagccctacaacttagggagataaaattggtcttgcggggaagatataggacatccagggagaacttcacgtttgccactcttaatcaagattaaatttctggaataaatatttatatgacagaaatttgttggaatagatggtttgaaagattttagtccttacaatgtaatatttgtaaagttgaaggcatatttctaaattcaatatgcaaactattgaaaagatcaatgtttttctctagctctacaatgtttttttgaaatgatgaaaaggccacataaaagtagcatgatgtcttaatatattaccatcaagtaatatttttcttcatcactgacatggctttttccatgcagaaatcacatttgtaagtataatgtttaatatgtagtcctttaaaataaactctacattgttataatgtttaatatgtagtcctttaaaataaactctacattgtatttctttgattgactttcaaaaaatatacttgctgatgaagcctaccaaagattgataatagaccacaggaaaaaaattgaatatgcatttgcttatggtttcaattttaagcttaatccaaagagtaattcaatttcaaatgttctcatttcagaatatgagctcattttgtgtgccacaggtaaatttccctaatcatatttgtgtggccatatatacttttattatttctgaaaaattgcaagtagaaatatgattctataataaatttcattaatttatatctttgaatagaaaataaaagagaaacaattgtattagccgtaggaatagagaaaaccttttttctataatgatattatataaaggttatgaatcatccctaaatataattttaaggtcttttttagacaaaattttagattccttgaaaattaaatgaaaagcattagtgtaatagcaatagatttcagcatgttctttcattcatggctgtctttcttgacaatttcagtaaaaatttctccctaatttcacaaatatggtatttactggctgacaggggaggatgggcaggctcaggaattgtcccaaggtgaggtttgctctcctccatagttccacatttaaggcaaatgtcttagcacagatcactcctgtgtatttctactactagattgtgcaagcatgtacaaatagccattcatatgtaaaatgcaacacaaaatggatcagtcatacatttttctcatgatctgctcaaatttcatgatttgttcaaatggtagacctgttcacatatgagatagggttgaggctaatatgagagaaatagccgagaaaaaagaagataagttatatgggcaaacatgggaggtctgaaaagtctaaaaaggctctaatgaagaggcctatgccagatgcaaaaaagcagaagaaagtagaagcagaaaaaatgttttttaaaaaatagtagatcctggccagatgccatggctcacacctgtaatcccagcactttgggaggctgaggcaggaggattgctgcttcaagtctgagagtttaagagtttgagagtagagatagatagatagataataggcctggacacggtggctaacgcctgtaatcccaacaatttgggaggctgaactagatggattacttgaggtcaggagttggagtccagcctggccagcatggtgaaatcctgtctctactaaaaatacaaaaattaaccaggcatggtggtgcacacctgtagtcccagctactcaggaggctgaggcaggagaatcccttgaacccaggagactgaggttgcagtgagctgagatcgtggcactgcactccagcctggggcgagaacaagactctgtctcaatttaaaaaaaaaaaaagatagatagatagtaggtggttatatgtatattatattcagatcttttttgtgctattataaaactgtgaacaaagagacctaccttatgtttcatagataactctttaatgctatatctcaaaatcacaactaccttattatcattacaaaaaccaaacaaaagacatggcagaaagcccacacctaaatgggcaggtagcattgaaatgtatgcaaaaacagagtgttagtagtgaactgaaataaatttaaaaggtccctcttgacagcctatttgcatccaaaagctctttaaagacagaccataatttttttctttttaaaaaaatatttcatagcatcaattgtagaaactggttcatcagtagaaactcaattaattattcttatttatatatattatttatgcagatgagactgaaacttttcacaatttcttcatattttaatatactaaatcctctacaaggcctctatactggaatactgtatccacatcctcatcctctacctgcctgttcctggttcctcggacaacctcacttttagaggtgatttccacccattcattatgctgttcaattgcaacaggatggccagagcttctggcagctcactgtcaaaaaaccctgcccacctttttttgcttccatgaagaaaaatatgtagatttcactgtgaagtctagttcttcccatgctcttgccagttttcctacaagaaaattttctacagactgtccatgaataaactataaccataataggacccaatacagcaagcacatgcaagtagaataaccttatattcacgaaaccgatggtatgctgttcacttggaataaaatattgagaaggatatgtggtagaaagtcctccacaaatcataatattgtgttgtacatatatatttggtgattagaaaattccactggcatcaatatcattgtgttggtagataacaatgattttctgtttcatattttctggagtctcatgtgtcatatcaacacagaaacaaaaagtttagtaaaaaataaaatactaaaaaatgatttctgaatacctaaaatagtttacacatgtattccacaccaatgccttctgatagattctaatggctttaatgattaaacagaaaccatatgagagtcctaagaagagaaaacatatatttttatgtaatagacacaacttaaataatacctcttcaactggaagacaattggtacaaaaggatattattcaatttggaaacttgcccccaaaaagagccaccctagaggaaaaatttaaaatacgattgatgagattttactttttcccatgcttcctcaagaatccaagttttttgttttctcctacccaggaaaaatggagaatatctgaaggatactgaattttagataagctgaaacagaattaatcactacagttacttatcatataatgatgatttgatgaaagaaatgctaccggggtggcaggtgctctatttctactaatagacattaacaaaaaagaagcattacctttagtgatgcaagattacatatcagcctatgttaaaacactacacatttattttccaattgttaatatcattgatctgatttatagtattaggcagccacttcatgtcaattaatctcctagaaaacccaatcaagataaggcaacattctgtacaaattatcattactagtgaaactgaaggaatcttccacgtttaatcaacaatgagaactatgattcatcctttaactttctccccagataaaataatgttatagattcattcttgcaattaatccctgccttggaaatatgctttagaaatggtaaatttagaaattttaaaccaaagattctccacacatgaaatccagagttgattttgtaaacaggcagtcatcagtggaatattattgaaaaattcaacattttctgacaattatgaaattacaatgtctctgaatctacgattatttattgagaaaatatcgtttgccaaatcattgtttctgtgaccattatattggtcttactttaactagtaaatataacatttgttttattcaaccatttttccaaatcaaacatccgtttgaagtccatcttaaaactttccagaactgataaaaaaaatacatattcttgaattcaaatacagtgcaagttatcttgtaatgatttattaacattaaagaaaacataagaaaagaggtatagccctttttgtctagttaacattaacttatgaaggtacaatttatattaaacaaaatgcagagatcttaaatattcagtatgttgagttttgacaatttcatgaacccatgtaatgaacacctacacaaaaaatataatatttttatcacactgtaaaatttcctaatatccctgtacagactatcttgtcagatgcagctgcttttgacttcaatcaaaattgcttagttttgcctgttcttggacttcaatagagtgtgtaccctttcctatctggcttcttttgctcaacttaatgttttttttgtttgtccttggtccatctattttattctgtttcattaatgtttttcagattccctttaacataatatggttttcatacctgtgttaaaaatcttgatttcattaaaaatcttgattccattttttatcacaaagactagatgattaatattaagggttactttctctgaataaataatagacaaattcatgtagataagtgtatttaaaataaaaaaagaattattactgttacagagaatgataaataactctatctttactaaaaactgaggagcaattaagcttaagttgaatatacatatgagcttatttatttatttatctatttatttatttttgagatgacgagtttcgctcttgttggccaggctggagtgcaatggcacaatctcggctcaccgcaacctccacctcctgggttcaagcaattctcctgcctcagcctcccaagtagctgggattacaggcatgcgccaccacgcctggctaattttgtgtttttagtagagacgtggtttctccatgttggacaggctagtctcaaactcccgacctcaggtgatccgcctgcctcggccttccaaagtgctgggattacaagcaaaagccactgtgcccggcccatatgagcttagaagttgttgaatatttgaatacttgaatgttgtaaaacagctaaaaaattgattcccacgtacatgcttaaagtaaaaagaaatgtattaatatgtgcttctttcacttcctttaatctccttatctctttctcttttttaactgtttcctgattctcagagagaatgtgcccatcctatggaagagaaaaatggggacaagtaagaggaactagagattagtcttacttctttctttaactttagattaagtgccagtactgcatattcaaagaaattccataaatggggatgctcctgaaggcccagtgatttttattccttgaaaagttgaagatatcgagttttgaactccatgatccatgtttctaaaccataatttatttcatattaaaaaatcacttaattatacctagaaattgtaaacaaaacacacaaaatatgtaaaaaaggatattcaactctataaggaatgtcagtgttatgcttctcatgaatactgtctgtgcttttagatttaccagaataattctgataaaaacagatgttcaaaatatatgtattaaatggaaggagatgatataaccacaatgaaatgtaaaagaatagcataaaactatgagaaatggatttggaaagcaaaaactcaaattagatagattcagaggtaatgttaatttcaccacaaagctgaagtctcaataatgttccactaattactgcctgtttataagtgtatctctacactttcatgtgtggagaaactcttggttttcaaatctgtcactatttccaaagcgtatttccaaaacaggaggattgcaaaaaaaaaaaaaaaaaaaaaaaaaatggctaaaacctgcactaagtattttaaaagtatcacctcctttaatcctcaatacaagtttatatcattatttattttgttatcatacttattttatggttacaaaattataggcttagaaagcttctgcctgatgttattattctaatacttggtgaataatctgaaatgatataatttagattatgtatctcattaaagataatttattttgggcccctaagaaaaatgttttgggttattttacagaaggagaaataaattcaacttaattataaaatatctcaaataatatatggcacagtgtcttgtttaaaagtattcattcttaaacactgtgcaatatgttatttgagaaatgttagaattcactattaatgaacttctgaaaaaatgagaaataaacaggaaaacaaaatgtggcacataacagaacccaagattcacagacaatctgaaaccatataatttagattatgtattaaagataaattattttgggccctaagaaaaatattttgggttattttacaaaaggagacataaaatcaaattagccagtacctgcattttaggaaactcttcttcaaataattattactgtcagaaaaaaattggttctcagcaagcaaattatttaataaatttccaaattcaccatgatttcagtgtgcaaacctttacattagtaatcaaatctctattgctagaacatgcctaaaccattgaaaagcattcaataagcgctcaaggagcaaagagaagaagaaatatagccaaccacagtaatttacactttcctcaattatatttcaaaaaataatatttcaacaatcactaataaaaatggtgggtaaaagttcaatgagaaacaggatagttacagtcttaacctagttccccacaatatagctttaatacttattaagtattaagtacaaaattactggtaaatacagaagggaaagctggaagacactgttttgtcaaagtgataaaagccatcactaccaataatgaaacagatacattgtgtgtcttttgtgttacatgctatgataaaaacagtatcatttttgaaacattcatgcacaaagtctacgaatcatgagaaaatatcaggtgaattaaaatttagagacattttatacactcctctggtcctgaaaaatattaaggtcatgaaagtcaaggaagtattgtggaaatgctaaaattgagactaaaaaaattgaaaactaaacttggttttaggaaatacacaataaagtagtaagggctgaagaagtttcatattttcaacttaattttcattagtataaaatagttatgtatttatatatgacatatagtatacattatatataattacatggtatatatacacttaatgtatgacatacttatatatacatataatatatgctgtatatttatcatacacacaaaaatctacctctatgtgactatttatcaattagtaagaggaaagaaatattgtctgaccagtgagtctcaatactgtcaaggtcatcaaaaacaaaaaaaaagcaaaaactatcacagtttagaggagactgaagaaacatggtaaataaaagtaattgttattctgtatggggacctggaatcaaacaggacattaggtaaaaagcttatccaccatgatcaagtgggattcatccccgggatgcaaggctggttcaatatacacaaatcaataaatgtaatcccccatataaacagaaccaaagacaaacaccacatgattatctcaatagatgcagaaaaggcctttgacaaaattcaacaacccttcatgctaaaaaatctcaataaattaggtattgatgggacttatctcaaaataataagagctatcaatgacaaacccacagccaatatcatactgaatgggcaaaaactggaagcattccctttgaaaatgggcacaagacagggatgccctctctcaccactcctattcaacatagtgttggaagttctggccagggcagttaggcaggagaaggaaataaagggtattcaattaggaaaagaggaagtcaaattgtccctgtttgcagatgatgacatgactgtatatctgaaaaccccactgtctcagcccaaaatctccttaagctgataagcaaattcagcaaagtctcaggatacaaaatcaatgtacaaaaatcacaagcattcttatacaccaataacagacaaatagagagccaaatcatgagtgatctcccattcacaactgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctatgaatgactttcttcacagaattggaaaaaactactttaaagttcatatgacaccaaaaaagagcctgcatcgccaagtcaatcctaagccaaaaccacaaagctggaggcatcacgctacctgacttcaaagtatactacaaggctacagtaaccaaaacagcatggtactggtaccaaaacagagatatagatcaatggaacagaacagagccctcagaaataacaccacatatctacaactatctgatctttgacaaacctgacaaaaacaagaaatggggaaaggattccctatttaataaatggtgctgggaaaactggctagccatatggagaaagctgaaactggatcccttccttacaccttatacaaaaattaattcaagatggattaaagacttaaacattagaccttaaacgataaaaaaccctagaagaaaacctaggcattaccattcaggacataggcgtgggcaaggacttcatgtctaaaacaccaaaagcaatggcaacaaaagctaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggctatcagagaaatgcaactcaaaaccacaatgagataccatctcacacaagttagaatggcaatcattaaaagtcagggaacaacaaatgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactagaaatcatgctgctgtaaagacacatgcacatgtatgtttactgcagcactattcacaatagcaaagacttggaaccaacccaaatgtccaacagtgatagactggattaagaaaatgtggcacatatacaccatggaatactatgcagccataaaaaatgatgagttcatgtcctttgtagggacatggatgaaactggaaatcatcattctcagtaaactattgcaagaacaaaaaaccaaacaccgcatattctcattcataggtgggaattgaacaatgagaacacatggacacaggaaggggaacatcacactctggggactgttgtggggtggggggagggggagggatagcattaggagatatacctaatgctaaatgacgagttaatgggtgcagcacaccagcatggcacatgtgtacatatgtaactaacctgcacattgtgcacatgtaccctaaaacttaaagtataataaaaacaaaaaacaaaacacagggaattaaaaatgaataaatttggttctctatatatgtacatagtgctctaactttttaaagcttaaataaacctttaaaaaactaaaaaaaaacaaaaactaaaaccatctgaataagctatgaatttgaattaataatgtaccaatgttggtttattagttgttacaaaaaatgtactatattaatttaagaagttaacaatcagggaactgtatatgggacatatgagaactgtacacttctattaaaatatcacttaggtctaaattgttctcatattatttaaataaataatgtaaaatatagttgtaaatagaccatttccattaccattttcattataacaaagctcaagacttgaatatatcatttaatataagaaaaataatgtttaaatgtaatatagctttacttctattacatttaatttttataaatataatgcacattgaaccaattatttgtcaacaaatttaataagatatacttatagaatgaaacagagtaaacagagaggaagagatagattttcatgtttttctgtgctttcatttggctgaagtttggttttttgtgtgtctgctaattgataaaatcattaaaaatgtttttagtcattcctttaaaatttcaaagaaaagctaaaatatttaaaaactcattgtttaaaattaagagctaattgatgcagtaggtattgatgaaagatatgattatgtcatgttaggagaaacaagcataataatatttaaaataaattaatatgcaattactaattaaatcagcatgtaataccaggtaagaagaaatactgaaactggtctaatcatcccacagaactgatgtttatgttttcgtctgaataaacctagaaactgatgctcccagttctgaaacttgcaaaagttacatttgccctgtctgagttcctttcccaggaaaccaaccattagacctcccaggtagtatcaaggaactggagtttgccagatcgccacatcaggaaaatgagatgccagaccgcttacctgtcttgattgtctaaccaaccacctgcttcctattgaccttcatttcccctccctaattcccattttcccacatatgattacttttcttccctgctatataaaccggcaattttagtcagccaaagaaatgaatttgaggctaatctcccatctttttggctgaagcacctgattaaatccttcttttctggcaatgtttgttgcctcagtgattggctttctgtgtggtgagcggcaggacctagaccaaagccctggcattttggtaaaaattacctctatggtgagctaactattatgcatgtagttgggcagggtgttcatcttcatgggtcccatttcattaccttttagagttttttcataaatttgtgggattctatagaaaagttattaaaggttatatattcagtcaattataactttttataaccatataatcacatctgctttttcagccattgaattttgatcctacatcatcatcatcatcctatcattctattcttcatcctatagctattattttgtaagtaaggtcttttacagtgtcccctcatgatcaattaaagggcattttctggttgctactcttacaaagtttgaatagaataaaaatcagaacttgtgttgatttgaattgacaaatttatcatagggaaagtgcccatctgtgaatagaatgaagtttaaaagtatgtttattagtcttgctgttatatgggatttagcattcttcattttgtttggttataccactatgttaaccatttatttttcttatttcaaaaatataactagaaatataattagaattgacatgacatacagttattccataaaagaaggtggtaaaaacaaaaatacagttgtcccttgccatagccagattattagttctaggattcatgtatataccaaaatctgcacatactcaggtccctaattgaccctgtaaaacccacagaggtttcacatccatgaatattgtatttccatctatgcttagttgaaaaactgcatgtacaagtggaccctcacagttaaaattcgtgttgtccaagggtcaactgtaaagtttaataaaatatttcctcaaaaagaaatgcttcatggtgaaaataggtgtattttacttttagaataatattttaggaatcatgattggatgaaagcagaaactgctggatataattagaaagctcattgtcatcatcgttcctaccattcaatgagtgttatctattcattgcatgcacccagcaccataggtctcatgttacattctctgtatcctttaacctttaataactaccctaaaagtattatagttttttttaattgagaaaactaagtccattagaaattaattaattttccattattatacaggtaggaagtggtcatcctaaaactgaaacctatgctgtgtgactcaatagattattcccttttctcataacactgaaccttgaacatgattattttactaaactgaatcaagtgcaacttttctgaaattagtattaatatttattcatattaatggtcttacactctacactttcagattttaagactcgggaaataaatatgaattttcaaaatcgcatggaattttctctatgtactcaagccctatcagtctcttgcctaatgtatgtatacaatatggtgagcaagtgctcagttttggagtgagaatgttttggttactgacttagattggctacttatcagcagtgagatcttgagcaaattcattaatgcttccctatttctacactttctcatctgtaaaatgaaaacaatgaacacacaaagtttgagtctgtgggcagctatctataagtactaagtaagttatttcatggaaaacacttagaatttgcttggcacacaatgcaattaataaatggtaactcaatggtaattattataattcacttattattgtaaaatacctttatttcattcaaagtcaggaggtatgatatcagaaatgtggtaaacatatctatgcagtattcttattatgaacaaatttggataagaacaaatttaaaattggtctagtatgaaattagttcctaatgagtatgcctaatgacaaaaggagtaagaaaaataaacattaaaattattataaatctaaagtttgaagacatttaacctggtaagcaggacataattttctatatacttgttatgtcaatatttaccaaaaaacttgattctttcagaaactcaaggttatttaaactgctaatactcaccttcctaaattgtgaatggcattttaaatgtaaatttatgaagcatcctttaaaatttcatgttattaatactgaaagaaacagaacttgattaaacacaaattcattaagctgactgtgaagcacttgggaccctttgcgttgatccttatagagccgtgcgtctagaaaaacctttcaacgaaaagaaaaggtacatttggtcaaaggggaatcatattaatgttgcttaatcaatgagtttagtatttccgggacatgaaaagtagggtaaaaaaatctcaagtggcatgacagtcatataatgaataaatacataatttctctctaatgttttataaatagaccgtaattcatatagttcatatttatcaagttttaaaaagtgttttttgttgttcttgtcattattcttgttttaatctatgtaatttattataataatctggaaaggttatactcgtttctttaaaaaatttactctatatgagcttcttcataaatttaactcaaagcaaactcttgctttctatctcaggaacatcagcgtagaaatatatatgttataggatatttttctgtatgataactgtgccattcctaatttaatgataaacctacttatagtacttctgtaatgtgccaggcactgttctactcaatgaaaaacaaagtgccagctttaatgcagattcaattttaaaggggtagatatcataacaaaaagcaaatacatatgcagtattgttgcagataagtggtataaagataaccagcttcagatagtctgttacaagagtcataaaatatgcaggtcatttatcatacatggaaaagttgtggggcttttttctttctattttaaaatttattatgtgtcttcattgaaccttgtgaggcaaaaattctaatactaccattttcgttttcaggtgagaaatctgaagtacagaacaaattaaatgaaatgtttttaagaaagacaaatgaaactaacaaatggtaatccagcaccagcatcactgtatatttgtattgtcagcagatttagctactatggaaaatctttgaagaatctttctcaacatgatttttgatatacacatgctctaatttattgtgggtatattcaacagagtagaattgctgagtcatagggtgtctgcctgttcagtttttgttgacactacaaaataactaatgtaattgtgccaatttacttatctaccaacaatgtatgaaagttgtgattatccatatctctaccaaaacatgagagtatattttctttcaattcaaagtgtaattgaacttaaaataaataaatataattaaaactccattttggtaggtattataatccatggatggattacttttaaaaatttcattttttatttgttgctgatgtataaaatttatttcttttaaaaaatattggacggtcacagtggctcatgcctgtaatctcagcactttgggaggctgaggcaggcggatcacctgaggtcaggagttcgagaccagcctgaccaacatggagaaaacccatctctactaaaaatacaaaattagctgggtgtggtggcgcatgcctgtaattccagctactcgggaggctgaggcaggagaatcgcttgaaccctggaggcagaggttgtgctgagccaagatcgtgccattgcactccagcctgggcaaaaaagagcaaaactctgaaaaaaaaaaaaaaaattgaccttgtctgcagtaaacttgctgaactcactttttaactgtaattttttttttctgtaaatactgttgggtagttctatatataataatgccatttgtaagtatttaatttaatgccattttccaactataaggagcatttctagtttgtatttattgattttaagctcaattgtttgatgattagaaaacacattctgtataattttagccatgtgggggacatgttgatacatccgtgaaaacccagcatttggtaaattattttatatgttccatccatgtgcctgaaaagaataaacttcatagttgttggatacatcattttaaaatacatcaggtcaatttcgctgatttcaatgttcaaatcttatgtttccttgcttttttttctttacttattttgacagttactgagataacttttgcattagttttctattgctgtcataaaaattatcataaattttgtggcttaaattaatataatttactctcacacagtttggtcagtcagaagtcagagatagctctcaccaagctaaaatcaaaatgtctgtagcactgcatttctgtagactctgaaaatgaattcacttccaagctcattcagattattggctgtatttatttatttttatgttggtagctgtcgactggggttccttcaagagtattcttgcattttcaggctatattatagctccactggtgttcaaaaccagcaatagtggctaagtccttctaagtcttagattgtctttgatctccccttatgcctcatcttatccagttcctcttcccttgcctctctctgactctagccagagaaaattctttccttttaagggctcacactgagattgggcctaccagagtaatccaggataatctccctattaacttccataaccttaatcgcatctgcaaagctatttttgccaggtaagtgtacagatatctttgggaggctttaattcaaattatatgacctcccaaacatcaattttctaatttctaaaacagggatattccttccttgtaaagctactgtgaggactaaataagataatgtgcataaaaagagcttaccacagtgctcataatatagatatagctccataaacaatacattttaatttattttaatatactataggtaacccatgctttagaggtttttatagttccttcctgtctgcctcaggatggtaaaaataaataaatattgactgaaaaattttctctcaatgaaaagatcattaaaaaccagacatatataagctctatattaacttgagataaattcttcacatgaccaagaaaacattatgtctgccttgacttgctcttgtttacttacatcaaaataaattttggggggtgagatgaacctcaaaaacctgccatcactgtcgagaaagatttgtctccaaaacttgcataagaatgatcagcaactgtgtaattttttcttgaaaccaggcaaactatttacttaatgatacaattgtttaaagctaattgagtcttcacttaaagagagaaaactacttcaatgtcttatgtcttgctcatgagaaagacatttgaaaccttgttataacccgtgttcaacatgtagatagaggaattaataatgttttggtgaattcttgacaaactaatagaagaacatgtttacgaagagcgtaagagggtagcatttaatgcatttataaaagtgctgattgtgattatgatataataccataaatgtaaatcatatttatttgtaaaataaggtacatgaaagtagttataatttagaatactagaatgtttattgataagtagtgaggggatgattgacctaaggacttgagttttattcccaacttcgtggtcaattttgtaaccatcaatttatactactgctccagttctcagttttctcatggtgaataaaaagagtgactaatcaggactttaattttggaagcttcttttataaatctgtgataatgactttattatacctgtcttttgtattttaatgaagtgtgaaatattttgacattaacaatctattaaactgtgaacgatttttttggaaaaacatttagatctttcttaattgcataaacttcatgtcttatactaaaaggacaaatagtatgaaaaataccttgcaatcttgcacagaataaaactcatttcatttaattttattacaaacacagcattgtagatgggcaagatagggatatctatttatacacatacacatatatagtatgtatgtatctaattttaatgtatcttcctaatacataattcataatagataaaattcatgtcaactaaaccaatagataattcataatttataattcattggactaaactaagtactagtactatggaagaactattcaaatgaaaaatgagaataatagctaaatttctattttttttttgatgctatttcaagctttaaatgcactgttttttttttcaagaaagtaaatataaagagtatgggcaaaatcaaaggtgaaaaatatgaccatcaagtacacacatttgatattatcaaaccatagaagatatgaccatagtgtcaatgggataggatgacctcagttatctaaaaggaaatgcattgtgagaaacttaccagttcaacaatgtattgacagctttgcacagtaatatagcttctcaaaataatgtttaagatcaaatctttacctttcctataaattttatcactctgatgtttaggagtttagggtttgaagaaattgaagatcaatacatgtaaatattgattatttcataaaaataaatcaagtaaaagagatgaacaaaattttgagacttgcatggtagggaggatcttattctaggcaaaatgaacagtgtgagcaaaggctaagaaagggagatatttatgagatgtgagagagttaatctgaacaggataaggcattatcagggagaatttgagaatgttcagaatacattgacaaatggtcagattatggaaaagcttgaaggtctgccagaagaagtgaccttttgacacccgacaataatgagaaattgcaaaacttttgaaaagtagagttgcatgattaaaatgatatttgagaagttactgtttaacaagacactgaaaagattagagagggaagtggaaacagtcaaatcacataggatgctttgaacttcaaattgaacattataaatttctgaaagaaggatgaactatgaagagggatccaggggcagttagtgacatggatgaggctggaaaccgtcattctcagcaaactaacaagaacagaaaaccaaacaccacatgtcctcactcataagtgggagttgaacaatgagaacacctggacacagggaggaaaacatcacacaccggggcctgttgggggagtgagggggtaggagagggatagcattaggagaaatacctaatgtagatgatgggttgatgggtgcagcaaaccaccatggcacgtgtatacctatgtaacaaacctgcacattctgcacatgtatcccagaactaacatatatatatatgtgtatatatgtgtgtatatatatacatatatatatatagattctgtaagtagatttgttgcctaagataattcacctatcactttataccaaaaataaagttagcactcaaccgaacaaagcaaatgtaactcaaagggtgtatttcaaaataagatcatttatatataattaaaactagttacttggaaattaattagtatctgtcattacagtagaaactcattaaacaaaagtgactcaaagaggtgaagcatttatcgaccagtaattcgtcttgttaaatttaaataggagtttgtattttgtttttaagttatataatttagaaagtctcagattacaaggaacataatttcttcaaactttcatgaacacaagaatgttgaaataactaaaaaatatttttagtaacttcaaaaagaatctagaggttaaaggcccaaatgatctgtttaattcacaaattacagttattctcctgtaaagcaggcatgcaaatttttaagattaaaaaaaaatcttgaaatgaaaagatggtctggtaaaatatgtactatcacattaatgtcattcattttttcatgtgtctaacatacacataataggtcacattagaggtactctagaaatattttgtagcttaattaactaaaaataattaatacagtaaccacggtttaaaaaaaaataaaagtggttcttcacttatgcactttagccaaaagagaaaataaaacaaagcaaaacaacaaacaagcatgtccttaaaaagttacaatactactttttaaatataatttttctaatttgatcagcatttttctataagaattcggttgtgatttgtagttaatttttggatatttcagaacttgattttaaaatccagaaaataactttacatttatagaaccgcagacattttcttccagtatttaattagtatgaccacctcagaaatacaaaggcaatgtatttgtattagataaatgccttaggataataataataactcgtgttatgcctaagtaagcatgtagatggatctaggcaataaattttcaaagatgatgaaaaataaaatatctattattataaatacattatttttcccatagttaaatgaattcctaaaataacatcggaagtcacatacttcttctgagtactatttttttaatgttttcttgatatttctaaacagttaagctcataattttaaaggaatcatttataaacatttattgtatatagttagatacatatatcaacagaaaggacagagagagagtaaatagaaactgacctcattcactgtggcatagtagctttcatgcttgaaagtgggtgagttgtcattcctgtctctcaccactattcgcacttcatggtagataatagtgcccacttttttgttgatgcactggacctgcaccacaatggagtgtatgttcatcggtggctgcaatgtagaaattgcatcttttaaaatactaattaaaaacaaagcttctcatcactgtcaaagcactcgttcattcagtacatttttctattcttgtttatttttaaattataataatctcaaagaaaatgatcattttaaggacaagagaagacaatcataattaatttattgtttaattttgtatctcagcgtgtggaattcaggtagcattatgctcacagttagtggatggctaatgagcgcacccacaaaattaatgcttagaattgatgggattaaacgaagtttgcccctccaaagattaaagaagcaataatataaacttttaatttgaagaaagtgttaattaataaattcctggagaagagagattgtttaacttttatgtttatttatatttttgctggaatattatatgttcattgctgatcaaattaaaaatactgattaccaaaagagaaaatccaaaagccagccaactaaacttactcattctacacatttaaatgcttattttgctaatctttttcactctctaaatatgtacatattatagacacacagacacacagtgaatatcagcccatgtttataaatatagatttactatagcattttttgtataatactatgaagttatgttatgtgacagcaatattatacttcattgtaagcctatagcataatgtatccaagtaataatttaaaatgaactactccaggctattatattttgtcattataaaaaatacttcaatacatagtatacataagcatatgcttacttatctaataatttttataataaattccttgaacgggaaaggtcaaagatatacttcctcaagtgccatggctaacagtttgcagagctggaatgcacacctacaaatatttgactctagagtcagagtattgaccactacaaagtatttctttgtgatttttaaccccttttgagcttatgcaactttatctctaaatatgtcatttttgcagtgtcctatcctgacccctccatcttaaaaaccttgtctccaacctgacatctcctttcaaatttcttccaatttatttttctttattgcatttctcaccgaaaatttggctcgttgtatattttatgtacttgttttggtttgtctgccttcactagactggaagctcaatacaacctgtgtgttattttagtcatgatagtatccctctttccagtaaccagccctatgcctaagacagatgatctggagtcaaactgcatggcttccagttccataacctactaactgtatgatccaggaaaaagtacaaagtatctctatgcttcgtttattcatctataaaattaaggctaatagttacaccaatgagaattgtaaatactgcatgtgattagactatactaggcatatgttaaacacctaagggattacatacatatcctattttatttattaaaaaataaatatccaaaatagtgaaaaaataaaatctataatgcacgacacatttgtaaatgagaaaaatgctacagaaactatatctaagctgaaggaaatcattatttagtttcaagatatttttatggccaacaaagaaaaagaaagttgacttgaatttgtagctgtctgaatgatgctacctagaaagaataaattgaggcatcattgacatacgaaaagaggtctctagtgaaatcacacatagctctgtgtttttatatctactctatttctcctttaatcactgatataaatgaaggcattaaaatcatgtgtataaaatctgtgaatgttacaaaccttggaaggatgtataaatacatttaatgacaaaagacatggttcaaagtcatcttaataagtcataataatgggttacaaaatggtaaatttttgcaataataaattttatcctccaatttgtaatagaaaaaaaatcacccaaatgtaatagacagctacaaacattaatgtaaaaatgtaattgtgaaattttgatagctaaaagctgattttacatgacagcactgtaaatgggctactggaacactaatgcatactgtacattaattaataatatcagataataatatataggtagattataacaggtaccattttacaggtgcatagaagagaaatttgaacacttttgagaatgtataaaatgggaggattttaaatttaacaacatatgatttgtcaaatatctaaatggttgtcatggaaacatccattagttgacttactgtagtttcagagagcagaaataagaaaaatagttgaaaaatatttcaaagcatgttttcaccataagtagagggcttctcttaatccaaatttgcaccaaataattatgtgcctctatcaaagtatctcatgtaactcatatgcacctactatatacccataaaagtttttaaaaaataacaaatagagcagagattcttatcagtagaagagtatagtttatgttagaaataaatttatgccttcgcacttccaaatacttttcctctgccattatgagctaaaatatttgtgatgcttcaatttctttttttcacatttgtctttgtataaaataaagaaaaatcaggaggaaaaagtgacatggaatagaacagactattctataaaacaagacccatcactgaaatatgccagtttgaggataaaagaccattgaaaaagactagctcttagaagtttcctggaaagaatttgaattagatgacctccatttttactaccagctttcaagtgtgtaatagaccttttaaggcatgtccagcatattttaattgtaaattaaaaacaaaataaatatgtgtactgtttgtccttggcacacctcttggaagacaatgaggtgaattatgcacttttaaagttatttatcttccaattattgcaagagagacctataaaaacattctatctcaacttctaattctacttggagtggtaccactgggaccaaaaggtcaaaatcttatcaaatagaggatcaaatgcactgtgtactgaggcctcacttagtcctgctaagtacccataaattagatctaaccaggtcacctggaacagttatcactctcaactttagctccctatgcaactgttagtggcatggctagaacttagagggcaataaattataaccataatggatcacaccgaaggcaaaaattccctgtggctaatatataacacacaatgtaattttgtattggcatagattcaattctgctgtataagaaggtcatacataaaagtacagttctaataagtccattagtgagagtttagggactctaagatgcttaagaatgcattagggaaattttgctttatctttcataactggtggcaaaaataagccatggtaatttgaccttttctaattttctttaattgctttattcatcaaacaaagaagaaaaaaaagctaggtagaaattgtgttcatataactatttaaaactattaccattcatatatacctaaacatgcaagctattctttcaatttaaaaatgagtgcttaacacaatactctgaacgtatacttgcacatttgtgtattagtgtacctgtgtataggttatgatatgtgtatcaggaatgatatatatcaacaattaaaggatactatcattaaaaagtgggtttgagagtatgaagagaaaaaattttcccacaaaaatgtaaaaattttgtaactctgaaaaagaaaaaaatataaaatagaaatttttgttatgaatttctcaatcatttaggattcaacatgaaaattaaagtttttataggggatttgttgatattagcagtttagattatagcacaaatcttcaatccaatatattttttttctagaaaccaaatgatttggaagtcaatgatttggggggcagggaatgcatttttggcaaatctgtaggaatttatttttcataaagtataggcaaagtttgtctaattctcaggagtgaattttttttgtcatgatatttctgtctatggacttaccacctttataacataatcattcctatttcacaagtaatgtggaagacagtgaaaggaaataagacactgtgtgttttagaaacgacttttacataaaaaagcaaacttaaaggaaatggctggccagagttgtcagtgtccttcacaaattaaattttcacaatgaatagtagcatatttactgaagatattacctaaaaagaaaatatcaatttgtaaatacaattatgcatatgtgacatgtagatacatctatagatttttcacagtgaattattaaggacattcagtctatttaatggtaggtatttgttatatgaaaagtttaatgtgggttaggattaatatgacttagtccttggatactaatagcaacttttataaaactgatatgaggtgatcataaataaagtcagtcaaaaatactattaaataatatggattttagaacaaggaattgcataccagtgttattagaaaataatttatacagaagcagcatttaagatatctcttagtagcacataaaattcaactgatagcactggataacagtgatttcaaagtttatgttcaaaagaacatcagggaaggtatggtaagaaaaaattggatatggtcatgggacaataattacattagttttcttagtttgtagttcatacatttctaaataaaaagaaaattatatagacagggtgcatcttgaatctagcaaaactcaagagacagatagaaaacagtttgcaatgaaaaggtatctgtgggcacagtctctgtttcagcactctggttgtagaataggttgaatcaagacaggtggtagacaacaattagtttatatgagtgatgactaagaggtcttatactaaagttatgttgactgatggagatgcaagatacaaggtggagataaaactactaaacttagcagttgaatggacactggcctgggcaggggagtcaagccccttttgcagctaccaagttagagtctgaaagaaaagaagctaagatatttgatgttgttatgaacataatttctctcgtttcaaaagcttttaaaattttgcccaggattttgagataagtattataggactgtaccagagtcatacttttctttctgttattattttaattattgatattgtcatgaccattattatcacatgcccaatagtgatgagagcattttggccatgtgagacaatcatttagcatttcaaaatttttatgtgatgtgcctttattactgagactcttcatgttcaccccaaatatcacattctggttgtttctcttttgtgacttttaattttgtaactcttcctttctttttttaatttttgggtgctgaaaatttatgtaactttagtgaacaaaaaaataaaaataagacataaaaataaatgatgaccataagggaaaatcttataaaccaagttttaaaattataaaacagttcatagtcatacaatctcatgtaaatgctttctaattaaatacaaatatctgagcgttgggtatttttattctttatattcttcctcggaaattttcatgaagatcatgtttatcagcttatttttaacacactgttaaaaatgtttctgtctatattgtttgcttttaattctattacagccataattattcaaacgtccccattaagagacagtttattgcctcaatgagaaaatgtagaaaacatgatttgcatcactttctctggaaaataaatttttctctaactgttgctaaaaagatggtataattggatatggatctaccatgtggccctactccttgctccctggctatagattcaaaccagtgagtatttaattgttatttctctcagaaattttaaaacaaaacaaaacacagtgactttaagccttctttaatggccactgcatcaaaagtttatgaagaactggcatggcatgaacacagaaaacacttaaagtcaaatgaaaaacaaggaagtggagtaaaattataagtgtataaaggaatctgctctgcagagagaaaaatagagaatatgcacagagaaaggcagaaactagagaccatatggtccaagaccaagtagttttcctctctccctggtaaacatacaatttccataaaagtaaattattttttatatctatgctattggtattgttaatattctctcccatcagctggaaatcatttgaaggcattgttgtgtcttccttataagccaaataactttgattaaaatcagaatattcttagaaaagcataatttcataacaaaaattcagtggaaaattttctataaaaataatttcaagagcaatttaccactaagaagggttaaagttaattataggctagtgattataatacaaagctttcgccattgttagtaggatcaaactcaaattgttggttctattttgatattcagagcatatatatatatatttgaaatggaatatatatatataatatataaataaaaatatatttttgaaatggaatatatatatataatatataaataaaaatatatttttgaaacggaatatatatatatatataattttttttctttttgagacggagtcacactctgtcacacaggctggagtgcagtggtgtgatcttggttcactgcaacctccgcctcctgggatcaagtgattcttctgcctcagcctctacagtagctgggattacagggtacctgccacaatgcctggataagttttggactttagtacagacgggttttcaccgtgttggccaggctggtcttgaactcctgacctcaagtgattaactggccttggcctcccaaagtgctgggattacaggcatgagccatcacacccagcccatattttttattttgattcattatattcataaaagaacaaccaaaaaactttgggcaacaatcaaaagaattacattttaggtaaatgccctatattttaaaagaaactacaaatattttggtatttatcataataatatagttatttaataataatgtatattttatctatatttagcttttgggaaaaaacattttacattaaataaaatttaaaacagtgtaaataaaggtatatatatttacatatatgaatatcatagtattaatatatatttcattaatactggagagcatattttcaaatacaatctatataaaaagtgtgcactcactttttttaaaatgaattctctactatatctttgtagaaaatattaactaggatcatagagaagcatacagaagaaaaaatatcttattctatatcaatgtaaataatgttaaaacaataaagtaaaaacatacaacacctctccaagtaaactaagattatttcaaatatttacataatattattattttatttcagacattacaattatttagcaatattggtatggaagcatatagggacaatatatcgagaggaccatttagtaaaatggataaaactccctagtccagtaatataatgatggtaaatgaatttatctctataaaacaactaaacaattgtagaaagatgcatgtacaaaaattttcactgcagcatttttgtaattcttaaaaactgcaaacaaacttgacttccaaaataggagattcattttttaaaaatctcttatttattcatgcaataaccaatcatgcagctaataaaaataattatataaatatacatttgtttgcattataattttacatgtattataaattttatgtaaaaagtaggccgacagcaaaatgaacagcataatccaatttaaattaataagtattataaatatacatatcaacacacataaatgcttgaaataaaatgtggcagaataaacattaaatgttattttccctaactgataaaattatcttcatatatatgcttcttattttctgatatgtttaccataagcatatattattttacaattaaatgagactgtaatttccagtagtgattagatttggactaaaagcccagatttacctcactatttgtctagcagtaatggtctataggacacataaaacagatgggcactaggttaaggatattcagaataaaagcccttatgctttgatgaatgaacccctaaaagcactgtggcagcaggaaaacataattcacaagaattcaaagaattcataagtaataaagcacatagtaaactgtagtaaaataagaggcaaattgagatttattaaagactccaaattttagacatgaaatagtataaagtatcaaccactccataacctattgtaaagtggatcataaaccctgagcaatgatgtgaaatgattcaggttcactaagctgagtatctgacatttggatttcataagctgggaacttgtgggtaagcatgtttagagttactctctgagttttcccagggcccagtgcaattactgattataatccactaccctctgcccctctgtactcaagaaagactgagatgcaaataagtgagtacaaagttactttagagagctacttatacctattaatttttttttaatttttccagaaatgaaacatccaactacgttggtaatttagcaatttttttttgaggtagtgtctcgctctgctgtcctggctggagtgcattggtgtgatcatagttcactgcagcctccactccccaaccccaagctcaagggatcctcccaccacagtctgcagattagtgggactacaggcacgtgttaccatgcctgcctagtttttcaaattttttgtcaagacagagtcttactctatttgccaggctggactcaaactcctgggctcaagcagttctccccactgggcctcccaaagtgctgggattacaggtatgagctactgctgtgccaagcccaatatagatattcttaataaaaaaaaatttatgctatctgagaactacttgactggcatattaccatgaaactttttctcattttttttttcttttttgcaactatgtaagacatttccacagttttgcccttcaaccaatgcttactagttgtaaaagcaggctcctgtgagtgcacccaccaaactacatcttcaagccggcagctgagtgacacacttacatgttgccattgttggacagaaatgagttatagccatgcttgtcctactttgccaagggtaccacctcttttttctaagcactatattttcttcttgttcagaaattgacaagcttccaggatattaaaggggaagtctaacggttctccaggacacagatgttcccttcctttctcattcttctttaaatgagttaaagaaactgttgttgctatactcaggaaataaactcaaattatgtaaataattcaatatcatataaacacacacatagacatttaaattataataaacttatattacaggggcaaagaaaaaaaatcactaacatctctatccagaactcttccggtgctgttcaggaaaagcatttgcttaacaggatccatcaacacccagtaatccacattatcctttaaagaaagttctatggtggggtctggtcctccagcagtccctttgatcagcatgttgtccaccagaattgtacctgcaaaccaaagaaaggtacttgaaaacatattctactcatatgaattctttagcaaagatcatgctcttaaaccgcggctggctcacaatcagttttaaagctgaaaatactcaactgtatatctagcataagacagaaaatattctttaccaaaaggccaaagtatctgcattatattatttataaataatatttttggtggaaggcagagatacagacatggtgagttccatcatccattttgtgtttccctctaacaacataaatctgtttccccccatctatcacttctcacaggagttatcactgaattttatcctgaacaaaaggaaatgcctgtaatagcagagtctgatgtctcaattaattctgttagacctctgatgtgaaaaaaagatattgtgaaactaagaaaggaagaggaaatagatttttaaaaagtagctgagcctcccatggtgagaactgcttctttttatcttagagcaaatacataaaacatacatcttgacatgaaagacaaaactagtgtgcagaaatggaatagaagccattcttctttaagacatgtctgggttactctactagaacaacgcactaggccagtgtaacatttcagtgattgctttcttattattttttttcagcaagctgaattgtagacagtttttgaataaaacttgaaaagattatgtctctaaccctttctactgtgttaaagatcccatgcattttacatgtcgaatgcaaacagcactgatgcaactcaaataccatttttccctcacgcagcaatgatctctttgccaaataataatgtaccatggcttagagcaatcattttcaaccgatccattttattaaacttatagatatagaagagatgtggctatgcaagtaaaatgtagcctccaaaaaaacactagaataaatggcaactatcgagagaacacatcgccttaggacagcactcaagaatatacagagaatccataaatacgaatctggcttgaaaaatataacgaaaaaagtatctgttgcattttcttaaggcatgaaattggcctaaatgttataccgttgcataattacaagaaaagtggaaggctctttaaaatattttctcagtaatttaataataactataattatctataatatttctttatcatactactactaccagtctttatccgcctaagaaatgctggaaagaaccatgaatcttttgtaacaagccagaataatgtttaaacacaaatgttgtctcacatacacatacttttgtaaatggcacattttttgcactttttcacatactaggacataattacatgaatattgagtggaatgagtatttttatttttgactgaaatggcaaatacacaacctacatacaatacactccaaagtatagatcagatattgatggcattttattgcctataaatatgttcaagaatgtatatatattcaaggccccagtacatactaatttacaaatacttcacacaactcaccatgaaaagatatttgatctgtatttcaatatataattgagaaattgaaagggaatttattttctcatcaagaaaacttatgtacaataggcaggtcaactaacattaacattaataccttgactcaatagtgtttaagagtagcaactgcaaatcttctgattgtgtgtatgcatgtatatatatatatatatatatatatatgctccatatatatatgctccatatatatatgctccatatatatatatatatatatatatatatatatatatatatatgctccaagctgcgagcagatacactaagggaaggagccattgaactatctttacaaagcaaatagtttataaccagataaagttttaatagtaactaatattaaagtagtgaaacaaaaacactgtatctggatttatattttatttaaagattctaactttcatggaaaagatctatagttttcttgctctcagctcactcctgagttcaatgattgaaactcaacaaaaaatctttctactgctggtgtgttgaaagagttttgtttgcttgcctgctttcccctttagaattgtccatttgtattgccaaaaagaaaaaaaaaagcctctcaaattttcatatacaagcttgctttaagccaaaatttaggggagagagagagaagagagcaaagcttaggcagacatgatacaaggagcaatatacatattttttaaaaattaacctaagtgttcactctgaattgcctgaacaactgtgcccatacccctctccttagaagaatacgtgacacccaagctatagttagcattaagccagaaactcctgtctctccctatcccagcagtggtgactgtatctttccacacatcctaagttttcaagatctgaaaagctagtgttctagacaatattggcaagcagctaaacaccagaatactctgggtgtattgggataatgtgctctctttcctccttcgttactttgcaagcttccctttttgccaataaaccttttgcttaatgtgtttcatttgatgtttaaatgtattctcttctttgacttcattttaaatattacagataagttaaaaataaaaagatgggaggcacgacacaacactaaataagaaaactggatggctctattaatgtcagctagaacaagcaatgtttaatagtggtaacgagacatatttaattataataaagggatcaacaggaataatcctgagtaggcctgtcttgcagaataggtaatacccaagatgggattcaccttacatgaaattttcctttcatcataataaaaatggtggcagttcagaaaatggaattaaatttagtttgatactcatataatagaagttaagagagctggccctggaatggataggcttagaatccaatccataatccaccacttaccaactatgtgaaagtggataaccgcatttaccctcgatttttctccctacaaaatcagtactataagagaaaaggcatttctactataatactatatgtatgttcctgaaaaagacttgttctcttgtatttagaataataaaaatcaaaacaatcacaatcgtgttaaaaatattagcacagttaaatatttattgacattttcaacacatttcttggctggtcaatcttttacagccttaaatactgggatttgtgcttcatcctttaagaagtaggtattgagggccatttacctctagggacgttttttataaaaatggaaaacttcctctttcatttagcctctttattagcctattaattcagaaaaataactttgcagcttctttttatgtacttcctgattctcaagagagattaacatattaaattacaggagttcatgtaactgctaatatagactctatttgtacagaataaatgttcttcaatagattttccattttttcttaagatcttctcacatagctagccctttctttttaattgtgacattagagcttgccacccatacaagaggatagtgggcattaagtatggtccaaaaaacctgtgacatgcttctaccccaaagaaaagtctatgtttctatttcccatgtatatgattatgtggttacataacatgagattctatgttgtatacatgtgtctatgtgtctgtataacatgagaacacaaactgtgttgtgttctgagtccataaggaatacataacaacctgattgaacttggaagcaaatgcttccctaaccatgtttcagatgaaatggtagccctgacaattccttgattatactcttgtgaaaccttaagcagagtacctggctatgctgtgtctggactcctgactcaaagaaactatcaaataataaatgtgtgttgttttaaattacctaattttaatgatattgttatacaataacaggtaatttacacaggatttaatgtcaaaagatctatgttcagaatcttggccgcacactattaactaactgtgagcttaagcaagttcccaagatttttacaatcagcaatatagagttctatgagaaaacaataaaaatgaatgtaagtggaggcacgcaactacccaatgaataacatttttcatcctacagctactagcaatttatatagatttgagcatataaaggagttatatattatttttcattaaattgggaacattatcaacaaaatgattttaaatgtaaaatgtactttctgtacaactgaaataagagaagcacagaacatacttaaataccagcaagaaaaaaaaaagactatgtatgcatatgtaaaatataaaacaaaaagaaggcaacagtttattcacagtaaccgttgataacttttcatgaaataaaaggccatttcttgctggcaaaagcaaaaatgaacaagataataagcaaaaaaagtcatactactaagatcaaaaatgcttattagtacttattagcatttgctgactgtattaactggactaagagataaaatagaaagacgttcagggaattaccatatttaattatcagactggtgtaaatgggaaaggtttataccctcagaatattgcaatattttattattttcaggccatcaaattgctgcagttaaaattaaaagtacaagcataccatgccgtgtatgtgtgtttttgtgtgtgtgtgtgtgtgtgtgtgtgtgtgtgtgtttcaacataatgattaaagtgggtaaaaaacaatcttcataccccactctcctcaaccaaaaaaaaaaagaagagtatagaatctaatcaggcagttctgttcattagaaaaatatgtcccaggggttgaaatcaaagaaacaaatattggttattttattttattttatttttgagagagtcttgctctgttgcccaggctggagtgcagtggcgcaatctcggctcactgcaacctctgtttcctgggctcaagcgattctcgtgactcagcctccataatagctgggattacaggcacctgccaccacaaacagttaattttttttttttttttttttttttttttagtggagatggggttccgccatgttggccaggctggtcttaaacttctgacttcaggtgatccatccgcctcggcctcccaacgtgctgggattacaggcgtgagctactgcatccagccaaaaatatggttttaaaatgtatgtgaaagattgatttgaaaagataaaagccaaaaaagccctgcttgatgaaaaagctcaacctcttaacctgtgtctccattagaatcaattataaacctcaaattttgggtttttcttccattccctaaccaaacaattaaatctctaccaagctgaagatccccccccttttttttttttaactaaaacttcatttcaacttgtgaaattcctttttttagtgaaaatgcaactgtagaaagttgttgttgttgttagatatgtgatttaaaatataaactttttgactgcgattttaaacactatttcaaagttttaaatgattcgattcagtaaatttgtaagtgtgatttattagattgaaagaattgattaagtgtcttaagaaaaaaatcctcttgggtatgcttgcctacccttctagatgtttgaagagtttgtattaaatttatcaacatcacagtagtttaattattaaagattgcatatatagtactttggataggggaagtaagtttgttaagcttatgagttaatagaactttaatcacagaacaaattaaagttttttcccttagtttttcagtcttcctacggttatagcaggaatgaaaatatttacgttatatttatggtcaaatacgattttgattttatctgtgtcatttacacatatttaatattagttaaaactcaagcaatattccatgaaaagacaacccacatattcaaaaaataaacaaaaacacctaattgactgtaggacaacaaacaattatataagacaatatgtttaagaaatggatgtggaattaactggtagtagtgaatcaatgaacatatttcaacaactccatttatttcattttttgagtttctggttgatccaaatccaagtgtatattccaggcagagagaaaggtcacatcataatcctcctccatttctcctctgatttcagatttaatttttaatataagatatttaaaaccttttattccatagataaatttgtacaatagaaaatgtggttttttagtacctctaggagaattctgagttgtcataaccctacagttaaatctgttttctcacctataaaatcattcagattaacaattctgtaaacaataaggcaaaattatttaatatgttattgaaaataataaaacagatggatgttatgacaatactaaatgtgaattagaactatgttacagaaaaatgttttgtttctataggtaatttgcttctggaaacaattaattggaggacatatttaataaccatacgtgctcaagcagtttgcttttttcatgtaaaagtgggcaagtattaagactaaattctgtcatttttttctatggcagtgcctatcgtagaaaaacaaataagcttaagtttgataattaaagcagcaaaaatgtaattaactaaagagtactcaaatattcaaagttttctgataggcttatcatttgagaggttaatccagccaaacaaatttaatttaaagtactctctaactgcaaatgaagtaaactttctaagtcatattccttttcaatagcacaagtacttgccctttttaaaaaatcaaataaactaactaaattaaataagattctttcaggtattttctaaaggtcattttattcatttggtctgtaagatgatgaaaatcattttacacattgaagaagctatttcaaagcctgacgaagtactttactttcaaaaatattttctaataatcattgcataaatgtttcacctccttggttaaattgattcctttgtgttttattctttttgatgctattgtaaactgaactattctcttaatgtcttttttagcttattacttgttaggtatacaagtacaactgatttttgtgcattggttttgtatcctactactttgctgaatttagttattagttgtgtgtgtgtgtgtgtgtgtgtgtgtgtgtgtgtgtgtgtgtagactctttagggcagggatgtccaatattttggcttccctaggccacagtgaaagaagaattgttttgggccacacaggtaatacactaacactagcgacagctgatagctgatgagttacaaaaaaaaaaaaatcccaaaaaataatcttatgctgttttcagaaagtttataaatttttgttgggccacattcaaagttgtcctaggctgcatgtggcctgcggatcataggttggacaagcttgctttagggttttctatatgcagtgtatttaagaaagaggaagattgtttaacttcatataataataatcagatacttgaatatgttttattatttatacataatattattcaaatattaatcagagaaccacctgaaagtgattatctactttctcaacataactttttcccactataaacattcattgttatgcagaatatataaagaacttctgaaatccaacgaaaaacaaatgatctgattgaaaagtgtgtaaagaacttgaatcaatagtttttcaaagaagatatacaaataatcaataaacacacagaaagatggtgaacatcactaatcattggggaaataaaaatgaaagctacaataataaaccacctcacattcattaggatggctactagacaaaaaacctaaaaaatagcaagtgttggcgaggatgtggagaaattgaaacactacaatgttggttggaaagtaaggtggtgcagcccaaaatttcagttacacaaaagaaacaagttcaagagattaattttacatcccagtaactatagttaataacaatatattgtacacttgaaaattgctaagagagtagattttaagtgttgtctgtacaagaagtgaggtaatacatatgttagttggcttgatttaaccattctacaatgcatacacatatcaaatatcatgttttacaaaagaaatatatacaatttttattaataaattgaaagtttaaaataaaatcatatggaaattgtggaaaacaaatgtttcctcaaaaattaaaaacagtattaccacgtgattcagccattttacttctgagtatatactcaaaagacttgaaagcagtctctggaagaggtacttacatacccatgttcctggcagcatcattcacaatagctaaaacttggaagcaaattaagcatccatccatggataaatcaataaacaaaatgtagtatatacacaaaaggaatattattcagccttgaaaaagaaggaaattctgacacatgctacaacatggatcaacagtgaggctggtatgctaagttaaataagccactcatgaaaaaacaaatatggcatgattatacttgaaactgacccaatacttccatatattttttaataaacatagatgtgtactcttctgatctgaaagtttgaaatttaccaaatgatcttcaggcctctcaaagtatcaaaaaactcaccatatcaccacatccagacaatgagatgcaggatccctcattcattatgcttgcttccttgcccctctgtaattcctgtttcttgcacattattgcatttcttccctgctatataaacccctagttttagtcagtgagggagataaatttgagacagctcccatctcctcggcagtatcacctgattaaagccttcttccttggcaatattcatcgtctcagtgattgagtttgtgtggcaaacagcaggacctagaccaaatccctggtgttttggtaacacacttatatggggtacttaaagtagtcaaaatcattgacaaagtaggttgttaccaaggacttggggagggagtaatggggagttattgattaatggtatagagttttagttttacaagatgaatacagttctggaaatggatagtggtaatggctgcacaactgtatgaatatacttaataccactgaactgtacactcagatatgtttacatctgttcctcttgcttcacttgtccttatcgtatttgctacaaggcattaggatcaattatcccccacaagtatggaaagtcttttctctgttcaaacgttcatcagcatgaagggtccaaaaatggccagaggacaatctgagcttccaattagtcagaacaatagttgagtttcgttgtcaaagcgttcaacttctggtcctagaacccaaatgtcacccagctgaaggtcacagacaagaaagccaaaattattcacgaagatcattaagtaagataggaagagagatcactttcatcttcacttcaagttgcccaggctctgttatgtcatgccatctcctgcatagctattcaggagagggcatgccttcgtgacctctaatttaaagcatacgccacatactgtaagagaatgaccaaacctcatagaagttcatcttctactagccgttatctgagaattaagaattctatcccaccatcttcttctgctagctgcttctgaatggtaggcattgtagtaacattattggattaagctgtggtgtgagctctttgctatgatccttcaccttaaaataaaataaatcaccttgttggaaatgaggttgtatgtccaccagataatgatcaaaagcattggaaagacgttctctgagcacatgaatgttgtttcaggtagaaggtctacagacaacacaaatccatactgaatcatatttatccatataaggaccctcctccatgataaaagtgggtttaatgccactggtcagtgagctggttccctgaggaatgataccataatagggattcagatttgggttctattactggcacattgagtatcagcaacagaagtaaccagattagccttagtaatgctatcttcttgagcccacatattaatcccatttaggtcactatgagcactttacacacagggtcatttatttatccctattgagaccaggaagcccattctgttacagcgtccctcactgacatccctaatctacagaggaaaaaaaaacaaaacaaaacaaaaaaaaactgtagggctcttcaaggaagccagatgcccttttaccaatatacttgttaaatcttgctgaagtgcatgtcctctggttatcttagaagtgtatagataaaggctggtttatcagattacacatgaagataaattcattgcacatttccatcactctgaacttttaaactcctctaaaatagggcttctcaattttaatgtgcccatgaatcacctagagatcttgttagaattataacttatgatttagtagatatagagtaggagggtagagccgtctagttgatgctgcttgtctgtgtgtctcactttatgaaagcaggctttatcacaatgtttctaaagtgtggtcccctgacataagtatcatcttcacacgagaacttgttcgaaatccgtatttgcggctccatcccaaactattgcattagaaactcagagatcccatttcagcaatctgtgtttaaatagccatccatgaggctgggaatggtggctcacgcctgtaatcccagcactttgggaggccgaggcgggtggatcacttgaagtcaggagttcaaaaccagcctggcaaacatggtgaaacaccatctctaataaaaatacaaaaaaaaaaaaaaaaaattaaccaggcatggtggtgggcgcctgtaatcccagctacttgggaggctaagggaagaaaatctctggagcccaggaggcagaggttgcagatcgtgccattgcactccagcctgggcgacagagtgagactccgtcttaaaataaaataaaataaaatagccatccatatcattctgatgcttgttgaaatttgagaaccttgttttataatgtgctgtaaaagttcagacattttgacttcattaactataagctattattgagacttggtttcagttagccaatctagcagactattaacgccacttttcattgtggtagccaaaacatcacaccctgaattcagggtgaatgcattcatgcaaaagaattcagcttcagcaagttttgtattttgttgtccattgtctaacgtctttagaattcactcccatgcatgatttctagctccctgccaatagtgacaatgacctataccttttgttttgttttgttttgttttgttttgagacagtctcgttctgtcgcccaggctggagtgcagtggtgcgatctcggctccctgcaacctctgcctctggggttcacgccattcttctgcctcagcctcctgaggagctgggactacagctgcccaccaccacgcccggctaatttttttgtatgtttttagtagagacagggtttcaccatgttagccaggatgatctctatctcctgacctcgtggtccacccacctcggactcccaaagtgctgggattacaggcgtgagccaccgtgcccagccaacctatacctgttttgtagtataggctatcttgttttaaaaaagatcttatattcctgtcttgactaaaagctaacatttcttatggccctagaatcaatgagagatggtataagtgggtcatgaaaagaattgacattagctcttgaggaaactgtccaaatatagttactgtaaggctattaggcagaagaggactagagaaagtgagagggtctatgttcactagccagaaagttcatgaaattgagatattcaatgttttcaccattatcattttcccatctcatgtctcaatgtcccttttcttccccagtgccaattttcagtgccttttctataggttaagaggatcaaaagggttgagagttccaagtatgttgcatctctgcaacacttataatcataaaaagatgggctccttcaaagctgccctgatgaccttctgtttccccatgtgctcttattgcattttatacctgttagtttacattttccctatatacattctcaagtatatagagaatatacacttggttgtcatgagaaaccaaatgtaataataattacaactattgctacagtgagtaattgctgcagccacttgatcatccaatactctatacctgcactcatcccatgccaccacaggtgtcatttgagtaattgtgatgccacacctggcaaaaattagccacatgctatgtgaatctcccacctccacgaaaggagtttatgcatggatccttaatatgcacactccaatccaagaatctcattttgagttattttttttttcttagagacaagtcaagcaccaattactataatacttggtgtaccagcaagaaaatgtcaccctcaaatttagataaaccaatgtgtttttagtaaaggaaagcttaagagaggtgtgagtagggtataggggaactataagaggtaatgtcatacactgacaaacaaggaatacagaagaaaaatttcatcaggaaaaaaaaaaaacaacataatctaatggggaaatgtcatataacatgagccatgtttagaaaagaaggcagccagcttggagagaacctatgcaacacatacctggctattatttacctctttcccttcatattctcctttctttgcccatttgtggaagccaactgaatgtcagatggctcaggagccttctgatgcaatccatgcatctctgagaaggtgaagagtggatgtaaaaggcaaacagatgtatctgcacattacctcctcaaggcattgtcttctgaattggtcttgtcaagagaatctcaatcaacaatgggatatagattcgggagaaattgagaggaaatttatgagttaaagcttaagtgattggcttaggaaagcaagtgccatatagtgtgaggcataataacactgtggtactggacattgtttagttgtagtttcctttatgtgtctgtataaaatcaacttttagttatataatttgctctatagtacaggtactttgtttcaatctctctctttccactataagaattgcatacacatttgaaagctagtttaatttaaaaaaaagtactaatttggccgggcatggcggcttacacctgtaatcacaacactttgggaggctgaggcaggtggatctcctgaggccaggagttcaaggtcagtctggtcaacatggcgaaacccatctgtacttaaaatacaaaaaaatttggtaggcatggtggtgggcgcctgtgatcccagctacttgggaggctgaggcagaaaaatcacttgaacccaggaggactatgttgcagtcaggctagattgtgccactgcactccagcctggcttgggtgacagagtgaggctgtctcaaaaaaaaaaaaaaaaaaaaaaaaagaaatgtattaatttattagcttttattgtgagtaatgaaagattatacttctgtccttagatcatattgatagtatttataacgttacataattctatattttgctccaaaaaaaaatctgtggccaggcacgctggctcatgcttgtaatcccagcactttgggaggctgaggtgggaggatcacttaaggtcaggagtttgagaccagcctggccaacatagtgaaaccctgtctctactaaaaatacaaaaattagctgggcatggtggtgcgttcctgtagtctcagatactcgagagtctgaggcagaaaaatcgcttgaaccctggaagtggaggttgtagtgagccgtgattatgccactgaactccagtctgggcgacagagcaagactcaggctcaaaaaaaaaaaaaaaaaaaattgcattgctgcaacatgagaaagctgctcctctagtcagagtatggctaagggaagtacatcataacttttaatcactgatatgtgattaaaattttaaagttttgataacattttaattaatgatttaagatgtttggctaatttccatctgaatttagattcaagcactttgcaagcctgttttaatctctatgcttaaaaaatctacatattaataaaatcagccttactacatacaagctgtcaacaaactctgttctaaacacagtggtggtatgaagtcaagtacctttctagctaatggtagtcagcttacacagttgttcaatggggcaacacaatcatatctccaactgttacagagattgaaatgattatcatctgaactactgcacttgtggcaaagttttctttctcaagaaggtttttggtaaaatacagatctatcaacaggagataccattacatttttagcacttaccatatcatttgcagagggatagactcagaatatgatagttgccatgaaaaatagtgaacagtaaaaactgaactaaatggaatatagaacacaagtattggaatgggaggcaaacgttaagaggaagagatatgggaaaatatatcaactcattattcaagcttatttaagcttcatttacatcacaaaaagtttccattcacaaccttttcaaataaaactgaaaggtttccatgatattttaaaaatataatctgtattttatcttaacaagaacttggaacaatattctatccaccattcctgatccaaacaagtgcccaatcttcatctatcttgcctcatattttcagtataaagagcccattcactttttagggaaaaaagacacaaataacacaatggcacaattgttaagtttctcattatatacaaccctatagctaataatgcacatgtcatttccatttctaggttgactaattttgatgggcagaagtgctctaaagtatgcttttataaacctcatatcacgtggtactccatggctgaaacatggcttaatgcatgttttaggatggtgaaggaaggagagaagggaaaaagaaaagacgaagaaaagaagaaagaaaaaggaaggtgaaggaaagaaagagagatgaagaaagaaaatgaaaatatgaccatgttataaagaaaattgaaaacatataattattttttcttaattttagcctgtgtagaaactcttaaggctgatgatgagatagatattttttgccataaattacatgaatctattcatttttacattcttattatatagcattagaatatgttgcattatatgtagactccttagaagatacacgtaaataaaattatcggggaacctgccccgatattcatgtaggttcttttctgtttttcctaagcatctgccagcttgagaagtaaagggacagagtacaaaagagaaaaattttaaacctgggcgtccaggggagacatcacatgtcggtacgttccgtgatgccccacaagccacaaaaaccagcaagtttttattagggagtttcaaaaggggagggagtgtgcgaataggtgtgggtcacagacatcaagtactttacaaggtaatagaatatcacaaggcaagtggaggcagggcaagatcacaggaccgcaggaccgaggtgaaattaaaattgctaatgaagtttcgggcaccattgtcattgataacatcttatcaggagacagggttttgagatcaactggtctgaccaaaatttattaggcaggaatttcctcttcctaataagcctgggagcgctatggaagactggggtctatttcatccctgcagcctcaaccctaagaggcaggcgcacctgggggcgctgtttataagcctatacctccaggtgggtattctctttcccaggaatgtttcatgctgagaaaaagaattcagtgatatttctcccatttgcttttgaaagaagagaaatatggctctgttctgcccagctcaccggtggtcagagtttaaggttatctctcttattccccgaacaattgctgttatcctgttcttttttcgaggtgcccacatttcatattgctcaaacacacatgctgtacaatttgtgcagttaatgcaattattacagggtcctgaggctgtaattacatcctcctcagctgacaggattaagagattaaagtaaagacaggcataggaaatcacaagggtattcattggggaagtgataagtgtccatgaaatctttacaatttatgtttagagactgcagtaaagacaggcataagaaattataaaagtattaatttggggaactaataaatgtccatgaaatcttcacaatctacgttcttctgccatggcttcagcaggtccctccgtttggggtccctgacttcccgcaacataaaataaaaaaaaaaaaagatgctttcaacttagtgactattattcctgtctatctctatgtgcatgtattacacacacacacacacacacccacattaagaacccactaaatattgttaagttcttggaaaatatgaccttaagtgaaatgacatacaataggtccttgaataacatagtcatttagatataattataatacgcaaaaaatggattttgttatgcatcgttttgattaaagtcacagtttccaagaacctactgatgacattaagtttatacacacacaaacatgcacacacacaaacacacacacacacctacacacacaaaggtagttatacacaatatactgactgccttataagaatgttttttctatcttgtaataatacatgagtaccacatttttcaatgcatttaatcatgctgtatctgagaatgtgacttattaagtcccataaatatatctaatacattttagagtataaatgttcaatgtattattgtagatataatatgaaactgtgcatgggagtggagtgaggaataattgaagaaaaggctcttgctgaaccaatttacctatgggagatcagaatatgccaccccaatttaggatggtttggcataaggtttgttgagctgaaggcaattaagaagcagatgaagaaaagctctctgcctctatttacctaaaaggacgatatacatttacaaagacaaaaaatatcccccttcccctctaaaccggggaggacaaatgttatccactgaagagaactttagactgttatgggcctggagatggcaccagaggaatctacattaacaagctttacttagcctttatctgccttttctttgccttgcctcaagttgctgtctttagaaattcaaaatccttttcctttgtcatgtcgcttccctaaaactttactgttctttgttgaacaatgcgttatataagctgaaattcaaactcacctccttggcggctactcattcccttgctgtcttccatgtatatatgaaatacacgtcaataaacttctctggcttttctcttgttaatctctcttttggtccatgggtccattccaactaatactttatcagaattgaggaaaaaaatattattcctcttccaaatagctatttagtattttctggctgacagagcaagtgtcttgacagagaactcacatttcattctctttccaacactcttcttttgatacactttaattataatccttaaaaatcagtctctgtgttagaagttgacatgatatatgaaggaaaagggccactttttaattctggaagttaatgcaataacataaagtagaaaaatagcatattttgaaatatatttcatgtcaaacacagacatatccttctaaaatgcagcatcaggaaatacttaggcataataacaaaagttcaaactatgatttcaaaacagagaatttgacaattcaagtatggatatgataagcctttattctgatttttttccaaatattccgacagtggaaaatgttcaaacaaaatttgaaggaggaggactgtgtactatcttattttccctcaatatttttcttatatactttaaagtaattttattctgcaatattgtgtcgaactatgaatttctcaaccattgtttctgaattgcaataaagtcaaaccgagcaagatggctttaatattgccctcatcttgacgaaactttaaacacttttcttcctgactgcatgtcctgacctttattttcttagagtgtttacttcagaaaattttccattgtaaattcttcctatgactctttgagatgtaaatagtctcccagccacttgtgagttttataacccagggatgtcttaaaaaacttggagacatccctttgaaatattgttatccagaaagatattttcccagtctcccagtttgtatggataataggagcctaaattccataagcaacaattaaacaattaaatgtggtccaaactcagggaacaaccttcccttcacttcctccaatgcttttccactaaaattttcttgcattgtgtttcaaaagaactgagttcaatttctatccactattgcaatagccttgaataaagtcttgcctgtttaactctatctggtataatttttcttcaagagaaccttaattagtcaagttctattttggcaatgggattcatattggaacttaattttatattataaaaatggataaataatcacaaacataaaatatgaatatatgtttccaacaacattgtgtgcatcaaaccaggcactaaatggcaaaggtataaataatcataataacaacttttgtggtgatagagttttttctagatgcactagatatgctgatattcttaaaataaaaattcttacatattagccaaaagatacttctgccagacaaatgttttattcattattacaaggattctagaccttttaaaattaagatattctgtttcaaagtcaatgtacaaattcccctaagttcttaaaaaataggggcaggtttcatggtgacctgttcaaagatctattgctgagatagattttagtaaatcaatttggttcactatcccagttggtcacaaatatgagtttttgttattacttcaattatcttattcattgcttactcaaaataccttttaagtcttatcccatgcagagatcagatggtaaggtttttaaagtaactatatgactatcagacttatttccatgtaacttgctttatttttgcctgtctttaagattttattacataaaaagtaataaaaattaattttaatgtattcctaaaatttcaaaatcttgcttgtttaaaaaaaaattagtcttaattaaaaaaacactatggaagaaaataagcctttaagtgatctatattatcctaatgatgttgttatgttacttaaatcaaaatttgtgaaaaaaataggttcacacttctgaatctcaaataaactttatagatcaaaaattaccaccaaaggtgctcagaaacaatgactaaaatttccatctctagcaattttttatataacaaaattgtcctaacaatactagctaataaattagagtttggttacaaaatgaaccatgataaaatctatcacagcaggaaaattttagaaaaggtcaagaccacttatgtgatcttaccttcaattttagaccaaggaaagtttgtaagtgaaatttaacccttcaaaaatgccccccaacatagtatcttattcttgtgcaacctggaaaaacaaaaaaaactgatattagaacctaggttattttatttgctgctggattatttgcttatttgttgttttaaatcagaaaaaaaaccccaaatattctggtagcctagaaataatcaatagccttgcagacaaccaagtatccgggttgccttatgaactaagcataggatagaattaaactagacactgctaaaatgaatggacaatttttagtggtatgtatacaaaccttaaagttcaaataatgtaaatggccgacatcaaacatattttctaaactatagaattttacaccaaacagtatgttctgccacagtaaactgtctctggctttcttaaaagtgatttattttatactgcaaattattctgtcatgtccacttggcatatatgtgttcctttctgattttctcaacaactctctcttagaaggaaagcattttctttttagaaaccattttgaatacataatcacatacatgtaacagaacatttaaaaagaaactgtttcagccaaaactatgctacctactctcagtgaagagagttgcagacaacttttgtaggacatggaaaagaagccactgaagttcagtgtgtaacatttatatgattaaatataatataaatataaataatataatgattaaagatgggaggctcaggtagcttggacactgaggatttgggaggaaagcaatattacagtgtgataattgcaagttatcaacaaagagtcatcagacttcttgcatttctccataagcttgatgacaagaacatcaggtgggtttctctgaaaagaactaaatttacagaagttagagaatttagagaaattagttgaagggtgtctgactttcacttgacaattttaaagggtgaaagtctaaatgaagaacttttgcagattaatggtctgcggttaggaaataactgtattccaactagagatgagtctcaagtgagtatttcccaccagcaaatgtgggccatgcaagagagtagacaagaaggagatgatctcaagcccagcccaagagaatcaccatgaggaatgaggagacctcagcagtaagacgctgggctgtgcagccacatccgcgggaacagcaaaagttagtgaccagaagacaaattctccagccatcccaggaattgccagaaacagctatccaaatttggaggtctccaaagaatctgcctacgtggttcacaatctcaggagttgccaaaatcagacctagagagtacagcaatgcaccctttcttttctttttacctctaatgctttttccagggtcaaacctggaggagatgaaaatcagtatttagtaagttgaagaaacagagatgaataaggcagagagagagcaaggttgttgacacccaggttctaaggcagctgggatgcctacaaaaggatatccaagcggaaaaaaattgaagtagatttctagccaaacttagaagtcctctgtgtctaatgtatttcagagtaggagataaagtatttgttggattagcacattagcaaaattatctagagaaaggaatacatgtgtaatgtccaataaaagccagtgattctccaattgaacataaaatggactaagttgataagaaatgtggggctctttcaacaaatagtttaaaatcaaaatcatgaaggtggataaaatatttctttacccccagaaaataaacggataaagctacttctactatctttgttatttttcactctactagccctaattatttcattactaacttatcatcaattgaaagttataaaatgcatgtttccatcatgatactatgtcatatatattttaaaagatggttataaaagtcatctgtcattattaaattaaattttgagtcaatatatatttgtattgggctatgaatatgcataagaaattaatattctgaataatatgtactctttcagtgccctggaaaagacaataggagcctgatacaatttgtcattcttgcacagtgacagttaatcgaaaattattaattcattatcaaagtatcatttccatgacaaagacgagaggaaaacatgcagactgtgtccagatttcttccagatatctaccagcaaaatatcaccaaaattaaacaatgaaagatagacgaaaagagaaaaaagccagagggagaggagagagaaagagagagaatgattatgttttacataaaaaacagtaaattgaattccttacttgatttttataggtattgttcatctagtttgtagtaaagggaacatagctatagacaggaaactgtcattgttgagaatttggagcttaaaagtattcagtaattttaaatgcaggacatgtattttcgaaaccattcataattaagaaattaaaaagattttagtaacatttgtgaaaaacagaaagaaaattatttaaaagtctttgctcttcagagatagtgcctggctcttgtagattcctttcacctctacactatgctaaaacctggctttgtctaaaaacaactttagctatagatggtcactttctgtaaaggcttttctttgttattgtcatagcattacagaatattgatgacttcaatatcacctacacagaaaaactgtatatgacttttggaaaaaaaatgagagatttagggcaagcaaagttatgctgttgtagattcaaaaaaaaaattgacattttaggttaagtatattttcaatgtttcaattataactgtaaatctataaatgctggtagaggtaacctcattagaaataactccttattctaagagcaaagagaaacctgaaatgctaaaatggatactcattcttaataggatcaagaaacaccaaatacccgtcaaatatccgaagattatattcaatgactctgaacaaggaaaaaagcaaaaaattaagtgaaacatgaatgaaagaaattacagaaatctaaacaaaggtataatctatattaatggattgtaaaactcagtagcttaaggatgctaaaatctcctcatgtaatgtcaataaaaatttcatcaattttgaataaattgaagaattaagtctaaaacatatacaattcaaattacaaagtatatgcccataatttatgactttactgcttaattctaccagcatataaagaagaacacatcttaaacaaactattacaaaaaataataggaaacacatactattttggtttttgatgctagcataaccctgataacaaacctgacaaaaatacatcaaagaataaaaagtacacatgaatatcctcattaacacagatacaaaaatacttaatgaatttatttagaaaataaatcaaatccagcaatctataaaataatgcattatgaccaagttggttttaccaagaatgcatggttggtttaatgtataaaatacataaaatcttattaacagagtgagggaaaaaaacataactcaaacaacacagaaaattcatgtatcaaaagtaaacgtgttcaagataaaaaatattaagcaaattaggaatagaaagtaacttcctcaatctgataagcaaaatatttacattaaagaaaacagaactaaattaaagctgacgggaagaagaaggcaagattatacaatcttataatttctattcatcatggtagttggaattcctagccactgaaataaagcaaggatcaatgacatatattaacaacaaagaagaactatgctcctatttagaaacagcatgatcgtttatgtataaaatattaaatacagataggccaccttttattgctttctttattagtttattgaactccataaatacggcatttttttaaaagtttgaagatttgtggcagtccttcaaataaatagcaaatttattagccattttttccatgtgctcacatcatgtctgtgtgtcacagtttggtaattcatgcaatatttcaaattttttcattgttatatctgttatgattatctgtaatcagtggtttttactattaattactattataattattttgggatgccgcaaaccattcccacattacattgaacttaattcatgaaatgttttgtgtgttctgattgctccacctactggccattctcccatctttctccatctcttcaggcctctgtattccttaagacacaacaatattaaaattagaccaattaataaccctacaatggcttctaagggttcaagtgaaagagttgcacatctctcaccttaaatcaaaaactagaaattattgagcttaatgaggaaggcatgttgtaaccaagataggctgaacgctagacatcgtgcatccaacagttagccaagctatgaattcaaagaaaaacttcttaagggaaactaaaagtgctattctagtgaatgcacaaatgataagaaagccaaaaaaccttattggtgataagtagaaagtttgagtgatctgaatagaagatcaaacaagacacaatattttcttaagccaaaacaaaatccagagcaaggacctagctctctacatagctatgaaggctgagagaggtgaggaagccacagaagaaaaattggaatcttgtagatgttggttcataaggcttaaggaaataagccatctccataacacaaaagtacaaggtaaagcagcaaccacatgattacatcaatagatgcaggaaaggctttcgataaaattcaacacacattcatgtcaaaaactctcaaaaaagttaggtattgaaggaatagaccttgaactaataagagccatatatgaaaaactcacagccaacattatactgaattggcaaaagctggagtatttcccttgaaaaccggcacaggacaaagataccccctatcaccactcctattcaacatagtattggaagttctggccagagcactcaggcaagggaaagaaaaaggggcatccaaataggaagagaggaagtcaaactacccctgctagcacaagacatgaacttatattcagaaaccctcaaaatctaggcccataagatccttaaattgataaacaacttcagcaagtctcaggatacaaaatcaacgtacaaaaatcactagcactcctggacaccaataacattcaaggatccaaatcaggaaatcaatcccattcataactgccacacactcacacacacacacacaaacacacacacaaacacacacacacctagaaatataattaaacaggaaggtgaaagatctctaccaaagaactacaaaacactacttaaagaaatcagagatgatacaaacaaatggaaaacattccatgctagtgaatagaaagtattatttttgctaaaatacctataatatccaaagtaattcatagattcaatgttatttctattaaactaccaatgacattcttcacagaactagaaaaggctattttaatattcatattataaatattcatatttattaatgataaaatattctattttaatattaatattcaggccccaaaaaaggacctgaatagccaaggcattcctaagcaaaaaatacagagctggaagcatctggctacccaacttcaaattatactacagggctacagtaaccaaaacagcatggtactggtacaaaaacatgcacatagaccaatggaatagaacagagaacccagaaacaaggtcacatgcctccaactatctgatctttgacaaagctgacaaaaacaatcaatggggaaaggactccctatttagtaaatgtgtagggagaactgacaagccatatgcagaagattaaaactagaccccttccttataccatatacaaaaatgaactcaagatgcattaaagacttaaatgtaaaaccaaaaactataaaaacccatttctctggacacaggaacaggcaaagatggcatgaccaagatgccaaaagcaactgcaacaaaagtagaatttgacaaacgggatctaattaagctaaacaggttctgtacaacaaaagaaaccatcaacagagtgaacagacaaacctacagaatgggagaaaattcttacaaactatgcatttgacaaaggtctaatattcagcaactaaaaggaatttaagcaaatttttaaggaaaaaaaccattaaaaagtgggcaaaggacatgaatagacacttttcaaaacaaaacatacatatgagcaacaagcgtatggaaaaaaatctcaacatccctaatcattagagaaatccaagtcaaaaccacaataagataccatctcgcaccagtcaaaatggctattattacaattaaaaaagtcaaaaaatagcagatgccagtgaggttgcagaaaaaaagcaatgcttatacactgctggtgggagtggaaattagtccaaccactgtggaagagagtgtggtgattcctcacggacctgagaacagaaataccatccgaccctgcaatcccattactgagtttatacctgagggaataaaaattgctctatcacaaagatacatgcatgtaaatgttcattgtgtcactattcacagtagcaaagacatggaatcaacttaaatgcccatcaatggttgaatggataaagaaaatgtggtacataaaccaaacttggaatgcggtacattccatgtgtaccacatggaatactatgcagccatataaaggatgagatcatgtcttttgcacgaacatggatagagctggaggtagttatccttggcaaacaaatgcaggaacagaaaaccaaatactgtatgttctcacttataagtgggatattaatgatgataacatgtggacacatagaggggaacaaaacacactgaggcctattgaagggtggagggtgggaggagggtgaggatcaggaagaataactagtaggtactaggcttaatgtctgagtgatgaaataatctgtacaaccaacccccatgacacaagtttacctacataacaaacatggacatgtactcctgaacataaaataaaagttaaattaaaaaaaaaaactaaaaattacatgcaatatttgtagtggtacaaatatatttatgtaactgtaaaaaagagagatgtataagaatatatacaaaatgtaataatggttacttccaaacaatacatgaaggctagaagttgaggtgttttttttttaatctgtaaggttttaattcttttaaaaaagaaaaagtattagtgtattgtttcacaatttttaaaaaatgtacaagaatgttcttatttctaccatattggtctgcttctttgtattttttctggcccaacccaaatcagtcttttcaaagtttatctacattggttagagatggagccttatagaacattgaattaaaggcagacatccaaacagttattgtatggaacagatctgcgtactaaatatgaatgtgtgtattgtgtgtgggcttatagtattaacaatacacattatgtctttttgttttttatgtgtattgtctgtgtacctgtgaatttcagtattcgtgagctatgcattaatgtataccacagttaaataaatgaattagttgcagaaaaaggaagatcaaagttggaaggctttatctatctgattttaagatgtactaaaaagccacagaaataaataaataaatgaataaataaataaataaatggactagaataggtaggaattagtcaactttatccttaagggccagatattaaatatttcaggccttgtgggacacatatgaggtgtctgtcactttttgcccctcttcctcctcctttctcctcttctgcctctttttctacctcttattttgacaatactttaaagatgccaaaattgttattagattgtgagccacataaaaacagcccaggagtcataatttggcaatttttggaacaaaggcaaaaaacagaaccgcagtagcctttccactaacacttcacaggaatttgatggatcaggaaaaacctttgtaacacatgatgctaggacaactgggtatccatatgaaaaacaaaagttaaccttaacccctacctcctaacaaacacgaaattaatcaaagaaggagcaaacgtaagagtaaaaggccaaactacaaagtatttagaagaaaacaggggattatcttcataacctgctatgaaacaacacagtaagaaacaaccataaaagacaactttaatatattagagtttcttaaaaatttaaaacttttattcttcaaaagatacctctacattaattataaactggaagaaaaatatttgcagaacttgtgtctaacaaacacttgtatgccaaatacacaaaactctatgacaactcaataacataaggacaaattttaaagtggacaaaacacttgaaagaaacttcctgaaggaatgtgcatgaataagtaataattacatgaagtgctcaatatccactgataaaaatttcttaaataggcaaaatgaatctatagtgatagaaaacaaatcagtggttgcttggggaaaaggatggagaaaattgattggaaaagagtacctgggaactctttagagtatttaaatgttttataccttgtcagagtggcagttacatgtgtgtatatacttttcaaagctgtatagttaacgttggtatatttcattgatttcaatgtaggtaaatctaacctcaaatatccataaatataataatcatatggaaggtcacttccaaattggtggaggaatagttgaaaaaatagtctaatattatcattttttaatctggataatggctccaggatagtttgttatggcattcaatttattctgtatatgactgaaattttaaaactcttaagctaaaaagcatttgtcacatgtttttgctgaaatattggttccttgtaatttctcacttaattcaagcagacatctaaaggtgatttattttccacccagaaaactaagagtacaaggattcacttgtgtccacaagggaatcaagtgatccaggagaacgtgcttcactattttttgcttttcctgacccttaaacagcttctaattcctcttgctaaaaaaggaaaagggatggctgggcgtggtggctcccacctataatcccagcactttgggaggataaggcgggtggatcacttgaggtcaggagttccagaccagcctggccaatatggcaatacctcgtctctactaaaaatatacaaattagtcggggtggtggctcactctcgtaatcccagctactagggtggctgaggcatgagaatcacttgaacccgggaggtggaggttgcagtgagtggagatcatgtccctgaactccagcctgggtgacagaatgagactctgtcaaaaaaaaaaaaaaaaaaggaaaaggaagcaaagaaaatagaaaagttacttcctctaaggtaaccctaggagttttcttcactatatttaggaacataattagctgtttttttaaaaaaaaaaaattgatgcatgcttgctttctctctatatagaactatattttgcagaagtgttaatgatgttttgaaggtgacaatgttatcccacaacatataatttcctctcttaaaagtactatctttgaaatgggctcacataatatgtaaatatatggggataaatgtatagtctcattacaaactataagaattattccatatatgtaaaatatgaactactataattgggtgtaaaaccaaggttgtaaatttaattttaataatttgcctataatatttatcagtccaaagtgatttgaaaagaaaatctattaacatgttttacaatattcttacattatttctatcattatgtatgagacaaatcatgatgtgacagcatgtgacaagtgtagcagatgctgtggatcagcttacacaaaacttattccaactacctcctttgcacatgtttctgaaccgcataactgagaagctaaaattatacttaaaggattcaattgcagctatgattctatgtatgattggggttactctgacaagattattttttatataagacattgttcagaatgtactatgaaggggacaggtgttacactttttgcagttacaaatcggggtggaagtgctgtggttctggtgttagctgtggttctgtagttggcaatgttggcatcagctttctggaaccaggcatctggatcatgggaaaggcagcatttcctaggtgatatggcttggctatgtccccactaaaatctcatctcaaattgtagctcccataattccctcatgttgtgagagggacccagtgggagataattgaatcatgggggcagtttctcccacagtattctcatggtagtgaataagtctcatgagctctgatggttttataaggggaaacccctttcacctggctctcattgccttgtctgccaccatgtgagacatgtattttgcgttttgccatgattgtaaggcctccccagccaggtggacctgtgagcccattaaacttctttcttttgtaaatcgtccagtctcaggtatgtctttgtcagcagtgtgaaaatggccaaatatactatagcagatcagttatgttgtggttttgcatctcattcctggcaggtcaaaacagaatctatttcttccaccctttcaatcatatgtgaactatttatgccacttaataagtcccttcagcttgaagaagctagggtatattgttttttgtaactaatatccctaactgatattgcagacttcacataaaaacatcctgttgaagatgaggaactagaagattctttccccagggacatatgatattaaaaaaaagctacaggtagctggtctttactgtgtacattatcaacctcttacccaaaatactatagtggtattcactgctataactatttacagtatattcagctgttttcttacagtcttagcaaaaccatcttctcatctgttatgacttgcatgtaccccccaaattttgtgtattggaaactaaatgcccaaactcatatgttgatgatatttggaggtggggcctttggaggaggtaatcaagattagataaggtctttagagttagtcccccatgttgagactggtggctttagaagaaaagaaagatgtgagctgacttgggtgctcttgccctctcactatgtgctgccctctcaccatgtatgatacagcaataaaaccctcaccagatgccgatgccatactcttggacttccaagcctccagaaccataagaaatattttttttctttattaattacccagtccacagtattctgttacagcaacagaaaagcaattaagacaccatctcacacctggttttgtctataccttgtgagaacctcacaactgtaattcttctgtataacacatcaattaaaatagaatctagacaaaatgtcagtattaaaacaatcaggaaaacagggctgggttgataataaggccacaatatttgctgcctctgagaatttgggaagggatggatttgaagaagaagttttctgcttgcatatctagttcttattcatatgcacacaagcctaaggggaaaaattcaggctcatcgtccttttgattgcttaaaagcatgtagcagcttccaatttacctttcctaaagaacaagtcaggctgcagaaagatcatggttttgaattcagccatggcttttaatttatttcttttagactttgcttgactggaaagctctggaagctggggttcaaaggcaattgtgtttaaagaaaatacttagttgggaatattctaacagcaactgatgggtttaataattcttgtagatactatataaaattttgaatagctagtatttaggtaaataattgcaaagaaacactcttcttttggaataaattacatggagtcctgttgctgtctacttgcaaataatctcattcacgttttgatgaaactcacaatgtacacattttctgaggaaaatggaaacaggaggcctcctgaagatacaataagatgattatatttattttcaaacctttaaggaaagctcctgcaagttaggctaaaatgtaaattttagtgaggattctattagaagttccaaggcaacagttactttcaaaaatgatagacccactgtgagcaaaagagagaagataaggactctgaccgagctggcattgttgaataaggggccctgatttgctgctcaatagctgactctgcaggtttcaattataggaatagctggaataatactgctctacaatattactggtagaatttgcaaagaattgatatatagagtttaagtatgtgtctctgtatgtgtgtttgtgtgtgtgcatgtgcagcacacagacatgcattatgaaaagggagttattcaagtaaaaagcacctgccgctaccataacaggtatgatctaggctgacccatgatgcttgggtgggtggtgggacattaagaatagaacatttaactacaggcatgcttatattccagttatatataggcccactgcacctctaaattgttgcactagagtctttattttggctggatttaaaggccacttcccaaaatttgtgcagaatctttgtagttacataattaaaaattgaaagaatttaaaaaatgacaactgtagtctcactgactttttaaaataaaattaaaagaccagtataactgtaagcccttgttcagaaaaatgttaattccttacgatctagactcagaatgtggggtttgaatcacaattctatcagtcactagcaatgtgatcctgagaagattacttagtctctctgtcccacagtgcctggtttataaactgggaataatatttattttaaaggattaaatgataagctacagatatgtctttttgcagtgtgactagaaaatagtaaacacgtaataagtgctggttgctgctaccataatgatcagtgtatttctatattgtttatttctggatatcagtacttttgatataagactagacagtgaattcctcaattacaggggctatgtctccagtaaacaagaaaatgcctgtcacacagcactcacattaaaagcttagttgaattgatacaacttgtcagagagactaatactgagggcacgatggccttatcatcagcatatcctcattactttgactagattatttaatttattctcttttactccttcttacttctacttcagttaaaggcaactggggagtatagaaatttgaatatttagctttttggggctatgtccgtagtttattcactacttagggtgacctgtgcacatgctaaatgattaaagaaggcaaattctaggatggtaagtagagaaatgtgcattatagattgaaggcatgtgatgggcaaaagagcctgaggaactgacaatagatggaggaactgacaatagatggaggtcagtaaacaaactgaaaaacaaatgtaagggaaaacatctgataaaattaaaaaataaatatcttatttaaaaatatacatcttcttaaatatatatttatattttaatatatatttaaaattatatatatgttaagtaaaacagaagttactaaaggaacttccacctttgtatgtttgcttgaatattacatctttaaaatagcttttgcaagagatgtttcacaaaagaagttgatcttacaggtattgtagttttctctaaaatgcctaaagattaatactccgcaaagtatttcagtcaatttcaagttggggaatttggatgaccaagacatctctgttctctcaattcctcagaggacatacaccgaagttagttgtgatagtagttattatgcctattaagggtgagatccttccaggttctaacttctattgtcctcaaacacagcactctgaaattctagcattaatgactgttactggctacttacaacaagcaacttcacttggatctaccatccagtttccaagctaccaacattaccttgttgcattgtttttgttgctgttgtttctttttttgcgacagagtctcgctctgtagccagggtggagggcagtggcgtgaccccggctcactgcaatctccgcttccctggttcaagggattctcctgcctcagcctcctgagtagctgggattaaaggcatgagccaccacgcctggccattacattgtttatgtacaagctagatgataaggaccaggcaacacttgtgctatcatattgcatgtgtgcaaggctacacagcctgttgatgcacacaggagagactaagaaaggcagacctggccatggcctacctacttgcttactgaactttgtattccacgaaagaagggagcatgaacatatgtttagcaggaaacttaaagtctagcaaatttcctggcccatagtattgtattctagttgtttgttaaataaatgaatggtctgtatacaatatagcatctctctctctctcaacgaatagcaaaattttttaatagacaagtaacgaagggccttccaatttaatgataataatacatggttggctatctattacagctctttgtgattgttggtttgtgaatctgaaggcactatttctcaaagtgaagtccaggaaccacttgatcaaaggtcatctgagttgctgtttaaaatttcagattcctggggtcacttcctgcatctccacctctgacaacaatattcaggaaactatataatcaacagtctaccaaggtgattttatgtacactactatttcaaaaccttagtgctagctcattctctaggtgaacaaatgaaacaagtataaatatgataaaaagtaagagatctattgatcatatttctacatgaagagattttctatttcagaaattgaagtaatcagctttttaaaaaagcctttttgggaatcaatgtaagtttcataattcagccagctgaccaataaatattaaaaaatgtttaactttcttatatttcatcatttaaaaaaatgagaaattattccatagtctatgtctgtctgtatacattattcagctcccacttataagtgagaacatgcggtattagactttctgtttctgagttatttcacatacgataatggcctacaattgcaataatagacattggagacttagaagaatgggagggtgggaggagggtactggatgagagactgcttaatgggtacaatgtacactatttgggtgatgattacactggacatttggtaatcatcacccaaatcattacccaaatagtgtacgttgtacccataaagcaatctctcagcctctcactactacacaatatatacatatgacaaaacaacacttgtaccccttaaatttacacaaataaaacactacaaaagaaaattgaagaatgatcctatttataatagtgacatgaactaatttgaaaccatgtactcataggagatataagaagaaacaataacatgtcctagaaggccaaaaactgaagacttgaatcaaatgaaagacatatcattatcttgaatgagaagattgaatattacaaacgtgttcatttactcgaatctacaaacttaacattaatctacaaaattaacataattccaatcaaacatttttggagggttttggacctggcatgtttacatgacggaataaatgtgaataatcaccaggtaactctataaaaagaaagttattaagacagagttctcctataatgaatgacaaacataatattgggctacagaacagaagtaggtatacaaatatggaagaatatattacatttattttgaaattaaatttttgataaagttagaattttcagtcagtgaatacttgatactttatttaaaacacagttgtcaactttttactatacgtcaggctatatgaaaatattaactgatttaagtctctttacaatcttacaaagacttacaagttaaaaattttaaatttataattttagatacatgccattatcagcattatataacacatgagaaaacgaagcccagagagtttatgtcacttgctgaaagcaacagcaatagtaagtagtagagccaggttgtctgaatgttctttaataccatgatataagatttaggctggcacttgaagaaaaagaattaaaatcatactagagttcttattttaaaagcagattaaaaatagaattttatttcatttaaatgaacaacataaaaccaggaacgtattagaaaaaaaattggtaagtatttgcatcaattgatgtggtaaaacgtgaaatgtgatatcaagttacataaaggaaaaatattcaaccagaaataccatttcacatagaaatgtttaaaatgtttcatatttcacatagaaatatttaaaatctatacctctaaagtatttatgaaaaaattcaaaatatgataagaaagtacattgtggtatatgtttaaattgtggtaatatgtttgtttttttcctattgtcacagcttaattattgataaggtctttatccacaaaaggggttcaaactgtgcaatacatttttgtcacactaattacaaaggttagtattactatgaaacaaaagtttcaagatcaattaaaaaatatggatgttccaagaaaaattgaagaaatttttaaaaatagtcaatagtttaaaaaaatcagacagagaaggaggtaataaaaagagagaagtactaaagtaagtaacaagagaagaaaaaaaggtagaaagaagaaaataaatattccatgttgtcaagaaggcaggagattctcaaattttagcaatgggattatttgaaagtaatttagaaaatagttaagtatttatgcaaaattattttaaataatattcacagatgtgatatatgtgaaaagaaaatagttgaacataatcaaaaaaattcaaagattataaaatgtattattacaatctatataccacatattatattggccactagggatgatataaaggtaaatttagtgtgacagacaaacaatgaaaatattagaaatggtagaaaggtgactttattgacataaacaaaaatgacaaaatgagaaataaaatgggaaatgttgtatgatctcgattgggtaaaagacaatttatctacatgtgattttcccatacaaatcatttgatccaaatggtatttccaatgacaactgaaaatataaagtgaatttaaggaggtgaataggtataatattttttaaaaaatcgacttttttattttttaaagacaggttctcacttggatgcccaggctggagtgcagtagtgtgatcacagctcactacagcattgacctccctggcgcaggtgattctcccacctcagcctccagagtagctgggactacaggcacatgccaccatgccaagctaaatatatatatacacataaaatttttaaaatttttactttaagttctgggatacatgtgcaaaacgtgcaggtttgttacagaagtatacgtgtgccatggtggtttgctgcacctattgacccgtcctttaagttgcctctcctagctccccaccccccaaaaggccctgatgtgtgttgttcccatccctgtgtccacgtgttctcattgttcaacccccacttatgagtgagaacatgcagtgtttggttttctgttcctgtgttagtttgttgggcatgatatcttcgagcttcatccatgtccctgcaaaggacatgatctcattcttttttatggctgtgtagtattccttggtgtatatgtaccacattttcattagccagtctatcactgatagacatttgggtttgttccatgactttgctattgtaaatagtgctgcaataaacatacatgtgcatttgtctttatagtagaatgatttatattcctttgggtatatacctagtaatgatattgttgggtcaaatggtatttctggttctagatccttgatgaatcaccatactgtcttccacaatggctgaactaatttacattcctagcagcagtgtaaaagtgtgcctatttctctacagtctcacaggcacctattgtttctgactttttaatagtcgctattctgactggcatgagatggtatctcactgtggtcttgatttgcacttctctaatgatccctgatgttgagcattttttcatgtttgttggccatgtagatgtcatcttttgagaagtgtctgttcatatcctttgcccactttttgatggggttgtttttttcttgtaaatttgtttaagctccttgtgacttctgcatgttaagcctttggcagatgggagactgcaaaaattttctcccattaatatgtttttgtagagatggggtttcaccatgtttcccaggctggtctggaattcctgggctcaagtgatccacgcaccttagtctcccaaggtgctgggattacagatgtgagctacctcatccagcaaccaaaattttttagtgttattcgccaatgctgctattaaagaattacatttcagtttacacttacgtcgatctactttaggaatttgtatactgatttgcatttatccaaattggaattttttttaaatactgggacttttctctcacagaagaggtctgagatcttagtctagcataaatgacgaaatggggagtgatagaatagaaaaccaagagaaaagaagttatttaagagattaaaagaaataattatctgaccctttcacatagtcttgggtgctgaattgcaaattctgctgtttctgctgtgacagaataataataattttcttttcaatgatatagagatatttaacaatgtttactatttcatagcactagcaaaacaggaaaaaatgcttgatgtaataaaattatttcacccgattattaatcaaatatagaatgggagaatgtatattaacattatttgtcttttgaaataatattatcacaaatattaacaaactttggatagctttttgatatcttaattcctgataattgctactaattcatttctaagtaacaagtacaatataaattccagatttaaattaaaaatatttgatcattcacaatgctatgactgtattacatttcaatattttacctcgtgttattttctccataaatagagtggttatggttcacaggtacacatgctatttgtttatttatttcattttgtagagagggtcttattattttgcccaggctaaaatgcagtagctattcaaaggtgcaataaagtgcgttacagcttcaaactactggcccgaaaagatctggtttagcattctgagtagctggaattgcaggtgcccagccactgtgcccagccacaattgccactgtgcccagccacagtcagctttttcaagaactgtttaagataacaggttagggaaaatcaggataatattttgaggggaaagaaggtaaaatcaattaagacagggtgcacagagtacttgaatggtacagctgatgtttcatcctttgtactaaatggtgtgtatatgggaattggttatattattttgactgtttgtagtcatattatgtacatatgtgtatacataatttaaaaataaaagacaaaagtaatataagctaaaattatagatattaatattaattttatttaaatataacaaagatttgccagtattcaaatgtctgcaattatccttaaaatgcacagaacctatgtttaggtatagtatcactgttcatccagccttcattcactctaatctactcttatctaaaatttgtagtgtaagtaaaattacattcggtatgacagaagacaaattacagtattagaacattatggaaaattggcataacattgtacaatcacccataactttattatttatcattttgtaacttttttattatattagtcaaaaaatctaactgtacttaatagctaatacatatattatttgattttttaaagactattattaaaataataataatttgggggtgagaaggcctattgaaaaatgaccaacatataaatcataaataagtttgatgcaacaaatatttgtaagtcttataggtaaaaatataaaaatttattctaaacaaagctaaaagacaataatatgcattgggaaatatttgcaacattcacttcaagggttgatgtccgtagagaatttttacaaattaataaacatttaaaaagttgaggagtggcaatagctatgagagataatttacaaacacataaaaaccaatattaaaactgtttaatctgtaagtacatcaataaaaattttattatagtagttattttatctattaaattagaaaaggtcaatacaactgataatctcccaagggaatatatgggagaagcgctttctcatacacttataatatattgttagaatgccattaaataaacatttggcaaaaatctatatcctctgtcaaaacaatttaagttctagatctctagaatccacatatacatatacatatatacatacacacacacacacacattcacacctatatatcaacaactcaaatccaactccaattctttcataagcagtattttgtccaacaaacaaatttatctaaaattcttcttggcttttctccattatagagccagcaattttgtgtagctctacctctaattccttcatttgcatttatttctgctttcaagcccttatatgaggcaaatgggattaatttatttcattatcttaactagattcattgctttaatttgtcaaactctgattgatttgctcaactcaatcttgtgtgttcaagaacttaatgtggatttctgttccacctcatgaaagtcttttccaaaaacttgctaaattcttgactcaagacattccagttagtaatgcatttctctgctcaaatacaatagaagtgtgctctaataaatactcttcaacaatgtgcagttatttctccccaactatcaattccccttaaagcagaattttactaaaaatggctttatccttctgggaataatcagtaaaatggcaattggagggtgaatttaaaatatactaaaagcagatggcagaacatgagtgcagatttttactacaaagcttaggaagaacaaaaggaacctgaatagagaaaatgcagaaaagctctccctgggctattaggatgtagagagcagaagtatgtttaggagcttcaaagagtctgtctctttgcaactgtttatcttaggactttaaggaaataaaaggtgcaagtgaaccactctggattataaaatagaatttcacacagaaaaatcaactcagttaatatgcatgttgcttacatggaaatgttgagaaatttttagcaaatagaaagtggtagatggtaggtatatataaaataattgcagaaaaaatgtgaaatgaagatgtatggtattacttttatatttaaattgttaatatgttgcccataatgctttatttcaaagaatgaaaaaccggaaaaatagttccttcctaacttcccctgcagccttgtcttgtggagcttgtattttacttcatgagaaatgccaaagatatgtcatttaagctgaaacctccagcagaattagccagaatatttgggaaaaagatgtttccagaaaaagagctagtataaatgtccttaagcaagacggagctcatgatgattgaggaacaacaacaacaaaaagattatttcacccaagaaaagtgaattgggagtacagatataaatgatgagatctgaatacgattcatggagcaggtcaaactaggatgtttgggtgtggtctaaatgaatgggtggcatgagttgttttaaggagaggagtgacatgatttgacaagttcttaagagatccctttgattactctggggagaatagaacataaagtagcagaaatgaaagcaaaggggagatagtgggaaataattgcacatttataagcaagagatgatgttggctgggactctgattatagcaacagatgaagaaaaaaggaaatactgagaatagttgattggatttgctgacattctcaacataaatggaaatcagtatttttttctaataaatatgatatgcataaatatttttaaatatttaattcttttaccaccagtggggcatgagtagacttcaggaaacatgccagtacagaaccatataaatgtgatcattggtagagataggctttaataggcatttgaatgtctccctcaacctggaataccacgaaaaaagcttttcgcttcgcatgttgcattattatcataccctatagctttctaccattttcagttacttaatattatgttttgcctcaataaataatagtactttctcttattgtattgtattgtatttgcagcaattattagtgaagttttacgtttcaatattacatctaaaacaaaacaaaattgtcccatactattttccattaaaacacgagatcactatgacaaaaaaagctaaaatgtcatgaaatgacttaaattggatgagagtatatgaaatacattaagaaataatctctgactctgtagtttttttatttgtaggttttactagaacatgaaatcaatatgtgaatcctggctggagtttgcatctaaatgtaataaaataaaatgaagtttaatattatcattgaaccattagtgtacattagtgagctggactatataaaataaactttattatatttagcatttgatttttatttatgtatattataaaatgaatatagtttatattataataaaaataaaagaagtagtatgttaactaattcgtataagatgcctacaaactacatacctgcctaaatttttgacctgtgaaacttcaatggtttgtgttagggcctacatttatatatgtacatgtgtagtgtatatatacatatatatatatatatatatatacacacacacacacacactatatatatttttgtgttatatatacacactatatacacactatatacacactatataggtttgtgttagggcctacatttatataggtacatgtgtagtgtgtgtatatatatatatatatatatacacacacactatatatatatatatacacacactatatatatatatacacacacacactatatatatatatacactatatatatatatacactatatatatatatataaaaatatatatatatatatttagggagggcattgttaatcctttaattttaaaaattttaactttgcagacaaagttgattatacctgtggcagaacaatgcatacagcaataaataaataaataacttttattttctgtggagctcccagaattatgaattattggatagattgagatttgccgaggtcattttcttagagttgcaagagcataggagaaagtcaagggaaataataagcagcacttgatttcctttaccacagaggatgggattctaaaaccaaattatctgactataaatcaagacctatcttttacaggctatgtgattgtggatgttacctcctctatgcttcaatttcctcatctgtaaaatggaattatagcctaccctattttgtagtatagtgaggataaattgagtgaatgtatgtagttcctagaatagagcatgacacatgataagtggtcaataaaatattgtttactactagttatgtgacagtcacttcacacatagtaatgatttaataaaggagcaagaagaatgtagagcacagcttctcaacatcggcactacgacattttgggtcagacaattatttaatgcagagggggccataggatgtttagcagtgtctctggccagtagtgtacctcctcctctccaagttttgacaattgcaaaggcttccagacattgacaaatattccctgaaaagtaaaattgtcccggcttgagaatcacaaatataaagtaaccactcaaagattacattactaattttgattgaatttgaccagcattatgaaatcaacataagcttaagtttctacacttgattttgtcattgtcagttagggcagcagagaactccagttctgaaaattctgagcatgtgctaatagcctataatataatcaaaactttcattttgaattgtatttcttaaaaaatagaaaacgtattaagcagcaacatggaataattaaccacaaaaatatggaacataaatctcatttgcctaatatctcttttgaagtcctgtttcactgtataagtattatgtgttttgtttcacagctagatacagccagttttttctctaagcctaaggttactcctcaaatttatggtggctttttgctcttctaagtttctataaaacttcagcaacctgcagcaggttgaaatttattgatatttagttattcaccaggccatatttacagtcagggattgacttacccaaaccagatgctccccctgccagcagatcactaggagatattgcaataatttccctggttactaaattagcaaaagattctcagggagagagaagggcaagatggcacagtttaatacttactattattcttttattctttaccatcattccttttgaatggattaagaatctgacatacacataacttactaacgaaagggagttaggtgagagggaagacatatttgtctaagaaaagtcttagagaaatattttgaaaagagatagaaagaagagttggattggagtgggtgggtagggaatcacagtaaggagatggatcattcacaatttctttagacatggtgaggcagccacaggaagtctgaacttgttgaaaccctaatccgaagccaaaaaaagtgctcaataaggtcatactttgatcacctctgcctaaagcagttattcacaccctacttttgggagaggaaacatctacaaacctttgttctctttgtttgttagcagagggatgacatgaatttgggaaaaaagtttgagagacagaatgagatttagctcaaacaaatgattgactcatgctgggttgaaaatgtgctctagccgtatgtagaaagctgaaactggatcccttccttacaccttatacaaaaattaattcaagatggattaaagacttaaatgttagacctaaaatcataaaaaccctagaagaaaacctaggcaataccattcaggacataggcatgggcaaggacttcatgtctaaagcaccaaaagcaatggcaacaaaagccaaaattgacaaatgggatctaattaaactacagagcttctgcacagcaaaagaaactaccatcagagtgaacaggcaacctacagaatgggagaaaagtttgcaatctacttatctgacaaagggctaatatccagaatctacgaagaactcaaacaaatttacaagaaaaaaacaaacccatcaaaaagtgggtgaaggatatgaacagacacttctcaaaagaagacatttatgcagtcaacagacacatgaaaaaatgctatcatcactggccatcagagaaatgcaactcaaaaccacaatgagataccttcgcataccagttagaatggcgatcattaaaaagtcaggaaacaacaggtgctggagaggatatggagaaataggaacacttttacactgttggtgggactgtaaactagttcaaccattgtggaagacagtgtggccattcctcagggatctagaactagaaataccatttgacccagctgtcccattactgggtatacacccaaaggattataaaacatgctgctataaagacacatgcacacatatgttcactgtggcattattcacaatagcaaagacttggaaccaacccacatgtccatcaatgatagaatggattaagaaactgtggcatatatacaccatggaatactatgcagccataaaaaatgatgagttcatgtcctttgtagggacatggatgaagctggtaaccatcattctgagcaaactatcacaaggactaaaaaccaaacaccacatgttctcactcataggtgggaattgaacaatgagaacacttggacacaggaaggggaacatcacacactggggcccgtcaagcggtggggggaggggggagggatagcattaggagatatacctaatgtaaatgatgagttaatgggtgaagcacaccaacatggcacatgtatatatatgtaacaaaccggcacgttgtgcacatgtaccctagaacttaaagtataataaaaaaaaaaaaaaaagaaaagaaaatgtgctttttcaacaggtaggttgaaaatgtgcttcagcatttaggataccagatgtaaacatccatgcatagaattagaaaggttcaactttcatggctgctatggtttgaatgctccctccaaaacttatgttgaaatttaatccaaaataggataatattgagaagtggactttttaaagaggggattggatcatgaaagttcctccctcatgagtggattaatccattcgtgagtggattaatgggttatcttgggaaggaaactggtggatatataagaaggggaagatagacctgagctagcatgttagcattctcagccctctcgccatatgataccctgtgctaccttgggactcttctgagagtccccacaagcaagaaggctctcaaaagatatgccccatcgaccttggatttccaagcctccttagctgtagaaaataaattcagttctgtataaattacttagctttggatatactgctataagtaacataaaatggactaagacaatggtcttatcctgaactttgtaaactagaattggctgtttagcttcagcatgtatttttttatagattcaaaataatttcattttgaattgcataatgaaggaatgtcataaggttttcagcatatagaggctctaaatatcagtctggcattgtgataaagcagagagtttaaaccaagtcctatttgtgacacatgacctttctttctggttacagctcagtaacataggaatggatacttaactcaaggataagcatataatacatgaggctttttttcaaaattttgatttagaaaatgaagtattctagtatgttaattatagacatttcaactgagaagtctaatagcattggaccagaatagtcacagcagtccaaagccatggataaacttaagttaaaggcaacaaataataagagccttccacattaatctctatcagagaagatgataaacaggtgaatggggactagaaaccatgcagctttagaactagacataaaacaaacagctatctaatgatttcctatttactatgagcccaagatattcttgtatcctctcagttaagctcctgttttactaaggaaatttaagtaagattctgtctcttgcaagaaaataacatctaagacatcttcgaatttaatgctgctttaattttgtttataccagtggtccccaacctctttggtaccagggattcattttgcggaatataatattttcatggacagggttggggggaaggtttcgggatgaaactgttccaccactcagatcatcaagcattacactctcataaggagcgtgcaacctagatcacttgcatgcacagttcacagtagagctggtgcttctatgataatcaaatgctgccagtgatctgacaggaggcagagcttaggagtaatgctcactcatccacctctcccatcctgctgtgtggcccagttcctaacaggccacggaacggtaccagtttgtggcctgggggttgggacccctgttttacactataacatttgcacacgtctctcatggcctgtctttcagatctgctgtttgtctcgactcaagtctagctacctgaaaattagattttttttttaaattgaatttgaatatcttaaagttgaatacacagtctccacttttacacggcccctactgtcttacatcatacctctctagccctggaagatagcaactttacattcacttttcctgttttagggctattattttatcttcagttatcaaaatctatctacttttaaatactttaacttgaaaatacatagtaagcaattatggattatttaaaatagttttcccatgagtataaaaaaaaaaagaatagcaaaagcaatatttgttgagtatttaaaagtgccaggcactgtgcaacatgctttgcttaagtaaatgtttgacaaaatagaaggtcttttaaaagttccatgttttaacgttaataaccatatcaagataaggttagatattctatcaaattaccatttttgtgaagataggccttttctgctatatagaatctcctcaaacctgagtgttcacattatggattatctagtatactccacagctatcaagtttgtttgtgtttctttctcaagtaagctatcttatttatcttatttctccttatttcttcagacttttcctctcatttctttctctttttctggttttttttttttttttttttttttttgagactgggtttcgctcttgttgcccaggctggagtacaatggcatgatctcggctcactgcaacctccgcctcctgggttcaattgattctcctgcctcagcttcttgcatagctgggattacaggcatgcaccatcacatccggctaactttgtatttttagtagagacggggtttctccttgttggtcacgcttgtattgaactcctgacctcaggtgatccgcccacctcagcctcccaaagtgctgggattacaggcgtgagccaccatgcctggcccctatcctctcatttctaaggaaatgacaaattaagtattttatgcaaatacagtgtagggtcatttaaaatattttttgtaatagatgtctctgtacataaatctatttaattttttcttttacaataaaaaggtattaatgtgttttagtttcaccaaaaatttcagtagaccaactgtgtaaaggtacacatttatatcaatttttttgacctagtaaaaactaaagagggaaagttattcaaatatttcagcataaattccctttccttgaaattgcaatcgtcatgtgtagctacaattgctcagtattactctgtagtatgagtagctacaattcctcagcataagaaacactgaagtagacaattgttaagaaaacaaagtcataacaaaacaacaaaaacaacaaaattaaaaactaggatatagaaacattaactaaatgttactcttgaagccgatataagagaaattattgtactagacactgtggttcatcatccagatcccatcttcatgggaacacatcaatcccacactcataggggatatcagcagctgaccattcacatctgtacctttcacgaaatattgccctaagacaaactaaaatgaactaacctgcccaaagcggtgtctcctttcggagagcatccattgactcatagctggctaatgtagtgatacaaagatgcaactgctttgcctcaatttgggacaactctgaaagatgcccagtaggactggctgaagactcagttcaaagttgtcaaataaagtaaaccatgcccagttgaatttacattgtttagtatgagtatgtcccatgaaatatttaggaattacataaactacacattattcatgatttatctgaaatttaaattcaaccaggcaacttgtaccttcacgtggtaaatctggcagcttttacttagttgcatctgcattgtaggtaagcatgtcggtatgcacagacctctcttccgtgcttccttacaagtgcgtcccagaaaacaagtattcatctcagagccaacgggcattgaggcattcgataatcatactcccaaaggtcaaggataaagaaaatatcccaaaagcagcaagagaacaaacaagcaaacacataacatacaatggagcttcagtatatctggcagcagattttcagtggaaaccttacagccaggagagggtggcatgacacatataaagtgctgaaggaaaaaataaaaaataaaaaacttttaccctacaatagtgtatccagtaaatatatcctttgagcatgaaagagaaataaagaccttcacagataaacaaaagctgaggaacttcatcaataccagacctatcaaagaaaaggttgttagtgagcaagaataaattatctgaggatacaaacctcactggtaatactaagcacacagaaaaacactgaacagtgtagcactgtaatggtgatttataaattactcttgacttaagtagaaagaataaatgataaatcaatccaaaataataactacaataacttttcaaaacatagacagtataataggacatcaagagaaagagcaataagttaaaaagcggggggagattttcaagtgtagaatttttattaggtttctttttggtgtttgtttgtttatgtaaccagtgtaaaattgtcatcagtctgaaataatggtttgtaagataatatttgcaagcattgtggtaacctcaaattgaaaaaattacagcagatacacaaaaaaaggaaaagaaagaaattaaatcctactgccaagaatatcacctccactattgtaagaaaggaagaaggaagtgaagaccacaaaatcatcagaaaacaaacagcaaaatggcaagagtaagtccacacttatcaatgataacttgtaatgtaaatggactaaatgcttcaatcataagacacagaatggctatggctgaatggatttaaaaaaaaagacaaattatctgttggctataagaaacatttctcctataaagacacacatcgactgaaagtaaaggcacggaaaaatatattctatgccaataaaaaccaacgaaagagcaggagtatctatactcatataagacaaaatggatttctcgacaaaaactgtaagaagagaaaaagaaggtaattatataatgataaaagaagccaattcagcaagaggataaaatgattgtaaatatatgtgtacccaatactggaacacccagatataccaagcaaatattattagcgataaagagagatatagaccccaatacaacaatagttggagacttcaacaccctactttctgcattggacagatctaagacagaaaatcaggaaagagacattagacataatctgcactatggacaacaaggatctaatagatatttacagaacatttcattcaatagctgcaaaatacactttttccttcttctcctttttttttttttttttttttttaaagacagagcctggctctctcacccaggctggagtgcaactgtgtgatctcggctcactgcagcctccaccttctgggttcaagtgattctcctgcctcaaccttctgcttagctgggattacaggcatgtgccaccatgcccaactaatttttgtatttttagtagagaccgggtttcaccatgttggtcaggtggtcttgaactcctgaccttaggtgatccgccagcctcagcctaccaaagtgtttggattacaggcgtgagccaccacacccggccaaaatacacatttttctcttcagcacatggaacattctcaaggatagaacatgtgttagatcacaaaacaagtcttaaaacattcaaaaaaattgaaatatcaagcatcttatctaaccacaatggaataaaactagaaatcaataaaaaattaattttggaaatttaaaatatatgctcttgaatgaccatccagtgtttcagtgaaaaagttaagaaggaagttcaaaaagatccaaaacctatgatataacaaaagcagtactgagagaaatttatagcaataagtgcctacatcaaaaaagaagaaaatttcaaaataaataatcaaaagatgcatcttataaacctggaaaagcaagagcaaaccaaacgcaaaattacttgtagaagaaaataaataataaagacaagagcagaaaaaaaaattccaatgaagaaaacaatacaaaagaataatgaaataaaaagtttgtttgttgaaaaaataaacaaaatggacaaacttttaaccagctcacttagcaaaaaggagaagacccaaataaataaaagtggagatgaaaagggagacattacaactcataccacagaaattcaaaggataactactggctactatgaacaactatataccaataaaatggaaaatctagaggaaatggataagttcctagacacatacaagctaccagaatagacgcaagaagaaataaaaaaactgaacaaccaataacaagtaacaagattaaagctgtaataaaaactatcccggtaaagaaaagcccaggacccaatagcttcactgctgaattctaccacacatttaaagaactaataccaattctactcaaactattctgaaaaataaaacaagacagaatacttcaaaactcattctatgaggccagtattatcctgatatcaaaatcagacaaagacataaaaaaaaactataggccaaaatttctgatgaaataaatatcattgcaaaaatcttcaacaaaatactagctaaccaaattcaacaatacattaaaaagattattgaatatgacaagtgagatttatcccaggtatgcaaggaaatctcaacatatgcacatcaatcagtgtgatacagcatatcaacagaatgaagggcaaaaactgtatgataaattccattgatgttgtaaaagtatttgataatgttcaacaacctttcatgataaaatgtctcaacaaactgtgtttagaaggaactaacctcaacacaataaaagctatatataacagacccacagctagtattatactgaatggggaaaacctgaaagcctttcctcttatatctggatcatggcaaggatggccactttcattactgttgtttaacacagtacagaatgtcctaggcagagcaatcagacaagagaaagaaacaaagagcaccccaactggaaagaaataagtcaaattatccttgattgtagatgttataaccttacatttggaaaaacctacagactctatcaaaaatctattagaactgataaacaaattcaggaaagttgcaggatacaaaatcaatataaaaataaaaaattttagaaataaaaaattcaacacatttacaatagccacaaataaaataatatacctaagaattagccaaagaagcaaaagatctctagaatgaaaactacaaaagactgatgaaagaatttaaagcatacaaagaataaaatggaaagatattccatgttcataggttggaagaataaatattattaaaatgtccatagtacccacagcaattcacagattcaatacaatctatatcaaaataccaatgacattactcacaaaaatagaaaaaaattctaaaatgtatgtggaatcataaaacacccagaagaaccaaagctatcaaaaaaagaaacaaacaaacaaaaaaaacctggagaaatcacattacctggcttcaaattacactgcagtgctacaataatcaaagcagcatggtctgggcatacaaacagacacatggactaatgaagcagaatagagaacccagaaacaaatccacacatctatagtgaagttattttcaatgaagatgccaaaaacatacattggggaaaagatagtctctttaaaatatggcgctgggaaaactggatatccatatgcagaagaatgaaacttgacccctatctactgccatataggaaaatcacatcaaagtggattaaagactgaaatctaagacttcaaactatgaaactactacaaaaaattgaagaaactctgcaggacattggtctgagcaaaagttccctgagtaataccctacaagcacagaaaaccaaagcaaaaatggaaacatgaaatcacatcaagttaaaaatcttctgcacagcaaaggaaaaaatcaacaaattgaactgacaatccacagaatgatagaaaatatttgcaaactaaccatctgacaaagtattaataaccagaatatataacaagctcaaacaactatataggaaaattgataacccagttaaaattggcaaatatcaaatagacatttctcaaaagaagacatacaaatagcaaacgggaacatgaggaggtgctaaacatcactgaccaccagagaaatgtaaatcaaaacaacaatgagatatcatcttacaccagttaaaatagttttatccaaaaaacaggcactaatgaatgctggagaggatgtggagaaaagggaatcctcttacactgtgggtgggaatgtaaattagtacaactactatggagagcagtttagaggttcctcagaaaactaaaaatagagccaccacatgacccagaaattcaaattttaggtataaacacaaaagaaagaaaatcagtatatcagatatatctgcactcccttgtttggccagcactgttcacaaaagccaagatttggaggcaaagtgtccatcaataggtaactacatttaaaaaatgtggttcttatatacaatggagtactattcagccataaaaaatgagattctgtcatttgcaacaacatggatggaactagagctcattatgctaagtgaaataagccaggcacagtaagacaagcataacatgttctcacttatttgtgggatctaaaacttaaaacaactgaactcacagagatagagagtagaagccttggaagggtagttgggggtggagggaggtggttaatggatataaaaattagtaagaaagaagcaacaaaacctagtatttggtagctcaacagagggactatagtcaacaataatttaattgtaaatttaaaaataactaaaaaagtgtattggactgtttgtaacacaaaggataaatgcttgaggggatggagactcaatttttcatgaggtgatttttacatattacatgcccgtatcaaagcatctcacataccccataaatatatacacctattatgtacccaaaaatattaaaatttaaaaatatttaaaaatttacttgtaaaacagcctcaggccaatctttcaggagatattgcacaagaaggcattgttattataggagacaacagctccatgtgtgctattgccccaaacacctttcattgggacgagacgtggacgtggaagacagcgatatagatccacatcttgtgtagccctaggctaaaatgtgtttaacaaaaaaatttaaatgttaaaaagtatacatttaacaaaataaaaaacttatagaacaaggatataaagaaagaaaatatttttgtgcaggtgtacaatgtgtgccttaagctaaatgttattacaaaagagtcaacaagttaaataaaagtttattaagtaaagatacagtaagctaagattaattactgaagaaaaaattaataaatttattgtgatgaagtgtacagtgtttataaagtctacagtaatgtacagtaatgtcctaggccttcacatttagtcacttctcattcactgactcacccagagtaacttccattcctgtaagctccattaattgtaagtgccttgcattggtgtaccactgcttactatttatacagtatttttatcataacttttccatgtttagataatcaaatattttccattgtgttatagttggctacaatttccagtacagtaacatgctgtgcagacttgtagcctaggagaaataagctataccatatagcagaggtgtgtagcaggctataacatctaggtttgtgtaagtaagtacagccaatcatgttcacacaatgacaaaatcacctaatgcatttcttagaaactatgcctatcatcaatcaaggcatgactgtatatcagaccactttacttatccaaaatgagccttgtgacaaattcactctctagaacaaaattggatgatgaattagtaaaaagaatcccttaacacaaaaattatgacattttcttacatcttttactttgttagaccaagaatagaagacttttcttctcactagtaactgcaatcaattggtatgacttggagtaccaggtatatcactcttggcaacacatctatttttagtaggacaaaactgatgtgaaaaactgaaaatctcttcaataagagcattgaaactaggaaaggggtttagtgagatttagtatatgtatttatttacttctctgtggtttttaaacttatcttacttcctctttttaaaactctgtcagatttatcactgatttcagaattacaatctttaccatagactacaaatccctgagtagttatgtgatttcctcccttctatcttcccagtccatctcataccatacatttattggtcttctatgtcctagacacaccagccttttaagaggactctttattaatcacaaagatgttgaacagatgattctgacagcctggaattttctctctccacttttctttttcttttacctaggttgaattcattgtttagatctcaactgaaatattccttctttgtggaagcttcaccacatgacccagattatgctaggtctcataacatgctggggccttctcaatattgtgattaaccatgagcatgatgtattttgcctggactatattgcagacaaagggcggactgcaaatgcagctgccgaacaaatatctgtggaaagaaaaaatgattccttattttagacctctactctgtctcattagcattaaatgtcacacaagtcttccaagcttatttatctgattttccaacctgagataaaatagaagcagctaatagatacacagcacagtggaaaggcaatattagaaataggttcagcaggacaggcgcggtggctcacgcctgtaatttcagcactttgggaggctgagaagggcggatcacgagatcaggaaatcgagaccatcctggctaacacggtgaaaccccatttctactaaagacacaaaaaattagccggtcgtggtggcgggcgcctgtagtcccagctactcgggaggctgaggcaggagaatggcgtgaacccgggaagcagagcttgcagggagccgagatcgtgccactgcactccagcctgggcaacagagcgagactccatcttaaaaaaatgaaagaaagaaaagaaaagaaaagaagaggagaggagaggagaggagaggagaggagagagagagagagagagaaaagaaagaaagaaagaaagaaggaaggaaggagggaaggagggaaggagggaaggaaggaaagaaggaaagaaagaaagaaaaagaaagaaagaaaggaaggaagaaaggaaggaaggaagaaggaaagaagttcagcaatggaaaagaaagtaagtcataaaagtgaattagaatgcaaagtcaaagaacacatccacatttaatgggtttttttttgtttgtgtttttgaaaatttaattgaagaaagtaaagttaccctggcttataataaagttagatattataacaaaagataagtcagtgaccttaatatgcaatgtgttttggtttactcatcagataaaatatgttattaatgaacaaaataaaaaaatctaaaaaaggaacatgtagagaaacctagagcttagcagtatagttctctgaaatattaataagttaagaaatatacaccaatgagaaatgacttcagaagtttcactccaagggccattatagctctggaaattcttaaaggattcattaaattttcaagcacagaaatttgttcatttaattgatttttatatatgctttttaccccttttgttagttctgatcatccttaacctacacaccaaatatgctacaattaaaaagagaaagctcataatattttaatccccaaacataaaaactgaatttattaagtacctactaaagtctagaaactttgttacacataccacataattttataactaaatatgtaacatcacaaaatcgagattcaaaatctaacattggtggaaaatgcaaagcatgagtttaataagatattaaccaaaatgcacacctctgtctctgctataactacctcacctctggtttgcactagacttgggttgccacttgatccatagagaaccgttattaaaaacaaaccagagagtaattatgtcaaaactcacaaagccctgatttaaatcatgagaaatctgaataaagcctcccttgtcacacctgtctaattagcacggactctaaattgaggaggggagccctaaaaaggaattttgttgtagctgtaaaaatgtatactctttaccagcagttacaaaaacaaataatcttcatttgaagcaagctctccaatttttcaccaggatagtgaatgagcaaagctacatatatcctgcagagttgctagacacacaaagcaaaggatataggtattacactaattaacaacaatgggacaaatcattaaacatcaagtagaacattcagccaagatgatgaacaaattatctgtaagctaagattaatttgttactgaagaaaaaaattaataaatttagtgtgatgaagtgtacagtgtttataaagtctatagcaatgtacagccatatcctaggctattaaatgttataagtattagtagtagcagtattggtagtattatcctcttttcaaattttaaccacagagcttacatatgtataatgataacatgataaataggaatcagtttttacattggttttgatggttcacactgtctcaactcatggtatcttgttagcaaaagtgcctctattgtccagttaggcctgattttagtctggcatacaattaaatctaatatgtggatgcacataaacagtttgattagatttttggggaagtaggtttctgcagacatgagccactgcttgaatatgcaatatactaatccaatcaatcaccttgatacatttagttgttttatttttataattctctataacaggtttatcagtcaaatttattggttatacttattggtgtaaatgaagaaatactttttttgttccctctcatcactacctttaaatatgctcgttggaatctctttttcccatcacttgagaataactccagccaatctccagctatctagcaatttccaaacacactttcaataaaattgaaagacaataaatctatttttggtaaatttgacttactttcaggttttaaaaaggtctagttgcatgtaaattaaaactacaattttgcaaccaaattaaaacattttccctacctgttcctcacctagctcagaattgatatgtaacaggaagacctgtggttgtttatccagatgtccttcttttgtctatggctccattaggattgtaatggggaaaacaagaatcatagcaggaagaattaaaagaaaagagaaaagctttttttttttttttttttttttaaataatctcatctttatttctattgagaggcaggcacccaaatgcttcttctgtcggggagtgaatttgtaagttctttgtaactctgtgctacctatttgttaacctgagtaatttgttctcctgctcacttcttgctaacacttgccagcggatacctgaagcctcttacatcttctgtggcatgcacttggcctatatatagcatattcattcacctaaagtgggaagaataatctggcatcttttctctttccccatcttgccatcaaaagctgcctcaacgagcatgtagccttcagaattttgaaagccagaagcaggtaacaacttgccatgtttagcttcatcttgaaactcttgaggacacctatcaaactttcccaaaactgtctcatcatgtatggttccattgcaggatgggtgcaatgctgagtgccagcaggggaggaatatcccattctttccttcttgaaattgcccccagtctttttgagctctcttcctatttggaaggagaactaaagcaagtttagttctcctcacaaaagagaaaataattgaaagcactctcacttaggcagctaattcactgtctatatgataattcttagaatgcctagtcctctctttacataagagcacaggtaattgaggtcaatgaaggttgtagagtcacagaacttgtctggctactttttattaaatcctgcaaagacttaactattcttctgtaatttagggataccggtcatttaatagggaataaacaaaaatctgagacataaggaaattctgtatccattctatatatgtataaattatatatagaaaaatagtttagaagagttaatatcaatttgaaaataggaattttaaagctgtgaataatacatagcataaatatgtataaggattcagcaaaatgttagttgacatgtggctaaataaacttaaagtttaagaaagataagaaaagaaaccaaatatgcataaatctggggacaaaatttgatattgctgctaataaaaaggggaggggcatcatattgggaagcttcattaataaaagtaacaaattatgagaacaaatagtcttattatagtttatctggtgaagcattttaatgaggcgtagttgtctgttccattacggaaagagttttcttatgtgtgctctggtagattttcatgtggccacactgaaagatactcccaaatgtctgactaataattctatttataggcaactgttctgaaggtttaaagtaaggaggatgaagttcatttggaagcagtggggaaaaaaatggtaatgctgggctttgaattttatggatgctgtagctgttctttatttttcaataaataaatgttttaaatgccatgttttttagctattgcagttaaactgccctcatctttttgcccagcaaaaaacccattaagttattcactgagattgactctagattttttataaaattaataactttgctaccagtttctcaaaaatgagtagaaacgacttttcaatgcaaatgccagtttttgctacagtgaaattattctgtctgtagtgactatttgaacatttatgggcaataggacattgagagatttagtatatgaactacgaatagatttatccttagattatctaatacatgttttccaccttgcaacataaaacctgatctctttttaaagtcctggttgttctgaaaaatgaaatgaaattatagtaaatggaattttgactggggggaaaaaaacttcacatgatttaagagaatggatgctggcaattgactatctactgtttattcaaagcttatagattagcaaccagatgtggcagaaagttggctgtttttcattcacaacaaaaacgatgctgtgcttaatgaacggaggtttgttatcccagtaataagtaaaaggaacatgaaagcccttgtgtttaatgcttatgcaaataagctatttgcaggtggcttttgggcagaaggtaaaatagtttcaaaactgggtcaagttttttaatcctcaaaaattgccagctagaggaaaacctcctaaaatctttattatgctatttgccaagtaaatgaaatgacatcatttatcatttaataaattacatatgaaaattcttttccttatgatttcatcaatcaacaaataaattctagaggattctagatacatttatttggcatattttttaatgcggtatcaaattttgtggatattcttttagagaatcaatttcttaaaatggcattgaacatttaatttaaaatgcccttcttgaaccatacatgtttattagaaaattattttatataggttgtccattaaaaaacaattttctatgtatgtaaacatttatgataactgctcaatattttggtccatatttatttatctacctatttattacacaatacaaatattacactttgtaaaattaaaggcctagtctaatattactctatgtcggaagtaaaataattcagagaagtctatattaaaagacaagataaaacacaaaatgatgagaatcacaaaaccattgccaaattttcagctatgacatttattctccatgtggccttaggtatcttactctcttattttaacctttgatgactataaaaataatttgttactaagaagccctctcgctttagtagctgtgactataaaattaagaacataattcacaaaaagtgtttgagtcttcctgaaaacattttaaaatatcaattaatcattgcacaatacacaatcgcctgatcatttgctaaaagagggttgcattctcatctctgttcactctgtcctttctgagactcatataggtgtgagagctagaaaaaatattaatgtgtagcaattcagattttctcattgatgaatcacttcagcagtgcacagaatactttgtaattttaaaaaggtgtttttattaatatacttctactattctaccccaatcaacagcaaatttacctaaatcatgagactgctggaactgctaagttttataaataaaagacttaagaactactattaaaccctgtgaatcctttatctacaatgagaatgtccatgagtcagctcttctgaccctctggccagtgttctggagttactgatctgcaactttctaattgaactctagcttggtatgtgagagcagctgtgggttaaccagcggggcgacatttaagtcttgacattgccattaatgattcaccacctgttgcaagttcaataagttattcacacaccaaattgtggccacagaattcattgagataaactaagttagaaggattgggtgtcaataaatgtttgctaaatcagaattgttaatgatagaaatccgtagcttaacaaagttgagaaatcttgtcttcttaacgtgtatttattgacttcccaggatatgtcttagtgaggaaacatagcttctggcatttattattagagggataaggaataataaaccacagtgattgagagacagggaaaggccgggggacctagagacacagtaacagaagaagtttaattggctaatgaaataaacttgagataagagagcagagaggaggttcaagagatgaaaccacatattcctctctatctgctcccaccatcaagggaattaataacatattttataatgaatccctgataaatattagtgtataattgaaaatctattaaaatgactatttctcagggtgcagaaaaatattaaaacaagtaaagttgccataagatggaatattatattttcctgcatgtctgcttcaaggctgaatcctaatggtcatgtatgtaggtaaattattcttcctacagcaacttctgggaggtggtatgtggtggggtataaaaggccaggggtgtagtgagggtaaagtgtaagtactttgatcttgagccttgactatattggacttgggatctcagaaatcttggggataaaccgtggattaaatccataaattcataaagtgttggttatacaacgggtagaaactacgtgccacttttggagggacagtctcctttttttttaaaaaaaaaaaaggccttaaaggctatatatatatatatatatatatatatatatatatatatatatatacagtcttttttattataataaatactattttgttttttttaaatgaaacaatctgcacatatacaactccactctgaaggcaattatttacataattatgcataaattcctatagttatgttagtagttgcctttcttcagagtggagtcatatatgtgcagattgtttcattttaagaaaagaaatatttatttatttgattaactgaaattatgcttaaaaatgattaaaatgcacagatctgtcttcatgaagtttaaatgtcttataagaaattaaagtaataaagactacaacatttattatttaactgtaactgtagtgggtagtaaaagagaaagcccagtgtgttggctttcagtagtaaaaaacccaacttgtggttaggaaacgccattgtttattgtatctaaattaatcaagttgtatcctgtaacaggtttcctgttatccactcgtcttccaacttctgaagtatgctttaaatgacaagggagaaacccagacactacattttctaggatctcagcacaacagagctccaggtgaaattatgctaaatagtggcatgagcgtgagatgtgggtggcataaagaagaggtttagagtgtttttctggtgacctcctgtttaagtttgacaagcatctgaaatcactgctagcaactttcccataattattgtgtttccagcctttatgaaaatagcagcaattttttttcctttctttgcctatgtacaccatctaatcatgagataagtctccttcttagtccctatattaaatatctttttacatgaaatacatagattgggatctttttctgacctgttcctgtctgacatattcttcaactctaagatgagttcatactcatcttcggaagcccctgggaaatgggaagttttttttcatattagatgttggtagatatagaggcccatcctttaataaacatctatgtgccagaaaatgtactaggcacttagatacattattcatgtaactctacacaaatgtatcaacaacacaaaaaaaaatctgtataaaataataattattatatcccttatatggaaacagatccagagaggaagatacactagcacctgtaaatagaggatccaagaattaaacatccatctgtcggactgactacaagctctttctttttcataaaatgctaatttctctcctgcttctaatatttgtatcaaaatttgtcatctattgttattgggtttataggtgggtagtgactccttggcttctattttgttctagtggattactgtcttctttattttcattctagtgtttattgagagtcctaattaatcaacctggctgctctgacttccatcagctcaccattgtctcttttcccagctcataatttctgtaacagagctctaagctatgctaaacttctgctatatgctgtcagcctctctaaatccaagtgctcttatctgccaagtttacatacacatgtttaaaatcttcttattgaatctacatacaaagtcttcatgtcttcctccttgaaataatagcattgtgagagaaaaaaaatcttcattctttttaaaactaattcagaatgtctaggtaacacaagaacactctgcaacaaacaagaggtaagggaatatttacctggtatttctgtgcctcattatcattctcactcattataaaattggtatctgaaaaaaatcttgctgtaaaaacaaaaagtaatgtatagagagtataaacaaagagtttgcttcacatcataaccattatgcatcccattgccaaagggaagatagtacactacatgattccggggaggagcatcattcacatagactatagtgtgcatggcacatgcaagagaccccacagtactacccgctttgttctctttgtagacacactcacggatgattcatactccctgacctggagtagccaaataaagagttgcatcagtttattatcattctttccagaccactttctaggtattcccattatacattccttcaaatagaaagattttattctgtaaattgcatcgcactgtacacatttttttctgaaatctgaataatttcatacagtttcaactgtgagagtacctgacagactgacctaactctaagctaaaacactcataaactagcacagaagcttgtcatatcattacacatttatccattgctctaaattacttatagtttttcctgaaacatctattaatattgcagttatttgagatgactgtgagcttactatttgccagtgatgacatgagcaccttggtttagtctagtgcctggcatttaataggaccattctatttattttcctaaactctggcagcaagattagctctaagcatatttttttatcacaacaatcgtccatctttaactacatgtgaggaaagcactttcttatattgcattacacatttttatatggccacagaaatccttacttaatctgacaaaattaagataaatttctttctcctaagttcaaggaaagaatcattctctactgtttccaaggagatgattctccttttctcaattgccaattgtctactgcttgtcctgggttccatcttttcatatgtcatgaggattctcaccccagtgttctgctcctctgagtcaaagcccttgacttttcacttctcaattgttttgtttgtaatttttttgcttttatttttttctccataaatgctatgaaagtgtatgtaaaaatttacccatcttttattttatatttgttatcacattttattcacataccaaactatacaggaaatgaatataagcacatctttcttagtaggaggtagaagtaaaattttgtttagaataaaaacagaaaaaaagagaatccaattccatatcaccagtttgctcctgaatgtgcaataagtttccacttatgagcttgctactgtacacaacgcaagagcttttaaaaaattgtctacatgatagtggttaagagcgtactttaggctaggttactttaaaaaaatatgtcatcattacttctgccatcaaaagctaattcaatgtatcataattgttaaagttgagtagggttaaggattcttctcattctatggtttccttataaacacagtttctaataaatgtctatttttttctgtgaaattaaaccactagatattgctgaatgtctgtatatttcttacatttctagaatctcattcttaatttttttcttatatttttccttcaccaaagtcttaaaacctatgcacctggtgtctattatttaaattctgtgatgtattttatttgactttatttgtgtttttagtcttttcacagaaattagtttattgtgatcttcttttccaaaaggacttaattcatatctcttttccatacctatcttcattagcaggttgcatttcagtttcttcagtgcttttttagataatatattttactacatctttcttcacaacactgtatatgctctgatgatcaggtctctcattttttttaagttcttgtcccctttgggacccatgacaaagtaaagggcagattttttctcacctggcttaaaagtaaaaagccttcatatgtttctcctctgattcttcttaggcccagcatttccaaaaacaaactagtacacaaaacattagagttgcaatgatacttcaaaaggttcaaatactaatttttgtctgctttctctctatagttttcttgtagagaaattttctgttatgaaggttgaactatttgctatatgttaatattttccaaataaagtttccaaactgatatttaaatacattctctcatattcaaacatattctgaactactttctgttgtgtctctagatcaatatttataaaactagacagttcatataatttttttcctttgctaactttcaagatcatatcaaaaagtactactgttgattcggttttttgtgtttcattatttgaaactgtattgacctttttcctcttatttctttatcatttcctgttatttcatctttgtgagtcttcccattaatgtctttttctttttgaattatttattttttaattgacaaataaactgtatatatttaagatgtaccacatgatgtcttaaagtatacatacattgtggaatggctaaatcaagctctttaatgtatgcatatttaatatatgcattaccttgtaattgggccccttgagattttagtatctcagcatttttagtgcctgagatttaaaaaagtcggattaggctcttgcttgcttgcacaaaagccaacatcccttgttctcacaatacaattgcaaactgctgatgtactgtttctttgtcaagcaggagaagataacttcaaggtaacaaaaaacattcgcagaaggaaagaatgcctataagattgttgcaactaactgttgagacccagaagtctggttgctcaggatgttatcagagattaaagaaacacaaacttccccattggttccctaaaactccccctctcttactctctggctgcaaacaaacctctctgctttctcttattgttaagacatatctgacagatcttgccccgttctcgctttggccaagtggaataaacttttatctatctctaagcgttggtgtgtcagtgtttggtttcgactgagcatctggtacatgagcctgaatttgggtctctacaacatcttcacctagttactatttttgtgtgtgtgtggtgagaatacttgaaatctactccattggcaattttcaaatataaatgtattgttattcactgtagtcaccatgatgtgcaatcaattttttgaacttattcctcctggctaactggaattttgtgtcttttgaccaacatctccgcaatttcccccatgccctagcttctgatgatgaccaattaactctctgtttctatgagttttacttatttaaactctacatataagtgagattatgtcatgtttgtttttaagtgcctggcttatttcacttgacataaagtctcccaggttcatacgtgttgttgcacatgacaggatttctttcctttttaaggcccattaaccttttgtagatctgttactgaggtaatcaaagcttactggacaattatgttatttgagtaaattgaaacataacagcttataaagggtcaaatggtagtaatagcctaagaaataggtttggaatattatttcttagcataaaagacaaagataatattggtcagagtcttctaggcttgaattcttggctacttagattttatcaagtaaattgtaaaaggataaccaatcaatatttcacatgtatttctgtatgaattttgatttgacaagaaagactgtgaaaacaaaaccactattatctgtgaactacctaatgtggaaataaatatccttaaataaaaccttgagaaagtatattactcaattttttttctacagatatcccatatgttataatatttaactgaaaacaaaatctttcttcttaagaaaagattttattcagttttagaacgttaaagtttctccactctaatatatacagaacttctctaacctttaaaaatactgctttgcttattactcatgataattgggccacatacataattaaaacacaccatttattattttgccatgtgaaagtggcatctggttccccaacttgacttcaaactgtaattttaaacaaataataaagtgttttgaaacattaatgtcattaattgtcttatctattgtctatgttcatcaggagctgtgacatgcccaaaggaaggtaatcagaggaaggaagagaagaagctaagttctagagaatccattaatcattccttagatgactgaccattttattattttcccaagtaagctgaggctgacaatatcatgaatcatttacatatatcagtattcaaatgttccatttttaaattgggagggggtatgttttagaatagaataatgaaattccctccatctcctcctaatgtacatcattaagaagaatctaatggaaacataaggttctaaggctcttgttggaaaccataatcagaactggaggaattctcttatggaaaacattaaaaaaaggaaattctagcaatagaattcattgttaaagctgtaagttacaacaatattgtctctgcatgctgactgtaatcctctataatcttcaaaggcaaacaggaacagtaataatcttttcatgtactcttaacttccttctctgaaaggctagaaaatgtcttacatgtagcactcatagtgtcatttaatcaaacccagtttctatttttcttcaacttctagatgaatggatgcttagtctttcgggcacaatgtgaatttcttaagggtctgtagactacatctcctatttttacttctcaaagtttctctcaaattgtgataaaaagtttcactctattggtactgttaactgccaaccactttgaaggcctcctcctccacttttttctttttccccatatctaggcaagcagtaagaaaactcagagtctctattccttggctacggcagggaagttcaaaccatttaaatcctgaactattggggctgagggtaagggactcacttgggcccaacccttaaccccattaaataccagaactccactgactcttccttaggtttcacttcccactgaacctgagccctttttgttgtggattattttgccctttagtaggtaataataccatgtaagtaataaatttgtttcatttcctttcagtcttgatatccataaattactaggggcaggggtggtgtagagttgcctagtattcaccaaataaagtaaaaacaacacacacactgagagaaaaatctagagaaacattcccacattgccacacacagttttcttgcttgcttctggtaaatataaccttctctatccatgagttcaattaacaactttggataggaaatattcataaggaaaaatggatggctgcatgaaaggagagtgttctacctgactttattcactaatcaggatatgcctaaaaactgggtggcaaaaactgaactgtaggttttgagaaagattctaataacaagaaaaatgtacaaacatttttattgttgtttatccctaagcaagacagcataacaactatttatacaacatttacattgcattaagtattacaagtaatctaaaatggatttaaaatatatgagagaatataagtaggttatatgcaaatactaggccattttattaaaggacttgagcatctggagattttggtatctgttgggggatgggaggtagggcggcaggtcctggaatccatcccccatggatactgagagacaaacatacatagaagctacaaaagcaaattacttatttcgcctcttgctgttgacttaaggaaaactatgcactgtatcatcagtatagagagttcttgaaaagcctagatcctcccaaagtttgaataggtgttgcaaatagcgagatgtggtgatagctcaaatagagaacctctcgggaaaaccatttccacatttagaagcaagtttgaagtggcagatgactattccttttttataaatatatatatatatatatatatatatattatactttaagttctagggtacatgtgcacaacatgcaggtttgttacatatgcatacatgtgccatgttggtgtgctgcacccattaactcgtcatttacattactttttctactgaaaatattttcttggcttcctgtcaagtaatgtgagttgcaaaaggcattgaagattggaccaactaatgaaatggaatcaggacatggtttcataaaataagagtgtttttttgtaattatttatagtttcttcctttttttatttttttaacttatttatattccaaatacggtttgtcatttagctcaactttttattttgccccacatatcttcttacggcttcttggtttaataggataataaaatttctaaagcaggctggtctatggcttccttaaattaaccctgcctcttctcttacaaaagttactaaaggcaaatataaataatcatgaccaacatataaagatatgaatgagatttacagagaataactttactcagttatatagcgttacccacaaagggaatttactagcttcaattgaaaaaaaaatcccatgacacctatgatatttacttctgtcatctccacattcaaaagaaaacaaacagattacccacatatttaatcactttttattttacaaatgctctgtaaacaaaatgcttctcagacctattcaatacaattaaaatataacatagctttgccaaaaggtgtattccaaagttatcagttagatttattaactgataaagattagcaatttaatgtgaatgttttctttagtgaatatacagaattctctcaaagttaaattattaaaaacatacctaaattcacctaactcaaaaatgtagtattcttatactcaatatctgcacattctcacatatacaaaaatataatctaaatgttatttttaacaatataaaatttgtttctctctttgttattgccaagattgcactgactgttgaaatataaaagaaaaacagcattaaatcaggtgtgataaaatcacctttttctgtttatcttcactactggcatttattggcacttggaaactatttataaactcatattcttattgctaacatcaattattatgcaaatacttgaaatttttactgacttcataaataatgcatgaaagtctatagacttcaactagtgagcattatcttttgtggtttataaatacagaatacagaataaggtatagtttggatgagtctgaacaacagatgtttctgctttatgaattctggtcaaatcatttggaaagagttttgtttatacaataagcatctgcgttttggaaagttaaactaaaaattattttgtcattttctctaatagcttgggacctacataaatctgttaagttgaccttaaatagaactgaaggtgatagtagaggtatttaaaacaagtttggatagtttttacacatgtaaatctataacatacatttaccaaaatctaatatttaagaattaatggaaattatacagttattccaactctaaagttttatgacacaaatatattacttagatagtatcttcacattaattttgtttaaaaatctccattatgctttagaggggatttcagtgagaatatatataccccatcatattttatcaagctgaaaactgattatgcaactttttgtaagtacagagcaagtttaatccatttaactcatgccagacttcaggcatttaagaataactatcaagtattcctttaagaatttttctttacaggctagtcatccttacttccttcaagtaattgttaatttgcttgatgccaggagctctaaattatgtagaattcattttactaatttccattataatatatatttcgtatatatcatttgcttcctcaaaacccacagttcagtttttgccacccagttctgaggcatattctgattagtgaagaaaagcaggtagaaaactcttttactaaaaataaccaaaacatagttgggaggaggtgcttagggcatacatttttgaccttgtttacctcttagccaatactaagtgctttcacatataatcctataaaatgcttctcctccatgctacacttgaataatcaaaattttgaggttatatatatataatttcacaattgcctttttctttctctattcaacaaattctaccccttagacactggctttctctgtttcttctgtggtagttgatagaattttacctatatttatgctaataaatcaattatccagctatattttgcacaggggtcctgctaatcttcttgaattcttccaattttagtatacgtgctgccaaagcaagtgccagctatttttgaagaactgatatgtactcctaagaacacaagataaagagaatcctaggactaaagttggtaagccagttttttttttccatttcctattctttctttttacttctcgtcttccattctagagctgattcacaggaatccttcaaacacttcttggataggtctttctggagtcccttcaaaagttcctgtttatagatgcacataagatatgagagggtctgaattcttcatgagtccatctcttttgttggaactcaagaaaagagactagactggagagtagaactagattttttgagtcatgtgtaaataatgactacaccgcatgtacacatttagatgctgtccccagttcaagagttctgtccactgtcaaaattcatgtccacctggaacctcagaatgtgagcttgtttgtaaatcagtttttgcagatgtaactagttaagatgaggtcgtactggagtagagtaggccctaaatccaatcactagtgtctctataaggaacacttttacactgttggtgcgactgtaaactagttcaagggttgtggaggtcagtgtggcgattcttcagggatctagaactagaaataccatttgacccagccatcccattactgggtatatacccaaaggattacaaaacatgctgctataaagacacatgcacatgtatgtttatcacggcactattcacaatagcaaagacttggaaccaacccaaatgtccaacaatgatagactggatgaagaaaatgtggcacatatacaccatggaatactatgcagccataaaaatgatgaattcatatcctttgtagggacatggatgaagctggaaaccatcatcctcagcaaactatcgcaaggacaaaaaaccaaacaccgcatgttctcactcataggtgggaattgaacaatgagaacacatggacacaggaaggggaacatcacacaccagggcctgttgtggggttaggggagggggtagggatagcattaggagatatacctaatgttaaatgacgagttaatgggtgcagcacaccaacatggcacatgtatacatatgtaacaaacctgtacgttgtgcacatgtaccctaaaacttaaagtataattttaaaaaaaagaaaaaaaaaagaaagtgaaattcagacacggagacagagaagcacacaaagaagaaggtcatgcaaagaaggaggcagagataggaagaaagcagctacaaaccaaccagaaccaaggatttctgagagccctcagaatactggaagaggcaagggaagttccttccctagagccctcagaggaagtacagccctcagaggaagcaccttctaacctccagaactatgaaagaatacatttctgttatttttaagccaccatgtttgaggtaatttgttacggcagctctagaaaacaaatatacacaggactcttctttccaataggtctgaaatataaatgtatatttatatacatctccttgaatatataaatataatagagattaaatataacagatttatagatttataaacatataacagatttatatatttataaatataaaacagatttatataattttgtaaacacaaaatagatttatatagttttataaatgtaaatatatgcatatatatttaatttttaattactaaaattttttctataggctctcaataaggcaaatacacaatgaccaaacagaataataattgcttttcatttatagattataaatgcttttaattgatagattataaagaatttcatttatagattataaagaattactgtgggcaattaaatcaaagccttttcaaaaatggtgcaaaactaaatctatagtattcaactgatgtttaataaatattaaacattattaatatttattgttaattttaattaatttttaattaataattaaaattattaatatttaataaatattaataagcatcttattcaactgatgtttaataaatatttctgtggattattcctctgaaataatattttaagaatacacatgcatagacataaatgtacatacatggttcaatgtggtgttttattccttgcctataattacacgggtaaaaagaatgcatatttatgctgaaatgaaaccattttgctttctaaaaagaaacccagacacacatttctaagtgcaatgacagcaaatactgatacattcacatacattcttttgtcttttgaccttttcaagcaaaatcgtgcaagtatatctaggttacatctgattagctttcacatgttttagcaggttttgagaaattttgttttataactttgataaggtttggctgtgtccccacccatatatcatcttgaattgtaattcccataatccccatgtgttgtgggagggatccagtgcgaggtaatttaatcatgggggcgattactctcatgctgttcttgtgatagtgaatttgttctcacaagatatcatggttttataaggggtttttccctttttgctcagcacttctccttcctgctgccatgtgaagaagaatgtgtttacttccccttccaatatgattgtatgtttcctgaggcctctccagccctgtggaactgtgacttaattatacctcttttctttataaattaccaagtctcgggtatttcttcatagcagcatgagaatgactaatacagaaaactggtagtgcagagagtggggcgctgctgtaaagatacccaaaaatgtgcaaacaacattggaactgggtaacaggcagaggctggaaaagtttggagggcttagaagaagacaggaagatttgggaaagtttagaacttcctagagatgtgttgaacggttttgaccaaaatgcttaaagtaatatggacaactaagtcaatgttgaggtcttgatggagataaggaatttgttaggagttggagtataggtcactcttgctatgcagggagactggcagcattttgccccgcagaactttgaacttgagagagatgatttagggtatctggcagaaaaaattctaagtgctaaagcaatcaagaggaagcagagaataaaaggtttgaaaatttgcaacctgatgatgtgagagaaaagaaaatctcattttctggggagaaattcaagccaatagggaaaatgtctcgaggacatgtcagagaacttcacaatagcccctcccatcacaggcctgaagccctaagagggaaaaatggttttgtgcccctcttccgacaacccatgcagcctcaggacatggtgctctgcatcccagctgcttcagctccagccatggctaaaacgggtcagtgtacagctcaggctgttcttcaatgggtacaagccccaagccttggcagcttacacatggtattgggcctgcaggtacacagaagtcaagaatagagctttgtgaacctctgtctagatttcagaggatgtatggaaatgcctggatacccaggcacaagtttgctgtgggagcagagccttcatggagagcctctcctggggaaatgtggaaaggaaatgtggggttggagccccacacagcactgtctagtggaatagtgagaagagggccaccatcatccagaccccacaatggtagatccatccacagcttgcactgtgcacctggaaaggccacagacactgaatgtcagcctgtgaaagcagctgaagggggggcataccctgcaaagccacaggagcagagctgcccaaggctgtgggagctcacctcttggaaaggcataacttggatgtgagacatggagtcaaaggatatcattttggaactttaaagtttaatgactgtcctattggattctgggcttgaatggggcctgaagcccctttgtgttggccaattacctctatgtggaatggatgtatttaaccaatgactgtatccccattgtatctatgatgtaactaactcacttttgatttcacacgtttgtaggcagaagaaacttgccttgtctcagatgagactttggacttgaactttcgagtacatgctggaatgagttaaaactttggggaactgttggaagagcatgattgtgttttgaaatgtgagtacgtgagatttgggagggactaggggtagaatgatatggtttggctgtgtccccacccaaatctcatcttgaattgcagttcccataatcttcacatgtcatgggagggacacagtgggaggttatttaatcgtggggttggttaccctcgtgttgttcttatgacagtgagttctcaccagatataatggtttataaggggtgtttctcccttagctcagcacttctgcttcctgctgccatgtgaaggacatgtttacttccccttctgacatgattgtaagcttcctgaggcctccccagccctatggaactgtgagtttattgaacctcttatctttataaactacccagtcacaggtgtttcttcatagtggtgtgagaatgaactaatacaatctttttcagcttttgtttcttagggatgcaattcaagttaaggtaagagagtagtgtagtataaatcagccttgctaagacttctataaatcatgaattcagcagctaattcaaagcacaattttgtatatggtacaaaagtatctattgtagatgactaatttcaactctaactatcaaagtgacaaaaaaacgagctatcaacatcagccctcctcaaaaatgtatgcactattttactaatagtaacaactaaacaatgagcaatattaggaagattaaaacccataatgtaatgtactgtttgacagccaaagactttaacaatgtcctattctttctagtacctctggacgctttattcttctgctaacgtcagccctcctaatctttcacattacattcctatattgcaccatttcagaattttctgcctcacagttggaatgttaccagatactcctcagtgtatggaccacctgctattgctctcagctcatgtttggagaaaactggtttatgtaaaattttattttttttcttctggtaaatgaaagctaatttgcaatatgtttccatgggaaaattctaggcataaaaattatataaccacatctaaaattgctaaacaatattttttaaaatacttaaaatttaatgataaatcatagtcataagcccataaaataaagtaatatcaaaatgaaaattaggaacacaaaactatgtgctacagggaaaaatataatccaaaagttctcaaacagtctacaatatctataaaatctgtgtattgagtttctactctgcattcagcactgttttatgcccaaacataatacaatattcctgtttcaagtggagaagtttgggctgtatatgggatgttgtttccatacatcagtggccactgaataacaataaaactcacattctattctcatgaaggcatgcttgtaatggctactgccaaatgagactctattttacaatagggtgtgtatttcttatgtatgttttatgtatctcccttatttaaaggatttctttccatatgcttttcttttattaaagttgaagattctgttctactttacttttagacaactaacttttgttgtttattccatagagtctctatttgtttctcaccaatcaatgttgggcatgaagccaggcccaacagaagcccttagtccatggagaattacttttattcacactaccgtaagaattagtatcttaaaaattttccaatatgtgaatgtagtgcttagaaaactttaatcattctacattgcctttggcattacaattaaatatctggcttaatatataaagcctttcacaatttaacttaatggcagttatcttctctccatacaattcactcaacctcaaaacttaaaactacataaccattcgtggttctttgctttttttttctgtttgccaggctgtatctaagttatatcagattactcaagtgtcatctcttttatacaccctttgtgatgcttgcagggtgaatctttcctatggctaatagtttatataaacatctatcatagcttatgtttttagttatatatttacttgcagaacttgttctttgattacaggcattcaccatacatgcctccctctgacttccttcaaaacatacttcagtgactgaactcaacagtcattgtagcttagtagtaaaaacaacgtattcaggggccaagattcttgcctttggatcccagggtcacgtactagctgtctgaccttgagcaagttacttacttaaactttcagtatcataagtttcattactagtgtgctcatactagtgtacagcaggttcttaaataatgttgtttcattcaacatccttccattgtaacattgatgagaaaaaacaaattcctggtgggatccactgcatgtatacagtttgcaccttctccccatgtctgcgtgggttttctctgggtactctggcttcctttcctatctcaaaaatatgtcgtgttcattggtgtatctacatggtgctaaaatgacagagagagagaaacagagaaagagagagagagagtgtgtctgtgtgagtgtgcccttgatagaacagtgtcatgtacaaagtttgttcccaccttgtaccctgagttgcccagaaaggctttggacacctgcgacaggaacaagaaggcgaataattatcttacttgtttttattaatctttcttaaaagtacatatagctcatgtttatttcaatatttaatattataaatatttttatctttatttagaagcttgatgttttcatgaaaagaattatgtcataggaacttgactcttgtttatatcaattaccctatgatcaagtttgttcctatataagttgttttgcatgaagtcgtagttgtcaagaacctatggaggatgttaagtgaggatttgcagtataaaattcttaggttatttggagaaaaatgacttaatataattagtcccataatgtaaagattttagagattgacgtgaagtcagtgttttatgaggatattagaaaaagacaggtgagagacaggatagaaataagaaaaataaatattgaaaacatcgtttccaagaaagaataatttctatatgtaatcataaaattgcagtaatggatggatttactaaaaaatctattccagtgctcagatgaaggaactgaaggcctgtgaagtcacacaagtttaaagcagatataggaataaactcctatttcactggtctcttccagagaggtttttgttttatccttgactaaagtctgcaacgtgttttccttatgtcaaatcttgctcttaatgtttttaggcattctgtgaccttttgttgactacttgacttagctctttctatttgccattactttaaatgtatattataagcctgcattgaagtttttcaaaataaaaacatacccaagctgttcttttccacagatgatttggggaataaaaaaggagaaataatacagtctaatttcactattgaaacagagatcagttgaactaaaacagaagaataaatggggtataaagcagtccactaagatattcataatttcatactgaactctttaggaattgtgatttcttaactagattcatttatttatttgataaagttttactgaataccggctatgtgcctgactcatctattgattagcaagattaacatggttcctacactcacaatgctcacattttgctgtagaattcataataataaaaatcatcataatcataaaacttgaaatagggacaactgatagccatggaagtacttttctgaaaggagtaatattaccatatttcaggttttaaaacgtcatttcagaaaaaatatttggagacagttggaaggaaggtagagtatatgcaaggagaaggagacaaacaagatgctaatgcaacagggcaccaaacaccaagaaataagcaagtaaaacatggagcgggaatcccagttttttgcagaagattaaaagagaagccttgagagacatgtatttggtataatacacaaaatatcatcatgcatttaatatagggagtgagggaatgaaaggcatcagaaataactttcatctctctggcttgagaaacattgagtagacaatggtggcatttaatgagataaggaaaatggagaataatatattttatcgaggtagcgagttgaaggatgatatgaattttgaaccactgagtttgaagtgcacttgaggaactccaacgtgggagagtgttaaatagccaatgctaattagaaacattcattgaaaaatgtatttttaggagaaatcatgacattaaaactagaaagaacatatttttgaataataccatttatattaatgtctgataaacagatacaaagtgcctaaaggattcttttttataaattattgatcattcatttaaatgatactagattagagaatatttacatcacctgctataagagtgacagcatattagccaatggtattcatgctcgactatgcaattcagaagcaacatcaaagaatattcttcattgtgttcataaactttctcttaagtgaataataaagaaaatgtaatgcctagcaacattttctagcaattattcttctgcaatgcatgaatacatatttgtgctattgtagcattaggttcaacctaattaactcagaaaatcatttatgcacaatagcctatctttcatgtacagcagatcatgtacattttctttactttttgcaagttgtatgtaacattagcacacaaaaaaatagtggttgtggttctcggttcttagcactgctgtttatcacatccatgtccatgctagtttttccatgtgtgatttaactaccaagttaaccatttgagattagaccatctcttggatttatgactctgtgcctataatattcgagctgcctataggtctttataagcatatatagcaacacatgttgtcaacaacaacaactgcttagatattaaatagctgaaacctctggaattaggcaaactgtgtgcaaatattaaatattgcttcagaccttgagaaactttttttcaactacctgtgcacatatttcctcacctgtaaaatgaaaccaatgataaaacagaacctccttctttggactatagtaagaatttaatatttaatttttaacaaattcttatggtaaggacttaatatttaattcttgacaaattcttatggtaatgtttaattcttaccaaattcttatgataaggatttaatatttaattcttaccaagttattagggtaagaacttaatatttaaaatattcatttttcagcatatatgaagttcttagaatacctactagcatatgataaaatcttagagaaatttaacaattttattataaattagattgcttaatatataatcatgttacatgagttgagatagtcaatgcaaataaaaaataatcttcactggttatccttttatgttactcagctttcaatttctcataccatctcaaagaaaatgtagctagtagttatttttcagaatctgagaagtgttctgcaaatgtgcgtaataatttttgtcaatgttgaaaatctttaggactttctgtaaagtcgatatttaatgagttgaactattgtctttagcatttatgtcctaatttttggaaggaaacacacacacacatatatatatatataaaatgaaatcctatcttacttgacctaaaactgcacaaaaatttatatttgctgcgtttattttgcattggtaatatcaattttcttccatctgaatacaagtcatttggaaaattccttacatccaagttcttcagctcctatttgttaatcctttctttctttcttttcttttcttttctttttctttttcttttcttttttttttttttttttttgagatggagtctctctctgttacccaggctggagtgcagtggcatgatcttggctcactgcaaactctgcctcccaggttcaaggaattctcctgcctcagccttccccagtctggaaatacaggcacgtgtcaccacacctgcttaatttttttttttttttttttttttttttttttaagtagagacagggttttgctatgtggcccggctggtctcaagttcctgactttgtgatctgcccacctcggcctcccaaagtgctgggattacaggtgtgagccacctcgcctggactatttgttaatcttgatcttgttatatatcaactgctgggttgctccatgattttcacattctcttcctttagtttgtattgtgttggtttttgtttctttcataaaacactaaaaatgtttacatcattttaaaacatttcaaacataaaacaatatcctaagtagcttaacagtagagtccacacatgttgggtattaacgtaaaaacttttaagctcgttataagatcaatcagtctgttcatatcagtactcaatgagaacattaacatgttcaactctgttcagtcattagagaagcatatataaaacatattccaaaaatctaataagctgagtgaatgccaataggccagtaaatattgatataggatgttgctttgatggtaccaatttcattttatatattgtaaggacttccacctactattagagtaaatttcaagctatataatctcacattaagtgtcatttgcaatctgaacccaacaattcaaaataattatgttttaccaactctaataataataagacaaaaaataatggctattacttatcagtaagcaatctgagacctagtaaggatagatgacttatccagggtcatagtgttagctggtgagagagccaggagttgaaatgaggtggtttggcctcagaaactttgcactaagcccctaaatgtattaacaacactacgccaaagccttgccaggaagcgtttcaccatcttccagtgggaagccaagtaaacataaacttttaataaaactgtctgagtactgtcagagaggtataaacacttctaccagacagtaatttttttcaccatcctggaagaccctcaaggtcagggattatattttatttgactttgtattcccagagcctcccatgacacctaccccatagaggacctcattaaatgtgtgctgttgttttatagcaaagtgattccaaagcggtagtagggctagagaaaaaaaaaggctttacagtatgtacgagcgacatttgaactccgtcttaaaaaaataaatataggtactcaaggaagaaacacagagaagaggacatttgagacagagaaaacaacatgtgtgaacaaggcctgaagtgggagaacaatggatatatctaaataataggcgtttggatgtagggaagccagagatagtgtcgggcaagattctggacaggggtttgtggcggtttaggaaggaaaacctttatgtcaggctttcaccttcatagcttcacctgcacagccagggctctgttgcactggaatcagtagagggaatgggtacagtttcaagaagctctccaagagctgggaacaccctatttgtgcctcagcgtggttgaaatttagtctctccatttatgagcattacaaattttaataaaatgcaacaagggcacagttggggagaggttataaatgactaaaacaaaaggagattttaatattgaagagtatagaattaagttttcaaaaagttcgaaacagagtgcttatatataaatataaaataaataaatgtgattgacattaatttattaataacaaaacttgcaagaagataaatctgcttacctggttttaagcattgagaggaactaggagtttatatgcattttgggggaaatatatttaaataatatttttgtgtttacacagaataattataatagcttacagatagtaaaactatcatatttggggttattgtctcccctagacaaaatctataactaacatctatatttacaatgtctaggctctcatcaaataataaatagtgaagtcaacataggtaccttatcccatgtaattcattaatctttacacaagcctcttaaacagtgctccagtatgatagtaaaataccatgtcttccctctccggttgaccttatttccaaggttgagtatctagctagctagctattttaaacaagagcaacctaattctattgatttaaaagacagaataatgatcactgcaggagacagagaaagtgaacagttaaaaaagatgtttcactaagctaagggaggaaggagggcctaaatttagtgttggagattgaggttatgatacaaggtttacagactaaaaagcaataacatgccatgaagtagtttaaccttttatgttttcttgcctctgtacttctgcaccctctcacaccactacatttgtctgcaatatatttcccttatcctttttaaaataaagtttcacttttaataattaaaggtacataataggtatatatatttctatcttattattgatacatagcatttgtatatatttacaggggacatgtgatttttttgttacacgcgtataacatgtaatgatcatgtcatagtatttattccctagaatacttttcatctcaatgcgttaaaaatatttcaaatactctcttgtgtctatttagaaatatacagtacattgttgtttagtaactaaagtttactctcaatcactggaaattattctttctgtttaaatgtatgtttagacccattaacctactctctttatccttcccacatacatttcctagcctctggcatctagcatactagtctataccttcatgatattaccttttttagccccacatatagtgagaacatgtgataattgtttctgtgcctgatttatttcatgtaacataatgacctccattttaccccatgttgctgcaactagtgttatttcatgcatttttatggctgaatagtttttcattgtgtgccaataccatatcttctttacccatttgttggttgatggacacttaagttgattccatatctctgttattgtgaatagtactgtaataaacatgggggtgcaggtatctttttgatatactgatttcttctcttttgaatagatatctgttaatggcattgctggaacatagagcagttctatatttacatttttgagaaatcctcatactgttttccacactgactgcactgattgacattgccaccaacagtgtataagagttcttttttctccacatcctccccagcatttatatatattttttgtcattttgataatagccattctaactggggcaagatggtatctcatgattttgatttacacttccatgatgattagtgatattgaacattttttcatatatatgtaggttctctgtatgtcttattttgagaatgtctagtgcccattttaacaatgtgttgagatccttgtataatctggatattagtcccttgatgaaagagtagtctgcatatattttctcccagttctacagattgtttctttactctgttgattgtttccttagctgtgcagaaatttttctgtttttgttgcttgtgtttttttaggtctcagccataaaatctttgcctagatcaatgtcctgaagtgtttccccaaagttttcttccagtagttttataattttgggtcctaacactatgtctttaattgatcttggctgatttttctatgtagtgagaaataagggtccttttcattctttccatgtggatatctgatcttgccaacaccatttattgaagagggtgtattttccctagtgtaggttcttggtgtctttgtcaaaaatcagctggctgtaaatacacagatttatttttggacaatctatttctgttttatttgtctgtatgtctgtttttgtatcaacattatgctgttttggttgctatagccttgtaatatcttttgaagtcatgtagtgtggtgactccagttttgttcttttcactcaggattgttttgaatatttggcctctttatgggttctacataaatatttttctatttttgtaaaattgccattggcgttttgatagagattgcaatgaatttgtagattgttttggtatggtcactttaatgatgttaattcttccaatccacgagcatggaatctttccatttgtttgtgtcctcttcaattgcttttatcagagttttgtaattttccttgtagaagtatttcagctctttggattactttatttctaggtattttattgtagctgttgtaaatgggattgccttcttgattcttctttcttagctaattcattactggtatatatgaacaccgatttgtgtatgattaatattgtatcctgtaactttatttaatttatatatcaaatctaagaaattttaggtaaaatgtttagattttcctagatagaagattatatcatctgcaaagaggaaaaatttaactttttcttttccagttcgaatgccttttattttttttaatccatctgatgatgctggctaggcctttgagtactatgatgaactgcagttgggaaagtgagcatctttatttttttccagttcttagaggaatggctttccactttttccctttcagtattatgttagctatgagtttttcacatatggcctttgttatgttgaggtatgttcatcctatgcctaatttgttgagtttttatcttaaaggatgttaaattttccctatttctctgtgtctattaagatgatgataagattttgtccttcaccctctttatgtgatgtatcacatttattgattagcatatgttgagcaatctttgcatctgtggaacaaatcccatttgattatggtgcattatcttttgttactgtttgtttcaatttgatagtattttgttgaattattttgcatctttgttcatcaaggatatcaagctgtagtttttttttttttttttttttttttggttattgtttttagactcttgtctggtattggtatgagggtgatgctggcctcacaaaataaattggctgaaattccctcctccccaaatatttaaaataatgtcaggagaaatggtgttagatcttcttcgtaaatttggtcaatttgtcagtgaagcaatccagtctcaaacttttctttgttgggagactttttattgttgatgtaatcttattactcattgttgataagttcaggttttctatttcttcctaattcaatattggcagattatatttttccaggaacttgttcattttttctaggctttcaaattagttagtgtagggttattcgtaatcgtctctggtgatctcttgtatttcagtgctatcagttgtaatgtctccatttttctgatttatttgggtcctctttctttttatcttcattagtctagtgagcagtttataaattttatctttttttggaaaacaactttttgttttgttgaccctttgtattattattttcagcctgtattttgtttagttccactttgattttttattatttctttccttttgctaattttggtttggtgtgttcttgcttttaaaatttattgaggtgtatcattagattgtttatttgaaatctttctactttttaatgtaggcgtttattgctaaaaactttcctcttagtattgttttttttctgaataccatagtttttggtatgttatgtttcaattttcatttgtttcaatacattttttgattcctctcttaattatattcttgacccaatggtcatttagaagcatgttgtttaatttccaaatattaatatagttttcaaagttcttgttattttttattccactgtgttctgagaagatacttggtatattttgattattaaaaaaattgagacttgttttatgtcctacaatatggtctattcttgagaaagttctatgtgctgatcagaagaatgtgtgttctactcctgttggatgaaatgttaggtaaaagtattttatgtttattgggtttaaagtgcaatttaaaggcaatgtttcttttttgatgtttttgtcaagatgatctgtccaatgctgacaatggggtactgaagtcccccaaatattacattattgcagtctatttgtccttattgatctaataatatttgttttatatgtctgggtgctccagtgtttgctgtgcatatatttacagttgttatattcttttgctgaatttattcctttataattgtataataaccttgtctctgctgtttttgattaaaattcaactttatttgatataactgtagctactcctgctcatttttttgcttccatttgcatggaatatctttttccatccctttacattcaatctatatgtttctttacaggtgagatgtgttccttgtaggcagcatatggttgagactttgtaatttttaaaattcatgtctttttgtttgtttgttttagattcttgctctgttgcccagtttggactgcagtggcacgatctctgctcactgcaaattccacctccaaggttcaagcttttctcccacctctgcctcctgagtagctgggactacaggcacgcaccaccacatccggctaatttttgtatttttgattgagaccagattttactatgttggccaggctggttttgaactcctgacctcaagtaatctgcccgcctcagcctcccaaagtgcagggattacaggcatgagccagcatgctgcccccatccctgcctttttttaactattaagccagtctatatcattgaactacaaaatttaatcaatttacattcaactttatttttatatgtgagggcttagtcacatataattcaccacacatacatgcaggtggtggtgaagtcttgctggggacagggccatcaggtgggccagtctttggcccccattggcggcagtgcaggtcaattatgtctttccctaattttcagggctgcatacactagcactggtgtcagcaggtctatgtaagcaggtctatgcaattctgttgtccctgtgtggcttgcttgggtgttggcagtgacagtgatgaactgggtgggtgagtgggtcctctggctccaaggcagtgggtttggtggtaatagtagtggagggtcaatcctctgactctcaagccatctgtactggtgttggtggtggctgtgacaggctgcaatggccagtctctaggcttgcagttggtgcatacatgcgggtactagctgtggtggtagcataggttgagtggactcattttcaagcccctggaaatagtgctcagctgctaatagtgtaggtggggcaggatgatacacaggcccttgaagggtgtgcttgtgcactcaggagggtagagctacatcacatgggccttccctcagccccccggtagtgtttacagtcactggctgtggtatacaggggtggagtgatccccaaacccccaacagaatgtttagatgaaggtggcagaagctgcacttgcagcactgctgtggggttggggtggggaagcagaggttactttcagttttagtacacacgagcagatagctgaggaatgcaagtttcagccctaggtgacagctataaaccgggcagcctttcttcggggtgcttttaagcgtgtggcgaccctgctgctaaaggttgctgggtcactgtcagtgcctcatgctttggtcctagcaacagtagccaccagtggtgcctggctgcaggtgggggaggtcagtggcgttctaggaatctggagaggcagaagttggactctagggcaggatgcaaactggtggggactgggctctcaaaatagcactctgctgtggctgcttaggcttcagtgtgggtatggcacccattcttaactcccttcccagagcaatgctcttgccatccccatgcagcttcctatgatagtttcagtgcccatatgggttgaaggactctaccatggctaagatttcaggaatctgctgtggaaatgtggaccactggggagcatttgcttactctttctccagactaaggagcctctgcatactccttgccaattgtagccaagcgggctgcctcgctttggtctcctttcttgccttaggtgttttctgtcacatctctgttgaattccagcattttttcttaggtgatctattcaaagtgtcattatctactccttattttgtgaaggaggtgagtaccggatgctttccatcagccattttgaaggcgccccttcatctctttattcactgatcaggtacaaagacccttgaaaaatgaatgggttaagggcatcaacaccccacacaattgaaaaaccatacgtgatttttggctactccaaaaattaactaatatccttcccttaactagaagtcttactgataatatattcaattaacatataatcattctgtatgttacatgtattgtacaatatagttttacaacaaagcaagctagaaaaaatgttattaagaaaatcacaaggaaaagaaaacatatttattgtgtattaagtggaagtggatcatcataaagaacttcatcctcatcctctttaagtatgccaaggaggaggaagaagaacaggggttggtcttgctgtctcagtggtggtagaagcagaagaaaatccacatataagtggatgcacaaagcccaaacttgtgttttttaacagtcagctgtattttttctaaaaacgcttctcaggctatccaaacctaaataaacatgtatttattttaactactgtagaaactattgccatgcaatcatttagcaattactcatacaatgtcttatattagtttctgttttatgtgagcagctatttagatctacttttgtttaattttctgaaattatttaatagaagattttatactattggcatatagtaggcatttaaaaaatagctgacttattgcagaatcttctattttaaattttatttatattttttgattttttttttactatagaatatagtttcctgcatattcattacaaaaacatgaggtatgataaaagagcaaagtgttatatttaaaattaatccttcaaacaatgaatcaagtgtaacaatatttccctaggtcagaaactttaaaatacttaattttataagttaaaaagaatgttttggtaaatactgcaaaatacttttaaaattagagctgtatatttttaaacatctttttttcaaaaaagtaattatacatattttgagtaatgctcagtcatagcacagaatataaaacataatttttatatgacactctgatttatgagagcacaaattactttttagcattaagccagtgcaatcatgtgggtcaccttccaaatataaagaaatagggggaaaggaaagtgggcaacttagtaggctatgaataaggtctaaaagagtgtgttcttatatttatgttacaaaaataaagtgtgtcctttttgaaaacaaatcttaaatatattttcaggcagattctacatattgttctgctgcaaaaaatgttgttttaacatgtttcccctaaactgcatgacttagaactaaacataaaaatggtatttggttgctgttccaaatgttatgcaaaaaaaaaaaaaaatcaatttgatgggaaaactagacaaattagtcagtgggaattaggtttattaagaaatttcacctaatttttgttgcttttaatagttgcagttttaactgagtgtgaagaaaagttgccaagatgacatatgtcacatgtttcttcaattcatacatcctcaggcactagccaaaagccactgtatgtgtgtttttttcaaaacccacgtatgaaacaacagaaattcctttaataaataatgattgttatctactatgtatcagccaatgtgctaagcattggaaccctcaagaacgtcatgatctgcaaggaacatataagagacacaaatccagaaaaattaaaattaaaataaaaacgcatggcagtgatagcaacaggcacagtggattgtcgtcaggaaggacgtggggtcaaaagaagatttcagaaggaaataataactgaccacagttttagaaaatgggagcgagcctggaaaggagtggacaggtgtttatgcagacagagttgcacataggtagaggcatgggaagagaggaatgaccagatggtaaaatatatcctatatacagaggagcatgtaaattatcttcacagttgaaaagagttattttttaaaataaactcttctataaccattcttcaccatttttagagtaaaaaattgttgatttaaaaatgtgaggaaacacagacttctacataattgtgtactttgtttcacctaaatgcaggtgacagatagacctcagtgaggtggctttctttttaatacagaatttttatagatcagttttagataatggccacaggagtcattaagagccggaaaatggtaagaagagacaacactagcttaaagtgaatgcaaacacatactctttgagattttgccagatacgagtcaaaaataccttttgaggaagaagttctaagaaagtaaaacataagcaagaatatcttttttaaggggatatttggaagcatattgagcaagttattgccaactaaaacatatccaaagatactggatattgtccttgataaatgttctagaaacttttaggactgagaaatactagggtaagcaatgaagaaagagttggagagaaaaaatttaatggtcattttgtttgagatgagaatgaattttctcgtctgtctctctgtttctgagcacgctatgactgtatgcaagattttcctacttaacttcacagttttccttctattttattgttaacacttccattctcactaatgtggttggtaaaataagtactttaattatttgcttgcacattcaatattaaaataccatgctgtcttcagtttattatgagttcaattttcaagacactataaaaataatataacaatccattaaaagggtattctaaaatattttgtcattaggttattattttattatcttcaagtaaacaagaaatacatgagtaaccctcagcatattataaaaatgtgccaataaatttaaagaaaatttataaacataggaattctaataatttttctatatacatgaaggtgattattccaaattccattagattttctaaagtattatatattttgttatttttaaattctctataaacataattgtgaagccactttaatcaaataattagaaacaataatttgcaagcttgcaaaagaacacattacatatacatcttttaaacaattaaaatctaaagagtgattcctgataaagtaaatttagtgtaaacagaaatgcaaataaataaaactttcatttctatattcgaattgcaaaaaaatttgcaataatgaatatgctatttttcttgcttgtaaattatggtcaaaagatgtctgctgaatccatcacaatagtatcctaatttctcaactagaagaaattttagcaataaaaattaagtttagaatgataccaaagcttagattcttcaatacaaagaaaaaaaaatagtctcaaatcaatccttgttttacagatgaggaaaaattggatccaaaaatattaagtgatttgttcagttatccaggtaggaatttcaggatcaaaacaggaattgggtttgttatgtcaaatcctatgctaaagcctgtaaataagcttcttccaggtcattaagtcacctctatgaaagtatttatctcagtagttcatatgatgacgatcctttttaaatgtaatcaactaaggtagtactccctaaggatagggttaaacacagcaggttctcaggacaggctgctgataaatagacagagatctaagtgtgtagtaaggaagaacagtctatgactgagttagttaatggacgaagtataatccataggaattttttatatgcctttgaattacataatttattaacaaaacactaaacaaaacataaacctctctgaagctacaaatgtcacatgactgaaatcctggcatattttgctaaatagaatacagtaaacaatcaacactgattttgataaaatgtttcgaggtttttcaatgaaacaaattctttgaacagagtgaaaattaatttttacagattatatcaatacaaatgttacataaaacaatttcttaaaaggaataaaaactaagttctacagattatataaatacgtccaacctcttttacatggaaaacagtatgaaatttagcctattctgatatgttttcacaattttatataatctacaacttattctcctaaacttttttttaatgttagacttttaattgggctacttacaacaaagaacaaaatgttttatcatacatttttccaagtattttatataagtgtaattaagtttcatcatgcaggttcaagtcgcattgccacgattaagtggctgtgaactattgatttgacttatttaacatttcagtaacgactaatgccagtgattattgcactgtatggaagttgcaaaaaataattataatattcaacgtttattttacttgaaacttaaaactttatttaagaacatgaccagccatcttaatttaccttctaactaaatcattgtttgagttgtatatgtttggaaaatttatgtaacatttttaagccttaatatcactatttataaaattccgattacaattcttacttgcaagatccctatacatattacagattatgcatgtaaagcaactaataaagtgtttggcacccaaatcttaattcacttgcatttaatcatgctggacctatacagacctttaaacagtacagcaattataatcatattatatttttttctgaaatatatcttatttatacatatttattcagataagcaaaacataattagcagaaataaaaatcagtgtcatttattatcatttttgcattgcctctgagggcaagagatttctattagaaaactggtatctgtgatatttatggacatagctgcaggtaaagatgatgatgatgattgtgcaggaatgccatatgaattatttcaaaagtggtaataaacttatattgatccatttttacataaactgtcaacaaattcccccaaggccaggccttaacccattatatatatataatgaaagtgttaaagcttgtagcataggtcctggaagtgccctataaatgtaatcactatgcatattggatgtaatcactatgcatatgatatatatacatatatgcatatatatatgcatagtgattacatatatatatatatatgcatagtgattacatttatagggcacttccaggacctatgctacaagctttaacactttcattcataataagttacatggtctttttataacactatgataaggctattttctctacttaataaatgaaatacttaagtgcctgactgaagattacacacatagcataaccagattgcaaatatagggagtctgaatccacaaggcatacactcaaggcccctcatgctgcctgatgttgctgctgtagaaaggacacagataaatagaaagtaccatgactgactgttgtctagagttctttatctctgtattttgaaatcaacagattatctaatggattaagataacataatcattttctttcagatgaacagctgtgatcaatttagcaggtggtaactttttttccccagtgaaatgggaaaatgttagggtacattacaggtaataaggtaaattatttgataaaattttcatttcagttgcatatatgcatgtatgtatactggatcattatataaaaggtgtttcttttaggttataatccaaagaagttttgaaagctgagtttttttaaaagggtgatcagaaatttggaggaaagacagaattgtttgttcataacatgtactttcaattttgtggttatgtttcaactctttacactatttaccttcagacttctagaaaccttttctacactccaggttctttttgtggtcatctgttattctgtggtcatctatgaatgaacaagcatacaggcccatcatggggtcaaacctgtaatcctgattccatcatcactcttctctcctatcttcaatttgtcatcaatttctaaagatatattagatttgcattcttctttccagtatcaaattttcattaatttatttcagacaccatttctctttccttaatttctgttccaacttccttctttgcctccagcctatcttgtttaatccattctccttagtgctactgagggagcctcctaatccataaataggatcatgttacctccctgataatttatttacatctttctcattaagctgacaataaggtgaggctcttcatggttcagctgtaacttactccagccttatctctcagaactcatgacttaaatactacaaaatagttcatgcaaaaatctgaaattttctcagagtactttctgctccatttttctgaaaatgttctcccttttcctttcctcacacatactcctctttggccaattcctacatatcctttagtcctcatatgataagccattgctcaggaagccctcctggatcctttatttcttggttgggcatccctattagtgttctttttatttttattactgttcctataacaacactcatcatgatgtgctagaattgcatctctacgcatctgcgtccatcaccaaacagtaaattctttgagatcagtgagtatgtgttttgcacacagagtatggcatagggcctgttgtgtactacattcttataaagcatgtgtgttgaatgaatgaacgaatatattttttaacttttattttttcttcttgagacagagtctcactctatcacccaggctgatgtgcagggatgcaatcttggctcactgcagccttcgacttctgggttcaacaattctcacgcctgagcctccccagtagctgggattacaggcgtgtgccaacacgttcaactaatttatgtattaatatattttagtagagacaggctgttctcaaactcctgagctcaagagatctgcccaccttgtcctcccaaagtgctgggattacaggcatgagctactgcactcagccaaataaacaaataatttttctttttaaaatgaaatacttacttggcagagaccacctactgttacgcaatcattctatagtctttaaaatctaacactaatttcaggtatcaaaatttatatttttaaatgtttatatatttattgtcatgtgagattttatggtggtcaagttcaaagggcccaaatatctagtcgccctaataatattttcagtgtttttcaaaagcttacagattttgatcatttactaatgacactccactgctcactcaaagctacactgactagcacaaatatcctgcttctttgcttagagtgaggctgctagttggcgcattttgatgagaaattccaatcggcaggcatatgcagatttggatattttttaaaaaatgaaataagacattttaaaagtaacaggtttacagagaaaaagtttactaaaacaggtcctaaggaaaaagactttgaaaccagttacctagcaaactataaaagctaaatgccccaaattgtaatgatagccagttgcaccaaaattcaatgttattcatattttatttttcaagataaaaaagttactatgtattgccaagtttgaaactgaatgctctatctcattcctttaagccaaatctttacaagaaaaggatttctacttcaaaagaaagtgacacaatactcataattaacataaaaataagcatttgcctaatttcaggagagtacattaagtcattagtataagtggtgttttgctttgcactctctttacattattccatctctttccatctgggagcaaacttaacaagcaatttaaaaataattggtgaattaaattgtcattggtggcctcattttcctttttcgcgtatgtcttcaacagacttactctagcagtaccattaatacagctgcggtaaaaaaaatctgtgcaaatggcatgttataaaattaaatggtaacatattgtgttgcttgggatcacagtcaagtctagaggcaaaatagaaataacagatgcaatacaaatgtagagttattatgtgtgtcatactggaatctagcctcacaaaattagcacaatatgctctacctgaggataagctagggaaaagaaaaaaaaaaaaaagaaagaaagaaggaagattgtgccagcaacataaatggagacatagaaacattttaatcttaatatggtaatacgttttgaaaagaaattgtacatagattttttatttaaaatttcagaccaagagaaatgccttctatattaatatagttctccaaaatgttttttggatcatgaaatttctgacattccttttgaatttagtgaatttactagtttgaatggtcctaattaaattcttccctaaagctatttacagaggtacctcctgattttattagtcctttagtgatgctgcatgtctggtttggagagtaacttccagcaaatgaatagtatttatgcttaaaacttaaatgtgtgtgtgtaacatattgaatacgtaatttaatataatatctttaatactatgctttactaattatctaatttatgtgtgatacatcatatcatcatatagctgcctgggtttgttttgaattgtaatccaaaattaattatctcaattataataacttttatctttacattaaaaagtaaaagatcccttttcctcatcctcatagaaaaaaataagaatgttaaaaagaatcaaaactatgttttttggtgaaattactggctccatttatttgccctcccgctacttatgcttttttccatataactttgcagttccttctctaaaaattccctctacttacccgtttctgaacaaaaatatctcacttctcacagaaaaaaatgagggatttgaaaaaataatactgttaaattatataaacatatagtaagcattttcttacaactgtgagtgtaaatgatgtcacattgcatttactatccaccattcactacctcacttcaccgcctcagctaccacaactctcagaataagtacccatctccagaaaaaactcttgagtctgtttttagtgatttgatttagatgagtgttaaattatttgcctcgaaatataattatgactcactagagttgaaaataaaaattactattataatgagttctatgagctagatgaacaagtctacacaccatttgtaaagtacagtggttttgctagctagttggtagaatcacgatcaagtgatgccatcttggccagccatcagcaaactgtaatagctgatactgataattatgaataacagcaaacttgaaaataattacataattaaatacttatttgtgtaatgagctgcttttagaatctatgccagtgggtcaagtaagaagaagtaattggatcagtaggagacatttagtagttaagagacttgcttgtgcacacctaaaaactcaatggaggttaagtagcatatcactgccaaagagattctctagcactggtgggcctcagcaaaaccgtaagtggccttgtgagactgtgggactttagcacattactgcaatagactcataatcttatctaaatcaaagactctgaaaaaaagtgttatttgctacttaaaatgcaaaccattctacttcaaaatatatagaggagaaagaggacttgtcccaagataaaatgtgtcacatttgacaactatcaaccttatcagagtctaaaacttatatgaatacatgctgaaagtggatgctcttagttgtatttatccccattattaaacctaaatagagaagatcaaagccaaggactggaattttgaattattagtagctacaaatttctttcttaaagctttctggggcaagtgattgtcaacttcatagagtagaaaatcaaattaaaatggaataaatattattattctgaagacaagtgttccttttttcatagaaacattaaaagtatttgctaagtatgataaaacacgtatttctagaaaacagcagatataagacagtgattttcatttttttctatcgacagtataaacattagtatagaagtatgagagcccgtattgctgatgtttggagactaacattccttgcaaagagatgtctatgtcctttccaactctaataatctgtgattctataatttgatattaagcgaagattttagtaacacctaatttctgaattgaaaagaatttttaaaattctcacccacttactcaatacttgattttcttctatatgaatagcacagtcatatagttcatgcttgagccaaatttatattagcctaaatacatttttgatgaaatatttttgtttcacaaaaattcttatattacaaaattttctctaatatatatatgcttactgcattttaaatcggtctggcgctactggaaattgcttcatattaaattataagaaatttaataatcaataataagtatttggctgggttaaccatatttcttacataacaaatgctgataaatatatgtgtgtgtgtgtgtttgtgtacatactcttgtcaaattctaattaacaaaaatgtttaaaatatgttgataaatgcaaataaacattcacaatattattatgatttcatacatgttttgcatcaaaaatggcaacttgctattatattaatagctacattttaattggggtctcactaatctagaggctactctaatagcttccatgtattgaatgcttcctttgtctggaaagatagacttttatatgttaacattggtaatttctgggtgatgggactgcacatcattttatcttgtaattcttgattttgatatttctacaatgaacaaacattaaaaacacgattttaagatgttataaaatatatattatcctatttctcttttatttttatttttcaatagtttttaatttttatacaagctttggtcagtgagtaatggtacttccacagagtacataagatttcaatgtccaaagcaagtcagtctgtattgcatatattcagagctccatcaagtaaaattcaatgttaatacagaggtaagtgttaacagagaggaacaatgaaaaatcctatttaggacctgacttcaaatctcataagggatcagaaataccactgtactgctgaaagtgttttcctaggaaaaacagttttcatagcatagctcgctgagaactaactgatttttggcaattagatcacccatttttgagttaaaaaaagataacaattgaatatcatttgaacttctaatacctattaagaaaaaagttatttaaaaatgtttggaatttttggttggaaatctatgcagttttgaaattaaaatatcgattgtgagaatagtctcattcaaagttgaaatacactcttcagtaacaaaataatactgaaaagggtgagtgcaatgacaagaacatcatatgaacagatattatattctggaaaaagtataaaagcagattcaagtgatagagattgatatcccaattaaattaaaagaatgcccagaaaatcagcataattttcaataaaaatgatactttattatgagtaggtaagtagagagtgtatttatttagatgctccccactggtgtccttgtgaaaatggatgtcaattgtgtcaataataagcaatgctacttgcacctcaatttctcagaaggtgttcaggaaaagaaggtaccaggtaccttagcaggcaatgggaatgaggttgggatatttgaaaaataaaaaagggaaagattaactgaaacacttgtaaggagatttagatctccaaaattcttctttaactcacaatcaattgacttcagatttgcctatgcccatatatcacccctcacacatcaagattagaagcaagcacatatagcagtggcgaggtagtgaatagaacaaagtagccatttgtagcccagaatcagaaatgtaggaagtgatccagagaatagagcttgcatactgactgcagggggactatgcaaggagtaaaatattaatttctaggcaggtaccagaatctaaacaatgataagcaggtatatatctaccagctatcagaaacaaacatggcagagattcaaagtagagagtcaggcagactaataaaagataacagtagtcaaacagtatagaaacaatgtaatgatcacaaatgattctgtttctgccatccttcttctaaaattctatatgtgacagaaagtctaaaatgaaacaaaataatatggaaattataattaaaaattattcttgactgagttacagtcaacatgaacatagggatatggacaacagcaacattagaggggtcatatttgcagggtctttctggagtcaagtgaatttggaattacaacatggtatgtgtttaatgctcagcaattatgttatgagcaaacaacaagttatattggtgtgggattttgagcaaaattgctttatttattttatttattttatgaagggagaggaccaaattttaaatttcagttgaggctttccatttgcagaaatggtagattttcattttaggaatcttccattagataatgtcagctcctaatacttctcattctcttgtaatttctttttttattaaattgagattctcagtgaggtcatagtgtaatggagaaaaaataggtctgcgagaaaattgtgatgtctttaccaacagaaggtgataggatcgcaggtgataaaaacaaatgaaataaaagaaacagaaaacctaaagaaatcaatcctatactttgtccactccattttttttctcctttatttcttccactttttcttttgaaaggtacccttttagttccaaaaatgtagagaagagtatattcattattttagtttttgttttctttcaattgctttaaaatatttttctatttgatcctaacattcaccctatcaaaaagatattttgaatgttttgacaaataagggtgatgatgttcagatttcagtgatgcacttagtaattagcagagcctgtatccaaacttgagtttgacacatttttaatacctatgctattccttacaagctatgttaggttatagatgatttttcccactgtccaaaactaattttttatgtccttcataatcttcagaaatgtgttttgccactttaaggaggaaaaattgtctgtaaaatccaaaacagcaattttgctgttgcaatggaacccaacgagtgatgccagcccactgaattgaacagaaagacagtgatgattctttgtgaagagaaaaaatatacatacacctctataatgtgaacagagcataataagtggcatttttgcaatttggctgcttgacatcctgtgtgaagttctgaatatcctttttttgagcataaagcaaggacatggctttttttccccttcatgcactcaagggactcactcaaacacctaataatgctgttcaacctttaatacattcataatggaattccccagttagcgtgttttcacttgcctgggtagaggcaccagctacaacctcttcaaatacttaaaagaaaatactgttcacattaattgtaagaatcttcaaaagaatgctagaatacctcaaatggaaaattcacaagtagtagcagacaagaagacatagagcataggagtgaatagtagctataaatcagatacaagccacattaatgaattgagataagaagtgtgaaataaaatcgatccccgctcatcagagaaggaggagagggttatttttaatcttgggatgaatttaaaatcaataaaaaagtataatagtctcataaacagaaatcgaacgacaatgcaaggagttggaaaaaaattaaaaacaaagggaaaaaagtacaccaatttacttcaacagttacaagaagccttgtttgatagtgttaactgtattcataatgaacatgtgtatagagccttttaaaacatcccatcaagcactgcacagctgaatgtgaccactcaaataatatttggtgaacataaagaagaatgcccataaataataatcttccaagtcaaacatcttagatctaaaagttaaggctacaggaagagtgagaactctttgtgtgaagacactcataattaacaatatataagcaactacataaggctgaaataggcagggattgtgaaattccacaatatgagaacacttattttcttcttttcctctcataaattttgttcagaataccaatttggggaatcaagcagaagtaatccctgctaatagtgctgacactatgtcaaaagttttgagcaataaaaaaaaatctccgactttctatataccagaaactttcattttaccctagaaaatcaaaggacccctttaactaaaaatgtgtttctagaaaagtgttccaaaatacgtcatatggggatctagctcctcagccaagcaattgagcctcttttccttttgtaagcagcatatcaaagtaaggccaaagttggatactaagaaaagaatggagttacttatatttaatatttaggatacaaaataagagcaaagtataattgcataatgcttgctacatttcaaatttgtctccttctggaaggaccttcatctctgctccctgaaagccaaaaacaacaggctactatttttgtttttcatgaagctagatattagccagttgctagacttcaactgtgatatattcatgagaagacacaagctggagaatttcagcctagtctaagcaggacagatggagttgctttttacctttatacagatcacgagtttttagccatttatttttcaaaagtctagccttcagcagggagcatccatatgcgtgtgtgcaattcacattgagttctgaaacaagacttctggtttatccataaatctggcaaaataaattctcgaggcatagcctggcaacaaagaacttgaataaattctttaaagctcttttgtagtgaaataatattagaagttggggcaaagacaaagccatgagaggtgttgatctctaacagttttatgaaaagatgtttaagtaacttttcagtggcatcaatttaaaaatctagtcaatgatgtaacgttgaggatggagtttgctgacttttatcttccatgagcagtcagactaaccaggtgttagtaatttgaatctaagcaataaagactgtgaagccacattgatatagttaccataaatgggaatcagtgagtcccaccagcgtcacagagaacaattcagtcagtagcttgggcagggccctgctagtcattaacaactccattaagctaagacagaaactggaagcattgcccagagaggtaatcagaagcactatgctcccaagactttccttaacaggtgctcattttcatcctggtaagatttagaactaagcatatacatatttaagagaatcatattagagtatggatatttgaaatctatcaatatttactattttatattcttaaaatatttcagataatttgcctttttgaatcacatttgtacttatgatgtataattaagtaatttacatacagttatattaaacttagatctattaatttcacatagtagaggctactagttattcccaaatatgttcattcttcctttctttcttcctttcccttccttccttcctttcttttctttctttctttttaaaatactgctccttcctgtacactgattttttttcctttcttgttagcagtaaaaatcttgattttttttgtaagtctaaaagactgtaaaaccttccattctctgctcagttatttgtgatgttaggactgagttctaactacttaaatgtatttatagtgctatataaaacttccagaaagcatctttgggggaacaggggcttgcccttttcttcttctctccattctctttcttgggactctactttaatgattccagtttaagcagccattatagaccatgagattaaggattagaccgtggccatggaataatgttgatctgggaggaaggtgagttaatgaggtcttcagagagctgcagtactagctgctggtttcatatatctagacttctttcataaaacgcaaactgccattcatacttgtcattattatatatttgggaggttctatatttcaagaagctaagccatataataaatagtttgtatttaaaaagtcagagtattttaaaaggatatatgcataatggaatactattcagccataaaaaggaaggaaatgatttctttgcagcaacatggaaggaactacaggccataatcttaagtgaaacaactaaaacacagaaagacaaatatcacatgttttcacttaaaaatgggagctaaataatgtgtacacatggacgtaaagtgtggaatgattgaaaatggagactcagaagggtgaagaatgggattggggttcaccatgggaaattaattaatgtatacaagtgtgtgttattctggtgacggatacactaaaagccctgacttcaccactacccaatgtgttcatgtagcaaaattacactgttgtcacataaatttatacaaataaaaataaatcactaaaattacaacttttcccttattagctttatgaggtttatttaagtactcatgagtggtgtctttcagtcaaaataactacaaaggaaattttctatctagatttatataactgatataaaatatctctatagatctatccgtacatcaatatctatcaattacttctaaaggttattaactatacagttttctaaaaggatccacacattaatcaagtccccttctcctcttaaagtcatagtcaaaagttgttagaagttgctataaatataagtaaataatatggttttgtaggctaaacccagatagtaaaggaactaaactaatattgtaatgtcctagcctttcattttaaacaaacaataaaaatgcatatatacacaaaactgttttcttatgcaaaatgctgataagcattttttctaaaataaatcaaggtcacgtgatcaaagtgaagcttttgacaaattagactagtttgataacctgggttttaaagaaactgtatcctttttccttgattttagaagagaacagcaaaagataattataaattttattttaaaatataatgtgtatttttctcactaaaagacgagttaatatgaaattcctaaacttttcatactgttttactattgagctaacattactttcacatataagtaaaataaatttaaaactatgttttcaatcaaattagattataattttaagaaacatttttatagtaatggaatatagttttgaacttatattaaacccaaattaattggatacttggattatttttaactaaagtagaatattaaaatattggttaccagcgtaattttgacatacattcctttgattcttatttttacatgttatagagtagcaataacttagggccgtgtttgaaaatgtcttaatgtttgcctttttaaggtatggtaaaaaaaaaaatgtgtatggccgtcagatatcatactatatgtattcattagcatagctgtagtgttagacaaatctaaaccccatttcactccatgatgtagaagttaaatactaaaaattatgttaatatgggtaatttaaaatatactagaatcagtactggcagataagaagaattgtgtatgaaaagaaagataatgcacttttgtttattaagggaaaatgagagcagttttatcctaaagtgaagtatcagttattttcagatgtgaaatagaatagtaaatgataaaacctaagcaaatacaggaagtcatagtttttggaaacgagaatttaattatcttagattataatatcaaaaaataaggaatctcaaaaaatgtagtagaatatgttaaaattttcccaagagtaggttagttttcatggttggtcagttaatactgaaagcataaagaagcttgtgaatcttttactgccaaatattaacagcgcaaaattagactatttctattgaaataataaattaatcttgaattacttagtctgattttaacaatatataataattattttccttccatgtaaccttctgacatgaatggctcaccagagttgtttcctgtgtgttgtgctgaatttattatgccctggatcaatcaattctgaaggagctaagataccattaaattgggttaatactttctgtttatttaaaatattgtattttcccttgattaacttgtattcaagccatgaccttttattgttctcaaatactgatattaatattctaatcaagtgaatagatccctctgataactcttgacattttcttctcaaaattaattcctaaatttagaaaaatacaatttagtgtgccttttatacctaatactatcttcgtgatatctcagatgatcacagaaaaatcacaaatgtttgtcttttactctataaaaaagagtaatgctgaaaataattatagttgttggatatgctcctcatttcttacatagctcaacactatgatgagagctacaagaggagttgttaaacaaaagccttctctaagatagttttgttcaggaaaaacatatattgataattctctggagtgtagagtctctgaaatacatacatcatacacacatacaggcatacattagagagaagagagagatgtacatatacatattctggagactacattctggagatttataaatatccttatacttatttttaacctcagaacataattactaaatacccttatgactaaatatatattataccttaatagatcttactattctttatccttatgtgttggtcctctaataaatttgccatagccatttaattctgtctttgccaggttaagatttgcttgcttgcttgcttgcttgcttgatttcaactgtcctgtcttcaatttcaaatgaggaaaataatatccacaagtgcacctaggtaaaatgtttagttcaataactggcatgtgatcagaattaaattataaatctgatcctaaaatgaaaactcaaaatgagaaagcattaggattatatttctgcttctctgacatgaacactttataattaattgaagagaaatgttgagtggctaacagccagaggaacaagcatggctgtcaatgcatcttgactttctaattcctcatacaggaactttaaaagttagcatatggctgagcatggtggctcatgcctataatcccagcactttgggaggctgaggcgggcgaatcacgaggtcaggagatcgagaccatcctggctaacacggtgaaactctgtctctattaaaaacacaaaaaattagatgggcgtggtggcgggtgcctgtagtcccaactactcgggaggctgaggcaggagaatggcatgaacccgggaggcagagcttgcagtgagctgagatcacgccactgcactccagcctgggtgacagagcaagactatgtctcaaaaataaataaataaataataaataactaataaataaataaataatgtctcaaaaataaataattttttaataaaaaaatttttaaaaaagttatcatatgatatgtcctcaagtttatgttgaaaatgtaaatcacaggtttttaaactttgccacgtaacagaatcagctgtataactttaaaaacacacatatgccatcccacccgatccgctgaatcagaatgtctgaagtagagtattttacaaatcttcatcaaaaatatcaatgactagtaaaagtcaaaatactgatcatattaactgaatatttcatatgtagggctttttgtcaatttactattttttacctgaaataaatgattttgtgaagatataaaattaggagagaccattttacataggtgtattccaaaaatatcacctttccttaagtcagatactgaagtaatgctccaaaacccaacaattacatgttactccagatgcattagctttaatggcattgggtggtggtttaatttttagcccaccctggccagggatatttccttagtgacagcagtatggtctgcagcaaatgtgaactttaggaaatgcactaacgtataagggaaaggcagctatcagcattcagtcttctctgaaggtaagtatagcaaattaagagagatgtagtagaaatgcagtagcagttaagggatcaattcaaagttatcagaaaagggtatcttgtaggacaagttcaaagctgaagattgaattttaaatgttattgtgtgttacatgcaagtctcttctcatattttaaatttcttaacaaaatccactaacaaagtattatccctatgatgtctcaaaaaaaaaaagaaagaaaagttaaaaaaaaaaaagaaatgaaactccaagaaatatgatcaaattcacacagttaacaactggaaaattctgaatgtaaagatagctttttcaagtatctaagttctttcttcaacagtccacatagttttaagaaaccaaaactacattaccttgtaacttcccaggttaggtttatagagtagatgattagaaagtaataagttcttaagaggttaagaagagaaatttaacttattcctttgatattgctagggaagaaataaagaaagcagtggggacaatttcttgtagttggaaccccttatatcattttttatttttcatttttaagagcaatacagagaagattcatcaatctatgttcaggtagtaattgctttttactactttaagctcatctgtaaaaatcaaagtgaaactgactaggttttacgatattttctgaaaagtcaaaattctggtctttgctatcccttttaggaatatatggtaaaagtttccctatttgctcattactgattcatctgcataatgaagagttaaaatcttattgagaaatgccttgcaatcagttgagaatctaattgtacctgtttggaaaggttagttacaaaagcacccacggtgatccaaacttatattacacatcctctgattatcacatttaaagtaatatgtcatttgttattcatatttagtgttacaactctttaataaccactcaatctatttccctttaaaaggacagctgcaataacagcaaaattgtaaaccttaagtgtagcgtaagaattcaaggtgaaacacattccaagtagtagcttaaaatgtcagtatcatacatggctccctgaataaaagaggcaagacgtgtcaacctgaacagacattcatctctttgcactaaagtgagagatacaaagacctgtaccactcccagtagagagatgtgctgagacattcaagagtcaaagacgctcagctgtctgaggcaaatactgtgagtcttcaggtctctgtaaattgttctacagctgtgaaggattcaaagtaaaatttcagaatgatcataaatgaataaaatgtggtggattatagtagttactgtctttggctgtccgtaatttattatgttgctacttcttgtaactgtacagtagttctcctttattcaagtgcttgctttccatggtttcagttgcctacactcaactgtgttccaaaattattaaatggataattctagaaataaacaagtcataagtttcaaattgtgtgccattctgagtagcatgataaaatctgttacacctctccattccttttttatcacaagaataaggatgagtacagtactataaggtattttaagagacagactacattcacataacttttattacagtgtattgttataactgttcaatcttattattagggttgttaatctcttactgcctttaatttataaattaaactttatcccagtgtactagtctgttttcatgctgctgataaagacatacctgagactgggcgattcacaaaagacagaagtttaatggacttacagttccacatggctggagaggcctcacaataatggtggaaggcaaggaggagcaagacatgtcttacatagatggcagcaggcaaagagagagaatttgtgcagagaactcctctttataaaaccatcaaattttgtgagacttattcactgtcactagaacagcaccagaaagacttgccctcatgattcaattacctcccactgggtccctccctcaatacatgggaattcaagatgagatttaggtgggaacacagtcaaccatatcacacagttatataagtataggaaaaatgtagtataaatagggttcagtattatccatggtcttaggcatccactgggggtcttgggatatattgtctgtggataagaggggactaatgtattttcatttctctgggggtgggggcaaacaaaactcatagaatggatagattatggtgcctcctacacctacccaaccaagtgaaaccagcattttacatcagagtaccttattttcactgaacacagatattggcatattgtatcctgtcacccctgcatagaattttctaaattagaagagatggatacatctattttgctctttgattgtgaactttaaagtgtatgtttggagagaaccactctaaagagaaaacatctagagtgggagatgacaatcttaaacttcacccaaatccagtgaccctgaaaaaaaaaatgaaggttaagaaactcccccacccgactgtaaactagttcagccattgtggaagtcagtgtggcgattcctcagggatctagaactagaaataccatttgacccagccatcccattactgggtatatagcaaaggactagaaatcatgctgctacaaagacacatgcacacgtatttttattgcggcactattcacaatagcaaagatttggaaccaatccaaatatccaacaatgatagactggattaagaaaatgtggcacatatacaccatggaatactatacagccataaaaaatgatgagttcatgtcctttgtagggacatggatgaaatcggaaatcatcattctcagtaaactatcgcaaggacaaaaaaccaaacactgcatgttctcactcataggtgggaattgaacaatgagaacacatggacacaggaaggggaacatcacactctggggattgttgtggggtagggggaggggggagggatagcattaggagatatacctaatgctaaatgacgagttaatgggtgcagcacaccagcatggcacatgtatacatatgtaactaacctgcacattgtgcacatgtaccctaaaagtataataataaaataataataataaaaagaaactcccccacccttttgtattccagagaatggcttactgcaaagaatcaccctttcccatacaacttagataagacccacagatggatcccttttttatctatgaaaagatcagacacagatcctccaaattcacattgttgcctcataaatgattggctaaactgttttttctccactgattaactggaacaaaatagattttaaccaatttcggttaagtttctctctttctgccacatctctaaactttgacccatcttcagcctgaatcagtgtagcaattctccggagattaggtaggccgcagagtaaaactttctctgctctatgatgcagccaatcatgccaccctttcatgccacatataaccttacctacttctccctagaaaagacataccctttttgcctaacccttgtgaggctggcagatattatggtcatagtttttttctctattttaatagtccctttcttcacctcacaataattcttttgaatagggtctctctttgctaaatccagattcctctttttgactttgaaaatgaaggccacagccaaggaaagtcagaggcaaggaaggacaagaagtaaaagaggatgtcttggtggggttgaatccattgctcaattctggaggccctactttatgcagccctacagttgtctaacccacaacctttgactttagcatggagttcatgctctgatagctttcaactaaagcagccattctctcctctccccagctcttttctttctctgttgatacagataatattttgtatttgagggtctgaaacttttcaaaattcaaatgtcatggattgaaactactgtccttgcacagagtgtgagaatcaggtggtgtggggggaagtgctaataatggtctatgatccccagaaagcaacctatgttctaatgtaatttctacattcatattaaaatttagagatgattttatgttaataactcatctgcaaaagtgcaaatatatgtggctatatataatgtatatgaagcagtatgataaagtaaggagatatgtctcatgtagcaatgcaaatttgagtttaaatccctgttgtgtaatttttttctaaatagcttctgcatctataaaagaaaatatatctcctttattaagagattgttgtgataactacatgagataatactgacacgttttacatagaactcgatccataataagtactgaataaacaatatttgctactaccatttacattctaagtttaagagtagcattcagaaataagagaggatataatttccttgagaagaatgcccttgataatctctggtccttccatagagataataaaagttagagaaaggacaaatggggagcttttcttttttattcatctcatatttaaactttgtaatcacctttggattctctcttattaaccacctctaacttatcttcccccatccatgcaatatttactggatctatttcaggtctgtgtccaaaactttagttttctactctttgagttcaatgtcacattacttgtctctcaaatggatttcacaatagtctcctatttggtccttttcaagtcagattttgctttcacacactccactgaatgtgctctcttcttaataaaaaatctacaagcattcctctattactttaaaatcatttcagaaatcttaagaataggactctgtttcagataagggtaaaattctggacttcaagtaaaacatgaaaactagattaaatttcaggttattgtttctcacaggggaaatatgatgggaggattgtgctttacatatccttggaaagatgtttgccttgggatgttttttacccaaaacggtgactatagttatgttacctgcgactcaatatgcattcttcttttcttcttcactagtattacttcagtttggtcaggggctggcaattttttcaatttaaaatttcatttcctagatttacatttccatgaaactaagtttccaagtggaaacttccagtttcctggagaggaagtcctttggagagagttttgttttctttatgtagacaccaccactctttccttcttgctgcttccaccttcctcataatgtctgaaattaaggtctggggttttgagatacaggaactattttgcaaccatgaaacaagtcacacattgaagatggcacagttgaaagagagaagctgatactaggacatttgtgatagcatcaagccactgcatcacccagagctgcccactccagagttcattcaactatacaaaacaaacctttatttgataaagctaccatctctgaaggttttcttttcatgcattttatctgaataccaattgtgataggatgcccaaatagttttcaccttttctccaacatttatactaagctcaactctgaacactgcgatgatagaaatttaaaacttgagagagcttatctcagcctctcaatacttcccttattttaaaagttttaatggaaaaatttcaaacatatatttaaaaatagtaaatactatgaaatgcagtcacttatccattgcccaaactcaagattatcagcttacgaccacccttgttgtatccataactttacccgttctgtattattgtacatagagagggtaatgtatgcctaaacacattatcacattaccaaggaacacttattaacccacgcctcactgcagtgcactctcctgcagtcccctggcactggaccatagtgcttttgttggcagcacttgtgggagtgttactgccagtggacttggaatatcttggcctttccagcacatcaagcaattgacctcaaggggccagagaacaaagccacatcctggtccaagccatccagggttagagcaggaagcccaggagtgctgagcttagctttagtcccctgaaagcataaagaaagaaagccaattgactaaacccaatttgtaccacaggaaaaaaaaaaaaaccctcaagggcaccaaacaatataaaagcacaaatccccatccaaaggaaagaaacttcaaagattaaaagaacattagcccccacagctgagaaagaaccagcacaagaattctggtgactataaaacccagagtgtctttttacttctaaatgactgcactaactccccagcaatggttctcatgcagattgaaatggctaaaatgacagacatagaatttggaatctcgatgacatgtaacctcaggaagatacaggagaaggttgaaaccaaatccaaagaaagcagcaaaacaatccaatatttgaaagatggtacagctattttaagacagaaccaaactgaacctctggaaataaaaagttcactacagcaatttcagaatatgattggaaacaataataaagcattaataatagaatggaccaagctgaggaaagaacctccagggcttgaagactgtaccttctaattaatgcaggccgaaaaaaataaagaaaaaataattaagaaaatgaacaaaacttttgataaatatgagattatgtaaagagaccaagtctatgactcattggcattcctgaaagagttggagggagagcaaaaaatttggaaaatatatttgagaatattgtctatgaaaatttctccaacttgctagagggggtgacatgacaatttaggaaactcagagaaccccagacagagaatatataagatgactatcgccaagatatatagtcatcagattcttctaggttaacatgaaagaaaaaaaatattaaaggaagctatacagaggggaaggcaacataaaaagggaacccaattaggctaacagtggacatttcagcagaaactttacaggccagaacaaactgaggtcctatatacagcatacttaaagaaaagaaattccatctaaaaatttcatatccagccaaactaagcttcataagtgaaggatgaataaaatctttttcaaataaacaaatgttaagggaaattgtaaccaccagacctgccttacaaaaggtccatcagggagtggcaaacatgtaaagaaaagaatacctgctaatacaagaatgcacataagtacatactgcactgacactacaaaggaactatacaattcactctacattaataaacagctaacaacactgtgatgacataaaaccctcacatatcaatattgaccttggatgtaaatgggctaaacacagaatggcaagttggataaagaagcaagacctaatggtatgctatcttcaacagaaccatctaacatgcaatgaaacccataggctctaagtaaaggaatgaagaaatatctatcaaggaaatgaaaaacagaagaggcaaagggtcctattcttattacagacagaacagtctttaaacctacaattattaaaaaaaagatgaagaagtacattacataatgataaaagattcaattcagcaagaagacttaactatctgtaatagtctgttcttgcactgctataaagaaatacctgaaactgggtaatttataaagaaaagaggtttaattggctcatggttccacaggctatacaggaagcacggctgggagggcccaggaaactttcaatcatgatggaaggggaagtaggcacttcctcacatggccagaggaggagagagagtgaaggggtaagtactacacacttttaaacaaccagatctcatgagaacttactcactatcactagaacagcaagggagaaatccgctcccatgatccaatcaccttccaccaggcccctcctccaatattggggattacaattcaacatgaaatttgggtggggacaagaatccaaaccatatcactattctaagtatgtaagcagccaacaatggagcatctagattaataaaacaagtacttagaaacctctgaagagacttagataaacatacaatgataataggagacttcaataccccaatgacagtattagacagatcactgaggtagaaaactagcaaagatatttgggttctagagtcaacacttgaccaaatgcacctaacagacatctacagaacactccacacaataacaatggaaaatgcatccttctcatctgaacacagaatgtactctaagatcaaccacatgctcagctataaagcaattctcaacaaattcaaaaaaagcaaaattataccaactgccctctcagacaatagtgcaacaaaaatagaaatcaataccaagaacatctcttaaaaccataaaactatatggaaattaaacaacttgctcctgaatgacctttgaataaacaataaaatttaggcagaaataaaaaaaattatttgaaactaaggaaaacaaagatacaatatgccagaatctctgggacacagctaaagcattgttaagaggaaggttcataggactacatgcatcaatcaataagttagaaagatctcaaattaactatctagcattacaccaagaggaagtaggaaaaaaagatcaaaccaacctgaaagctagcagaagtaaagaaataaccaaattagagctgaccagaatgacattgagatgtgaaaattcacacaaaagaaaaactacggaaagcagtttggtgatttctcaaagaacttagaactaacatttgacccagaaatcccattactgggtatacacacaaagcaacataaatctttctaccaaaaagacacatgcgcacatatgttcattgcagcagtattcactacagcaaagaaatggaatcagcccagatgcccaacaccagtgcactggataaagaaaagatgatacatatacagcatggaatactatgcagccattaaagaaaaacaaaacaacattctttgcaacaacattaaagcagttggaggtcattatattaagcaaataaccacagaaacagaaaatcaaataccacatgttttcacttataagtgggagctaaacattgagttcacaaggacacaaagatgggaacaataaaaacaagggcctacttgaagggggagggaggagggcaaaggtcaaataactatctattgggtactgcactcactaccttggtgacaaggttatttgttcaccaaaccacagtgacatgcaatttacccatgtaataaacctgtacatgtatcccatgaacctaaaagttgagaatagaaaaaaacaaaaacatattaacccccaaatgatttactgtcacttaggagaggacaggggtctaggatatgatgattcaccaaaggttccatagtcaggcccggtggttcacaggtgtaaccccagcactttgggaggctgaggtgagcagatcacttgaggtcaggagttcaagaccagcctggccaatgtggtgaaaccctgtctctactgaaaatacaaaaattagctgggtatggtggtgcacgcctgtaattccagccattcaggaagatgaggcagaagaatcacttgaacccaggcaagagaggttgctgagatcatgccactgcactccagcctgggcaacagaagtgagactccatctcacttggaaccaactcaaatgcccatcaatgatagactggataaagaaaatgtggcacatatacaccatggaatactatgcggccataaaaaagaatgagttcatgtcctttgcagggacatagatgaagctggaaaccatcattctcaggaaactaacacaggaacagaaaaccaaacaccacatgttctcactcataagtgggagctgaacgatgagaatacatggacacagggaggggaacatcacacaatggggcctgtcagggggtgggaggcaagggaagggatagcattaggagaaatacctaatgtagatgagttgatggtacagcaaactaccatggcgcatgtatacctatgtaacaaatttgcatgttctgcacatgtatcccagaaattaaagtataataataaaaaaaaaaaaggttccacaaggtacaagcaagggtgatcataatggaacactttcacgttggatatccaaaggtataggaataaaaaagatttgagaatattgggaaataaaaaaaagatgatattcagaacagactaaattatctctctaatttggcataaacagtctgcaaaacaagggtgttttgttaattcacaacttgtaaaataaacaccacattattccatctaaagtgataattgatttccacagtgttaaaccaacaactttgaaaagaatttcatagtccagtctgatgccagaatccttatgcttctttctactttttgatcagtgtatattttgtaaacatacacaatgacaaatgacagcaaagatcactattttacattctcccttctactcttctacttctccatttttaatttgttctttaatatgaagttcttaaactcattatttaaagatatccaatgctatgaaaatttgatgtgtataattctccatgattatacatataaaagtatataattatatatgatttgttttatttgatttttaaataagtaatattctatacatattagtctatggcttggtttttaatgtgttatgataattcccccaagggtaagaaaatacttgtattttccaatttttgcatgcatgcatgcatatccatctgtaattataaatgaatcagtgtaaataacacatgctagattgctcttcttaatataatatgttagctgttcttttttccttcttttctcctgtttttccttttcctcctccttctcctcccctttcctctcttcctcctctgtctttatcttctttgatcagaccactcccttcttctggctaacaagtgtggaatgagaatgcttaaattcaaacatttggtcaagcagatatgttgcctagagcaagataacatttcctcacttgtaaaatgaggataagcataggccctacatttgaggttttggtattagaatatatattcatatacaaaaatgtttaatataatgcttggcacataaagagactataatcagtgtaagcagttattaactaccctgcttatctttccagccattctatttatatttttcacttgtttcgcagtgtttcagttataacagccttttctctcttccttaaataggccaaactttctcttgccttagggcttttgcactggttgtttcacccttaggtattttactatgaacttacttacgcatctttttctgcttctttttgccctctaaagtactatatataagttctataaaagttggaatctggtttgttgtgttctacactgtgtctctacagcctaatatcatgcatgacacagagtttatggtttaacatgtacttgttggatgactgtaaaattccatttgatatttagtatcagagtaacccataaagataggtattatttcctcaattttataaataataaaagtacaacaatgaggcttaatgctttattgatagttaagctgttgaattgggcttgaatgcagtttccttttctgtgtgttgtattctttccactgtttcctatgtgttatgcatttttaaaatacacagaaaattagctttatgagattgtaaatctcttcgaatcatgcattttactgtctctatgtaaaaattataagctcacaataagtacataatatgcattttttattactaatgattttcttcccttcatgggtttatgctttttctaaatgtaaaatatttgtctaatacatatatgtaaaatacatagtatgtgtaaaatatccttttctaagcttgctataaaatcttacttgtttatttaggtgttgatagttaaaattaatttggcaataggtatgcaggggatgtctctgaaacccttggaagacattgatggtttctgaacttcaactggtgtagcagattgaaggcaaatcccaggccaaatatacatatatatgtgtgtgtgtgtgtgtgtgtgtgtgtgtgtgtgtgtgtgattatatatatttatatataatatataaaatattatataatatatacatgttttatattatatatatataaggcataagacaacacagagagaatatgtttaatacgacagcaatttagaagtaggaaacagtcattgcttgtgaaataagggaggctatggtagttgctgtgctgagcaataatgaccaagtgaacataagtgggatattgcagccagaaataggaacaaaaacagaatagatagaatatttaaaaaaaaaacttgaaagctactgcttagaatgggcttgactcacatagctgtactgaggtgaaactaaaccaagagatctttggaaattttctcccgagacatacaagaatttacctagcaatatacagtatgcaccctttaaatcatcaggctggcaaaatcatggtttgtgtaatacttgacattgaaagttaaccccttcttttatttataattagagacaaatgaagaactatgtagaatgtgaggcaacaagaggtgtttagattgttctttcaacacttaaagacctggaatgtctggtcctttttctccacttttactgtaataaaggcagtccaaattctcatcatttaacccctgaatgaaaacaggatcccaacaacttgttcccctgatgcctgaggccaatgcacagtgtccggaattttcctcttaaatgtgaactgaccgtggtggtccaatcctaaaatctcacttcaggctcctagtgaagaactgttagttcttagctaacatcacgtttctcttggacagctcacatattcatagttgtcttctaatcttaaaatacacataaattcactcagcaagcttgtaaaaatgtacatatttggacctcaaattcaaagattctaattccatatttcttggatgtgacttggcaatttacttctaaacacatgctccagcaagtgaaataaatgactatataggcatgaagaactacttagatgccctaaacaccctgctattttacaactatttgccaagaacatcttccctgccaacttggtctttttgtcttggaaaattgctacaaattcctcacaaccctgttcaggtattgttcaggtactgatcacttctccaagctttccattattcctccttccctccactagatggttaatagattccttctctatatcaattctgtgccttgcagatacttattttactgcctattttatattttggctttattgtcatcttcacaaataaagcgtaacctcttgaagggttgaaaattacttttggtattagtggttagcaaactacttggcacatgttaatgaagaattaataattgctgaatttagcatttttacactgaccctaagagtaaggaccaagttctggttctatcacttttgttcagctaattatatgtagagatacagatatacatatacatatatacatatataaatttgaacacagggttctcctaacacacatcttaataggtacagaggagaaagatcttggatgtttgaaaaggtagagttgccattttctctctgtactctctctgtacatgatttttggattgagaatatatctagaatgtcaccaacaataaataaactatgctgggaaaatcatttataatagacagatttataatgtcaattattaacatactgcagactttttcaaataggggagttcacttggaaatttaaaaaatgccagctggtcggttctgagatcacagaaatgaagattcctttgcaataaaaagaatcactttgtttttttgtttttttcctaaatctccacttctgcttatagtgactgtacccaaatcaaggagttataaatattaatctggtaacttcaaattgagaattcatagccactaaaatgggttgccttaagaaaaatcttttttccatcatccaaggtcatatgcctcttatcaaaggaactacacatatattacaaagttattttcagtttttctcatgaatttctatgtatacacaggtctctgtatgtagctaataacatacttagggcaaaatgaaagaaaggaaggcaatatttcccatgctcctaagttaaaaaccctatttgtctgtgtgtaatatggaaatatttacatattatctgtacagatttgatcatatgccaaaacatgtcccccttcaagttctatctgctttggacatccaaatacaattcaaataactttcaacagttttacatgtaatgaattctcagcaaattaacacaagaaaataaaaccaaacaccgcatgttctcactcataagtgggagttgaacaatgagaacacatggaaacagggaggggaacatcacacactggggcctgtcggggggtcgggggctagggaagggataccgttaggagaaatacctaatgtagatgacgggtcgatgggagcagcaaaccaccatagcacgtgtatacctgtgcaacaaaactgcacgttctgcacgtgtaccccagaacttaaagtataataatgaaaaaaagaccaaagacgttttgtgtgtttaaattattcttaaagctgtataaaattagcttgtgaaagttgatctaactaagatacaacaaataaaatgatcagtgatatggtagatctctcttcctatagagtagcgatattatttaacatgatcattgtttagttataacaattacttaaaaagaaaattttgactcccatttggtataatttttctggaattcggtattaaagtgtaactcatattgttagatatttttcaccttgcattgtccatcacagtatctactgtatcaaatgcacagttcatgaatcagatcagctcttttatatatctgatatatcatagtttattaaacttgaaatttttgcgtggaaaatatcacatctgagccacttggaactttggagtatagtgaaactccaacacactgattttttttctcaatccaaataaagcatattggaaatatgtatacttgcttaaaaatcgtttctatatagtcagtatttaggtggataattcaaaagtactctacctaatataatgtgaatactaaggactaaaaaatatgattaaatttggaatctcaattttagagtttttgagatgagtttttttttgagaaattaacattaaatcattttcatgttttataaaaatggaacaaagtattctaaaatgtaaagaatgcttgtcctaatacctagtaagtaatccttaacatagagcttgaatcatgtaataaattgccattgttctgccctaaattttcaatgttaaaggttaacacttttgggtctaatagaataacaaagcagaaggactcctaagacattcttcagttgactaaactgtgagttggtactgaattgcctacaaaaactggactgaaaaaacagtgtttgcatttcagtaaggtgaatgtaagaaagccaattattaactcattagtattccgcagctttactttcaaagggtaggagacaaaaaaatgaaagaagaatgtatatataattttctgtgtttattctattgactgtgtgaaggtaccaggacagaataacatttggaaaaaaacaaatatgtattcataaattcaggagacagattctttttatgggcaaaacatgatttttttttgatcaactgattcaaaaaaataataatatgcaaagcaatggttatttccatataaccttaggctttttcttaataacaacacaattctaatttttgcctttaggattcctttaataattacatggctaataaactattgcttttcctcatgcatatataaatactgacttgttccttatgagaacattccagggtattattagaagcatttgtcttgcactttactctacgcaagcactttaatgatctcacattgtttggaaatcccaatgagcttttgaggtaagtctcctagccttatcattttacagattttcatttaaataataataatacttttattcctgcatagagtattatgtaatatatttaatacatatataatttatacaaaaatatacatgctatatatatatatgcacatctcatatgcatgctttttaatgcctttacattttttccttagtgttttattttataatcagtgctttataaaaggatgcattccttttgaaaactatgcttccttcagctactaggaacacagtatggtatatggaaagaaaaaatgaaaacctctgacaacacttgcagctaatatttattagattctttttgcttcataaagtgcataacaaatttgcatgcattttactcatatgatctctcacatcaagcggtaatggtggatatgtttgttattgctcctatttaacagatgagagtactgaaatataaaaaggtaagtaagtttcccaagcaactaagcaagtataagtcaagatctgaaacataacaatgtgtctgtggaatctgatttttaaatactgttaatcactttaacagcactaatttggcaataacttatttcaaaagctgcttcctttctctaagcctcaatttcttcatattaaaatttcagtatgaatattgcaacttttaggatactcatagcacaaatattatgtttaaattagtgattatcttagtactgagagtaatggtgccaataataatagtttccatttactaagtctctactgtataccagaagcactgtgaacattacttcctctaacctgcataacacatccccaagacgaacatttcacattttatagttagaaaaattaagaatcagagaaattaattttcccaagatcatgtaactaggacatagagtatctggagttaacatcctactgtatgtgactcaaagatatttattttcttatcaccaaacattgtaagtaatttttactgtattttacacatcaaaaaccttagccagcacactatcatacatttactgaaacagagtagatatccttatctttcacttagaggcattgcagcatggttaagggcaatgctcttgaagtcaatatagtaccatggaattaaaaacaagaaaaaaactgggcaagcctcagtcatactctactacagatgctctttgacttatgatgagattatattcaataaacccatcataagttaaaataccctaagcctaagatggatttcatctacccaacctactaaatgtcatagcataacatagcctaccttaaatgtgctcagaccacttatattggtctacatttgggcaaaatcaaatgcttatttcataattaagtgttgaatatctgatgtgattcattgaatatggcactgaagtgaaaaacagaatggttataggggtgttcatcatttatgtacataactgaaagcacagtggacataaagagtgtttgaagcattgaactaaaattaatcgccggatgatggagatgctacagcaacagagtcaccaatttctccttcttctgatgaggttcaaaaatagctggtacaggttgagtaacccttacctgaaatgcttgggaaaagaagtgtttcagatttcagatttttttgaatattggaatatttgtattacataatgagatatcatggaaaggggacccatgtcaaaatgcaaaagtcatttacatttcacgtatacacacatagcctaaaggtaattttaaatgatattttaaataattttgtgatatttttacatgaggtcgtatgttgaattttcttcctgtgacatcatgttggtgctcaaaaattttcagattttagagaatttcagatttcaaattttcagattagggatgttccacctgtagaagaaactggttattgacacttattgatggtctagagtttgatatggtttctctgtgtccccaccgaaacctcatcttgaattgtagctcccataatttccacgtgttgtgggagggacccagtgggagataattgaatcatgggggtggtttcccccatactgttctcgtggtagtgaataagtctcttgagatctgatggttttataagggtttcccctttcacttggctctcattttctctcttgtctgccaccatgaaagatgtgctttttgtcttccaccatgattgtgaggcctccccagctatgtggatctgtgagtccattaaacctctttttctgaattcacagtgttctttggaaagatagcaagtattgattgtacagcttatttcttattattacatatctttctgtaacaagcaagagcactgtgtctctgcctgtcagttctcatgagtctctcctaatcgacgtgccatttctttaacatctgtatgccactgctgaatgcagcaaaggcctccacaggtttctttgctgtacactttcttggttcctccggtttaacttcttcctctgcctcaacttctttacttctttcttcctacagtttgatcacttgaaaactcagtgccaacaaacccatgaatatcctcttcatcaatacccaattttagctgtttctcaagtgctaataacttgttacctactattcatcaacagcagagtctttgttaaagcttttgaatgtgttcacatatgtcttcgaaactttcttccacatgccgatcatgcactgctgtgtgacttcttcccatgctgttgcgatgttctggatggcacttaggatgtaaaaacttttccaaaactcttggagaagtcagccagactcagtcacttcactaatctacacaaatccttggcataaatatactttgaagggagctattgctccttgttccattggttgaatgaatgtggttttgttcagtttcaaatacacagtcaaaaaaattgcttttatttctgtttgtttattcacttttcctgattgtctttatgcagagccctaaagaagttagtggtaaagccaaacccttgacatcagcagaactttgagcagcatatttggttcttcatttctcctgaaaagagtgatagccaaagaacatatctaccctgatgccctgggaaaagttaatagtttggctgacagtacttgaacataattggagcatcggtgacagggaggactgaagaagatttatgtgattaattctctctacttgggtacagagcttaaacacatttgtgtcacatataggtgctaaccaaagagtaacttcagcagatggataagtgaaaccatttgtaggagatcaagtgggtccccttagtactcccttgtgttgtgatcaaagttattggaaaactacaatggactaacacaggaagaactactaatggccaaggctcttcaggaacaaaatttcaggtcattgtttcagacaaaaggacctgatgatctggttaaaataaaagtaataatgaaataggtagtacaagaaggaagctataaacaagctatgaccatgtgaccaattgcaaacataagaattgcgataattatgaaaagttctttcttattttggtgtgaatgtatttcaaaaagattaaccaaagtttcccttttttccacgtctcctgccatctaacataaaaatgtgataatagtaattaactttatgtcaccgtatttaactcatatgatactaaagagggagaagtgtatcagaagtggaatgaacatcgaccactggtgaacaaatgacttttgtgagtttgtatccactttcagagtgatggttagcgtgctttcagttggtagaagtatagatgcgtcaccttggaaagaagcatgattttaccgttacctttatttggaatgtaaacgtgatttaaaatggaatacattgatgtcaatttgagaggtaaactttagtgaaaccatatttttaagaataatttttttcctgttaaaattgctgcagcacccattgtacctcgtgtgggtaccctgttctgctcttgcatgctgttgctgatctgctgactttccttgtcagtatgaagtagttagtagcatacaggttaaaggtggtaacagatatgggttacaattattgtccccatggactctaatttggcttcatggatatcagtttgccctcactctcctctgattcacactaacttttccttcccagctgccagcctaggtgacctgcagattcttcacgcctaccaccagaaacagagagaatagcacttcacagattgctacaacagatcccagttttatagagtttattttttacagaaaatcttgattcatattgattattgtgttgtttgtttccatattaagtctcaactgatgtcttcagtttatgtgatatatcatacggtcactttatggataatgcatttgggtgatcacattaaatttggaaaatagtctttgaactcctggaattttaactcttagtctcaaaccaaacacatatctagtctaactttctaaaatatgactgaaatagatttatatagctactatatttttagtttcaaattttctctatacatttttaatagcattgtttaatacaagtccctggatatgttttctatgacctcaaaatgttttgaaattttgggtcaaataaggtatgtgagtgcttatttttttttctttgggggagtgttttcaaatgaactttgaagcccagttggacactaaccaaacatttaagaaaacataccataacccttgattttataaaagaactaatacctgctaatccagctcaataatgaaaacccagagatttcatctttcaaattccaagttgacatttggtgttgttatttataatgtcaaaagccagcaatttatttcttaagagaaaattcaaaacaccccttctagggttcttgacctccggatatctttctgtccaccaagatgtctaataaaacataaagtttccatgatataaatttaatatggattactgaaatttgagtaagagttcttattaaatttaaaagtacagagtattctttcttcactagtgtagatgcaggtatggtttcaggaaacctatcatagcttgaatattttaaaactctattgatttttgaacatggtatagacatttctggcattgtgtgtgtgtgtgtgtgtgtgtgtgtgtgtgtgtgtgtgtgtattattgggggatgatgcgtatatgtctaccaattaactgtacatacaataatatcttgctatcctacaaaaatggcattacatttcattttaattttttaatgaagaaagggttatcaaaatttagttactacttctgaaaatttaatcttaattttaaactagaaatgtcaaatggcaaatgggttttttcctcatttcatgaactgcaaactcacataacatattgatgtttgttaaatcatttgcagtttcttagaggttttaaataaaaatatttactcatgcagaatagttattttttaaaattactaacacgtagaatagacagcaaattattaatgaaagtataatttgactttccattattttctttaattcaaaatattatattctgtctaattatactctttaaaaatgtcatttcatgatgcacgtgtctactttatctaacttcccttaaagcctaaaagacctaagtgaagattttaccatcaaaagttaaaaactaaagcgagccattttccaagaattagacagtatttttacacagccattaaatcataccacatgacaaggctgataaacttcatctgtcatatgaaattatctaatacccctaaaataaaatataattttataaatttacctggttatctgaataatcagatttttcattttatgaaatattcttaaatgtacaaaacattttaaaaatatgaatacataaaatatgtatattttatactttaatttgtgatagtatgggttttaaaatattttagtgttagatttctttttctttgatttggccaaatattccatttcatttatttttgtttatttatttatttatttatttatttatttatttatgagacacagtctcactctgtcacctgggctggagtgcagtggtgcaatctcggctcactgcaaactctgcctcctgggtttaagtgattctcatgcctcggcctcccaagtagctgagattacaggtgcacgcccccatgcctggctaaaataatattcagtctaattttatatgtctacacacaaacacaccagtattccctcacattagaatattgttatattattttctattatttcaaaaacatcttattgaacacaaaacaaaatttttgtcatcattgtagacatgacaatgcaagcaaaaacatacttgaaattaaaaagaatcacactatgtatttttatacatgcaaggtgaattttgattaaagattaattatgttaaaaaatcttaatcatattaatactccaaactatcctaaataggcaggtaagtctcatttaagtctgatgcagctgttatttgtgaaactcatgttaatgttaatggttcactttctcaaaaaacagtatttgaaatgcctactatgtacctggagaaattcttggattacagcaatgaatcaaaaaagatagtctttgccctcacagaaattgcatgtaatataatgatccaaatattctctattctgagataaaaggtgctgacagttgtttgcagaaaaatattagccacaggcttgcatgtttaccttccatctgtcttctccctagagcatggcttcgtattcacaggcttacaaaattctgtctttttatatagggaattcttcttgttttctaaccactttgttaacatgaaaacaattatgtgctttactcatgtaataagatttacagaggatatttcttttacatattgttaaaatgttagtgctatctctgaacaactatatcacagaatgaagaaggcacatctttgtgtagtcttaattttaactaatagtcaataattgaaaaacccagaaataaattaatctctgattccttctaaagaaaacatatatataattataataatgttcacacagcttcctatcagtgttttacttgccaacaataataaagactttatacaaaatagtgatttttaatcagataaatatataaagttagcaatttaggattatgtgaaaggataataattatctgttaattttaaattgctggtattttagtcaactgaaaatctatcatgaatattagctgatttacctctcctgaaaaaaaaaatgaaagcaaggagtagcacacagttagtttttttaaaaaagtatgaacaagtatgaataaaaattatattttgtgagatttagctggaattttgaaattggctgaaataaaattgaaataattgcttttctcctgggattcaaaatagacttcaaaaaaaaaaaaaaaacagttttaactgaaacaaatctattcattgtgaaacattatttcaaatccatcagggtccaaggtgttaaaagaatattcaaataatacaaataaaacatttacttagcaaaactttcatacttgctatgcaatacagaatggaaattctaatagaggtatcaatggttcatcagtaacagaaaaacaaagaaaacatttgttataatagtgttccataaaacttactcatcgaaaagaaattttagactgattgtttctaagatttggtaaagtctcaagtgtagcatgaaaattaatcacttgggggatggagccaagatggccgagtaggaatagctctggtttacagttcccagcgtgagtgacgcagaagacaggtgatttctgcatttccatctgaggtaccgggttcatctcactagggagtgccagacagtgggtgcaggacagtgggtgcagcgcaccgtgcaccagccaaagcagggagaggcattgcttcactcaggaaactcaaggggtcagggaattccctttcctagtcaaagaaaggggtgacagatggcacctggaaaatcgggtcactcccaccttaatactgcacttttccaacgggcttaaaaaacggcacaccaggagattatatcccgcacatggctcggagggtcctatgcccatggagtctcgctgattgctagcacagcagtctgagatcaaactgtaaggcggcagacaggctgggggaggggcgctggccattgccgagttagttgtttgattaggtaaacaaagcagccaggaaactggaactcggtggagcccaccacagctcaaggaggcctgcggcctctgtaggctccacctctgggggcagggcacagacaaacaaaaagacagcagtaacctctgcagacttaaacgtccttgtctgacacctttgaagagagtagtggttctcccagcacgcagctggagatctgagaatgggcagactgcctccttaagtgggtccctgacctgcgagcagcctaactgggaggcatcccccagtaggggcagactgacacctcacacggtcgggtactcctctgagacaaaacttccagaggacccatcaggcagcagcatttgcagttcatgaaaatctgctgttctacagccaccgctgttctgcagccactgctgctgatacccaggcaaacagggtctggaggggacctctagcaaactccaacagacctgcagctgagggtcctaactgttagaaggaaaactaacaaacagaaaggacatccacaccaaaaatccatccgtacatcaccatcatcaaagaccaaaagcagacaaaaccacaaagatggggaaaaaacagagcagaaaaactggaaactctaaaaagcagagcgcctctcctcctccaaaggaatgcagttcctcaccagcaacggaacaaagctggatggagaatgctttgacgagctgagagaagaaggcttcagatgatcaaactactctgagctgacggagaatgactttgacgagttgagagaagaaggcttcagatgatcaactacgctgagctacaggaggaaattcaaaccaatggcaaacaagttaaaaactttgaaaaaaaaaattagatgaatgtataactagaataacaaatgcagagaagtgcttaaaggagctgatggagctgaaagccaaggctcgagaactacgtgaagaatgcagaagcctcaggagccgatgagatcaactggaagaaagggtatcagtgatggaagatgaaatgaatgaaatgaagcaagaagggaagtttagagaaaaaagaataaaaagaaacgaacaaagcctccaagaaatatgggactatgtgaaaagaccaaatctacgtctgactggtgtacctgaaagtgacggggagaatggaaccaagttggaaaacactctgcaggatattatccaggagaacttccccaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaagattgggttacccacaaagggaagctcatcagagtaacagcagatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccccaaaagagctcctgaaggaagcactaaacatggaaaggaacaacaggtaccagccactgcaaaaacaggccaaattgtaaagacgatcaaggctaggaagaaactgcatgaactaacgagcaaaataaccagctaacatcataatgacatgatcaaattcacacataacaatattaactttaaatataaatgggctaaatgctccaattaaaagacacagactggcaaattggataaagagtcaagacccatcagtgtgctatattcaggaaacccatctcatgtgcagagacacacataggctcaaaataaagggatggaggaagatctaccaagcaaaaggaaaacaaaaaacggcaggagttgcaatcctagtctctgataaaacagactttaaaccaacaaacatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcatctctgcaccaagaggacctaatagacatctacagaactcttcaccccaaatcaacagaatatacatttttttcagcaccacaccacacctattccaaaattgaccacatagttggaagtaaagcactccccagcagatgtaaaagaacagaaattataacaaattgtctctcagaccacagtgcaatcaaactagaactcaagattaagaaactcactcaaaaccactcgactacatggaaactgaacaacctgctcctgaatgactactgggtacataatgaaatgaaggcagaaataaagatgttctttcaaaacaacgagaacaaagacgcaatataccagaatctctgggacacattcaaagcagtgtgtagagggaaatttatagcaccaaatgcccaaaagagaaagcaggaaagatccaaaattgacaccctaacatcacaattaaaagaactagaaaagcaagagcaaacacattcaaaagctagcagaaggcaagaaataactaaaatcagtgcagaactgaaggaaatagagacacaaaaaacccttcaaaaaattgatgaatccaagagctggttttttgaaaagatcaacaaaattgatagaccgctagcaagactaataaagaaaaaaagagagaagaatcaaatagacgcaataaaaatgataaaggggatatcaccaccgatcccacagaaatacaaactaccatcagagaatactacaaacacctctacgcaaataaactggaaaatctagaagaaatggataaattcctcaacacatacacccccccaagactaaaccaggaagaagttgaatctctgaatagaccaataacaggagctgaaattgtggcaataatcaatagcttaccaaccaaaaagagtccaggacaagacggattcacagccgaattctaccagaggtacaaggaggagctggtaccattccttctgaaattattccaatcaatagaaaaagagggaatcctccctaactcattttatgaggccagcatcatcctgataccaaagcctggcagagacgcaaccaaaaaagagaattttagaccaatatccttgatgaacattgatgcagaaatcctcaataaaatactggcaaaccaaatccagcagcacatcaaaaagcttatgcaccatgatcaagtgggcttcatccctgggatgcaaggctggttcaatatatgcaaatcaataaatgtaatccagcatataaacagatccaaagacaaaaatcacatgattatctcaatagatgcagaaaaggcctttgacaaaattcaacaatccttcatgctaaaaactctcaataaattaggtattgatgggacttatctcaaaataataagcgctatctatgacaaacccacagccaacatcatactgaatgggcaaaaactggaagcattccctttgaaaactggcacaagacagggatgccctctctcaccactcctattcaacatagtgttggaagttctggccagggcaatgaggcaggagaagaaaacaaagggtattcaattaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctagaaatctgacttacaagggacgtgaaggacctcttcaaggagaactacaaaccactgctcaatgaaataaaagaggatacaaacaaatggaagaacattccatgctcatggataggaagaatcaatattgtgaaaatggccatactgcccaaggtaatttatagattcaatgccatccccatcaagctatcaaggactttcttcacagaattggaaaaacctcctttaaagttcatatggaaccaaaaaagagcccgcatcaccaagtcaatcctaagccaaaacaacaaagctggaggcatcacgctacctgacttcaaactatgctgcaaggctacagtaaccaaaacagcatagtactggtaccaaaacagagatatagatcaatggaacagaacagagccctcagaaataaggccgcatatctacaactatctgatctttgacaaacctgacaaaaacaagtaatggggaaaggattccctatttaataaatggtgctggtacaactggctagccatatgtagaaagctgaaactggatcccttccttacaccttatacaaaaattaattcaagatggattaaagacttatatgttacacttaaagccataaaaaccctagaagaaaacctaggcaataccattcaggacatagtcatgggcaaggactttatgtctaaaacaccaaaagcaatggcaacaaaagccaaaattgacaaataggatctaattaaactaaagagcttctgcaaagcaaaagaaactaccatcagagtgaccaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatataaacagacacttctcaaaagaagacatttatgcagccaaaaaacacatgaaaaaatgctcatcatcactggccatcagagaaatgcaaatcaaaaccacaatgagataccatctcacaccagttagaatagcaatcattaaaaagtcaggaaacaacaggtgctggagaggatgtggagaaacaggaacacttttacactgttggtgggactgtcaactagttcaaccattgtggaagtcagtgtggcgattcctcagggatctagaactagatataccatttgacccagccatcccattactggatatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacacggatgaaacgaaaacatcattctcagcaaactatcgcaaggacaaaaaaacaaacaccgcatgttctcactcataggtgggaattgaacaatgagaacacatggacacaggaaggggaacatcacattctggggactgttgtggggtggggggaggggggagggatagtattaggagatatacctaatgctaaatgatgagttaatgggtgcagtacaccaacatggcacatgtatacatatgtaacaaacctgcacattgtgcacatgtaccctaaaacttaaagcataataataataaaacaaaatagaaaattaatcacttactgtttttaagtcatttataatatttactctgactgttgtcaataagatccctcatatctctaaataaacccttttaaagatactgaataaactccttagagaatactgatgggatgctatttgctattttctcacaaataatgctcactccttgcctgtcccgaagtattaagataaaaccaagcacattaatcaattttcaccaaaatatattcaataaagaagatcattttatcaagcaaagtaaatatatttgtaaggatttatctgaaatgtgaagctgctactattgaatcttccctctttattaatgattttttaaaagagaatgtaatataacaaaaatcacttattaattttgatggtaccacactatgaaattttctgacactaagtattactttccaatagaaatcatcacattcatattgacctttggtatgactgtaataatcctctactttgtgttaaatgaggcagtgataccactgagccaaattgaatgacttaatgcattttctgattttttctgagtaaaatatatttttaaataataaagttggccgggcgtggtggctcatgcctgtaatcccagcactttgggaggccgaggcgggtggatcacgaggtcaggagatcgagaccaccctggctaacacggtggaaccccatctctactaaagtacaaaaaattagccaggcatggtggtgggtgcatgtggtcctagctactcgggaggctgaggcaggagaatggcgtgaacctgggaggctgagcttgcagtgagccaagatcacgccgctgcattccagcctgagtgacagagtgagaatccatctcaaaaaaaaaaaaaaaaaaaaaaaggaataaaattatctgtgattgtgaacaaacatctacacacagttgtgaatttgaatttttaattatgcgctgctatgacattgagtgatgaaaaaagaattattctttgtaaattatatgttactagatgaggtcaccatcaactgatttgttggcaaatcaattaaaaagtcaaaaacatttttgactaatctacatacattcaatcaacatccatcttctctatttcaatcacatatgctctttctcatcttctccagctatcttcttgccatttcttaaacttatcagcatattcatcttcagagtctttgaatttattcctctgtctataatgtaaattccctggatgaatgcatggctcacatcttcagtcttaactttatgcagttttgctctaatgtaatttcctcaaagaaacaagtcgtctatctgaaacagcatcactgcctcctcagttgttaatcacaccttggtttcttgctctgtttcgtttttactccctgtctctatctccatgtggaaagtggttttgcctgttttcttctctgatgcatcgccagtaccagaacagattctcacacaatatagagtgtcaataatcataccttgaagaaataactaagcaaacaaatgattaatgaaatgactgattgaacaacaaaattatgtattgggcatgtgttcaagattgtttgtaacagggaaggagagaattgcaagcaggtggtctttacttacattctatttcagctgttttgttgtaaaaatgaagacaaatttgggagaataattttaatactaaactttgactaggaactattgtctttcttactcaaaaccaacttaagaagcaacactctcaaccacacccaggtctgacaactcaaagcactgctctgtaaaattgtaaattttcaaaagcaaacacacaaatgacagtaaaagcaatatcatagtttccaatgtgtcctgaggtacatgaaaagagcttagtgctaaccaggtcagcatttttggaatgagaaccaaggattactgtatgacaaaatggagaatctagaaagcaaaaacttggatcaataataaacaaaatcttgattcttgacatcaatggcaagttgctttggtggattttttaaaaaagcactcaatatattagtatatatctacattttgttgaataaacccatttgaatttaaccaaaagtagtgtactttaacagtgcgtagattataacaatttcataaaaattttatattgagtatacttaacagattcatttctattcatactgaaaagtaattatacattctttgcttaaactacactacctgatataaatataaaataaatgctcattttagtatatatgtcaaatttgtatgaagtagtcatagatgaagggatagcaagtactttcatgttctttaaatcacatgacatacttacatttagttgaattacataagtaattcaatttaggaatacttggcatttgaatatttgttttgaaaactgctgtaggaaatattttaagtccaaaatattttcaagatagtttttgaattactatttatatctagcaattgctaagaaactttatactgttgattactgcactctattcaaaagtgaaggtagtgatcagattttcagtgtcttaacagggaagaaactcacagtccaattgtctcagcaacacaaatccgaagtctaacagtcaatatttgatcataaggaatggaagaaatgaaataactgtttacggcaaaaggaaatttagagaagaaaggccttaaagacagggaatggtaaaatctaagacctcaagagagcccgtgtaaggaagagaggatggagaaatactgcttaggaaagttctgtacaaagaaaatcttcatgacctttatttcaaagccagtaattgaactttggtgcttcctcccctcttacatcgataaatttccacaagcaactcactccccaaataacttttaaaaaattatacaatctaaatgtaaacttcttcattgagtccatcatggcatccttggttgatgttgctttcaaattatggagacaactcagatttacctttcatttcccaaatttactgagagtgtacaatatattttaaactttaaattcatgaagctccttcagggtgggttttctaatctctcacgtagtgatatccttttgtctctgcatctgtccatttctgtacagtcacagtggtgtgttccaaccatgacttaaaatcattttctccttctctttacgtagcagtgcctgtacacttcggcagattctgagaattagtttgaatgagtggttccaaagtatgtttaatgtcaatctatagttgctgtaaagcagccaaggactctgatgtggctggcactcagtggcaggtctttaagtagtcccagagtaactgtccccacctctcttctttcagtaaggcttcaatgctataagcaacttagagtcaagagaaactagaaaatatctgttcagaaaggtattttagacattctcacttaattaaacatagataatgtgatctgtttctctaaatccattctcccctcaaaatgaaattacatactaaatacgctctacatgctagttcaagagctttctggtggtagtcaggaactaacatatctctttgtgtgtccactttgcccctttacaacgtaagcttagtattaccagcaattgtgatgaaaataatctcttgttcagcccaagatgatgtaatgaatctgtcattaaggtgctgttgaggacaaagatcaggaattgaaagcatctaacagagcccaggatgagaaagaagtttatggatctctgcctgttaaattcataattcttccaagcatgcacatatgtataaatgcacttgacatatatattcacaaagaatatttctgtcccacaaattataaaagtctttgagagatagagacatgtgtataaataagtgttctataaatgtagctcaatgacttacataaacaattagctataatttaaaaaatgagctatttagatgctttgctttagtagtgaatgtatttagatatagagattatttagcaatagacatcagttaagtgagccacaggcaatttgacttcaagtaaatttactaatttagctgattaaagatttgttaggcctttcttttcaaagaagcttcaaagcctttaaaaatgagtgctcatcattctggtaaaataggaaacccacatgttttattactaccaattaaaagatactggaaaggagaaattaagagagtatagagcaaggctaaaaataagtatttcttttctttctttttttcagacaggatctcactctgccacccatgcttcagtgcagtggaatgatctcagcttactacaacctcccctcctggcctcccaggttcaagtgattctcgtgcctcagcctcccaagtagctgggactgtgagtgtgtgccaccacacctggctaatttttgcatttttagtagaaacagggtcttgccatgttggccaggctggccttgaactcccgagctctagcaatccagctgcctcagcctcccaaaatgctgggactacaggcatgagccacccaacatggccaaaaataattgtgtcattgggaagttttgattgcctaaagaaaaatataaaaacatttgcatggattgtttcccttagatttttaagacaaaaatgattaaagcactacattataatatctggcagaggttcatttgatcaccatatttttagaaatttaatgcaaaagagaaatgcaaaacatttactctctagatcagtatttatacttcttgtgatgacttaaataactctggcagctttctgagtagttggcagtttctacaaaatatgccaagtaaggagcacaacattagtatactatatcatgtcattttcttctaaaacacaaatattgaacttttaccacctgctactgtacagcagtgctatggcaacatcttcgtagagttcctaagctcctttgaaaagtaggatctaatcagcacaaaaggaaataaactatcatcattgctgttgctataattacctagttggcaaaataagctctatctatacagaatcacacattaaaacaaatttgcttaggaaaactaaatgttttatttcagcccagcttacattttcaaatgaattggttaacaattagaaaagaaattgttgataaaccttgcattatgtttattgaatttttatttctggttaaaaaggttaactgttttcactgtggaatatttagaaaatatagatttctttctttaaaaatagttagccataaggaagccataattcatcactgtaacagagaatcttttttcatatatcttttactttatagtattttaatattttttctctactgtagacacatttgggatttatttccaacttacataaatgcatcataataactgtaactccatatgattttattatgaataaggatagattttaaaaacataatcaaaatgttcacatttttgtaattacttaatgtggcaaatattttattaatacttaaatttgtttaatcagaggccagcagtactgtagatatttctgagtgatttcacagaatgtgtgggaatatacatctgcgtcaattctttaaatgagtaaaaggagcatctgtaatgcagcaaaatcaatcatgaagaagtaactgatgcaggaattgcctatacaggtttccaaagtacatgtacgcgtgtagattgagttacaagaaaaaggtcactttctaataaggcaactgacaattattttgtaaaaaatatgaaagtgcaagcacatactttagaacaaatattaggtacaagcttaatggaagagtctatcatgtaattagcagacaaaatgagccacagaccacatttacatacttagtttaaaatagaaacagagtcccaagagataaccattttactgctgcccagttgaggagaaaacactttcaatatttctacattaacgttcagagagtcaaggtggccgatgcagaacaaaaacactaatgataaggaaaaaaagtttttccaaagaagaacttggtatgaattagatattaattgttaattacttcagaaggcccaagtgaaaattcagacttctttctctgctcttggccttatttcatgttcccgctttctaagcacattaggttttcctattaatcagtcacaatcaccatgtctaatcggctgtggatctagatccttaccagatcccagccaatagaagttagcaatgtaaggcttattttgtggaccacttctttggaggaatacgttgtgtttctgttagatgactatacacatgatagtcaacttccagcccatatctggatgcattcttgagatgactctgaatcaaataatttcttttaaaccaaaactaaatatttatattaattgaatgagacttttataaattattccaagtaaagcatgaatttccagagactggcataatttaaacccatactggaggggaattatccatggatttgggttgaaactttcattttagtacctctactcatagtagattgagaattaaaatctgaagaaaaccctcttagataagacatttgtaaaataaaaaactcacttaccattccgactttcttcatcaatagcaactatggtagctggtggtcctcccctagctagtttgcaatctaaagagagaaaataaccaaaagtaataattgactgcaggggcacacacaatgagaaaaaaattcattgagatgtatattaatatttaaaaaggaaaatcttgcaatctaattaatatgcatcactacaattaatattatttaaaaacattttataataaccacatagattccttaccacatcataatacagtcactttgtgcatcacaaaactactcaaatcttactgagaaaacaccagcagggaccactggagagcagaagtccttcaggacagagataatgggatggaaatttaacccaaagaaataacagaaagggatgattaacaaggataaattgtaattaaagcatcacaacagaaacaaacataattggactttaattgtgataaagggtctaattagagagagtgaatagaattttaataatgttctaaagagaataaaacaaagacagacaagcaatgctcatgaggttgtttggggtttttatttttgtcatcttaccctcatattgccagtctggagtcaaaagtatagagtcatcaatggaagcagatcagaaaaatggaagaaagaaaggaagagagaatatatgtatatatttagtgagagatttaaggatataaaaagcattatacaataacattatctaatgatttgtggaaatagaatatataaaatccctatcagatttcctacttctaatataatgttaacacattcactggataatacacatcattagcattttaaaagccgttacaaaaaagactagaaaataacataaagtaaattggtatttttcttacgaaaaggtaaatacgaattacttatgaacagtctgttatctgtatgctgaaaaaactttaagaatagtgcctgtcaatcagtagtgatgattaattcattatttcaaacactgctaatatccttccaggtatcacatgataatgaacataaaaaatagtatgagctataatatccatgacagttgaaatgtgaaaactttgcctgcaggatgtcaaatgtgcacctctgagacataaagtactctactaggaaatactttgtgaggcagagagggctatgtcatgcagttatacatacatggcacactcctgtacagcagtgcaaattaattttgcttgaagttttccaaatttgtgtgttatttgggaaataatttcaaggtttatttacttattaaaattctgccatttattatgtacatatacatgaataattaggccttcaggaagcactattctgtattgtaaggtatgtacgctctcatatgaagcaaagaagctgggagatctacacattttctctctttacacttgtcaatattgaaggagttccaagtcataacattttcagatctaaaatatctcacactcattacgcctcttcctctccttatgccctcctacagagcccagcactacactatttgtcatctctgctcttgatttagtttcctcgctgatctcccagaagtcttgttctcatcctgcattcatctattcctttcatgagaatgattttcatgtacccaaatcaaaagtgaaataatagcattcctctgaacaaaaaccttacatgtttcttttggagaaaatgaaaaaaaaatcagaagaacaaagtttcttcacatggccttaacatcctttattgagaattaagcaacctgtccttcaattacatgaatcctcttactgttgctggaatgtagcctgtatttttagcaaaattttgttatctaaattcattgttgcctttttttgcctagcaaatctctgcttctttttgtagaattagatatttcacatatttgcacctagtgcgaattaattttgattaaagccttccaaattttcatgttacttgaaaaatgatttcaacatttctttatttatttactgttttataaaattcctccaattattatgtacatagaaatgaataattaggctttggaaagcactgtattgtaaggtatgcactctctcatatgtacacacacacacatatacacacactcatgtcactgtgtgccaatgccataatacctactgaaaatagataaaaattatgtattttagtgtgaatgttggtagaggaataaatatttaatcaacaactttatgggcaagcagaatatagaataataaaagaaggggaaatttggatataaatatttttgaacctttttacagtttgttactattaagtttaaaagtaggctttatgaagctaagccaaataatatcttcatattccagcccttcctcactctccgcctttcccattctcaaagttaattctccattcataccaaaccaaatttatgttttttgcatcaactgttaaaatatactttccactcttcttcccctggttaattttattcctttttcaggaatctgcctacgcatcacctcttcttgaaaatccttctcgttgtcattctagattaagtccttattctctgtattcctgcagtacacactgtatcccattggactaattgccccattggcacaatactaatgtgtctttctctctcacaagagcttcttcagaccatgcctgcatcattttcaccttggtaacctcagaacatgatactggtcctgaaagaatgtttgttgactttttccacaatgtagtctgctaagctacaatcttccattaaaacctctccatgagagcagctcagaagtctctgttctcactaacccctcaatagcagaaacagcccagaagaagctgcttaactacattttctcctgctacagtacccttagataattcccactacgatttattattttagtagattcaaaattctccccaataaaacattctttatatactacatatacttctggataaatacaaaaataatttaaacttttttaagactcaaaacacaaaatgaaaagaggttaagcagacacataataaataatctattaataacattgttcataacaaagtgtttgtttttaaacgatgcattcacgacagcataattaattagttttgaagtgcacaaaagcatttttaataagaacaattatatttagaattgtcttggaaagaaagtaatttggatgtaatagccaactatatattatgtatgaaaatatccaaatgtaaatcaaagggaagactagaaagcaatttgggggatggggagattgtaccctatggtctgtggatcatctgtctgccacaggaaagtcaggtgagctgctgatacctgtaccctggaaatggacttccttaatctatttaatttcacccttgactgtcctggttaaatcacaaattcattgtttttcatgcctaaagtttctagcctgttaggcctatactcattttccatatccaatttgtggtaaagtacaggatatgaataccaataactgaatgctcagtgtggcttatttctgcaaacttgtcacaatgctaaaaataagccatatatttaaaaatattcatatgcaatagatgggatttaaaatccaaagaggagaattaaaaagacaaataatgactgatctcacagatactaagcctgtgatactctgttgtcattgtagcctgaattttaagagcatgttacagacaggtcagacaaaggcttttgaaaatctaggattttccgaatatgctcatttcgtagaaatgagagcaagcacccaggaattcaaattctattcccactttagcctattctcaaaatgttcttttaacgttgatcaatgtgttttcaataagacttcaaaactatttactttaaaaaatatattaacatagtaattgcccttatatgttaataacttgtgtattgaatttcctacccatatttatcttctgagcctgggtcccatttgcccagacaacttctgtacttgcaatttcaaagttgtcttaaatgtagccctccaaatcgcatcccagttgctatcatagccgaaaactggatattttcaatatatattatttcagtgaatggcataattctgcaccaagccacataagtcagaaaccaggaagtcacatttcattttacccatgtttctagctttccaaaatgtaccgatcgataagtcttgaatttaattcctaaagaaaaacttgtcatatccactcactgctttcaatctgcagtggtaccaggctaatcttgtctcttacctaatcaaataggttttcctaactgctttccttacaatcaatcttgcccttactctgagttaattttctgtctttaagcagagtgatctttataattaaaaccttgcttatttttaaaagaatttaccatttattttaggttataagctaaaatattttggccatctacaactcatcacaaatatgattctagaatgtaaactaacatattttatataacctacaaagtcctccacaatatgccttctccttccctctccagtctcatctatttccatgtccctcttttcccaaagcaaaatagtttttgatcccttgactaggtaaggtttcccaatatatactctcataactctgcctcataatatcaatttatgattacttgattcttcacagaaagaaaactcagtgataacattgaccttgtttctattcctcacggttgtgtccacagggcagattttcctggcacatttttgattccaagcaattatttactgaatgcaaaaacaaagggcctcaatcaaatttgtaacaataaaattaaaacaacactctgtacattaattcccttttttctttttaatttttcaaatgtctttctcaagtgcaagtacagcaggtccttgaatgacattgtttcattcaatgtcatttcattataacaatgaaaaaaaaaaacaactaattccaggcctgagccactatctgtgtggattttgcaagttctccccaaatctgtgaggactttccctgagtactccagtctcctcccacatctcaaagatgtacatgctaggttcattggcatggctacatggtaccagtgtgagtgagtgtgggtgtgtgtgtgagttgccctgagaaggaatggtatcctgtccaaggtgggttcctgccttatgccctgaggtactgggctagcaggctccctgatgggaggccctgaactggtaaataattatctcactttttttgattaatctttcttaaatgcatgtatagctcacatttacttcaatatttaatataagaaatttttggtctttatttagaagtgtggtgatgtttttgtaaccataactatgtcataggaacttgtttatattttgtttagcctaaaataaaattggtttcattttatgtcatttcattgaaagtctcaatttccaagaacctacggacaatattaactgaagacttactgtaatgaggaaaaaattgacagataatttgttgtctaaagataaggtcattggtgacaactcagcagatgtgaaaggctaccaataaagtaagaaaggtgtagataattctgcaagaatttgaggttatttggaacaagttatgaaagattagagagagctcacaataatagacaaagtaaagtgatgaaaaaaaaggagaaaatgttcacttgcttccaaatgtctataatttctattagaattccaagatgttttatgattttaccaaactgtatcttaaaggaataaaactaagaaatttcaaatactaaagtttaaattatatcaaagatcaacttaccttttttttgtcatcttagaatttttaagctatttccttacaagctgcctaaatcaccagtgaactctgtggcacctagtagagtatttgacttaacataatcatttaatttatttgctgaattaggaaatatcttcctctatggaaaattaacaaaatgaataatccatcaaatccttagctttaaccatttcaaatctttgggggagtgttttaagatgttaaagaaatgggtttctaatatattatagtggttgtgaacatgtgctttggagtcacaaaacctaacttcaaatcctaactttggtttttaatagttgtataatattggacaaattatttaacctcttgtatttcattaatggggataagagtaattacaactaactcatatatttttacaacaaggacaaaatgaggaaatctatggtaatttcttagaagagtgtctggcaaaatgtatagacagactaggcctacatttgcttttattagtatccttattttcattaggaatatattcgaataaaatgttttttctatttttttcctttcatgcaagggctgatagtaaatatagtaaataaaccctcagctctcccaaatattcagtgagggcagatcttagttatatatgggattgtgaaatatattgttattaagaataaaagtaattacatgaaatgtcactggtggtctgtagggacaaaaatttgcttgaattcctatcccagataccaagctagatatactctgatggattaaatttactagggaaaaatagactccttgaacttgaagcttaaaaaaagtaatggggttctcacagtcctctactggtcccagtatgcccctgatatgagttggtgagattccacagaaagatcaaggaagagttgcagattttgtgaaacctctattcctgccaacatttctctattatctgtttcgttattcagagtaatctagtctcttgctcatgtgtttgtatttacacagacacacacacacactgaatctattgctaagttcaaagcaatttggcacctcattcaaagaaggtactgtgttctctttaaatttcatgctacacaagcattctgttttcaatttgcatgtcacaagcagcaggagagggacttttctcatttttcctgttgatctttggtatattcattttcaggaaaatacacacaggagtgaaatcttaagacagatactacttattttacattttgactgcttcatccaaaagaaaaagtttgatcttgaatttataaaatcaatggaacaataatctaacttgtatgatctaaagttacagtcaacaaactaatggaaaaagacaatgatagaacaaaagcaaaataaactgagtaaatttaaggacagagcaagtaattcagttccaattcaagaacaggatatgctacttgtgttactctcttggcattactatttgcagatttcagatttcaccatgaagggagcaaatgatattttatgtaccttagtgtcattattaattgaattatataatttgatgaagactttaaaacaacattgtctagtaatatccaccaaattcattcatggtaattactcaacatcattgctttcatcaatacaatttactctagagaccatagctacctcaatctgtacttttaaaaaaaacaatttcttattattttattttattctaactggtctatcaacaacagcagacttgaacataaatggcatttggtcagagaccagaagcccatacttagtcttaagaagtttggccggatgcggtggctcacgcctgtaatcccagcactttgggaggccgagacaggcggatcacaaggtcaggagatcgagaccatcctggctaacatggtgaaaccccatctctactaaaaatacaaaaaattagctgggcgtggtggcgggcgcctgtagtcccagctattcgggaggctgaggcaggagaatggcatgaacccaggaggtggagcttgcagtgagctgagatggtgccactgcactccagcctggcagacagagcgagactccacctcaaaaaaaaaaaaaaaaaaaaaaaaagaagtttaaggttctaggggctttaggaaaaaggcagaatatgaaataaattgtcagtagaaggctgctccaaagatgaagtatataattttaagattgcttttgttgattgaaaatattattgtactttattttatagttttatgtaaatacattgtcaaaacatgttaatctttgtattcatacataattctcttacatataattcataccacatgagttagaaactgtttaggttttccttccattgtgggttacaactcttcttttcttgtctaagcttccagcaagcaaccatgattcaatttgaggaatttaagatgaacagaacaattcttggtccaaggtgtaatattaccactgacatcaaaagaggccatataatgttgtggttaagaacatagcctttgagacagactgcctaggttaaatactagtcacatttaacaccttgctcactcttaggacctttgaaagttaattaaattttctgtagctcagttgcattatttgtaaaatagatgttgttttagagtagtgtctggcatatggaaatgctttctatgttattgtgaggtaaatttttattctaaccaagtgagcaaatcacttaaaatatgtctgttttttaaaaagcaatgactgtcatttttttttttaatatttcagtagaagtttcttccatttttaacattcaaaggaaaaccacattttattagtagatcaaataaggaatggggcatatgttaactttttaaaaaataatttcaaattttcttttatatttaggaggtatacaatatgcaggttgttatctgggtatactgtaaggtttgggatatgattgattccatcatcaggtaatgagcacagcactcaatagttgttttttaaatacttgtccctcttccaccctctccccttttctagatgtccagtgtctattactgacatccttatgcccatggctatgcaatgtttagctgctacatataagtgagaacatgaattatttggtttttctgttcctgtgttaacttgcttaggataacagcctataactgcatccgtgtggctgcaaacaacatgatttcattctatttttatggctgcatagaattctatggtgcatgtgcagcacgtttcctttatccaattcactgttgacgggcacttacattgaatccatgtctttgttattgtgaatagtactgcaatgaacatacaagtgcatgtgactatttggtggaacaatttgtttcctttttttttttttttttttttgagacggcgtctctctctcgcccaggctggagtgcagtggtgcgatctcagctcactgcaagctccgcctcccaggttcacgccagtcttctgcctcagcctcccgagtagctgggactacaggcgcccgctaccatgcccagctaatttttttgtattttcagtagagacggggtttcaccgtgttagccaggatggtcgcgatctcctgaccttgtgatccgcccgcctcggcctcccaaaatgctgggattacaggcctgagccaacgcgaccggccgcaatttgttttcttttagatatataaccagtaataggattgtgagtctaatagaagagctggtatcaagtctgaaactactctaaaatatcaaggaggagagtctgctccctaactcattctacaataccagcatcaccctgataccaaaacctgtcgaagacacaaggaacaaagaaaactataggtcaatattcctgatgaacatagatgcaaaaatcttcaacaaaatacttccaaggcaaataaagctgcacataaaaaacttaatctaccattatcaagtaggcttcattcctaggatgcaagattggttcaatgtatgcaattcaataattgtgatttatcacatggacaaaattaaaaccaaaaaccataaggtttttgagaatctccaaatttccacattggctgaactaatttacattcccaccaagagtatacaagcattcccttctctgtgcagcattaccagcatcttttgttttttgacttcttaataatagcattttgactggtgtgaggtagtatctcattgtggttttgatttgcgtttctctgatgattagtgatgttgagcattttttcatgtttgttgtctgcttgtatgtctgtttttgagagaagtctgttcatgtcttttgccaatttttcaatgtggttatttggtttatgtttgttaaattatttaagtttcttatagattctggagattagacctttgcgggtgcatagtttgaaaatactttctaccattgtgtaggttgtatttttactctgttaatagtcttttctgtcgggcagaagctctttagtttatgtaggtcccacttgtcaatttttggttttgttgcaattgcttttgaggacttgccataaattctttgtaaatgcaaacatcaaggatagtgtttcctaggcttccttttaagattcttacagcttgaggtcttacacttaaacttttaatgcatgttgagttaatttttgtagatagtgaaagtaagggtccagtttaattctgtatgtggctagccagttaactcagcaccatttgttgaatagggggtactttccccattccttatttttgtcaattttgtcaaaaatcagatgattgtaggtatgtggctttctttttggattctcttttctgtttcattggtctatgtgtctattttgtaccaataacatgttttgttaccagtactatagccttagagtatagtttgaaaaaaagctatgttgtttttgcttaggattgtgctttggtttgaacttgtgtccccatccaaatctcatgtcaaattctaacctccaatgttggaggaggggctggtgggataaaactggatcatgggtgtaggatttgcccttgctgttcttgtgatagtgagtgaattcacacaagatctggttgttttgaagtatgtagtaccttccccttcattctcttcctcctactttggccatgtccccagccatgcttcctgtacagcctgtggaaccaagggccaattaaacctcttttctttataaattacccagtctcaggtagttctttataatgatgcaacaatgaactactacagattgctttgtctatttgggttctttttggttccatatgaatttcagaattttttctaattctgtgtaaaatggcattgaaagttcagtagcaatagcattgaatctcttgattgctttagagattatggcaattttaacaatattgattcttccagtcaatgagtatgaaatgctttttccatttgtttatgttatctatgatttctttcagcagtgtgcagttctccttacagaggtctttcagcttcttggttagacgtactatctaaaagccctacttaaaaggcacagagtgatgggttggataaagtaacacccattcatctggtatcttcaagagacgcttctcacatgtaatgatccccataggctcaaagtaaagggctggagaaagatctatcatgcaaacagaataccaaatggaacaagggtcactattgttatatcaaataaaacagcttttaaaccaacaacaataaaaaagaacaaagaagggcattacataatgataaagggttcaattcaaagacaagacttagttatgctaactatatacatatgcaatattagagcatccaaattcatgaaacaaggacttctaaacctacaaaaagactgacatagcacacaatgatagtgggggtcttcaacaccccactgacaacattagacaaatcattgagtcagaaaacttccgcagaaattctggaattaaatttgacacttgacaaattgagcataattgatgtttacaggacactccatatatcaaccacagaatatacattcctctcatctgcacacagaatatactctaagatcaaccacatggttagccataaagcaagttggaaaaaatccaaaagaaggtctttccataaaacaagtctcaaagaaatcaaagttataccaatcacataccaaccacagtggaattaaaatagaaacctataacaagaatatctctcaaaaacacacaaatatatagaaattaagcaactttgctcctgaatgagttttggattgtaaggcagaaattttaaaaaattcttttaaataaatgaagaaagacacgcaaaataccaacatctctgggatgtgggaagagatatgttaagaggaaagtgtatggtgctaaatgcctaccttaaaaagttagaaaaatctctgattaacgatctaacaccacatctagagtaactagaaaaacaagaacaaactaactcaaaagctacctgaagaaaataaataactaaaatcagggcaggactaaataaaattgaggcataaaaatccataaaagcatcagcaaaaccaaaagttggttgtttgaaaggacgaataagatctatagaccactgactatatgactatataaacaaagaacaaaacagagaagatccagataagcacaacataaatgacaaagatgacattacaactggtccaacagaaacacaaaaaaatcctcagagactattatcaacacctgtgttcacacaaactagaaaatatacaggaaatggatatattcctggaaacacacaatctcccaaaatttaatcaggaagaaattaaaaccctgaacagaccaacattgagttccatattgactcagtaataagaaacctaccaacgaacaaaagccccacaccagatgaactcacagccgaattctaccagatgtacaaagaagagctggtaccaaatctactaaaactattccaaaatatcaaggaggagagactcctccctaactcattctacaatgccagcattaccctgataccaaaacctgttaaagacacaaggaacaaagaaaactataggtcaatattcctgatgaacatagatgcaaaaatcttcaacaaaatactttcaaaccaaataaagctgcacataaaaaacttaatctaccattatcaagtaggcttcattcctaggatgcaagattggttcaatatatgcaattcaataaatgtgattcatcacataaacaaaattaaaaccaaaaactatacgataatcccagtagatgcagaaaaagctttcaataaaatccaacatctcttcatgataaaaatcctcaacaaactctgtatcaagggaacatatctcaaaataataggagccatatatgacacaatacagctaacattaaactaaatgtcgcaaaagctggaaccattccccttaagcactggaacaagacaaggataccattctccattctcaccacttctatttgacatagtactagaagtcctaactacagcattcaggcaagagaaagaaagaaaatgtacccaaacacgaaactaaagaagtcaaactatctcttctataaccaggaaacctcgatgacatcaccaaaaagctcctgaaactgataaatggcttcagtatagtttgaggatacaaattcaatctataaaaatatattaacatttttgatgtgcatttaacatactaaaatcatgacttaatatatttcagtatataaccaccgattgtttaaattacatagtgataatggaactatactttctttttaaaaattatctgaggaatgtttataaataaactaaaaataaacaactcttttttgatacatacagtagacagtatacagcttctaaaagctctttacatggtgaaataagatctgttattccaaaatctttccaaaagaacttttctgttattagcttgtttttcaacattatccaacttgtctctgtgttttgtaattgaaatataaaggagaaaggaaaaggataatatttgtgtccatgtggaaaacaaaattattcatcaaacactttatgaaaagcagcttttatttccatcttgtttctgaaagctaatttgttattttttctaattattcttaatgaggaggctcagaggaaattcttaatcatgattcttactaagacactcaacaaggtcaaaagataaaagctgcagaatcaatgtcactgtttaaaattacactcttccaacagagagattcttaataagtctttgtttgcagagtactttgactactaaataaaattctttgccacaagacagttatgtgtacttaagctgcattaaaaaaagcaaactgtatggattaatttttgaaacaaaaattataagcatttaattacttattaaagaacatatccatgtaaatatgtccttagctgtccagttgtgacagatgttagcatgaaatagatgtgccacatttacaaggtacgggatgttgaagcaattttcctacttaagtgaagtaatataggcttatatttctggaacttcagaagactgtgctaatatttacctttctgtttcatcatctaggatataactatttttcacttatgtgtgaagcaggaaagttgttagacatagcaggaaaaagtacttcgtatcactggctggcagagaaagtttatatatttgagtttatacaggtaactggaaatttagaagtatttttcattgccttattttcttattccttgtcatgaagagtgtttggactgaggttctactatgaaaggtgaatatccaagggtggaatgagtagggactgtggctgagagttatgaaagaagatgattctgaaaaaaataacagaaagcataaagcaaatatttcctactttttccatacatcacatcttgctttctcagaaatttctctgctacaaacccacctgataacaccttccttagagccatagagccaaagtcattacagaggaatgtttcatatagaacaggaagttccaaatgaacctatgttctttttgatacgggagtactgggaagggaagagcgtggtccctttaaatgacatggaagggggaaagggaagtgctgagtggagaagggcgtggtccctggctagggctccataggtgaagactggcgctcctgcttttgtgcccaaatgttgcattttccaagaccaccctggcctgccatgcccccatcctgggcctataaaaagccaagaccctagcaggcagatacaaatacaggtggatgtggtgaggaacacattggcagaagacataagcggctcctagactccaaaaggatgtcgagggagcacaccagcggaagagcacaccgacagacactggcacgcgtgcaggccacccactggtggaaggaggcggagtttggtccggggaagttggaggagagccgtggccccccaaaactccgaatggcccactccaagggaaaaccatctcccttctggctcccccattggctgagagctacttccactcaataaaactttgcagttgttctccaagcccacgtgtgatccgattcttccagtacaccaaggcaagaaaccccgggatacagaaatccctctgtccttgtgataaggaagggggtctaattaagctggttaacacaaatcgcctatagatggcaaactaaaacacatgccctgtaacacatgcctactgggccttcatccctagacactggggtcagagccccacatcctgcccatttgcatgctcccctagaggtttgagcagcggggcactgaagaagcgatccacacccccaacgcatgccctgcgaggaggacaagggaacctttcccatttcgttttcattgtttcacaataaagaagtgacaagggatggatgtctacctatgtcaactgtttttaaaaataatatttcatgtaatgaactggcctatgaaatttgatcatatgatttggatcattcttgtcacacccaattaaaagaaagttgactagccaggggaaaaaaaatcaggacatgtagcatcgctctagaaacgtaattttctgcaagtctggctgttgaaactgcctattctaacccgagacagttttatttataactgctgagacaacttgcaactccagggctaattttccccaccgctgttgctcaccaaacagagtttgccagctccccagaaacttactagtcccaatgcactttctctaagagcaatacataacatttctcatttttataaaatcaccaaccttctctttgttcttcagacataccgaagaacacctgacccgtgtgtatgctccaaattgtgattctttattctcaaagaaaacattgaatttagagatccatctccacatttctattttgacttcaacaatcccattctgcatcataaaccttgagagaataatatccaaaccaagtcagatcagtaatttgatctgacatttcttggggtgaaagaaaacttttgttggcaagtttagcaaaagggactttggccacatgctgaagtatgcatatgtacaaatgaattacttcaaggaaaatgagctaggataacagtttttatattggccataaggataaaaacacattattgattaactgcattttttggagcttggaagttttcttaagaattctctaaaactgaatataataaagtgctaagacaagtattttaccacccttgacatttagaaatgaagtttttgatagtttgttatccacatgtataacatatgatgtggaaagttttatgtcctgctgagcttagttctcataggctcaattttagacaatttctatacagacgcctgcaattttgaatatctgctgctatttatgaggccttcccaagggtggtactccatatttaatttaattgtgtttgcatatatcatacattttgccaacagtaagctctaagagcactttatagttgataacaacttccttcattgctttccaagctatatgatttcttactataaaaccagccttccaccttcagtattgttagttctaacggcatacacgcaatggttttctctactatgttcaaaaagagggtaaaactactaagagtggaaattaatctgttaaaaatttctgttacattaacagcattttattatatctctcctcaaattaatttacttgagtacagtgctagaattgttattctgttgttagactttatgccataaattttggtaatatgtctatcatcaggaggttgggattttcaaaatttttcaattatcataatcagagacaagacctaggaaatgagatcaatttagtccctctaatcacaaatgtctgtactctaaagttcatgaacttgacactaagggaaagccccagaatggattagaaaatgctaataaaagtggagaatgtgtgggaaaaaaagacacctggctaaaggaaggcatgtttccaattttagagcaaggacagagaaatttttacagtagatataagaattcacaaagcatagctgtctggagcaaataatgtctttctctactaaaatagcttcaatactactttgttgcagattgtactaattaacagttatgttaatgatggtaactcatcatcacaatttttattttatgcaaactctttaaataatagaaaagtatgcaatgtattttagaaagatttgtatccatggaacttataaccaaaacaaatgttaattaaaataaagtaatatttttcttctgtcaaattgtcaaaattttattaaaaataatagccactattggttcaagtaaggaattaaaattattttataattttggtgtagctataagttgtttctatataaagaaagaaaggagagaaagcaaggaaggagggaaggaaggaaggaagagaaagaagacaaaatggaaagccaatataccaagaacttttaaaaactgtcctttgaatgaaaaattttactttgggatctatagcaatatagagataattaaagaagtatatattgctgctaaaagtacttataatagtaaaacattatatatgtttattaaatcattatgatttaaacacactctgtaattgtgacagatactgtatattggaccacccactctaacacctcttcttgtatttttctttttgtgcactattgaggcagataaacttaaaactgcacttgccagactcatttgcggatagggtctaccttggaatctgcgaagcagaagacactctcatgacacaagaacataaaggaacaagtgagccaaagggaagtcagttaatcactgggcaggaagtgtatggttctttgggggcagctgtggtagagaaattagtgcaacaccaggttatgatagttgccatgatggggattgtacctatgaggtttccactagaaagttcagattcgtggttaggtatctatttggctctcatgatcttgccgctgtggcatccaagcttagttttctgatgcttctaagtcactagaccacattagtaaattcattacagatgaaagaggctacctggattctatgaaattggatgaatgaataagccattaaaatatatattcatgttgttaaataaattttgatgggatgagtaattctcatggaaagtcaaaaaattataaagcaggttttagaactgtctgtacattcttagttttgagtgtgaatatataaagtctttttaatattaaagactaaataaatgaaacattattattgttattagtgatttcttattgaattcctaaattgcttttaggaatttattataagaaaatagtgtcctttgcatttttataagaaataaatgcattgcatttattataagaaaacatgacaaacacaatttggaagcaaaaataaggaacttcatttgtttagaatacttatagtaaatatcacaaagattctaaatagaataataaccttatcacaatataacgtaagaaacactgtaatgtgaaatctgttttgttaaaacacatttagatttaaaatttcttaagccattggatatgccttgttatcagtgtcacacactgaaaacttctagaagttgtcatttcatctgatacatgaagagcaacagttattccttaacacctccttcaacaccgcatgattctcctcaattcatattttgaaatttgacatatggcactgatggtgatatgacagagagaatctcaatgtgtcaatgacttcatcatattcatttgggcaactgagctagagtcttctgctccatgaagtctgtaatgacattgtgggaaagctgtaggcaggagcttcatattcagatcaaaggcaaatacaaaccagggaagagctatcttccagtcaatatttgttggcatttgctatattataaaacttcaagcactctcccatttttctgctcaatttttcttccattcattgcacggtgagatatgttccaccatgaacaaaggaagttaataagagttttcaaagatacaataaaatagatgaagtttaatatgacatttaaccctattgcttctcaaacaaaatgctttatatacatagcaagctggcttgctatccatcttctgtcactattctctttgtttactattattttgttttaccttttctaaaatgtcaaatatatcagacacacaatagagtatctgatatatttgtagagcttaaaaatcaataatactacaataaaatgaatatttatgtcaccaccacctacaatcagaaataaaatcctgccactatcttataaatcttctgtgtgcactttgatagacttttgcaagttttagggctgtataaaatagatttacacagcacaaattctgcaacttggctatttctctgcattattatgtttttaggttaatccatactgatgtatatacctttagggaaataatgctgtaaagtattccattatataactggatcacactatttacctgttctttattggagagattactgttgcaataatttttatttgtattatgaacaaagaccagatgcatattctggcatatctctcttggtgcacaatttgaggaatattttaggacatacccttaggaacgaacaaaagtgctgtgtcatgggtatagtatatatttatatttacttagttaaaatcaaattattttccaaattggctatgccattttctcagttaccagcaatttcagaattcctctttctccccatcttctataagatttgatatgatattaaacttttgtcattttgattgttgagacttgatattttatgtttttaaatttacatttttttctgactacttggcaacttctcatgtgtttaatgaaaacatgcgccactgcactccagcctgggcgacagagcgagactctgtctcaaaaaaaaaaaaccaaaaaaaccaaaaaaaacccatatatatatatgttttatatatatatttatatatttacattttatatttatattttatatgtatatacttatatattttatacatatataaaatactcacatgttttttaatgtggcttatttaaggaaactttactgatcatagagacataaaaatatttttcttaagtttcctttaacagttttagatttttgtctttcatatatgtcatccatatatgtgaaattatctattgtaattatttattaagtgttgaagaaccattttaattttccacatgagaaataaattatttgaaaaactaaggaaagttaattatatccattttcacctctaaatatcacctatttatacttctattttccatggtatattatggatccatttctgtacctttatatatatatgtatatgtgccttatataaattattatataatatatattattgtatatatttatattatatatttaatatatagtatatattatatataaatatataatacttatataaatatatatacatatgtttgtttcacatatatatacaacattgcttggttcaatttgttaataatttcttaggaaaatttttatccctcctgactttctatggtttttggtgacaacattttcctgtgtctttgaaggctgaagaacattgtaattttgttgcctagatgtttcttggatttcttccataaaactttttgagcctggggtttattgtgtagggaaaacataattgctagtgctagaatttaggttttctatcatgtcagatgtcgctatgtatagttaatgtttttctagaaatgtgtctattttgtacttttttcaatttattaacatatatatttcatatcatctttatctaaaaatctcagtctcttctgcagctataatttcggcaataccagttttaatattatttatttggcttctttctttaatttctatttttcctgttcattttaattataaattaaataatccttggctttgttaagtctgcattattttgatactttatgttttttattatttatttttatcttctttgtccttattctcttttctttacacacacacacacacaatatttcagatagatgcttattttgttgattttcagcctttcttcttttcaaccatgagaagttaaggctataaattgccccctcaatgcttttagaatcacatttcaaaaatgttgaaaatttatattagtggtaatttagctacaattgtcttctaattatgatttcttttttacccataggttatttaaaagatagttttaataaatacaaatgtatttattttacatatttttattactgaattactaatttatgtagatgtcagagaatgtgggtatactaatagattcttttgtaaaatttatcgaaaccttctttaatgcctagtatatggcccatttttaaagtttcatttgttattaaaaataatgtatgttctacaacttaacagtagtagtagtatcaaacctatacctttggtataggtttttatatatgtccactggaaagtttaagtatattttgatatattcagtatcttattgagataggatattgtgtctgctaatctatcaattgttgacaataatgtgtttaaatcttctacagtgatgtttgttaaattatttttgtacgtctgcgattttttaatttatattttaaactatgtagctaggtacatgcatatttagaattgctacatcttcttagtaaattgaacctttataattactgtatagtggccttctttatagctagtgtatttttgccttaatgctttatgatctggtcaggcaccagattttatctcctaactcctatagactctttaaaactcttaaaatcttaaaatataggatccagaccacaagcaatttacagacgctccaaaacaaatgtggattttaaagctttcttacatcaatagactcatgctttcttatcttatctgattgttgaatgattctatttctttttccatgttatcaccacattttaaaaagagtttgttttgttttgttttgtttttgttatccgtgtttttagggagtagttttctgaaattccagtcagctaaaatcctgaaataggaaaccaactgttattcttacaacttccactatgcaacctctctctcgctagaaaaatagtatttgcaaatatcaaaatataatcccctttcctgttaggtgagctgcatgcaattaaactaaacataatttatattttaaaaattattttttgccattattttcttgagccagtgagttctcttatttttgcccctgtgccttagtgtatgtgtctgtgtgtgtgtgtgtgtgtgtcacatgtgcgtgcacacacatatacaatgtttgttgtatttttttctggttaactgagactaaacttgaaatttaaagctggccttccatgaaaattatttaatgatgcaatgcaaagacaaattgctttctacatcaattttctatgcaagtacctataaatgttagataactaaattatcccagagttttcttcaggaaatatcagccttttattcaagtatatgattttctataaagtattgctattataatcttttaatgctaggtgaatccacatcaagcattcaatatttgttggatgatacaattaaatttctctctgcttaggttgagtttacattgtctttaaaaatgtcttttaggcagggtgtagtggctcacacctgtaatcccaaaacttgatgaggctgaggtgggaggatcacttgaggccaggagttcatgaccaacctggcaaacatggcaaaaccccacctctactaaaaatacaaacattagccaggcatagtggcacacatctgtaatctcaggactagagtggacgaggcaggagaatctcctgtacctgggaggcagaggttgcagtgagctgagatcacaacactgcactacagcctgggctacaggctgagactctgtctcaaaaaaaaaaaaaaaaaaaaaaaattaatatcacaaacatggtaaacataaaaattatcacagtgtaaaggaaaaagtaatatatactcacaaatataaacagacagtgggagtggggacaaatttgcattcatattgaatcaagacatttatatcgcctctatacaaaaacaagatgaactaaactaaattaaagggatgttaatctagaaattaaatgtatcatgtcagctagttttaatatatggatgctttgggcattgtaagattaaactttctgaatcataacagaatgaagctcattaaaataaaataaacttacccaaatggaagatgacctaaaagaataatttttgggcaaaatattataaaaatagctacacagatattagaaaatataacaagcaaaatttgatttttactttggtgtacaatgtcccaacattctgaataatacatacccttttctcttgaaaaatatgtatatactgaatgactttaaaacaaatctagaaattaaatgtatcatattttccatactgtttttgtttcaatcagattttttaaaagaactttcatctctaaatttaggaatctctttttacaattttttcatttacagctacctcaaaaaatagtatgtattcctaaaataatatagtataaatttattttgaacatcaaaaagaatctgagctcacctatagcccacaaatggaaatgagaaactcatgtgttttcatatttataaacacatattacatcttatacaacacattatgaaaaagaaaataaataaaagcatgctaatataatttgaatgaacaagaaatgctggaaatatttgaattctacctttcaaccacattaattagagcttccactaaatcatttccagactcatataactgtaataatttcacacctataattatctctccatgttccctgctatgtttattttacttaaattagacatatttcagtatgttctgaagattttgccttatattcaacattacatatttgtttaaactcctcccttcatgaatgtactctcctctgattctataggaccacccctcatctatttttatgcactagctccattatgaaacctttcaaaatcataaaaagtagaaaattttattcatagttcacagttgaagaaaaggcagctcataaccttgaagcctatatcctactgtgatactctttgtaaatgatagtatgagaattaagcctttatttaaaactttttcatgtcaatgtcagttctgtctccaaaacttaaatggcattattaatgaatgtgttacaggcattacaatgcagtgattaagaatacagccgctaataccagcttccttgagtttgaaacctagctcatggctccctcctcctttgttttgggaaaattacttacactttatgtctcagcttccttattggtaaaaaatgtataatatgcaagtctaccttatagaattggtggaagcattaaataatgcagttgtgaaacatacaaaagagtatctagtggatggtaagtgtaaaagtagtattaactattagtatctactatatggggttgtgggttgaagtccactaataatttgtgtcaacattactctggtaagagttcatggcaatgacttgttgattctaggaaatttctgttcatcaatgtattgtaaaaaataaagaacttcactgttttttatttttccatgaaatgcctacagatcaatttactgaagacaatagtctgcttatttgtgcaaacagttcacttatgaaacaagtttatttcttcactatacctaccaattctaaattattatgtcatggattttttccattcctaatcagttccttctcttgaaagatctgcattacacaacttgagaccagactccaaagctccataaatatcccattctgacctcttttaaacacttctaagattctgtcagggtggtgtgctttttgattacaatgtattccaataaattcaggtgtactttacttacagattatctggtgatatattgaggagagcaatgaactgtaagcaccactgtgttctagctgagatcccctctctgatgtgtcttaagatccttgacttgcaaaatgaatgctctactggggaagccttgagagactctgcaactgtgatggtggggtctaggtattgatattgtgtctcaactttggtcactgtcaagttcccaaatgttagttttattttgtctaatgggaaatagaatctattttaggactttttctgtgatctgtttagattggaaaatgttaatgtttgatttaaatctgctttattgctaaattactcaattgtgtccttctgtcctcatttttgtgagtctctaagaggaggtttatacaaaaatggccagacatggatcctgataagttgattcctagagccagctctggaattaataacttcagaaggttcctcctcggactggtatccctcacataaattttccctggagtcaactcttcaaaaccttaggcaaatgtttcttattcttatcctgttcagtctttgagagtcaggttctgtataaaatctcccattaaaaaagtttatgttatccaagaacctcagattatcgaggctgggattaaaaaaaaaatcattaacttggaggcctgaaaacactatgcaaaagcaacactttctactgcttgttgctagattctcatggctttgaatcacactaagtgtatgccttctgtaggctgaacccttgcctcatatatgtatctacattataaatctaatttccatgactgtctttcaaaaaggcataatttctttacaaataatttacagttaagaggctacttggtgaaatttttatattaacagaagttgttaatttgagaggagtcttaaaatggaaaggaggtaaaattcctattacaatgtgaacttaatggccttttccctactttttattttcccctgtctttgtttactcaatacccttttgccttactccattttctcacctggccccttacctcctggattacacaacctgagtttcacaaatctcaattgcctcttaaagttaagtcctctttagacatcaacaagcttcttatagtttatttttagccttcattctcagtctgaactaagaatcaatgtaaaagtctggacaaagtacagaggaatttagaatcattctaacaacatatatcgtaggtttcccagatctacgtaagtgattcttatgttagtaagaaaattaatgtaaaaaaattggattaaaaaatgaagacttaggataatctaaggtgaatgaaagaccctgaatattagagaaaaccagaagtatttaggaaagctatacacagtggagaaaatattttggaggctaccccaagactttcctgaaaataggttggacttccatctcattataaaaagagaaagaatgaatcaatttgaaactttaggaacaggacctccaacacctttagaaaatattcaggagtagatcttgagacagacaggacctaaaccctctcatcatttttgcaaagagccctaaaccaaaattagggaatgtaaaatggaaaaagtacatcggaaaatgacttcattgacaaacagaactccaattcctaactgaacattttgaaaaagtcatggaataaaaacagaataagcctctgaataagttaacagccttacagatgaaacaactggctatttctcctcaatttatcaagtatcagaggaggaagcttcctgaatacaaacattgatagataactgtaagcagaaaggacattggaaaaagattcataaaggacattggaaaatagctattctgcactaactgtgaaactaaaagaaaatttttaaaaaggaaggatgtgataagggaagttgatgctgatctgtggggtcattaattccctgatgtcccatttctctaaacattaacagacagtatcaaggtttctgattgattcaggcacagtaatatagtttacagaccctgccacacatgcattcagtcactcccctagagtcaataaagtatttaggagatgagtatttgcaaaaatctacagattattgtgtatcactctatagcttttgccctcagatctttaacatcgtttgctcatttgagacagcacttcccctcatttaataggtagggatttcctatgtaaacagaattgctaatttaagtgctctcttgatgggctttctcttgagatctctaaagaatcacctattcagcagggcacggtggctcacgcctgtaatcccaacactgtgggaggccgaggcgggcagatcacgagctcaggagtttgagaccagcctgaccaacacggtgaaaccccctctctactaaaaatacaaaaaaaaaaaattggccgggtgtggtggcaggcacctgtaatcccagctactcaggaggctgaggcaggagaatagcttgaacccaggaggcagaggttgcattgaactgagatcatgccactgcactccagcctgggtgacagagcgagactctgtctcaaaaaaaaaaaaaaaaaagaaaagaaaagaaaaaagaaaaaggaaaaaaaagaatcacccattcataatcatatcacacctaatttggactatggagtacaaggagcctggtatcgacatcaaactcaaattgaagatctactgatattggctgaattattggggaagaacacctcacatttctcactgacccatttaagcctccatctacacttgccctctacaaccaaagggaaaggacaaaagccagcagttgtgtctaacagaaaaataattacgaatactatgcactagtccttggaacactcctattcttctgatcaagagatcccagtgggctggggtacccatttatttcagaccttgcaactataaataaaatatttagccctgttttcctgtggtgccaaaattctatattattttaatttccatgctacctgagattatgtattttagcattctaaatccatgttctgctgtttgtattgtcccttttagatcataatagaaaatactcattagtctttctctagaaaaatcaatgatgtacctggacagttttactgcagaagtgtactgaggcacccaggtaccttatacaagtcttctgctagacactgaaggaccttgaatctctctataattctactcttatccaacatgcagacaatttttgctatgttgtcaagatgagataatttttcaggttgattccaactactacttatagctcagaaagtatataatgtgttcaaagaaaaattagaattttgtaagaagaaaatgcactatttagaacatgatttataatccatcactctggagagattacaaaacactttttttttttctaaaactgttaagaaaatatacttattttaagagactttttttttttcggctgtagggggtgaattttttttttttttcagtgagagcaggttaattaggaaagtaaaggaataaagaatggccactccatagagatttcataggttattacatgcaatgggttcccaatattactgaaattactgtacctctaaattttaacttagttgttagtaactcaatctctttgttgtattataagcataattagctgtaggggtgtgtctctgtgtgccctgggagtggcagggttggggttgggggtgggaggagtaggaggctgtgtgatttaaaattaattatttggccttcctaattatcttagatctttttaccaatttgtgcatgatcaatttggacaagccattggtgttttgactttactttatcagaatctttaaagactattcatctttaaagttatccataaatttttcatagactcagtggcaaaaggctactcaccttgtctaagggcaacagccagactagtgggtaattacagtgggtaatcttctgatgtttctgcattatattctctactcttcacctaattacctctgaatgtcaccaaaactgtacagtaaattttaatcacacaaggaaggtattttggacaatgataagtctttgggtagattctaaagaccagtgttaggtttgcaaaacaaaagtctattgggtgtggccaacaaattataccaaaaaattgttatctttgtaaatttagacactatactttcagaatggtgcctaatattactcatggatgatttgggcacatttccccctcaaaccctagaaaaagagaactctagataatttcattcaagaaagagaaaaacagggcctcattttgagatatacaacattactcatgtctaattctgaatagttttctcctgtctttaaatcatactatctgtgcttcagatattatcaggaacactgaacaatttcagtgaggccatagaaatcatcacctggagatttcataatactgaggaggtggtacttcttcaaaacatagcagtacgagaaataatattggcctgtcaggatgaaacatgaggcattttacaggaggaaagtttactcatattcctatagttctttctgtttttattttattaagaaaatatgggaaattttttaaaaattacaagacaaggtgataaatctagtattcccacatctgaccattaaaactttttggtttggtcatgggttccattgtattgctttaatttaggcatttttggctcttggcttagaatgtaaaatacttctgttagtatctgtctgtgattcagcattcaaatatcaggttttcataatcaaaaatatttctatgtagccactctgatatgacaataaatgatcatgcagccaaaacaaaaacaaacaaacaaacaaacataaaaacctaatgtatatgatagttgaaatgatcccaccagaaatctgatatgcaatcaggaccctgaagacagtggtattgattttgattgattatttgtgcagatgattattatttatcctccagcttaggttgaaaaatgactacaagagagttctgagaaataagaaaccacctatgttaacaaaactttttattgtttgcttcaaaaatattttctatgaaaggataaaatcataagccaactaattttattattttcttcaggaaatttccacagatcaatttattagagacaacactctgctcatctgaataaataatttatcaaacaacagtttacttattgaggctgcttgtttccacatgcatctcgctctgcccaccagtcttaaattactatatcataaactctgtataatctcagttaattccataccttaaatgactcagtttaaatcactttaccacaatccccacacacgttaagtacctcagttttgacttccctcttctgaaacattgctatatcattgtcaaggtgatgtttactcttacctattgtagtaacttctataacatttaaattttattactacattatcattcttggactaaacagttaaattgtagttattgttctttcttctattactattaatactactattttggtatttctccatcatttactgttgtgggaaaatgtgagaaatatgactgtatatattttattttattcacccaaactagaatatttgtctcttttatacctctccaaagaccccacttctatttttaaaaattagttgatatactattttgtatacatgtttgtttctatctgcttatttagtttacatgtttccttttattctttaccatctaagtactcaattcaaataagatacagagataaggtcagtttctgatagccaaagaatagcaataggtttggcacaagaattgcgcaggttcctcatgaatttgactctaagaaattgtgaaatctcggggaagacacacgaaggcctctgcatcccagttttcccttatctcacttttctcttctcttttcttttatcatatgtatgctatgtgagaattacaataattaaaatatgtaacatatgagaattaaaatatataataaggatagagcttactacaacacctagcacatcctaagtgctcaataataatccttattactttgtaatgctcctgtgagtctgaaaaataatgtatttaaggctcctagtagatactcttttaacaggaactactaatcttgttattgatattaatatagcttggctatattaatccaggtggatcaacatcctctgtataaatgaaaccacctatttacaaggtattccacaataattcaatgttgcatcttcagcaagaacaagccataggtctgaaaatgtaagtgcaaggcattgagtatgcatttgtgtatgtggtctgattattgctctgaagataaacaactactgagaccatatattctgaatcctcttacaggaatacagtatatgattgaattttttttctatctacagcttgcaatgactaaaaaaatgttggtttgttcccacaataaattccctccaagaccacaaatgagaaataccactttacatgtgcataccttaatgatgacctcttcttgaaaacaaaacaagcatgctttagacagaattagcttctcactgtagagatgactggcttaaatgagaattctgtctttgctctaataagtttatttgacatcttggtttgtcttatagtaaaaaaaaaaaaaaaaaaaaaaaagaaaagaaaaggtggtttgctccctttccccatggtgttaaattaattccatgagcagttttgttactctacacaataatacagtgtgtccccttatttatgtcataatgtgtcataatgtctattgggaaaagagatcaatttatgtaactcaatttgttgtctttaaaggagtttaacattgtatttgagctggacattggttgccttgagctttgagaatttaggctgattcatcatgtgaacctgttgtagaaatgaccttctctaggcttctgctttagtttttacatgaatggtcctaatgtccgcctatagaagattttgtgcacatgatgaccttagggttaatctacatcgggaaacacttaaattaccataataatgttctctcgaaattcttaagtatgattaatgttggttatgtatcggcctagatagagatttctaaaagtgagtgttcctgagtgctttggatgatactttgtaagcatatagacatgaaactatttaaaatcattgcataatgttgcaatatatcaaattattttcctcttgacgtatatttagattgttttttgtcactcattaaaagaatgctacaaggagttttttttatgtacaacactttgtgaccatataaaggcagttgcctagatttggaatttgtatataaaaaatatagatacacacttttgttaaaagcttaaaatttgccctttcaaaagaatgtacatatttaatttttcaataatcatgtataaaggtgtcagctgtattttcataagtttaaatgaaaataactgcttgcgttatagatttttcttttttatgttataaaataaaacttgctctaatttatgggtagaaagaatatgccttacaaatttaattaaaagttttaaatgttaggatataatgaaaatcaccccattcttttttatttccgaaacaagaaagggatgttaagtttttcaaaattgattcacatgagctaacattaaaaccattggatgggttgtgtttgtgtccttgccagttagtaactttattataaaatctctaaatctattaccttctgtaaaatgattttgaataagcatctgtgtaaaaattgttttctttttcactggattagaaactctgttaatgtgaacacagtaaatgaacttaaagaaatagtcaagagtaagaaaatatgagaaaataacttttaaaaataagttggcaagtcaagttctatggaaaaattaaaagacgcttaaacatcttaagtaaaatttcaacatgcctgttacgacacatccccaggaagtttattttcataatatttgatgtgattttaaggtcatcatttaagagaaaataaaaaaggtcatgaaagggattttccacatgagggcttccaattgaaaatatttacatataaaatgttaattgtagaaatacaatccaataatgaacaaagttcaaaagtgagtaaaccctgaagcaagacaaggcaagatatgtaatatctatcaataaaactaaaacattttcaaacatttggtgggaaagactatcttagttaatcagggacttctggcttaaggaaagaaagcaacttgtcagatttaatcaaattcatgggaatcaatagaattgttttcttttgttggttttcccagatatatgtaccaatcagcagtggtgataacttagatgaaaggaattggtggaaggagaaaggtctcttcaaaataggatattatctcacttcctaggtttcataatctctaataaagcactcctaatttaaattgaaaaacatcactgtttatttcatgcaataaattaaatcaaaatatataactggtttgatatttgtttccaagtatttgtcagtctttagtcaacaattcattaaaatgaaaaaaaccttaattctgatttacaaaatgaaaactatcaatggtaattattattattattattatttctatttttagtagcgacagggtttcaccatgtcagccaggatggtttcgatctcctgacctcattatctgcccaccttggcctcccaaagtgctgggattacaggcatgagccaccgcacccagctttttttttttttttttttttttttcctgagattgtatctccctctattgcccaggctggaatgcagtggtgtgatcttggttcactgcaacctctgcctcccaagttcaagggattctcctgcctcaacctcccaagtagctgtgaatacaggcgcctaccaccacacccagctaatttttgtgtttttagtagaaatgaggtttcaccatgtttgccaggctggtctcaaactcttgacctcaagtgattcacctgccttggactcccaaagtgctgggattacaggcatgagccactgtgcctggcctatcaatggtaataccttattgtagtatgtaaggattgtataattctattggatcttgaaaggttggtaagaaatcactgaaatgagtaagaatggaattcagtaactcaatattgatatcaagaaattagaagagaaaacaatacattgtgcataatgaagccaaagataagttaattattccttttatgaaaggtctctcatggcatacaaagtcatgtgatacacagtagcacacctcatctcttacatatgaaattaactaggaaagtgtgtttttcaaaatgggcatgaagacattagtttcacaacatacttatatataatacctagatatacatacatgtaacatatacaagtatacatagcacatgcttcatatatatgtacatatatgaaatctcactctcagtctctctctcttgatatacagacagaaagacagagaggtagagtttcatgtatagagagctatatattataactctttatatatagcacggaatgattgaaaccaaatcatttcaggtccaaaaacatacaagtaagggccccttttgtcagtttagttaggtcaatattatacccacctctctatttgaacttgtctacatgaactgtctctatgaatttcagtaaagtggtaacatgaactctaatgtttgttggacttaaccttttaggagcaatacggaacactattaaatgtttatttactcatgtataggagataaaagatagtgaattcttagcaggcttcaaactaacttttgagcttgaaggtacttatcaaaacttataaatgataaaggaaataaaaaaagtgctatcaaggtggatttttaaaacaatttacattttgcttatcattttgatcttcctcttatgatctatacatttgaaaaataaatacgtctatattattgcccaggttttgaaataagcccagttactaataatgccacaagctaagactgagtctactgttaccataaagccagattagcaatccaagggcctggggaacttccgcttttttagcgcttttcctctggtgggtttgttcttgcatttgaacaaagctatgggtttacatgagtaattgcctaagtatctggacttgccgggtatcactgacaacaggcccaaattataattaactcaaagtaccgtgttaactttttcagccaaaaatacatagaccataagatattaggctttctggaagagtctaagttattggctctggcagcaaaagagtaacatattaactgaagagtaaagacaaagcttcagacaaaggttctctataaataattgtgtcaagatgtcattacatcagtggaatgtagctcaattaacaatatcttttaaaggacatcaccttgccctaccaagagaaggtagctgttaaattgtggctccagcttgaggtttgataatgtggcagctataggatccatttcctgttctagttgtgtatattgtggtaataagaaaagcaacagagccccaccataaccaaatacttttaaaaatacaaccttaccctaagaaattaagtaaaaacaaatcttattcctctggtcagtgttgaagaaaaaaacaaacattcgacttcgactggttgcctcacagggggagaaaaataatagtgcataaaagcaaagcaaaacaaacaaaaaaccttagtgagcctagctgacttgttctcaagaacacagaggaacatggaggagaggcaaggctgttgcctagttctaaattaattaattataaagaattacccccaattaaacactaactcactgcactttttttgtagattccttgtttttcccccccacatcatactgaatccaccaaaattatcatcaaaattttaaagcttgataaattattttgtctatccacttcaaatgattatacatcagacaagatccctaacgacatatcagaatgaattacatatctggatatgaaagaactaggatgtctaatttaaggcaaaggtggagtttgcaatattttagtgagaggattgagaagtatggctaaataggaattaaagtcagcataatccttacattaacggaattttattaaaattgtaccatgttatgagtagcagaaagtatttggaaagctgtttccatgtttacctttagtgtagtagataaaggctatctcaaataaaatgttcagtctaaaatgacggcacattttttcttacaatgattaattttagaaaaatctataatccaatttactgcttgaatttacatggttgcatataaatgatgtgactcctggtgtgaattaggtggcaaattagaaaagggctttttatttttattgttttttagtgagaaagcaggtatcaatataactcagagaaatattccctacatcttagagtgagattaataaatatgtctttgttatcaataaaatgggaatataattctatctctttgtattgttataaagattaagttgaaaaaattatgggaagtccatagtataaaactgagtaccctcaaaaaattactctacaaattattgtttatttctatattattttatcatgtatcaatacatattacattttcaaaaatataaaaatacctcattcttggaaaaaaatgaacatttaagagagacaatatgtcactttctcttcagcaatgtcaagagaaaggaaattttaaacagaaaactgcagatgtctattcctgtaacacaagtggatgcattgatctagcaaaatgagatgaacccaaaccattataagcaataaactcacttcattcacttggattctaatcacatctttagaattgaaatttggcttccaacttccatgttcctacaaggagaaaatgtaccacctaatattcaaacattccaacacctttcctttgtcaattatatttcttttattataaatcaacaaatttgcatgttgtcacatagttgtcttgcatgggtttggttactgtgatcccttctcctgactccaatcacatccagctatggagacaaatataaatttcttgatctgtgaatcaacctctggtccttgatttccccagacaagtatttctacccactgaggcctgaccttaacagccagccagtctctttagacagcaattatagccagtctgtttctaactattgcactgtatttataggttgaaactttttaagtagaaactagatatcaacagggctgcctagggtatttctgaatgatgaagacaatgaggatgatgatgatgtcaacaatgggagagaaaattgtctggaaagagcatgctgttactttctggaattatgaaaatattttattccttgtttggggtggtatttacctagctgtttgcaattgtgaaaactcatgaaattaaaaacttaatttctcgtgttttcttttatgcagattatatctcaatatgttcaggcagtagaaataactatgagatttcttcttcttaaataaaatggaaggccaggcgcggtggctcatgcctgtaatcccagcactttgggaggccaaggcaggtggatcacttgaggttgggagtttgagaccagcctgaccaacctggagaaaccccatctctactaaaagtacaaaattagccaggtgtggtgatgcatgcctgtaatcccagctacttgggaggctgaggcagtagaatcgtttgaaactgggaagcggagtttgcagcgagctgagatcgtgccatttcactccagcctgggcaacaagagtgaaatttcatctcaataaataaatacatacatacatacataaaatggattgtgaagatttgaatatggactattcaatttgtggtataattttttgtcatatttgaagaattttcttcacagagaagctttaggtttacaaaaaaaatgggaggaaggtatagatattttccatatactcctgtccccacccatgcataacttgtattatcagcatcccccaccaacgtggtacacttgttacagttgatgaaacttcatttacacatcattatcactcaaatactagtttatattagggtttattctttgtgttttacactctgtggctttgactaaatgtataatgagatgtttctatcattatagtatcatacagacttattttcactgaccaaaaaatcctctgttctctgccgattcatttttccctgaccacaaccccctgacaatcactggtgttttcactttctctatagttctgcctttcacagaatgtcaaataggtgaaatcatagcgtatacagccttgtcatattgcctttttccatttggtattttgaatttacagtttgttcatgtcttttcaaggcttgatagtacacttacttttagcactgaataatagtccattgtctgaaggtaccacagtttatttatccattcacttactgtagaccctcttggttgttccctcccaagttttgaaaattgtgaataaagatgctgtaaacatctatgtgcagatggatgttttcagcttctttgggtaaataccaaggagaatgaccgctggattttatagtaaaagcatctttagttttgtaagaaactttcagattgtcttccaaaggcactgtgtcattttgcagtccccagcaatggatgggacttcttcttgctccacatgttcaacagcatttggtgtcatcagggtttagaattttggtcattctaataggtgtgtagtgttatctcattattatttaaatttatatccccttgataacatctgatgtgggacatcttttcatgtgcttatttgctctctgtatatcttctttggttaggtgactgttacggtttttggcccatttttaaaatgagtggtttgttttcttattgttaacttttaacagatctttgtatattttgcatagcagtccttaatcagatgtgtcttttgtgagtattttctcccagtttgtagcttgtcttctcattcatttgacactgtctttctcagggaagaagtttttaatttcaatgaaggtcagattatcaatctttaaatgaatcctacttttgatgttgtatccaaaaagtcattgccatactcaaggtcacctaagtataattgtttttaatagaaatcatatttttgaaaaagaaatatagttaaattatatcatttcacattttttatcaatgcttttagctcttccaaaccattatgaaatagttgtatttttattgtgttataaaatcaaatcataattaagcttttcaaatgcaaagctaaaaaatgaaatagcataaccttttgaatcgaattgaatagttcaagatctctatgctctatgttcaagcattatgttaaaactgctgtcttactatctacagaattttctaattagcctaaagagatttttataatttacctataaatatattttgagagggagtgataataaaatcaaaataggtcaagatatccaagtaactttattgagatgtcaagtggcatccagcagaaggtgaagaagtcacagagttacatcatagaaggccttcctgctgtgctatttccttcaacagaaaaagaagctttcatcctctaaggcttccagcatctgctgaaactactttgagtaattcaatcttgtaaaaattatttctgctacgtatacttatctaacacataagtatacttataaaaaaataaaaccttgggcccacttgagaaactaaattatatttagtaaggagatcaattttgcacaccttggcttattgtgctctatttaaaaacatattttcaaaacgtagctcttttttttccctgtcatacacttggcttcagtcattttgctgtaattaaacatgataagtacttccccatgttagtaaggcctgtgaatttccttctgcttgaaatggctcatcttccagatgcctacatggcacaaggcctcctttagttcctgtctctactcatgcactgcatcactttctccaagaaatctacttcaccactgtctaaaatagcccaccacgcattccctcacatcttatcccctccctttttgtacataatacatatcactacctgatatattacatcttcatttgtttattcaaaaaatggactttgtagacttttaaaaaactgtaaaatatagtcttcaacaaatagtatgctttgtttctattttattgtggtataatttacattcagtgaattgcactgatcttaaatattactgttcaacagttttgatgaatggctacaccagtgaaacctgctatactgagaggacaaagagcacatatacttctcttccccaaccactatctaccccaccctttccataaaggaatacaggtagcctgatttatttcactattgtttacctgttacagaacttcatataaatgaaataatacagtatatcaagtttatgctacatgtatattatctaatggtacctttttctattttaaatatatagaatagcaaatatgagaatatttttaaactcatcatcatcattctaaattgtaaactcaatcatcaataaaaattaagatcttagtaaacctcacaaaccattttgtaaaaaatttttgattgccattttgtagtctgtaatatatgatttatttttgaaatgtgggaaacagattcaaaacctagtttcaaggaataatctataaaaattgctctaatataattttaaattatttattttggaacaatcataatgttttcagagaccatagaattttagcacaatatcctgatatttaaaaaataaaagaaaaaaagcaaaacccaagaaattaaaaaactacatatgctaatacagagtcaatatatacttggatagtttgttattactattgaactttttataaaattaaagtatatatatgaaaacagagaatttactaaaaactatactgtgaagaaaatatgtaaagcaatattcttgcacaataggccattcaattatcggtgggttttaatctcattttttatttgatcatgcttattgcttaatggtcatagaaatgttcctttatcaattttcatgggaaagttttgcagcagagaagttccctagaatcaacatgtcttagatgtttgtaaaataagtgatttctttttccaaaatgttaaaatcattagtacacaaaagtcattactacgttaatttattttaaagtgttccatttcagtaagcaggtattaaggaagttggtgttgggataagataattgtgccaaagtaaattcttaatggagttcataagagaggaaatacagtaactgttctactccaaggttggctttgggggatttttcaaaccaacttaaaagtcttggatgttatatctgactggaaattatttctactccctgagaatgaacaacatgctggcaacagtgaaataaggaagcttgaaaaagggaatgagttattctatgaaacagtctgtcctatacatcaagattcttttagtttctcactcaagactttaagatacacaaaaatcttgccgcaagatttctcgtaggtggtgtgacctcagtatacgttgaagtcagagattacattgggttctaacaactcagggtttttagataagatctaaagttaaaagctataaatcagacctctagaggagggctacattggtccaaattttcatgaggaatagactctctttgccaatacaattaggggtgtgtgtgtgtgtgtgtctgtgtgtgtgtgtgtttgtgtgaatgcgtttatctcactgtctcgggagtatgtaattgtgtgataggtggaaattcataaggagaatggatcaactacaagtggtcatgggtagtgccatgtggaaccatactggagcctaaggcaaaaggaaagtgtctggctatatacgtgacttcctgtgctttttaatggttatttttctcagaacacaaaaatagttttaaaaaataatgaaaacctggaaagtagagtattgaaacatacaatctagtttttaggtttaaatatctcatttatacctaaacctgaatatattataatattttcaaaatgtactcttttgcttactcatttttaattgagagaattgctatgtttgacaatttctcttgacaaatgtcttgattaacttttacttaatttcaacttactgatcctttcttttagattttgataaactatttcttgtgggattttcacattggatttctattttttaaatattgcattggaatatatttattctattattaagttgtgttggcattccttaaattctgcacccgaagaaagtgcttcacttgtgtccattttttttcctttcttttttgagatggagtctctctctgttgccaggctggagtgcagtggcgtgatctcctctcactgcaacctcggcctccaggattcaagcaattctcctgcctcagcctcctgagtagctgggatgcaggcatgtgccaccacgcctggctatttttttttttcttttttttttgtatttttagtagagacggagtttcaccctgttgctcaggctggtcttgagctcctggcctcacgattcacctgcctccgcctcccaaagtgctgggattacaggtgtgagccactgtgcccggcctcacttgcatcattctagttgcagccctgatgatgaattcttaggtttgaccttggattgtgtgtatccaaagtgaggcaaaagccaccagaaatgagatcaaagaactgagagcccaatgccctaaaacagactttccatgtagacagcaaatgcacaacgattataagaggaactgatgtagagtggagggcctcgagccagaaatttgaacgaggagaaactactggcaagacaggagatgcaagcaacaacaaagttttggggtacctggggcttaaaagagcagagatcttggcaaatgagaagataccagtcccaccctcttgctctgaggtgctgaagtacgagacaatagacaaaatttgaaaaaaaaaaaaaaaaaaaaaaaaagctgcaaagaaatggtttcctggaggaaagcatgaatgtcttaaatataatgggctttctgttcagtatttcagtatctggtaaatctcatcattagaagcaatgcagaaaattaatatattaccttcacaataccctcattagaacacaattataacaaccgaaaaggcaatgtactaacccatgaggactcacttaactcattacaatggtttagtgagctatattgagcttaaaacatatgctggaatggaaataaaaaaatgaaaaccctgaaaaataagctcttcagaggtttagaaatgaaatgggagtgatgaatagctaggagcaaggacatgggagtatacatggtgccaagagagaaggtatcattttactaaacacatacttcacctttttcacatttcatctaattttagcagcttaaaaaaagcttttgtttttagcttagacagaaactcttaggctttggacccatgttccaattctatacatcaaaaattgtgaaaatttctagagggaatgatggcaggacttctcagaaggttggaaaatggagggtgtgagttgaagaacagtggttaatgacaaaaattgtagatgaggtccacctgatcacaaatcatttctaaaaccatatttggggatttggataatttatttgcactcctaaacctctgtttcttcatcaataactgggcataatgatactactcaggtttcttatgagaattagatgacgaaataccgtgtttgtcatgtaggaaggtataataaattttacacctgcctacatgacatatatggtataattaatttataattaataacttgacttttataactaatttactgacaattacttattgagtacctgctatgtgttagggtaaagcaattcaagaacctaactgaactcctgatatttgtggcttttacattctagcaggtgtgccataatgagtgatattatttataacatcaaacgctaggagaatcacaaagagctgactccaccttgagtttgccttctagaaacagaaaaatagcatgaatcctaattttcacaaagtagatgaagatattcaatttgatactttaagaactttccaaatgaactaatttgaaaggaaaacgaaaagagaggattgaaagaattgtcattccctgttcaaatatttaatcttgtcaagttctctttaaatttgagtggaggcaaattcctgaagatcaagcacctggcctatgaaaatgtattaaatatgttttgatgataatttcagtgatcatagaaggcatttccaaatggaatccattacactgcttcaagtattattacaatgagttctagttctttcactaggttaatagattaataagttttattatcttgcttgtagaaagcattgaaaattcccaaggaagaaaaaataagttcaaacaagtaaccagaaaaataaaagagaaaaaggataattcacttctctattgtaatttatgtgtttcttgtatgtgggattagacccagcaaagctaaaagaggcaactaaaagctcagccccagtgctaattttgtatccttgaggaaatcacataccctttcaagttttaattattcatctgcaaatccaagattataaaatgacctcatattctagttgacaatgtttttatatcaatattttatttctttactttttcctcatactgtgccttgcttctcctttatatgtaaagtttacatatcaatttatacatgcgtatatataatttttctatcaatttcaggagtggataaaggatgtctttgacccaaattcttgccaaatctccttccaagagaagtattgcctattatactccaaatgtacaataccatagcattagtttagtaaaaaacaatatgtcttgtttctcctttatttttcttgatgttttcataattttaataaaaaacacttaaccaaagtgctgaggctgtgtttacaataaggtatttttaaattttatctctcctctaccaacacatacacataaatttaggaggaaaataagattaggtagcatcaatttggtgctaatgaaaatgaaaccagcattgatattttctaaatctaataatgcatgcattttgaatagttttctttgactcatttcccctgaaggtgaattcagattctttaggcattttcccaaaaataatttttaactctctgccttgtagtgaaattttccaaattgaaaagccatgtagaatacactgcgaacaattttacagccttcattaatatataagtcaatgtctaggtcacagcttctattaggtagccttatctttatcgatagttttccccaacttcagattctggtaattgcatgacttaccctaccctctctgtgtttaaatcctagattaaaggaggaaaacagcgtcctgtgaacactagcctcaggtgctgacagcatcatcctttgtagcagtccctgcaccttatccttacttagtaaataatcctttatttaaaaaaaatttgtttgagttcattgtagattctggatattagccctttgtcagatgagtaggttgtgaaaattttctcccattgtgtaggttgcctgttcactctgatggtagtttcttttgctttgcagaagctctttagtttaattagatctcatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttgtttttctcaggtttgtcaaagatcagatagttgtagatatgtggcgttatttctgagggctctgttctgttccattgatctatatctctgttttggtaccggtaccatgctgttttggttactgtagccttgtattatagtttgaagtcaggtagtgtgatgcctccagctttgttcttttggcttaggacatgaacagacacttctcaaaagaagacatttatgcagccaaaaaacacgtgaaaaaatgctcatcatcactggccatcagagaaatgcaaatcaaaaccacaatgagataccatctcacaccatttagaatggcaatcattaaaaagtcaggaaactacaggtgctggagaggatgtggagaaataggaacacttttacactgttggtgggactgtaaactagttcaaccattgtggaagtcagtgtggcgattcctcaggggtctagaactagaaataccatttgactcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaactgtggcacatatacaccatggaatactatgcagccataaaaaatgatgagttcatgtcctttgtagggacatggatgatattggaaaacatcattctcagtaaactatcgcaagaacaaaaaaccaagcaccacatattctcactcataggtgggaattgaacaatgagatcacatgcacacaggaaagggaatatcacactctggggactgttgtggggtggggggaggggggagggatagcattgggagatatacctaatgctagatgacgagttagtgggtgcagtgcaccagcatggcacgtgtatacatatgtaactaacctgcacaatgtacacatgtaccctaaaacttaaagtataataaaaaaaaaaactgaaattggcctgttttattatttctcgtcagttctttgatttaataaaccagataaaatctcattataactaattcctaatattagccaagttattttattaaaaataactaagacagaaaaaaattggcttcaatatttggttataattttagaatatgagattacaaagaaattgtattgtactcatgatgttggtagcagggtttaacaatatatcttgggaaataaaatatttccatctatatcagaatgatatctagatgcttgtgtttctcttaatcttttaaagcttctttttaaatgtcttgttctactgggcttactctacagtgcaggtagatatattgaaaattcctaatttttcaatatatgaaagaaaaaagcaaagaaaagaaatatcagaacaaaacaggtatttagtaataaacaagtcaactgctttcttaaaactagagttgtaaattagttctcagacacttccacataagagtcacatgacacttactaattttaacagaaggctagccctgaagcagtgacacatgtttttgtgccatatttaattccacacaacattgattttaatgggaattgctagggagtaactacagttttgcccatggtcatcaaagtcactacaacatgtcttcaggaactatatagtcaattcatcgccctggccaatggccaatttgtaagttagatacatatcttttaccttgttattaaacaaacaaacaaacaaacaaacaagctctattcttctaagtgagttggttacatttaaattatcatttatctatgtatgtacgtatgtatccatctatctatctatctacctacctatctatctatatcttttgctgatgtagaactgctgcttttccagttgtatccaagtaaagttccatatcaatgcaatgatcccttttgtacagttattaagtataagttttctataaaaattagcattggatatgtagactactcatgtagttagcgatttaagttaagaccagacttggagaaataaatattaagtcagaatgaaaatcactgatcagctgacatcctcctttaaaagtgagaatatttcccacagaatactaatcatttaaagacaacttgctgtaaatgaaagacaaagatgaataaagccaaacactggtatgctgcagggcaagatctttgtatatattctatccggtatttgtttttgaaaattatctttattcatgtcatgaaattatcaaagaaaagagtgataaaggatctctgggttatgacagcacttctcctgcgatttttttaaatgtaaggaattcagtcagactcagtcagtctaaaaagatgcaaattcttgggaattgtatccagatcagataaaacgttggacactggttaacacagtatggtccacgtcactgactctcacagttacagtgtagtaatacatcagattatttgccaaaaatgtccagtgatgtttgttccattagtactcaaagtaaaagagtgcatctattctctcaagtaatattgaatgtacagtgtgtttcagacatttgtgaaaaaaatacattggtagttccgctcttgaggagtacgcaatctgttaaagaccaccaagttatttttttttactggaagtctttatgcaaagatagagaaaaatgtctacattgatggctgaacacctaggggattgaggtgtagtgaagataaaagaagagcacagaatgtatacctgaaagacctgaagaaaattttaatttcttttttttttttgagacagtctcactctgtccccaggctggagtgcagtgacgcgatctcggctcactgcaacctctgcctactgggttcaagtgattctcctgcctcagccccctgagtagcagggactataggcgtgcaccaccacgcccagctaatttttttttttttttgtaatttttagtagagacggggtttcaccatattggccaggatagtctcgatctcctgaccttacaatacacccgcctcggcctcccaaagtgctgggattacaggcgtgagccaccgctcccggctgaaaattttaatttcttgacccatattcttcagttccctctaaactatgctttcaagaataatgtaaatgcaagttaaaaatgtagtgtccaactgttctcacattaagaaatcagggttacatttggtgagaatacaaaaaaggaaaaaaaaataagtcaagattaattgatcatattaatttcatggtatcactccacgaaaatccagaataattaaattaaaaacaaaagttcaaggcaaagcattgctacaaaaatttcttataataattaatttactggttatgccccttacaggagtcaggaaacaggttagattccttacccagtgtgcccactaatagtccctttataaaaccatctcctggaggcactagtcctccctcagaagaacagtaggtgaaggagttctctggtttctggccttgaggccagttcctgtttaagcctaaataaatgaataaataaataaataaataaataaataaataaataaataaatattcctcttccaagaggcatctggcagttccccttatccctgatgagtccttcttaagaccatgtcgaattaagttaaatgaatcgaaagtaaattaggattaaattgtataacattgattcatacattgccttggatgatttatatacatttggaaagtttaatactttatcacaatggttaagttttaatgcaaaataaaattatctatgtagtgttttaaaatgttgattagcctactccttagcctttttgaagtactttttaaatttctggtgtaaattctggcatgtagttctttaaaaaaatcctgcaggaagtttttgtgcctttcaaagtttgagggcccctaatcttgggcatacaaatcagtctttcttctgattaatgtggcattgtccatcatttttataaatatgagtctcaaacccttgattgataaagaaaatgctcattataacattgtgacatttggaaaaatttaatattttgtatttttaatataaattaattctttcagaactattaaccttataggaaaacactagagagaatgattttagcagatttttgtaagaactcatctcctaaggtttaagaaatacctacatggtttaaaatagtaattataaacatagtaattttaaaataagatactattttgtttaggtcttccaagtcagttagctggtgtcagttttatggtcagaatgacaaaaatatataataaaaatgtgcagctcatttagctgttgaaggctaatgaacaattaaagcattccataagaacttaatctcacccattttttagtcctatttaaatctgctcctcctttccacaaagttcgaatggcataaattatttaagtcatatacaaagggaacccaatcaggctggcagaagacttctcagtagaaatcttgcaagccagaagggattaggggcttattttcaacactctaaaagaacttaaactaataatttcatattcctccaaacttagctttgtaaggaagggataaataaagtattttctagacaagcaactgacaagggaatttgtaatcactagaccagctttacaaggcaacctcagcggagtcctaaacatggaaaaaaaggacaatttctgccaccacgagaacacaattaaatacatagtctgcagaccctataaagcaaccatataatagaaactacaaagcaaccagctagcaatttcacaatgggatcaaaacctcacatataaatattaaccttgaatttacatggtccaaacaccccacttagaaggcacagacttgcaagttgtataaaacacaaagactcatccatctgctgtcttcaagagacagaactcccatgtaacaacacccatagttcaaggtaaagggttggagaaagatgtatcatgcaaatgaaaaacaaaaaagaacaacagtcacttgtgttagataagacagaatttaaaccaataataataaaaaaggataaagaatgtcattaaataatgacaaagggttcaactcaacaagtagacttaactatcttaaatatgcacacactcaatattggagcacccaattcataaaacaaatacttcaaaacctataaaaagacttaggcacaaaacaataatgggagacctcaacacatcaatgacagcattagagagatcatcaatgcaaaataacaaaataatcctggacttaaatttgacacttcaccagttggacctagtagacgttacagagcactctacccatcaaccacagaatatacattcctctcatctgcacacagaacatactctaagggtgaccacatgctcagccataaagcaagtctcaataaacacaaaaaattaaaatcatatcaaccatactcttgaaccacagtagattaaaaccagaaaccaatactaagaacatctcccaaaaccacacaatgacatgcaaattaaacaacttgctcctgaaggactttcagataaacaacgatattaaggaaatttataaaattatttaaaatgaagacacacaacatttcaaaatctctgagatgcagcctatacaatgttaagaggaacatttacagcactaagtgtctacatcaagaagttagaaagatctcaaattaatgatctaacattacacctatgggaaccggaggaaaaggaacaatctaaacctaaagctaatgagaggaaagaaataactaaaatcagagcagaactgaatgaagtagagacccaataatccatacaaaagatcaacaagaccaaaagttgggactttgaaagcataaacaagagagataaacctccagctagatgaacaaaacaaaaaagagaagatccaaataagcccattcagaaacaaggatgacattacagccaaacacatggaaaccgaaaagatcctgagaatattatgaacactggatgcacacgaactaaaaaatctagaggaaattgatacattcatgaaaacatacaacctccccaaattgaatcacaaagaaattgcaactctgaacaaatgaatcagtcataaaaaaccctatgaatcaactaatgtccctgaccaggtggacataattcacagccaaattatagcagaaatacaaagaagtcctactaccaattctactgacactattacaaaaaattaaggaggaactcctctgtaactcattctatgaagccagcatcaccctgataccaaaacctggcagataaacaatgaaaaaaagaaaaactacaggctaatatccatgatgaacataaacacaaaaatctccaaccaaacactagcaaacctgatccaacagcacatcaaatagctataccatgatcaagtagcctttatttctgggatgcaagagtagttcaacatgtgcaaatcaataatgtgattcaccacataaacaaaattaaaaacaaaaaccatgtaattatgatcatctccatagatgcagagaaagcttttgataaaatctaacatctcttcatgataaaaatacttaaaaaatgagtcaccaaaggaacatacctaaaaataataagagtcatctatgacaaacctatagccaacatcatactgaatgggcaaaagcgggatcaatcccttgagaactggaacaaagcaaggatgctcactttcactacttctattcaatgcagtactggaaatcttagagcaatcaaagaagagaaagtaataaaagacatccagatatgaaaagcagtcaaactatttctctttgctgactatatgtttctacactaaggaaacctcaaagactctgctgaaaggctcctgaaatggataaatgacttcagtaaagtttcagaataaaaattcaacatacaaaaatcagtagcatttctataatgttcaagtggagagtcaaatcaagaacacaatcacatttacaatacccacaataaaaattaaatgtctatgaatacatccaacaaagaggtgaaagatctctgtaataactacacaatattgctgaaagaaataatagatgacacacacaattataaattcattccacactcatggaaggtaagaatgagtattactcatggtcatactgcccaaagcaatttacagattcaatgctattcctgtaaaactaccaatgccatttttaacagaaatagaaaaataggattctaaaatatagaacaaaaaatagcctgaatagctaaaggaaggtaaacaaaaagaaaaaagccagaggcatcatattatccgacttcagctatacaataagtctacaatatccaaaataggacggtattaatacaaaaacagacacatagacgtatggaacagaaaagagaacccagaaggaaagctgcacacctataatcatacgatctgtgacaaagttgacaaaagtgaacgctgggtaatgttcaatatatggtactcaaaaactggctagccatatgcagaagaatgaaactggactcctacctttcaccatataataaattcactcaattcactcaagatggattaaagatttaaatgtaatacttcaaactataaaaaccctagaaaaaaacccaagcaacatcatttttgacattaggctaggaaaacaatttatggctaaatcctcaaaatcaattgcaacaaaagcaaaaattgacaattgggacctatttaaattaaagagtttgcacagcaatataaaaaaattttaaaaagatcaacagagtaaatagataacctgcagaatgggagaaaatatttgtgaattctgcatctgacagaggtctaatacccagaatctataaaaaacttaaacaaatttacaagaaaaaaataaccctattaaaaagtgggcaaaggacatgaagaggtacttctcaaaagaagacatacaaacagccaacaaacaaatgacaaaatattccataaagattgttaagttccattggatcgcatgataatttcattgaatctgtgactggtaaaatttacagcttcagtaacaccagatgtaaaatgaagaatctatatgttggtcaggttataatcaagacattatttttcttgtcataattacacatactcttttatcatgtattttcttgaggaaatacatatatgcaaacaaaacggtaggtgctcttattttctttttaaacaatacaatatgaaatataaatgtacactagatgccacccaatttaagaaatagaacattactggcaaggtgtggtgtctcactcccgtaatcacaacactttgggaggctaaggctggaggattgcttgaggccaagagttcaactagcatgggcaatgtagggaggccctgtctctacgaagaaaattaaaaaatatagctgggaatggtggtgcacacctctcggcaggaggatcacatgagcccagaagttcaaggttacagtaagctatgattttgccactgcactctaggcaatagagcaagaacctgtttccaaaaaaataaaaataatgaaaatatttgatctaaagaaaggaatataccatgttttcctttatttagcatattaataaaaacaataaagatacacatatttcagttactggtatcttagaatatcttgcatatatacaatctgagctttttgatcaggaaaaaaatttaaaagaatctcttgcataccttttcttacactatcctgaattttgcgttattacttgccatagttgatagacagactataatgtatgcacccctaaacagtatatagtttttccttttttaactttatgaaaataaaattatacccttgaatttatacccaaaaattctcatatgaaatattttatccatgcaattaacaaatttaatccaatggctataaaatatagactattataccaaacaattgaggaattagaatgattctataatgtcttttatttacttgtgctacttggataattgttattttcctccattttattttactaagtggagggctggtttatgttaccttttcatggagaggacaaaattaaaggtatctcaaggcaagactaggtgtgggcctgtagacaacactaaaatgaatataaggagagagatatgctagtaagggataccacaatgggcaaatgcttttatttttgacctatggatgggaagggatacacagacctgtagggttaatggtatccaaacacatagaaattctaacatacaagcattcagtagataagattatcaactcccaatttctactaaaaaaaagttcatatgctaatcaaccatatcagttgcttcaattataaacctcatttacaagtcttaatagaaaaggaattgatttttttctgctttcaaagagaaaatgagtgaaaatagacaccctctaaagcatattcaacacctacccaacaaactttcaaaggtagatctatttagctaccaccatttacttgaagttaaaatggtacacaaaaatctattgcctaaatggtagtcttcattttatcatttaaaattaagattcgactaaaagatcaatagaaaaatatttgatctaaagaaagaaatataccatgttttcttttatttagtatattaataaaaacaataaagatacacatgcttcagaatggaaagaaaggtgtttacttttaacggcagaacatatcaatcacctcattattacataatatattatttaaggtcaagtgtagatgctcaagcttgtaatcccaaagctttgggaagctgaggagaatgacttgagctcaggaatttgagaccactctgggcaacataacaagaccccatctctataaaaaggaaaacaatgaaaataaaattagtcatgtgtggtagtgcccacctgtagtcctagacccttgagagactgaggcagaaggatcacttggatgcagggttttgagtctgcaaggctgcagtgagctataatcatgccactgtactcaggcctaggtgacagagcaagaccctgactttttaaaggaactgtatttgcttctattaaacaggtcacaaacactctcaatagttttttttctcaaagttgagatatatggaacaagtttttaaaatttcaccatattgataaaattatcccctaaatctatccagggtaatatattatccacaataacatattttcatatcttctttcttttactccttactggttttctactgcttcaataatttgtttttctctttattctatcttgattcatgtctagttcttgtttcctatgatatcctccttgtaattttaacccagttcatccctctaatcttccattcagtatctctctgctgtgtaggaagcataactgtgctgagttcttggctggaccactgaaatcaagtaatgactgaatataaatcagaatcatggctgtaaataaaaagaatgtgaccaaatgtccattagcaatgatagtctagtcatataaaaatgtggctattttcaattaataaaacaaaacaaggaagaaaaagtaaagacaatgtcaggaacgatgataagaataagcatgtaacaagcaaatggtaggtttgcttcaaccaaatggtaggtttgctttcattacatgaaaattttaccaaattgtacatataaagtcttctaagaacaatatacaaataacattttagtatataaattggctcaagaaagtcatttttcagggactctagatttataggctctttaagtctctttaaaactgtaaatgacccacagaagttggctgccctaaaggtttagattaaataaaccatccagtgcacaattcaaatataagctgaacaaccttaattggaatatctatcctgtgcggttttccagtttctgatttggtactccccaagtagcaatttcctatgaattaccgtttcccaactaagaggtacagaaattcccagtttctttaggaggctgaatattttaaaacttcggctttattaaggttttcaacaaagttctaattaaactacacttcattaatggcttacccccctaccttagaataaggagagctttcttacaattattaaagctaaccttcagaactgttgttaataacaagactaagaacaatttttaattttttttaacttcatagctgtaggctaaccaatagttaacaaataattcattcatttcattggcatcatcagtcctcctagcaatatgtgttttttttttttttaatttaagacttggtgggggaggcggtgaggactgtgcaattactagtcactgttttcccactcattggtactattagcttaacagataaaaccacagataacagccgcaatcaacttcagcaggttcccagaggcaagctcttgctttttgctgattagcttcattcaattatgtcttcttaattgttcatgtgctacagctcattaaatgaaaaataatattcctttcctgtgggtagggcacttgagatttgaaaaatagccacttcatctctgcctcagaggcacaagtaagttgatctgatggtgtctgaaaaagctcaacagatttgtgcagatagccctgcccgagaagggacaataaaattaataaaattgattgttaaatcaagtcaaaaataaaattactcccagtattttcctttaagattaattttcaggaaaattagacccagttttgtagcatttgattatgttcacctctgtaatataattttctttgtaaaaagatcagttattgctgttccattacagatgggatttagggaaagtggagtaaatttttaaatttttctgaaaatagattttgacagattaaaaagtgtgtcacacaatttatttatgaaatattctagaaatggagaaggtaagtttcattcattaaaatagattcattgagtacctactatgttccaggccttttgctacacaatgaggatacaaaaggtcttaacttcaagaggtttattagtctggtggagtagaaataataattcaataataatccattagctaatatatactggctatttactaaggacctataaagtacttggtcgatatgtgtcaccttacttaatctttttaacgatcttataacatagaccatatcatattttttattatagatgaactaaggcttagaaaaattatattgcttcctgatatcacataactagcaaatgctaaagtttagtttgggacaagatatgtatgaccttgtagcattcctatttacaggtactcctcaatttacagttcctatatgcatacatttcagtcaccatgtttagttaagttagaccagttacccagctcaagcgattctcccacctcatccttctaaagtgctgggattacaggcatgagccaccacacctggacggatgtgccatagtttgtaaaagagttgagaatggctgctagctagtagaaaaaaatggtgatattagaaacatgggtatattttcaaatgaattccaaaagtttgagaaagtaatagaatttttgtctgttttgttctctgttatttcgcaaacacagatactcagtacatatttttgcttttttttaaggagatgaaaaagtctgacatgattttataaaaaataaaatttcaaatttcagctaccacagtgtattaactgtaagtaattacataagtacaaattttgctccttgctctttggtccaaaatcattatgtaaataacaggtgtgcttcatgatcagtgaccattggcatcatctttttaaatgtctgtcagtgattgatcactacacatctattattcatcacatgcagacagaaaagtgtgcagttatgttgtctctgtttcccattgataaacacaagtgccatttcttaaaaataaataattgaaagaattggccagaaaagataaaagtacaacataaagtaaaacgttgagtccagtgaaaatggagctacagcaaaatccctgtgggaatattgacactgctgccatctgaggaacttaagctttgcagccagaacaacttagtgcagaggagcttattgacataaatgaagaaagtggatgtgatgaaaaggatgaagatgtatcaggctaagtgacgccagcaaaaacccaaacacacaataaaaaaaaaaaagacttacattaaaggaacttacagagatacttaacaatattgaaagcatcaaagcataaagtgatgaaagctgatccaaatttaagattatgacaatttgccaaggcataaaacattgcccccttcattgtaagccatgtaagaagaaatcaatcactattcaaactattagtaaacattttttaacaaacaagtaaactttaagtctttaacatcaatgtaattaagagggaattggccagcatatgtgaaagtatagcaaacaaatgaaaataatgatgcaaaaaataataatgtaagatatgagttgaatataaacagagttatagaaagaaagaactgactttaattcttttattcccagtgtaaattccaggatgttaaatgaatatgttttataatttatttattttcctacacatttgtaagtgacagtaaaagagtttctaatattttgaaaagaaattaaaggttatggaataatatttattcttgattattaagataaacttgcatgatttcagctgagattatcatgtttatcatccttcactaccatgtaaagcgagaagtgtgggtattaacttattatctgtttgtttaaagtgaatgacacacagcttagtgttacatcaacagaaaaatatttaagaggaaatgacactaaatcaattttaagataatgcttctattatgtatgtttctgtatcgtctttctaaacataattatggaaaaggcatcccaactggtgacataattattgccaataatataatagtaatgacaatatatttgttggtcaattaaaagtaactacattagctttggtaaaactacatttttcacttacatgattaaagacacttatcagtgctcttgtgatcctactttaagatatacatcttcatattaatttgtaaatgaaatgtgggagtttttcataaccaacaggtttaaagctgtgtgaagatatgtgagggaaatatatagttatgtctgtaagaatcagtgatgtgccatactttgtgttttgttgttattgttttcttgagacaggatctcactctgttgcccagcctggagtgcagtggcatgatcacagctccatgcagcctctacttcccactcaagcgattttcccacttcagcctcccaagcagctgtgactacagttgcatgtgaccacacccagctaatttctattttttgtaaagacacggtctgactatgtggccggggctagtcttgaactcttgggctcaagcgattctcccacctcatccttcttaagtgctggtattataggcataagccaccacacctggactgatgtgccataatttgtaaaagagttgagaatggctgctagctagtggaaaaaaatggtgatattaaaaacatgggtatattttcaaatgaattccaaaagtttgagaaagtaatagaatttgtgtctgtcttgttctctgttatttcccaaacacagatactcagtacatatttttgcttttttttaaggagatgaaaaagtctgacatgattttataaaaaataattttgatgttagtaatcattactcaacatatttttgaagagtctaaaggaaatttccactgtttcaaaagatcccaccttccatttctctctatctcatctcctagcaatctacccttcatttattgtactctagttgtgcttatctttttggtctttatcaaacacaacaaatattctgagaccttaatatttctgttccctctccctggaacactattcctcaagaaataaaattaggtaattatttcaatcaagctggtatttaaacatcttctgctcaaggaggcctagctgataatctgtatttaatgttccagttttcctatactctctctgaacccccattggccattctattttgttttatccatagtgcctatcacctgttggcatattatatgaactctttgtttattaacttatttgttaattttattgtttatcatttatgtctatcaatggcatgtagactctaagagagcaggcatatttgtgtgtgttattcattgatatttcaagattaccaaacagtgtctgtcatatagcaaccattctttttttatttttttctgagacagagtcttgctcccgggttcacaccattctcccacctcagcctcccgagtagctgggactacaggtgcccaccacacccggctaatttttctatttttagtagagacgggctttcactatgttaaccagggtgatctcgatctcctgaccttgtgatctgcctgcctcagtctcccaaagtgctgggattacaggcatgagccactgtgcccggcccgttcattacgtaagaataaagaaatatccccttgacatgaaattctgtgtattggaataatatatataccatggcaatgagcatttgtcattatcttagtcagcagtatatattttcctagacaatgaaaagactcccaactggccttttgtatgacaaaaagaactgctaatcactttcccagtttggcttttatttatctccagattaaagtgttattaaggattaatttaatgttattttattccatttagtgaacttttaaacaataaaacacttttatctatgttgttttgcacccatatgacaataaagtgttatcatgcccatactataagtagaaaaacacaggtagaaagaacataactgatttgctcaaagtcatataactcagaagtgaccgaatacatttgcctgactccaaaacttggtctgattttatcatcccttgctggctgtcagatctgatatatcagtccaaaaattacctcttgcttaaaccgatgttttggatgacttttgtaattttctgcgttccatcatttattagcgccaatatataaatggttatttagaatacagaggtttacacatattcgggaccaacattccaaaaatggcttaaatatttctggcagcctaatattatctacggagaattattttcctcaagaacattagtgagatgtgctataataatggttgagcaaagtagcacaacactagatgctgtgtaactctgggaacaccttatttcctgctctgatagaaatctgttaaagaccctcatctgttacaggcagagagaagagcagagtaaaagtgctttgcctacctaaagggattgttgtaagaatctgatgagttaaactgtgtgaaagcattttgcaccctctaaatccatacatttacatgtgacttccctgtatgacacaagctaacaaacaaactagaaacaagcaaacaaaaaaaaaccgagacacaaaaataaaatatctttctgttacctcatttgggaaggggtctaaaaacccagaaataatagtatttacatgtacatgtagttggtaaacattcaatggagtaaaaagtaaattaaaaataataccattagcagaggggaatgtatttttacttatgcatatatacccacatattggatttgtctctatttcatctgtaggacctagccactagccaaatgcccgaagcccctagaaccccagtgcctagtgtggtatgcagaaaataatgccctgttatatgtccattacctaattccaagagccttggaatatgttaccttacctggtaaaaaggactttgtagatgtgtttaaagttaagaacctccatatggaaaaactgtcccaaattatctggatagacccaatctcatcacattagttttaaaaatattaaaccttccttggctgtggtcagggagagaaatgtgattgtagaagaatggcaggcaaatgtaacattgctagttttgaaaacaaaaggagtccagaagtcaagggacgtgggtggccactataagctagaaagatcgagaaaactgattctcccctagagcctccagaaagtagcattaccttgccaatttaacctgattttaatcgtcagacctgtgtcaagcatgtgacttagagaagtataagatattacatttgtgttgttttaaggcactaattttgtgataaattgctaagacagcagtagataactaatacagctagaaaacaattttaaaatacattttaaaaagaacttcaacatgccaatatctaatgaataaaaccaaaaataggatgaaaaattaaaatgaaacttagaatttttctatattacatatttgggaaatttgaattatttcataatattctgatctcaaaaatatgaaaaaagtagcttgtctagttatcattcacctgaaagcaactgttttaaacctgtcattacaatctgataaaaagtaatatgtctcattcagtcccaactacgctcaacatgacccaatcttgtcagaacccaatgtgaagcttcaagtgtacaggaatttacaatgacaatgctccatggaattttcaatgacaatcaatgttccaaaaaagctatgacctacacttgaggctatcccaaggagaagcaaatatcatagcagcatcttacatttgtgaacacagtggtaaatatagagcatacaaaaccatgcatgggtattttcttctgtttttaacaatggataatgaatgtcaaaagtgatattcaaactagcaatatgcaagttaaaattaaatccataaagcacagcaaaataagcatttgttccattgtagagctcacgtttccttgagcacttattttctttcttttccctcctctctgctcctgtcccctcccctccctccttcccttccttcctcctttcctttcttccttcgacttccttcctgacttccatttttcttttttcagctttattgaggtatagctgacaagtaaaaatgaacatatttaaggtgtgcaacttgatttttgtatatgcatacattgtgaaatgatcatcataatcaagctaattaacatatccatcacatccataatgtaaaacatatctaatgttgtacattagatatactgttaccatgctgtacaataggtatatgccacattttccttattcatttatctgtccatggacacttaagttgtatccataccatagctattgtatataaagctgaaatgaaaactaaagcaaatatcgattcaaaattattttatttcctttgaataaagactcagaagtgggattgctgaagcatttggtagttccatttttaattgttaaaggaatcttcatattgttttccataatggccacaccaatttacattcccatcaatatgtcttcctttttctccacttccttcacaaaatttatattttgaagtttgataatagccattcaaacaggaatgtggtgatacatttttgtggttttgatttgtatttcctgataattaatgtcattaatctttcatctttcatctacctattgacctgtcgtctttcatctagctgtttgccatttgtacatctttggattaatgtccatttttgtaaatttatttttctattgagttttgtgaactccttatatattttgaatattaccttttatcagatatacagttgcaaatattttctgtagtttgtcttttcagtctgttgattgtttcttttactgtgcagaagctttttagtttgatgcaattccacttctatacttttgtttttgttgcctgtgcttttgctctcatatccaaaaaaatcattgccagaaccaatgacaagaatctttttcctgatggctttttgctattagttttacagtttcaagtcttatgtttatgtctttaatccattttaagttaatttttatttttgtatgtggtaagagcttatcttcatttttctacatgtggatatccagttttctcagcaccatttattgaagaaaataccttttccccagtgtgtattcttggtgcccttattgtaggctggtttactctaagtgcatggatttatttctgggctctctgttttcttgcattaatctatatgtctgtttttatgcaaattccacactgttttgattagatttgtaaattattttgaaatcagaaagtgtgatgcctctagcttgcttttcttgctcataattggtttagctatttgctatttggagtttattgtggttccatataaattttagaattttttttcctatttctgtaaagaatgccattggaattttgacagggattgcatgaacctgttgattccttttggctagcatggctactaaaacaatattaattatttcaattcataaacatttattttccatggatgaatgttttttcatttatctatgctttaacatttttccttgattcctcctccaagatggccaactagatgcagccaggagaaacatctcccacagagggaccacgacatcaggaagacgggtgtacccctagtaaatcttcagagggaaggcattgagagcagatagagagaagatacagaaggtgggataaagggagatgaagctgggaatgctgcatgtggctaccacacaccaggactcattcctggctcccagcaactcctgtggaaggggtgagttgaacagaaatgagcaactcactctcaccatgagcctctggaatcatagcaggaggagtcttgtcagccaccatggacacttgagttggcagagaaagctacttagtgaagtggtagggacagaactccagctgcagcagagcccatggggtttggtgcaggagcatctatagtggagaacagccagggatgcccatccccctaggcttgatttgctcctatagtagacattagccctaaggaaaggggtgaacgtagactctgtagagcagtcttgcccatgagatgagccaggccccctgagcaccctttggtgtgctgtcttctctttgggccccagcctgcctgtacctgctagcagtgtacccccccaggcacctcaagggggcctgcctcattgctcctgcactggtggactgcagctgactgggagagtgctccagaagagcaaaccctgtgtatacatataagactgcccatgtcctccccacactacagcctcctccatactgctttgctggcaggcactcgctgccagcgatccccatacatctctttgcctgtacatgtgtttgcagacagacctagcctttccttctctgacagtgcatgtgtacacatgtaccatgccatgccatgccactattgctggcttgagtgtgccccatcccttctccccctgttgcactgccatttttgttggagcattggagggcatatagtttgacagctctgccaccaccagtgctccactcctgtgccaaaactgctggcatgaaactaagcacagaaaacagtgtatctactcccatccctgagaggtcactgctgtaagcaagaatgctcacagagggtgcacacagtcctgcgaccactagcgccccatccctgtgctaacaccagcaccagtacaaatgtgcacaccattgccagcagggccctccaccttcccaaaccataccgccacagccactactacaaacacccacatggaggctgtcatcttccatgtggatggaggatgccgctggtacatgcaaatgtggacacatcccactacgactgtcctacaaaatgctttggctgggagtagccattagagtgttgtgaccagcagtctgagatcacattgacccctccagtgcagcaggttcctaaacttgatccacaggtaatagctggtgtatgataccagtctcccagagttagagcacacaatgcagagtgctgagctgagccttggccacctgaagtcttccactaacaaagccaggtgactgaacacagcttataccataatcaaaccctcaaggtcataaaatagaataaaagaaaaaaaatccaaaggacagcaacttcaaagattgaaggaacaccagcccacaaagatgagaaagaaccagtgcaggaactctgacaactcaaaaagccagagtgccttctttcctccaaatgagcacactagccctccagcaagaattcctaatgaggcagaggtagctgaaatgacagaaatagcattcagattatggataggaataaaaatcattgagttttgggagaatgttgaaaccacatctaaggaagctaagaatcacaatattaagatacagaaggtaacagacaaaatagccagtacagaaaaacaaacaaacaaacaaacaaaaaacataaatgacaggatagagctgaaaaacactctacaagaatttcataatgcaattgtattaagagaagaataccaagctaaggaaagaatctcagagctcaaagactgtttttcttaaataagatggtcagacaagaataaagaaaaaagaataaaaaggaatgaagcaaacctccaggaaatataggaatatataaagagaccaatattatgactcattggtgtccccgaaagagatgagaagaaagaaagcaacttggaaaacataagtcaggatatcatccatgagaacttccccaacctaaccaccaatattcaaattcagaaaatgaagagaactcccacaaagtacttcacaagaagatcatccccaagatacataattatcaggttctgtaaggtcaaaatgaaagaaaaaaatgttaaaagtagctagagagaaaggacagatcacctacaaaaggaagcccatcagactaacagcagacctctcagtacaaatcctacaagtcagaagagatttgggacctatattcaataacctaaagagaagaaattccagccaaagaaatttatatttggctaaacaaagcttcctaagtgaagggaaatatgatccttttcagaaaagcaaatgctgagggattttattaccaccagacctgccttacaagagcttctggaagcattaatatggatgggaaagaccataaccagcaaccacacaaactcacttaaggacacagaccagtaacactataaagcaaccaaacaagtcagcataataagtcgacagcaacaggataacaagatcaaatacacattaatactaaccttgaatgtaaatgaactaattttcccaattaaaaggcacagaatgtaagctggataaagaaccaaaacacaattgtatgctgtctgcaagagacccatctgacatgcagtgatgcccacagaatcaaataaaggaatggaaaaaaatctgccatgcaaagagaacacagaaaaaaagcaattattgcaatcctaatttcagacaaaaaagattttaaaccaataaaaataagaaatggcaaagaagggcattatataatagaaaagggttcaattcaacaagacctaactagcctatatatacatgcacctaacacagaaacattcagatttataaaccaagttcttagggaccttcaaggagacttaggctactacacaataatacggggaaattttgacacccccactgacagtattagacagaccatttaagcagaaaattaacaaaaataatcagaacatgaacttaacactggaccaaattgagctgtgaaacagctacataactgttcatcaaaaaacaacataatgtacattcttctcatgtacacacaacacatattctaacaatgaccacacaatcaaacataaagcaatcctcagcaaatgcaaaagaaacgagatcataccaaccactctcttggacaacagcacaataaacatagaattgaagaacaagaaaatcagtcaaaaccatacaatcacatggaatttaacaacctgttcctgaatgacttttgggtaaataatgaaattaaggcagaaatcaagaagtattttgaaattagtgagaacaaagatataatataccagaatctctgggacacaattaaggcagtgttgagagggaaattcatagcactaaacacccccatcaaaaagttagaaagacctcaaattaacaacctaatatcatagttaaaaagctacagaagcaagagaaaaacaacaacaacaacaaaataacaacaaaaacaaacaaacaaaaaaacccaaagctagcagaagataaaaaatacaccaaatcagagctgaacagagactgagacataatacaaccattcaaaagatcaacgaagccaggagttgactttttgaaaacattaatacaatagatagaccactggttaaactaagaaagaagaaaacagagaagatccaaataaacagaatcataaatgagaaagggaatattaccactgaccccacaaaactacaaataaccatcagagactactatgaaatcctctatgaacacaaactagaaaatctagaataaatggataaattcctacacacatacagtcttccaagctgaaccaggaagaaattaaatccctgaagataactataacaaatgctgaaattgaatcagtaataaacagcctgcaaaccaaaaacagccctagaccagatgaattcacttctgaattctaccagatgtacaaagaagagttggtgcattcctactgaaacggttcccccacaattgagaagggacttctcctcaactcattctatgaggccagtatcatcctgataacaaaacctggcagagacacaacaaaaaagagaactttaggccaatatacttgatgaactttgatgcaaatatccttaacaaaatactacccagctgaatccagcactatatcacgaatccaccacaatcaatattctttatccctgggatgcaaggtttgttcaatatacaaaaaccaataaatatgatttataaaataaagagaactaaagacaaaagccacatgaacatctcaatagatgcagaaagacttttgaaaaaattctgcttcccttcatgttaaaaactctttacaaattaggtattgaaggaatatacctcaaaataataagagccatatattgcaaacccacagccaacatcagactgaatgggcaaaagctggaagcactgtccttgaaaaccagcaccaaaaaaatgatttctccacttgctatttctattcaacacagtattggaaattctgaccagagcaatcaggcaagagaaagaaataaaaggcatccaaataggaggagaggaagtcaaactaatcctgtttgcagatgaaatgattctatatctagaaaagcccagtttcagctcgaaagctctgtaagctgacaaacaacttcagcaaagtatcaaggtataaaaatcaatgtacaaaaatgactaccattgctatacatcaacaacagccaagctgagagccaaatcaggaatacaatcccattcacaattgccacaaaaagaataaaatacctaggaatacagctaaccagaaaggtgaaagatctctacaatgagaactataaaacactgctaaaagaaatcagagataacagaaataaatttaaaaaaaaattctatgctcatggataggaagattcaatatggttaaaatgaccatattgcccaaagcaatttgtacataaaatgttattcctatctaattagcaactacattattcctatccaattagcaattacattcttcacagaactagaaaaaaaatcaattttaaaattcatatggaaccaaaaacatagcccaaataatcaagggaatcttaagcacaaagaacaaagccggaggcatcatgctacctgacttcaaactatcctacagggctacagtaaccaaaacaacatggtattggtacaagaacatatgcatagaccaaaaaaacaaaacagagagtcaagaaataagtctgtacagctacaaccatctgctctttgagaaaactgacaaaaaataagtaatggggaaacaactccctattcaataaattgtgctgggataactggctagccatatgcagagattgaaactggaccctttccttacatcatatacaaaaatcaattcaaaatgtattaaatacttaaatgtaaaacccaaaactataaaagcactggaagacaacataggcaatactattctgaacataagatctgacaaagatttcatggaaaatatgccaaaagcaatcacagcaaaagcaaaaattgacaaactaattgaaaaactggtacactagtctccagtgaaagcaactgcacctgaagttaatggaaagaaagaaggggaaaaggaagaagaagaggaggtaaaagatgagggtgataagttagaccaagctgaagagggaggatctgagaaggaagcctctagtgaaaaagaggaaggtgagcagaaagaaggagaaacagaggctgaaggtgaagtagaggaagccaaagctaaagaggaaaagaaagttgaggaaaagagtgaggaagtggccactaaggaggagttggtggcagacaccaaggtggaaaagccagaaaaagccaagtctactgtgccaaaatcaccaaaggaagaggcaaagtcaaaagcagaagtggggaaaggtgaacagaaagaggaagaaaaggaaatcgaggaagctcccaaggaatagaaggtagagaaaaaggaagagaaaccaatggatgtgccagagaagaagaaagctgagtccctggtaaaggaggaagccatggaggaggcagtcaccattaccaaattggtaaaggtgcacttggagaaagagaccaaagaagagggaagccacagcaacaggagaaagaggagaaagtgggaggaaatggggaatgagaaggaagggagtgataaagattccaaggaatccaggaagaaagacatagctgtcaatggagaggtagaaggaaaagagaagggagagcaggagaccaaggcaaaaggcagtgggagggaagaggagtaagacattgtcaccaatgacctagacttaagcccagcagatgaaaagaagggggatgataaaaatgaagataaagtggtggtgaccaaaatagtagaaaaaatcaccagtgagagggagatggtgctaccaaatacatcactaaaactgtaaccatcactcaaatggtcgaagagcatgaagagacctttgaggagaaaccagtgtctactaaaaaggtagaaaatgtcacttcacatgccgtaataaaggaagtcacccagagtgactaagatttgagtccactgcaaaagtttaagccatacgacaatttcaaaatgcatgtgattgacagcttcaaaacagaacagattctcccataggggctccagacattgtattttactttgtgcaatatgaggagactgcatgcaagctcagtgtgctcccccctcagtctttgggggattcaaatgcatgatactgtatgtacctgggaaatttaccaatttcctgcactgttggaagggggtcactcagaaggggagatgtcttgagatgtattatgtaaagtaccaactgagccaaaaacaataaatgaaacacagaactctcttagccttaagaaagctatatatgaataattatgtttaccacactggtgcatttaaaatggacttttcttcatgggagaacctcgttgacacggacagtttgcaatcttatgttgatcgatgtgaaatgtcatagcagtacttgctcaataaaggtcatattggaaacatagtcaaaaaataaataaatgaaagagcttctgcacagcaaaggaaactatcaacaaagttaccagacaaccaatagaatgggagaaattatttgcagattatgtagctgacaaaggtcgattatctagcatctataaggaatttaaacaaatttacaggaaaaaaacaaacagccccactaaaaagggtgaaaagtatatgaacagacacttttcaaacacaaaaacaaaaaaatacttgcagccaaaaaaaagtattttaaaaaagctcaacatcactgatcattagagacacgcaaataaaaaccacaatagaaaacatctcacaccagtcagaaagctttttattaaaaagtcagaaagtagcatatgttggcctggttgtggagaagagggctcacttttacactgttggtgggagtataatttagttcgtccattgtaagaagcagtgtggtaactcctcaaagaaccaaaaacagaactgccatttgacccagcaatcccattactgggtatatagccaaaggaatatgattgatgtattataaagacacatgcccacatatgttcatttcagtaaatgtggtacatatgcaccacggaattctatgcagtcataaaaagaatgagaccatgtcctttgcggtaacatggatggagcaagagaccattattctatgcaaactaatacagggacagaaaaacagaaaacagaaatactgcatgttctcacttataagtgggagctaaatgatgaaaacacatggacacaaagacagcaacaaccagacagtgaggccaaccagaaggtggagggtaagagggagaggatctgaaaaaagtagttattagctactttgcttagtacacaggtgattaaacattctgaatatcaaacccccatgacataattttacctatataacaaacctgcacatatacccctaaacctaaaagttttctaaaaaagaaaaatgttgtattttgcaaaaagtaaacattttcctttattaatactttataattttcagtgtatgtattttcctgtttgattaaatatatttcaaagtatttattcttattattatataaataggatttttaaaatttcctttcagataatctatttttagcctctacaaatgccacttacttttatttagagcaactttactaaattcatgtattaattgtagcatttttggttgtcattgagacttttagacttttctgcctatacacctatatgtcaactgtaaacagagataatattactgtttcttgtctagtttgaatgtctttcatttctttttattgtatcattgttcttgactagaagtggcaagagcaggaaatcttgtacaggattttagaggagaggcttttgggttttccccattgattattatgttatcagtgggcttttcttatatggctattattgtgatgaggtaggttttctctacacctattgtattgagagttttttaaattagaaataggtattaaatttgacaaatatttttccagaacttattgagatgatcatatggtttttgtgtttcattctgtttatgtagtgtatcacattgaatgacttatgcatgttcaaccatccttgcaccccagggataagtcctagttggtcattgtgtacaattttttcaatgtgttgttgcattcagtttgcttgtattttattgagcatttctgagtctacattcatcaaggttactggcctgtagtttacttttcttgtggatgtctttggttatcaggtcgatgctggctacatgaaatgagtttgtaagtgttccatcatctagattttcaaatagtttaagaaatattattaattctttgaatgtttgctggaattctcccacaaagccatgcagtgctggactattctatttcttcttcaatcttggtaggatgtatctttctaggaatttatgtattacttcgcatttatctaatttgttggtgtatatttattcataacagtcccttaagggctctttttatttctgagacatctgttgtaatgtttcctctttcatatacagttttatttatttcagtcttctctctctctttggttactctaggaaaggatgtgtcagttttatttgtctttttcaaaacacaactcagttttgttgacttttgaaatagcttttttgtcctttttaaaatttattttttgccttaattagcattatttccttctttctgataatatttgggttagtatgtatttttttctgtctttggctagttatttttttaggttgtttatttgagatgtttctttttttttttcttcctcagaaacatttaataggtattaacaaacagaagccatgtctctcgaggctgtgagacaagatggtggatccccatgccattaacccccagaacccagggcttatatactataggtaaggagaattgaagtaatttggtcagaatttatggtaagtgtgtgctcttaacagtagtagagtaaaaatcttagaggcattcccagaaccgaggttaatgaaaagccaacatgttggattagcatttaagacagaattggtttagcctgtacactccacctatctgacccagattttacaatttcacattctctcttcttccaagatggtccctgagcctagagagaggttgtttgatattgcacagctttagcagtagtgcattggcaatggaaaacagattgggcccagttgctataatgttccttctcagaaatacttttgctatatctcacaactgttggtatgttttcttttcatttttgtcaggaggtaatttttaattttttaaatttaatcttggacccaatgattgttcaagagtgtattgtttagcttccatgtatttgtgaatcatatggtttcttgtttctttaccattaactgatttacactttcactctattgtgacctgaaaagatacttgatacagtttctatcatcttaaagttgagttgttttgttatctaataggtgatctattgtgaagagtgttccatatgtgcttgaaaagaatgtacaatcttctgttgttgggtaaaaagttctgtagatgtctgttaggttaatttggtctctcctattgttcaagtaagctgttttccattgatttctctgtggatgttctgtccattattaaaagtggaatattaaaatcttctagtattattgtgctgctataaatttctccagttctgtcagtgtttgctttaaatatttagatctgatattgagtgcatatacatttacaatagttatatcttcctattgaattaacctttttatctttatgtaatgaccttctttgcccctggagacagtttttgacataaagtctattttgtctaatgtaagtatagccattctgctttcttttcattaccatttgcataaaatatatatttttccatcctatcatgtttaactatgtgtgtccttaaatagttggtgccaagtttttattctttcagccagttaatatcgtgtgattgggcagtttaatccttttacatttaaagtaactattgatagggaaggatttactattgaaattttactgactgctgtttttcttgttcctttttttctttcttgatgtcttattttgtgtttctttttttgttattgttgtttgacaggctttaattcctttctccttttcttttataactagttttttaactactgtaggtagtagattttcttttttaagtactatggctattttctgtgtgaatgacatgagtcttacataaaatataattataataatctaaaactgataacttctcttccacacaaaaacttcacatttttaccttgttcccattatagattattgatatcagaatttacatatcttaacatgtgtatctattaatgtaattttagttatacctatatttaatacttttttaaattttagattagaattaaaagtgatttacctaccacaaccacaataatatagtattttttatttgcctctataaatttaccattaccgatgagttttatacttttgtatgctcttatattgttatttagcatcctttgatttcaacttaaagtactccctttagcattttttatatgacaagtctagtggcaataaactccctcagctttcgatttttttaattttgtcttaagttttaaaggataattttctgggtatactgttttgattggcagttgtgtatttgtttgtttgtttccgcattttaaatgtatcatccaactcccttctggcctccaaagtttctgctgaaaatccaccaatgatcataggagggttccctaacacataacaagttgtttttcttttgctgctttcagtggtctctgggtgtccagagtatgccagctctcatcattgccctgaaacaggtgagatactgatcctttttagtagtaaccataaatgttggggcactaactggattttccaatttcttctctcctcagggaaaagctgggtgtataatctgctcatgctgaactgagctggggaaaagaactatggcaaatgtttgcaagctcattcaaaccacagactttttcaaactgttgctttgatctctgtagcctccatgggcctaatggatgctgatctccattagttctcatagacacgtcagttgaaagctagttcctcaggtagcagctggaaaagttaaggggatagatatgtagataaattccttccagactgaagctagaggcttgcttttatcattagagtgagcaagtgggagaatttgtggaaatatccacatgcctgtttaaaatggctgctttgttttctatagcccacatgtaaatagtgaatggcaacaccaatagctctcatagacagtgagttagaagccagacctcaggtaggagctagaaaacttagaatgcttgatttgtagtctaacttctttcatagagaatctgggaactgggctttgttgttgtagctagttggtgaatgaggaggtgaagtggaggagatatgggaagaacccatttgtttgggcattttttctcaatgtaccttagtttgtctgtagtagctggccacagtagtgatgattctatttcctgagaggtgagaattgctgccaaagaatgtctgccatggatgagaatacaaagaaaggaaactaagaactctcaaagcagctactagaaacccttcatagaggacaagaattatcttcagttttgagatatatgagaatgattacaactcctttgagcaggcttcacatactgcccaaagatgcttctctagtttgtgtccttcttgctatcagaaagagagaaggaaactaaataaaacaaaataaaaattttagaattttgtgctgtcttggacatggaagcaatgggtcaggatcaagattgtggaaagatgccagttcggatgcaggctagaaaaattagtattgtcctcaactggaatcagcaaccaaaagactaagtgtatgtgtctctgtaggctgaagggttttcagatatcataaaagataagaagtcaagctacacttgtttggaagcatgtggcagagaacacagattaattgtttaaaggatggcccaaacttaaggccaagtcacatcaaacccatcagaaaccaaaagtgtggcagaattcctaacagaaggatgagagaggaagagccttatatagatctgtcttctgtttcacattctgactattctaaagcttttaatgaagaattccctagagtcataaaacaaaggctaaatggtgagtggctgcaaatacacataaaaatatagtgaattttttgaaaagatatactaatttcaggtggctagaaagatttattaacataagtaataaaggtcttttagttgtcaaagtaacttatacttaatatttattgcaattttaaaaaattaaaatgctaaaaattatttgtgaaaatgagttgttttatatgtttacatttaataacaatactttttacataaagaaaatacaataattaaatatatctgaactagtcaaaagataattataagatttaaaattgagtttatgtgcaataaatgtggtaaacaataatgtgatataaaatcttctaaatttaataatattcttggtagaggattctggggcaaaaatatgattttctccatatccctgcccactacccaatatatgataacatgtggcattattaaatatggaaaaatattaaagaatggcagtagactagagagaagagaaggaaaggcatacaggaaatccaggtccctgccctcagagacctctcaattcctggcatatgtttatgttttgaacattatgcaaatttgtctgcatgacaaatttattcttgtttcaggttaagagtagaaatcaacccatagtccttacgattagaattgccttagcataacgattcaatcagtaagaaaatataatagactagagggtaatggagattttaaaatttatattatcttaatatatttattagaaaaaatattagattgctcaataaatcaatggtaactttaaggcttttactgtctactacaaagaatttttatagatatatgaagaatgatggtaaggaagagatatgatgccatgaggcctactgtgagcaagacactgctaatcaggctattaggttggtccaaaagtaattacagtttttgtctttgaaagtaatgtcaaaaactgtgattacttttgcaccaacctaatacttccgcactttggaaaggctttgcctacatcattttggttattgtgagaagacttgcacacataaggaatttttcaaaataatattttaacttgaaatacttttctttgacaaatacagtaaaagtgatagagccaaaaagaggactaggcatagccctgaggggatttccgagcaaaaaaatcccaggggatttgtatgcaaacacttcgctcaataaaaggagaggccaggtgtggtggctcacaactgtaatcccagcactgtgggaggccgaggtggctggattgcttgagcccaggagtttaggacgagcatgggcaacatgacaaaaacttatctctaccaaaaaaaaaaaagaaaaaatagcggacatggtggggtacacctatagtccagccacttagagaggctgatgtgggagaaacgcttcaactcgggagtttgagacccgcctgggcagtttagtgaaacctcatcactacagataataataataataattatctgggtgtggtgacacacgcctatagtttcagctactctggaggctgaggtgggcggatagattgaacccaggatatctaggctgcagtgatctgtgatcatgccactgcactccagcctgggtgacagagaccctctcttaacaaaataaaaaatacaaaaaggagaaagtcatcaaacaaaatgatgtgacttagtctggtaatattcgtcaagaagtcaagatttatgctctcttacaattctgactttcacattgaattaaattaagggtgtcttggcttgtttagtgtagtttagtaaaatacagtcatttgttttccacagctattatattattctccattaaaaaaagaagaagaagaagaaatgagaaaaaaaaatcagtccctagctagaaattttaagagtcaataacatttgggaaatgaaaatatattctgaagtagtataatcatacccaaatttttagactctgtactcaatctataagatgtatgtgagcaaaatattattagaagcaacatgaatgataatcacgcactacaagcgcacgaataatgtttccctgaaaggtacaataaaaaattattcaatgtgaaacaaaacgttgactgcaacaattattaaaatttgactattgaattgtcagtatactcaattatgaagacatttggaaaatataaatgagcactactgtttttgctcattttttaaaaatgaaaatttttggtaatgtctgacctgaaggcagatattcattataatagtcaaatatcataaatacatttcaaatgttatgtattctacataaattactcaggagaggaacatgtaggctcataaacttgcacacaagtaaaggaatgtttcttaggaaaaaattctgtgttaaagatattccacaccaatgtctcaggaaaaggcatttgtagtatactgctccattacctatgcttcataaaaaatgcagctatctaatttaatttagctctgaacagatttcttagcagcataatttatgttttgagaatatctcttaagaatcatagcttgcaatctatggtgcttcaatgaagaataatctgtaaacaaaatctccatctatcaacaaaggccattaaagaccataaaataacccatccttgactgattaatgctgctactgaaagggatttcaggctattaacatccagaaaatatactgccactgtggttgcatttattataaatcacatagttatatgtactggtgtaaagcaatgttttcttaaccacctccctctcccaaattaatttaataacaaagatactttgaagaacactaaatatctatagaaagtaaatgattctatttttttccctagaggaaatgtatgtgaaggcagggctatttataatacattagatagctaaatattggtttaacactttatatgcagttcaattatgttcatatatttatgtcattaaaatagtttctctaatgtaaaataaaacattaaattcatttgtatttcttgatacttttattaacaatactgatggtttttcatgggtaaaatagccatcaaaaattgttagttgttacctttaggttcatcctattctgtcaatttgattgtcactaactcttcctcttaggggatgtgaatatagctgttgagctcatactcttggaaggtaaagaggctttgtttactggtgcagatctcgattttttcaaatatagtatttcacctcagaaatactatctattagctcttatgccttacaaaactactggcttggatttgtccaatggttttaacccttgatcttacctttaacatgcttggaatctcacaaatattttcttatattgtttagtacaaggcactgtctaaatagtttagccacattatctcattccatttacaccaatcccatgagataggtacgttttaaccattttataacataagcaaaactcaatttcaagaggttaactaatatttccaagatcacatagctagtttatggcagaggaggattcaaacacaggactgtgttgattcaaaaatctatagagttaaatgtgtacttgtccttccgtaatatctgaggctagacaaaacaatccctggcttttctctcctgctttctatgaatattctgtcttagactacttagtcattatatatttttgtcttttcagtagagttctgttttgctgtgctagttcttttgggtttctataataataaaaataataataaaaggagaatagaagaataagagtagatcagggagaagatattctgaagataagttggtttaaagagaatgagttaatggatcagcttttgtctctgaagtcaacaaatgacaaagaaatgaaaaaggtgtaccctggaacaatgcatctatctgctggtagtacttgagaaatacatacaaaattcatatttttattttcttttgtttcattttattgcttattttggtcagtgttatttgcttcttatactagtaacattcctccagcacagaacaacatatctttgcaaatatttcattaaatatataaatgtcttaaataccacaaatgaaagacatgagtaacacaatatagtccacaaaactcaaaaggaaataaacacagtttagcatttttttcttacaattgaaaagattttaataactgttgagtatttataattatctatgctaactcccattttcttgccaagttatgtgtctttaaacactatggagtccccttgcaaaatttaacagagaagcaaagatatgtatcagtaatattgatgtttttatttttttaaaaaaaacctccctgataatttaagtgaattggattagaataattaaaacagaaatgaaggacacagaagcacatattctcaatatcgtcacctctgattactttagaattctgttagcatgtgctgtaaaaatcctttttaaaataaatattcccactataagcttaagtttattcatatctagggagaattgttttgttcggataattagatcaacagctgactctttaagctgagataatggcccactagccaataggaatcacacatgttaaggagaacagaattcaaagagtctggtcccttttgcacagtgacagaacatatgaggcagctacatatctagagagacaagaagataaatataagagagcaaccaaatcaagatgtaattactctgcatttaatcaaggcaccttagggttagtccagaccttttatccaaaacagctctgtaaacagcctactaaaccagcatcatcagctttctgtatttctcatctgtctaagtcagtcttccttgtttcaccatattcctacttgttttgtcttcaacactttctgagagaatgaagaaaaatgacaaaaaacaaattgtatgattgtatgaatgattaatatctcctctttcatgttgttcctcttctattgttcaaagagtatagagtgaataaatacaaaaacaaacacaacactgaagttaataaataataaggtccatctcatttgttaaatttcgtttcttaaggtatatgtgtctttgaaccttctggttatttctacaaaatagttctagtggctttggcagagtggtagcataacacatcactttttaaacagagttgaataattgtataaccctaaaagtaaaagaggcaaacaataaaatgaaatgaacaaatgaaataaaatcagaaattctcagcttaacaaaaccacctttcttgtgagcacattttgtgcatagtgaaataagggacatatctctaaagctctgtacacatatatttattaaaataaattgaattaacaattggcactacacagagtggcatgaaaaggttcagtatcttaacctcagctattcactaagataaaaggatcaccaacataaaatcttttttctttgcattgttaaacttaaataagtgttttttctctaaataaaatgattaatttttaattatgtagataaattttggatctaggtggactggaggcataaatgacacttacttagagatataaccagcaaagtcaagatggcaactttacagaaaaacataatctaaaagtttgaaaaacaaactgcagaatatattgtgtgtggctctttttatattctaaactatgttataaaaattttgcctcgacttacttatataagaaaaataaaactggttgcagaaatataatttagtattatgtcttgtgtgacctaacaattgggtaacaattatactaaaatgggacataatttattaatttacacagtataaaacctattggaatagactttgtaagttccaagtaagtttcttatcgtacctggtcagatttactttgcaatgtccatcttaatatttatgtttttaatatttttaaaataaattttaaggcaatagcatgaatagatgaatacataagataataaatgaaactctagctctttataacttaaaagagggtaggataaagaggcatggcataattttacattttaacttcagtagatgacaatatttgggaaaactaaggaaatatggaaggttagacaaaaataccgattcagggctagaaacaatatttatattttacaatgcccattttagggaaacacggcattgctatgtttttaaagcacgctttagagagtgaaagagttcactttagaaagtacaatttagaaggacttcactttctaaagtatgccttagaaacacagcaatgctatgtttttctaaaatgaagagaaagaaactttatcactctcaaacagcaaggcttaaaatttgtagagaatgtgaatgaggaaaagaaagacaattgttcaggaagttcaataaatcatatttgctgagtcattgagttattaaattcagcaaatatgattcactttgtggcataagtaacagggaaacatgttccatcacaatttcaagatgaaatataaaaagcttcagtctctcttttgtctctctctcacacacacatacacacacacacacacacactcacacacatacacatatgcacaaggtaattgaggctagggaggtgaaagaaatgtagagtagggtctctgacaaatgtggtgaagggtctctgtgtacataatgattttttgaacaatctgaagacaattaagcaaattcagaataattttaacatttcagcagattaactggtattaaaaggggaaaagattggcagaagctttattctaatcatgcaccagaacaacaacaacaacaaaaacacacacaaaaaatcaaagtggcaaatggtttcattgattattgtgaactatccggcacccacgagaaaacaataatccaaatttgttagctcctcaaccttggatgagttttcatgagtattttataaattagtgctataatggcaggagacaacgaactcccagaccacttccaaatttaaaattatatagttttccattgaatagtttattattttcttaataaagataactgtttcttaataaaactaatgctatataaagacaaagtggataaaaaatcattagcaagagaattagtaaacaatgcatagcaacatacatgcatatgagcatatatatacacccatatatgcatatacactagacctatatgcacataattgtaattatatattagtataacaataaaaatcctaaaatatctcaaatgtggaaataaaaatgctgagccaacactagcctagagggctgagaggccagaagagattttgagtttcaccatctgttggatcattcaagcatttcacaacttcctgccagtatcaaatctccgctattttatttgttccaagaaattttaaaacaaatgagagaggtaaaagcagttgaaaatgctgaaagttttgttcactttaaggggttattgttgaggcaatattgctcattaaaggaattttaatggcttaaaaattaaagcttttcaaagtcaagtactttatccctttggaagttttagcaatttaaacttgaataattttcatgaccaaagtaactgcaaaactataattttatattacaattgtatttgtaccatctgacctaattattaaatgtttaaacataataaacactaatgaagtgctctgtcactacaaataagcttctggtcagggtgctattgtcattctactttcttcttgtagttttgttacttttctcgtgcttgtccacagaaattcccaccaagagtcaaagttccacttgcatactcctgtgtgtggaacaagggtttgggatcaaagagtctgccttttcattctgggctctgctacttattacctcttccttgaatctatatttttaatctagagtttctaatagttgtgatgaggatcagatgagatataaggcagaattgcatttgtcaaatggctaatatatgatatgtataagatatgctaagtactcagtaaatggtaattgtttttgctatttctgatttgggcttggattttaatttattttttattgaatgttggataggtatttacccattcacacaatgttgtctaaatgttcatcatactttctaaagttaagggataaagtacgctgaaaggtagctattacctaaaataataactatacctcaggcgagataatacatattatgaattgagaataaacacgcattaaataagtggtaaagcgatacaaattgagtttatacagtagaaaatagaagggggttatttctattggcagccataaggctagagtatgttgggcataattcttctttaccagatacaatgttttgtatagaagtatactcagtagattttttaattctgtgtttctggaactaaacagaaatgtgtggaaattgtagaattgggcaagaaatggaattagaagattcaagagttaatccaacggatgtgcatagattgaagaaataagtccaagaaaataataaatggattagaattttgcaatctctagtactcatagttttttaaaagcaatattaatcaatgaaatacatatatgtgcatccattctatgccaagaacatcacagttaccttggtacttgagacacggagacaaataagacactgtctatctctataaaaacatcatagactttcattctagtgagagagaaaaacacacataaactaggaatgacaaaataagacacatacaaataacaacgtgtgaagcatttcatatttacaaaataaacataaaatactgttcattttctgaaaaactttctccatttatcttgaaatatgtagtatttctgtcaaattttataatctattattaggtatagaaacataaatacagagataagtttttcaataataaaaatattcccagtggaaaatggcgatggatacttagtcttaatgtcagtggcatcacagggattggtacagacactggtgaactaaaaatatcacacggtttaaaggcagtggactatacttggaaattgttgctgtagacaacagcaggctcagcattaccaaattatctcatttttttgagtagaaataaattttgatattttaatgtgcaaagcctttaaaaatgtgttcaattcaaaaaagtggctaagaaaaaaattaaaaataaagtttaaaaaaccctcaaaactatatctgtgggtggaatcaacattcaggtttctgctgtttgatcctgaactcaaggacttataaaagggaggcatgaagaagagctctgcaaaaactatagaaaattggaagatacagaaagaacactgaagaaaaagctactgtccttagattttctatggaaaattaggtcaggtataaagaacatattcctaatcagatgaggaacttttaaatcagtgaaatcatagaactgcttctttggaggccttaatttttcatctgtttggggttatttaaatgaagccattgcaagtgtgtcctattttttcaaagtatattttgtggactccccaactgtaatcacaggatgtgcttgttaaaatgcagattcccagacacctttccagatacagaatcaaatatttttggttgggtacagaattctgatttttttaaaaaattaactctagttaactttgatacaaagtacatgttgagaattataccactggactcacagccaccaaagacacttgtttagttggcgactttgagacccagtcagacttatgagtacctcggaactggaacccaagagacgtatttataacaagtttaactaggtgacattaatgtgtcttcagctacatggaggctatattttattgcattatatattcttccttcttgttactaatttctttggatgcccgcttttacaataaaattaataatttagaagcttataacttctttgtaaaatggcatttctagcccaaatacttgtttaaattcagcataaaaaagaaaacctagttcataagtgatatgtcattaaggatcactgttgtttatcatgaatttcattgtatctttaaaaacatgacgtttttatttttattttttaatttttatttatttatttttttaagtagagactggatttcaccatgttggccagcctgtctcgaactcctgacctcagatgatccaccagccttggcctcccaaatgctgggattacaggcatgagccactgcacctggcctaaaaatatgactatttggtaaacatcaccagggtcctaagaatattgtgtagattatttccagtgggatggtagccattgagcaaccaactgatcaaattttaagatcttgtaagatcttgtaagatgtaaaatgtagcactttcgtaattacctaacttatttgtgaatctgcttttgaataatagtaaaattgtgttttcaaagccatcttactcagaagtaaattatgttaatatacaataaagagaacatacacttttactatatgtatatggaaaattactatatcataaggtcttctatacagctaaaatttttgtgacctgggtacctggacttcaattgagtgagaaaatgaaactaagaaagttacagcattgatgaatagcatagtatatactatattaacagtcattactatatattaaaaagtagcttaaaagaaaagaaaaggccaggcacggtggctcatgcctgtaattcgaggtgggaggatcacaaggtcaggagttcaagaccaacctggccaagatggtgaaaccccaactctaaaaatacaaaaaaaaaaaaaaaaaaaaattagtcaggcatagtggcgggcacctataatctcagctacttgggaggctgaggcagagaatttcttgaacccgggaggcagagatcgcactgagctgagatcgccactgcagtccatcctgggagacagagtgagactccatttcaaaaaaaaaaaaaaagaagaagagtaagagtaagaataggagaaagaggaggatatagaatggaataagagtcacagaatgagagtattcagcccaactgtaactttgttttcaagatatattagaagcctggggaattcttctataaattctacttcccatttagcatgttctaaagttcttctgtcatgtcagtataatatgagaagaggtaatgtattttgatacctcctgttttctatagacaaagtatgtagattaagtacatgagtatttgaggttcaaatgcacctattaaaatgacagtataagtatctatttaactggagcaataaacatacatatctttcctaaagtgatacttaggttattacaaatgccctattaggtttagttatcttcctcatttaaaacactttccacatacagatagtagtagactactaaccttatgctggaacatacattatgatgtaaaaccggggaaatatttcaggtaaactcattctcagcagtggtacatgattatgaagctgtgttttatcaacatgattgctgtgagcaccaaataagaacatgcaagtagcttggttagcataatgtatagcacagagtaagaatataacaaatgtgagttactaggattgtaaagattatcattattattgtttgaatagtaatctctgtatgtaaatagacatacatattctactaacagatttgtgttatctacttgagtgtgtgtatatatgcgtgtgtggctatgtgggcaccagtggagcaataatgagtttgctacatgttatatatttctagaatcactaattatgttgaaatattattacaaaagtatgtgccttaacaaactaataaatactttggtgtctaaataagctcaccatagagcaaaatatatgaagacacacagagatagctatatatagagacaacggcagcatgttattccatatggaaaaaaaaatttgtatctgcagataaaatggcactccaggaggatatcaaagcatcaaatggatgttttcattaaaagaaaatttgtacatgaatttttaaaatttcagttcatgatgttactcattagctctatttttaacaaaatgttcccttttgcatagagaaaggaaagtcaaacactgatcttcaatattaatagttaagaacctgaaaacatcttacattttattttataggtttaatctaacttaaaaaaaatgttaaataaaagacaatgaaattgaagacccctcctggagaaactagtgaggatactaatatagactctacctcctcaaaaacctaacttcaaagagattttaaagaagtcatcaattctctcacatggcagactgggataacatctgttaatagagacttaaaaaaagtaagtaatttaaggaagaagggttgataattcattgattgggataagagaggaaatggcaagagaaacaggtatggtttcataatgacattgagataagtctcaaaggctgaaggaagaatttaatataattattacatctagtgatactgatgagaaacacatcctttctccctcagttttctttttgtgcgtaatcttgtaacagattgttcatgttttcagtaaatactgggagtgaggaatggtggaatgcagagatgttaagcagagggatttggtcccaccaaaggtactctaaattaaataagatgtgctcactttgcaaaagtgacttcaagataagtgcctagcttccaccattactgctatactccacttctaacaaaattatcatctttaattttctagactgccgcactagaaccatcatagtgtggaccaaatttacactatttttctacttcctatttctattcttctaaagttcttaatctgtgttctaaatctgggactgggcttctaagagtaggttcactgattgtgttatccaagacaggggttggcaaattatagctcaccggacaaatccaacccacacctgatttttgtaaggctgaaagggtaagaatggttttgacatttttaaacagttggggaaaaaatcaaaaaaacagatatttcttaacatgggaaaattatataaaatttaaatgtccacaatcttgttccccttttaaagatatattgttgattattttaacactacaacaaccagagttaaatcgttgcagcagagatgacgcggcccacaaaagccctaaagatttactttgttctttacagaaaaagtttgctgacccccaactcaataacttattttatataaacataaatttttcaggaaaataatactgtgaacccataatatgattgtagcataatgggaaaattaggcaaagattgataaaataccaatcttattattatacagtcacatatcatataggaaaaatctgatacaatggatttaatatatcagatgggaatttgagataaaaaagattctaatatttctagtcttataaatgaaactgagcctaaatgaagctttcaggggaaatgatcatgtaagacaaattacaggggttggtttctaaaaccgattctttttactctttactgaaggtcaaggatactgaatgtgccagtgcaccttcagaaagcagcctgcatcagcacatttaaaccactgaatggtctcaccacctagtttcttgcgaaagctgagcaatacattttgtgatagataccactgagaaagttaggcagaaattgttattagtagtatatgacaatcataatagtctaacttttactgtaaaactctattatttatatgttttctgtacatcctgtaggattgtctgtattttgcaatagaattgcaatgtgtaagagaaaaagaggcagtctatgtttccattgtcattctaagggacatattatccatacaacacctcctttttcccctttactgaaaagctgtgtataaaacactctaccatgctttcctgaaacataaaagaagatttattactattttaataaagaagtaagaacaaaaatatccaatctcctaatattcaatggagaagaatatatattcttttttaggaggacacaaaaatagcaagcttaagtatattctgttccctaaggtactgtgtaggtggagaaaattatttttcatttaaaattatatacttgtagttcattttaagtaagcccagtggacataaagctgattcattcacaaatgcaaaattttgttgtaattatttgcttaaccaaagcaatattcatcaaaaatggattaatgctaggattattttatttcaagtaaatgaacatatattgattagtgaccttccaaaccccatgctagcaacagtaattactattattaataaaatacatcctctagtgcatattaaatggttcaatttattaaatatgctgatctctgcatacctcctcaagattattttttaagaaaagtttactttgcctgagaaagaaaagatgaaatatgcaaacactaagtttactaaaaccaccaaatacaagctgccttggagtcccgttgttctgaattgtcttaccctcttaaaatcagatgttttaagcagataactcaatttttcatacaatataaaatgtccaaaatccgtgtaattctctgcctctgaatacatagtctctatctatttttctcattgttttaatctaaaaggaacattatgttttctctttttaaaagtaccctccttcagcattgtttttacttctaaactccttagattttctcctcaaatcccatttttctccgcacaatctcatcctcctttagctagaatcactcactggtgattaaacagagtcacgcagaaaataatgaatgcaaaaatgtgggcaggaagaaagataagggaagaaatattcttcaggaaagaaaatgaaacggtatttgtcagcgatgttgtaaaggggaagaaacattagagaaagggtgattggttgatagtgtcaaacgctgtaaagaaaggaaagaagaggtattttttaaattagcaaagtggagaatcatttttaaactttgagttagagttattactgaggaatgagaatttaagtttcctttgtggttttctgtgcttactaaatcaccagctcttcttataaggtgagtgatatatagtaagaatgagagtctgtggggaaggctggtgaacatactttgatgaaaaaatggactgtaaaggagtaccatccctgtcataggaagagatattttagtgtctgaatctgtgagggggtgtgtggaggtcaatgttgatgctctatgtatctaccggaggaaatttatgtgtgtgtgtgtgtttatctattgtaaggggaagccgtgagatatcagacttccctggcttttcctatctctgataagaaacactgtagttctagggaagctgagcgctggaaaggaccttgactttgataaatacaataattggtgacaagatttaaattttgttttccatgagttctggtgatagggcattctggcttgttttatgtcatttgtcctaatcctcttaacctcttaacctattctacaaaccactttaaatatttcttctcattattccaaacccttgctgtcaaacatcattgtaacctgtgtgtatatatatatataatatatataatatataatatatataattatatataatatatataatatatattatataattatatatatactatataatatatattatatataatatatattatataatatatattttctatatattatatataatatatattatataattatatatatattatatataattatattatatatatatttttcccactacagtgggaaaaaccattaatccagtggctatttcctgtacactatctctcgtgtctgtgagctcctttctgtttctattgccatcagtgtctttcacaacctcctctttctttatgatgtgtttcaaagcagattctttattttcattctcccaagacctgctgcaccttgcctactaatgtcagatacgttttcttcaaatgtcacacttcaggttagttatttgattgaatgcctatgtgattcccactacttccatataaagtccaatccaatcaacttaattattcacagttttgttcaattgattttactttccctgcctgactttccatttgtctattcaaggtagactagtttccaccattgcgctgacttcttgccctgaaatcactacttacagccttactcatcaaagcaaacgacatcaattaatgaagtaaaactcttgtcctaggctgtctattggtcttctctgatcctttggcggcagaagctctgcatacatccatcttgcctagacagtgttatgcaaattaacacaaccaaaaacaaaagtcaaattgtggttccttttatatattttataagtactattattaataatgaaaagacttttttttaaaatttgactaacttttttacataatactatctacttcataacatgaaaggattaagtggatttttataaataatgtgcatagaaccatgctgagaaaaatatgaatgttctaacattggtactgattgttattgttatttttactgctaattcttaattagtagagacaaatgttgactgaactatttctttggcgagaaataaataatgccatattttgggctcttcaagccgagtctcttctggcttggaacactaaactatataaattgacccttattatttaaaatgtaaaccacattaaaaattcattttcttaatcaagatgaagctaagatatttggtttccaaaccattaaaatttttatgagcaattctctgtaaaagcatttacctctggtatagtcgactactagttatgtactaataactattactaggatccattagctactcgctttgatctgtgttgtcatgaacaggaagatttggaaactgttgatggtttatacattgactatacaaaatactatattttaaaatgaaatcatatgaaattaatttatcaagattaactgtagtgattacaaggaaagaacagagagtacatgtttgatacattaaaaaatcttttcaaaaaccaaagaaaatcatgggtttagattataaagtcataaggtgataaggcaacttttgctcatgcggaaatatgttaattagttttataatattgtttctccatcgaagtacttatacacgtgtttggctacttaaaatagggtaaagaaataaataaataaattataatgctctaaatgaaatttggcatataccatctctcaaatttgcagtttatagtgcaggaacaaaaaagaaaagggaagtgtgatgaaaatatttagaaccacttgtctagagtttaaaagaattagtagcaaaaatattacaaaatataaaactactgattgccttgaatttgttacctgatcccaagttatgaacattaaaagtgtcataaagaaacaaagtcagacacttgttaaaaatagcaagacagatcttagtaagatactgcagtagggaagagagacttcagtggaaactgggttcagctctgatgaaacaaaaggcagaaggctgtttaaatgctggaatatgctaaagtaggggttcccaatccctgggccatggaccagtatgggtctgtggcccgttaggaactgggctgcatagcaggaggcgaatggtgagtgagcaagtctaagtaacactttgtatttacagtggctccccatcactggcattattgcctgagctctacctcctgtcagataagccacagtattagattctcatagtagtgcaaaccttattgtgaactgtgcatatgaggggtctaggttgcgtgctcctaatgagaatctaatgcctggtgatctgtcaatgttcccatcacccaggtgggattgtctagttgcaggaaaacaagctcaggactcccattgattctacattatggtgagttatataattatttcattacatattacaatgtgataataaagtacacaatacacgtaatgcacttgaattgtcctaaaatcatccccccaccccactgggtccgtagaaaaattgtcttcagtgaaactggtccctggtgccaaaaagactggggaccactgtgctaaagcaaaagtaccaaagcactttgaggtggatgcttaatgtgattagcccagttgtgtttgctaactggcacttacagaaataaagtccctactttaccacagagactgggaaatagaggccctatctttctcaatggttacatttcaaaaggaggtctcccaggtccttgagaaagacattcctgagttgcagatacatttcacaacgacaaggaaaggactacaagtttcctaatgtaaattctctaagaaaagggaagtctgggacccatagccaatgatatggtttggttctgtgtccccacccaaatctcatcttgtagcttccataattcccatgtgttgtgggagggacccagtgggagatgactgagttatgagggggagacttttcctgctgttctcatgatggtgaatgggtctcctgagatctgatggttttaaaaatgggagtttgcctgcacaagctctctctttgcctgctgccatccatgtaagatgtcacttgctcctccttgccttccaccatgattgtgaggcttccccagccacatggaactgcgagttctctattaaacttttttcctttgtaaattgctcagtctcaggtatgtctttatcagcagcttgaaaacagactaatacagtaaattggtaccagtagagtgaagctttgctgaaaagatacctgaaaatgtggaaacaactttggaactggctaacaggcagaggttggaacagtttagagggctcagaagaagagaggaaaatgtaggaaattttggaactccctagagacttgttgaatagctttgacaaaaatgctgatagtgatatgaacaataacatccaggctgaggtggtctcagttggagatgaggaacttgttggaaactggagcaaaggtgacttctgttatgttttagcaaagagactggcagcattttgcccctgccttagagatttgtggaactttgaacttgagagagatgatttagggatatgtggcaaaataaatttctaagcagcaaagcatttaagaggtgatttgggtgctgttaaaggcattcagctttacaaaggaggcagaacatgaatattcagaaattttgcagcctaatgatgtgatagaaaagaaaatcccattttctgagaagaaattcaagcgggcggcagaaatttgcagtagtaacaaggaacacaataggggaaatgtctccagggcctgtcagaggtcttcacagcaggcccttataccacaggcctggaagactaggagaaaatggtttcatgggcagggctcaaagtccccctgctgtgtgcagccagggacctgatgccctgcttccaagccactccagccatgggtgaaaggggccaatttagagcttgagctgtggcttcagagggtgcaggccctgagccttggcagtttccacgtggtgttgagcctgcaagtgtacagaagtcaagaattgagttttgggaacctctgcctagatttcagaaaatatatggaaatgcctggatgtccaggcagaagtttgctgcaggggcctggccctcatggagaacctctcctagggcagtgcagaagggaaatgtggggttgaagtccctacacagagtccctattggggcactgcctagtagagctgtgagaaaagggccactgtcctccagaccccagaatggtagatccactgacagcttgcacagttcacctggaaaagctgcagacactcaataccagcccatgaaagcagctgggaatgagactgtagcctgcaaagccacagggatggagcttcccaagaccatgggaactcacctcttccatcagtgtgacctggatgtgagacatggatttaaaggagatgattttggagctttaaggtttgactgccccctggatttccaacttacatggggcctgtagcccctttgcttcggcaaatttctcccatttggaatggctgtattttcccaacgactgtatctgcattgtatctaggaagtaagtaacttgcttttgattttacaggctcataggcagaaggcccttgccttgtctaggataagactctggactgtggacttttgagttaatgctgaaatgagactctgggggactctcgggaaggcatatttggttttgaaatgtggaaatatgagatttgggaagtggaatggtatgatttggctgtgtccccacccaaatctcatcttgaagctcccatagttcccacgtgttttgggagggagctggtgggagatgattgaatcatgggggcagatctttcccgtactgttctcatgatagtgaatgggtctcacgagatctgatggttttaaaaatggaagtttgcctgcacaaactctctctttgcctgctgccatccacataagatgtgacgtgctcctccttgccttccaccacaattatgagacttcctcagccatgtggaactgtgagttttccattaaacttctttcgtttgttaattgtccagtcttgggtatgtctttatcagcagtgtgaaaatggactaatacagccaggttttggcagaaacaaacattaacttattttagcaatgttgatgtttgtcaggtagacatttaagtgggctgggattgttaacctgggacacagccttgaactgttaaaaagctgtgctagaatttgttcaagtctcttagtgtgggacatgcacaaaatcatttatgctgagaatctgcagttctcacaggccaaggttaagtcccagtcaataaaaatgctcggaggagcctgactaaagtctggtcaaggagagagtctttgccataagaaacttaataataactaatatctctaggctactatttgtcatgcaatgagctagtatttgcagctttttcttatttaattctcatatttcctcttgaggaatatactaggattactgcctttatttgaaatgtgtaacaggctaagtaattttttcatgaattaatgctgtcctcatttatttaaactgtattttcataagttagcactagatacaggaaccaagggaacaggtgtagaagtcccaagaaactgaatgtgtgggcaaagcaaagaatggctaaacacacaacatccactgagttaccatgcacgagaagaagcaggaagatgtaggtcccctgttggccttatattcttcccacataaattatagattaacatatttcctgattttttgaagtttccagagatttaccaacttgatctttcatgtgactttctcttattctggattttcagtgacttttcctctcactttattgtctctaaaatcacagaaaccctgtttaccacaattattttcttaaatttatttctacaggtctttagttaaaaggtacagggaagcagacaaaccttaaacttgataatacgtgggaaataatgttactggtatcttagaagtcatgccagtaattcgtctaaatttaagcatcaattgaaatacggatgcaaaattattatacgtgattaattactttaggtctttcatcagtttatggtagagtaaccaaattgcccttgatgcctctcatgtgtcaagtattgttttgggtgcaaaggatagatcaataatatgacatggttcttgagtcagtttggttatgactggagttggtgagaatgttagactcacattcatgagtggatttgataaatacaatgtggctgacatgatgtctgctctcaccaagacttccatttcagttctttgatttctcctttgctttcgttaggaatggcctatatttggtacaccaaaaatttacactaattagtgagcacttctcctactttaaaagagaagctcaaacaggaaagaatacacacacacacacaatttttttggtatgagattcaaaattcctagaaagcttatgacaaaattatcaaatttgttgaattctcaaaattgctaaatttctgaataatgttcatctagctacagtacttattattccaccggaagaaagcatatgcttcaacacaaaaaaaaaatttgagtgcaaaactattaagtaaaactctgagaaaacatcatttttgtacttggcaataaggcaattacttaaaaaaagttagctaatatttgtgagtgttacatttaattaaacattaaagaactttatagaagtatttttaaaaaggaagaaaggaagaaatgtaataacccagaattcaagagaagataagcaaaatgttatttgacagaatccagaagcacatgaaaaagttaattcaccatgatcaagaaggctatattcctgggaagcaaagttggttcaacatacgcaaatcaataaatttgattcacctcatacacaaaacaaaactgaataaccatatcattatttcaacagactcagataaatcttttcataaaattcgacatctctttatgataaaaacctacaacaaactaggcattaaacatacctcaaaatgataggaaccatgtgtgacaaacctagagcaaaatcatactgaatggacaaaatctggaagcataccccttgggaactggagcaagacaataatgcccactttcaccattcctattcaacatagtactggaagtcctagacagagcaatcaggcaaaagaaaaaaatacaaggcatctaaataggaaaaaaggcagtcaaattaactctctttggtgctgatataattctgtacctagaaaactgtaaagactctttgaaaaggcccctagaattgattagcaactgcagtaaagtttcaggatccaaaatccacatacaaaaatcagtagcatttctatacaccaataatgttcaagttgggagccaaattaagatcaaaaacccatttacaatagccacaaaaaaaattaagtaggaatgcatccaacaaaggagatgaaagatttctagaaggagaattacaaaatactgctgaatgaaatcatagatgaaacaaatgggaaaatgttccatgctcatgaactggatctaccgactacgtttttcccagaactagaagaaagtcttctaaaattcatatggaactagaaaagagcttgaatagctaaagcaatactaagtgaagagaagaaagctggaggcatcacattacctgttttcaaattgtatataaggctactttaactaaaacagcatggtattgtcacaaaaacaaacacatagaacaatgaaacagaatagaaaacagaaataaggctgcttacttacaaccatttgatcttcaacagactcgacaaaaattagcaatggagaaaggactttctattcaataaatggtgctagtttaactggctagccatatgcagaagaatgaaactgcacccttgcctttcatcgcaggcaaaaattgtcttaagatgaatataagacctaaaactataaaagtgctagaagaaaacctaggacatggcattctggacatcagccttggctaagaatttatgagtaagtcctcaaaagtaattgcaaaaacaaaaattacaaaaaataaaaattgacagttgggaccctaaagagcttctgtacctcaaaataaactatcaacagagtaaacagataacctatggaatggaaggaaatattcataaattatgcaacttacagaagtctaatatccggagcctctaaggaacttaaacaattcaaaagtgaaaaaacaaataagctcattgaaaagtgagcagaggacatgaagagacagttctcaaaggaagacttacaagcagccaacaaacaaatgacaaaccctctacatcactaagtatcagagaaatacaaatcaaagcaaatatgagatactgtctcacaccaatcggaatgctattattaaaaagtcaaaaaataacagatgttgatgatatactttgaatatatgtccctacaatatctcatgtaaaattgtaatccccgatgttggaggtgggacctgcttggaggtgtgtttgggttatggaggctgattcctcatggcttggtgctgtcctcatgacagtgagtgagttctcatgagatctgatcatttatcatttaaaatgtgtggcacttccccacctctctcttgcttccactctgccacgtgagagccttgctccagctttacctttcacctgaggcctccctagaagctgagtagatgctggtgctgtgcttcctgtacagcctgcagaacaattagccaattcaatctcttttttaaaaaaattacccaatgtcaggtatttatttatagtaatacaagaacagcctaacacagttgctgaggctgtggagaaaagggaatggttatacactctaggtttgaatgtaaattagttcagcctctgtggaaagcagtttggagatttcccaaagaactcagaactaccgttagacccagcatttacgtgactagggatacacactaaggaaaataaatcatcctacaaaaaagggacacattactttgtgtgttccatcatagcactatgcacaaaagccaagtgtattagtctgttttcacactgctataaagtactgcctgagactgggtaatttataaatgaaaaaggtttaattaactcacaattcagcatagctggggaggcttcaggaaacttacaattatggtagaagacaaatgggaagcgaggcacctttttcataaggaggcaggaaggagaatgaactcaggaggaaccaccatacacttataaaaccatcaggtctcatgagaactcacacacttcgcgagaacagcataggggaaaccgcccccgtgattcaactaccttcacctggtctctcccttgacacgtggggattaaaaggattacaattcaaaatgagattttggatggggacacagccaaaccttatcatcaagacatggaatcaacctaagtgtccatagattggataaagaaaatgtagtacatatacaccatggaatactacacagccataaaacaagaatgaaatcatgtcccttacagcaacatggatgcagctggagaccattatcctaagaaaattaacacaggaagagaaaaaccaaatactacatgttctcacttataagtgggagttaattattgggtacacatggacataaatatgggaacactagcactgggaactactacagagggaagagtaggagtgggtcaaggtctgaaaaaatacctgctaggtactatgctcactatctaagtgatgggatcaatcataccccaaaactcagtgtcacacaatataccatgcacatgtgccccctgaatctaaaataacagttgaaagcataaaacataaaataaaataaatcttcgattggcatgataaatgttaaaaattaaacatcaagggaaactgtgtgagaaacatatggggatactctgtattaccttggcaacatttcagcaaatttaaatttatttcaaaataaaaattcatattaaaattacccctgctaaaattttaattaacaatatttataactttaaaaaggaaattaaatgtgtttcaagaataaggggacactgacatcctccttcttccattctgaagaagatcataaaacataagcacctgcacctgccccaagactggatcaaaaggtgaacacacagatctattaatcactcatctaaaattctcaaacgctaagatattccatagactctaaagtcagacctgaatactacctcaaaggacttgaacaagaagttccaagaaaaaaatagcaacagtagttttaggaggaaatgtgcataattaataggtcaacaaggataggtaagagacagatagcctgaattcccactaatgggaatattaaaaagaaacaatgaaagaaaagtatatacttacctgtacaaatgaaattgtaaactaaagagaattccagtttagcagattaaagctgaagtcttgactcaaatttccatttggtctaaaaccataatggaatacggagactgaaaaaaagcccaagtaaatgagacacatttctgtggaaggagttaaatgattttatttttttcaacagagtaacctgaagaagggagcctgcataatcctgaaggtcagggagcaaattaaagagtaaaggggcatccactggagattttcttctgaatgccttgggttttaagcatatccttttgtgagatgcaagggatgttgggttgtaggcagagctagaaatctttcccttcttattttctagttcttttcagaagttgccctaatcatttagaaaggagatttgcatgaacctgaaagttgcagagtttgctttgtaaagaataagaaacactagtgtcaaagatcaaataaagaaggctggttgctttacccgttattcaggcagagaaggaaaatagtgaactgtgtggaccatgtctaggttcaaggaggagacaggtgaaagcccagagtacctaacagtggagaatttctggacactggaggaaaaaaggtttgatgtgaagaagattcaaaaagtaaaatgaaaaagaaacagtgtaaatatgtcctccccacacaaacactggctcactgagggaaatgggagtcttcgtaatctccaaggtttcagaaaatataaagtatctacctgtaaatcaattacgccccaacccaatgctaatgaatgtactttctatggagagatctctctgcaataaccatggagaactgaaaaactaaacctaaatcataagaagagtttaggcacatattaggagtgttttagagaaaatgtcttctgacagcatggttgtacacaaatcagccagaacttttcatgaccccatgcattagctgatatgccaagatgcccatgcaccagccatgaatctccttctggccactggagccaatccttatcttcataaataccttccattactttcaggtttcttgtgtccatagccaaatgactgaattaaactctgaaaaacttgtattaggagcaaccttgattcttaccaaaaacaatactgcatttcaagaagatgaaactttttatatggtaaattataaaatcttgcactgctttctatacttgtatcaggagcacccttgattcttaccaaaaacaatactgcatttcaagaggatgaaactttttataaggtaaattataaaatattgcactgctttctatacttataaatattttgcatatgtcattatagcaaataacaatttttagaaataattaaagtctcaaagtgttcctttcttgaagtcagcagcagttacaatttgttgtaactagaaaaactgaataatattttattcattttaattattggaggtcatataagtctctggacttactgtattttatctaaaacatgtattttcattttggaaatggagaattatttctttattaatctaagcatgtctatgcttttagaatatgaggcaggctctgcaattttcttacaagacgctaaaggaatggaaagcaaaatcaacaaaaggaaaagagactgagaaaaaaattatacatattgtttataagtttggtgataacaagagttacttttaaagatgcttgcgcgtatacactatcttccaactgtttcagatgtaaatatattaaaacaagcattttaacctcagataaataaaaaagacacatagttaggcatcttcacaattataaactgctgcttattcttatccatgctcctaaaatgccttataatatctgctgtcactgccttggattataagcccaaaacagaattttctttttttaatagataatattataaaggtgattttctaagtgtacacggcctctttaggaagatagcagtaaggctcagatgtatgatttatagagcagagcttttaagccataaactcatcattgatgtcttacagccagatttaattaccttcctgaattttgattattttttccttgctttaaacagatcacacataaaagtatgcctacgtgatatatagtttttcttgtttttgaaatgtatacaaatagtctcctataaataaataaataaataaataaataaataatttattcattcctggacttgctttcttgactcagtcaagtcaaagctaaaatgaaagcaattattttagagacctatgtaaaatacatgcttatttagctgagatttgcttcaaaaactcgagtaaaacaaagagctccatgtaaaaatggtgacattcgtgtttaattttccttaattcatctcatatatgtatatatatatatgcacacacataatttcatacactgtgtaattttacaatctgtactgtcaccaaaatttacctattttatcttgtattctaccagagttctattacatggaaattgtgaagttcacagtaatataactactctaagttgttaatcacatataatacattaagcattgtgttgggtaattggcattcttttatctcttttaatttaatgaaaattgtattagttaggataggcaataatgtgttatggtaacaaatataaaacatcagaagcctaaaataagaaaaattatatattgttattcactctcaatgtccaaattgttctgctattatactcactcaaggatgtaggttgacagagctaataatgacacactcaaaagagggaagaaaaacatcataaatgatacactggatcttatatttatcattcagaggtgacctccacgagttcacttttaatcacaaatattatggtcatatatcacttgaaaaacaaaaacacagaagtataatcctgtcatgtgtctgcaaagaaaacgagaaatatttggtaacaggaataatgactaacctctctcaaaaaaaaattacaagacagccactatcatcatttgtgaagtaaagaaacagaagctcaaaaaagtaagtaacgttaataattgacatgaagtcattaatccagtaatactaaaaactgaatactaatccatttctaaaacctttattttttcctagtattaatattttaattggaacttaaaggtaaaacattagactaatcatcaacagtttatgatgcaccatcaccattagcaaataaatggcgcttttcttaatggtatttatttgtacagtgcaatgaatattaaaaatttgcttaaaccaagaattagagtattaccaactatattcatctgcatgtctctattctcccattcccctgtctctttaccctcagagataatcactttcccataggccagacaagagccaatcttgtaagcagatgtttctaagtgcagcagtctcaggtctcttttctgcatactgtaaaactaaattgtatttaatttgcatatatcacattttccttcctaatatgaatttataaatgtcatgaatgatgttgacaaaccatgaaacaatttcatataaatacattttctagaagccacatataatagcaaatgaagtggatttaagattttaggttaggtctctgaaatgtacaaacagaaagaaggggaaagagcagaattgaaagaagaacatgggcaggaggtcacgtcaccagcatagcattcccagtcagctttctagagctaatgactgatatgacagaagaggcaaacaatcccaaatctataaaatataacattgttaaattctttatttttataacttataaataagaacattaatttccaatataccattgccctattattttccagtactagaaaacacaacaaaattttcaaatgatttacacaacgtcatatcaaggcaaactatagccatattgagacatactcatgatgtaatataagtaaacaagatgtcagtaagttgtgattctcccaagtatataaaagcctttcaaacttttatggcatagcgtaccttctttccttttttgagctaaaattttctactctgtatcactatatctattcctctgtctgtcctactcctagtcaagactcaactaagaatcaatcttcaaaaaaaaaaaaaaaacaattcagggaggctagctgaagaatgatttagttacctattttgagctcccatcatcttcttggaacactattttgatagatatatgagttttcttgtcagtatccctcactatgctgtaaaatctataagagaggtgttagttttctatcactatggtaacaatcaccacagacttaaaataacactaatttgttaccttatagttctgtgagtcatcagtctcattagcctaaaatcgaggtgtggacaggactatatcccttctgtaggtcaaaaggaaaatccatttatttgtctgctccggcttctggagacagccctgttccttgactcatggttcttcttcaattttatcagttaataacagttaattgagtaccactcacaacacgcacttattccatagtcacatttccctcagactttgagcttatctgctttactctttcattttcaaggactctaattattgtattgagctttcctgtatattccaaaataatcttttcaggtcagctgactggtgaattttatcttcaataaattctcatttgctatgtaatgtaacatatttgcgagttccagaaattaggacatagaaataattggggagttattattctgtttatcccaaggggcataaaaattatccagtgtttttaatgagctcaataaatatggtatttatcaatctgaaacaatcaagtttcagaacatgtctgaatctatttggtactgtggacagcatgagcaatattaaatgttagaacatctgaaacagatgaagaccttttatgtggacaatactcagatctacttgactaattagtacagtctcttaaaataattcctttagattaattccttcagataacagatgaggaaattgtatcccagacagacaccgtgattttctctatgtccttcatggaaacagggagactccccctccaccctgtgtcacattttgtaactcgcacaacataaaagatctgcttgaaccctgatgactgatggtctcatgaaaaaaaagatctttattttcagctttttgtaactatgtattttagacatatacattatgagactggattggggtaccaatctcagagagaaagtatgtattttacctttacatttttttatttgattacaatctagtaaacaagttaaagaaagaaacccatggcctcccaaataattgacagacatttacaattaagattattctttcaaaattcaagttttgaatttgaggtaagaaatatcccttcagaaatctcccacatttttgctgtatctacagtatatctcattatactcagttaagtcattcagtaataactaaaatcctaaagtacttcgccaaaaatttaaccagataaaaacaattttaaaaagtagctaatgaatttaagatagtgcctggcttccattttttacacttgtcaactagcctatcttttattatttaatttttatttatttctcaaagaactaaagtagatctaccatttgatccagcaattccactactaggtatctactcaaagaaaaagaaatcattatataaaaaagacacatacacatgcgcatttatttgcaacacaattcacgactgcaaagatatggaatcaatctaagtgtccaccaaccaatgagcggataaagaaaacatggtatatagacaccacggaacaccgctcagctataaaaaataacgaaattatgtttttttttgcagcaacttggatggaactggaggccattattctaagtgaagtaagtcaggaatataaaactaaatacttcaagttctcacttgtaagtggaagctaaactatgggtacacaatgatatacagagtgatataataaacaatatcctaccttaacaagccactgtccctttaattttatctcctgtatcccgtaaaaaggacgtaaaattcacaggtgagtactattcttaatgtctccaaaattaatagctgtgcttgatgttttcttatagaattgaaattccaaatatatgcttataaataaacgataaatccaaatttgttacattgtacacatgttgccactttgaaagttaatattattttcaacttccaaagtttgtaataatattttaagagattcagacaaacatgacctcagaagaatctatgaggaggcatacatattctttagccctagatatataaaatcttatttggtcagagagttaagagttataaagtatttcttggagccgagtctaaatttcttcattttgttacattaaaaggcaaaaaaaaaggtctcagaagtttaagtttttgagagaaaactacattctaaaattcatgtttgaggattatttctccataatttgacttaaaatggttattttaataaattaaatacaagatactaatgccaaatgataaggcaatagaacagttacatatttgacatcactacaaagatattcaatacattgagttgtttataatagtgaataaagtagccaaaaactaataaataggagtattcctctgagagtctggtaacatatactgtaaaatccgcaaaatgtatatgggaacaccaccaaaagaaacatgattaatgttgatgattctgaggttttcaaatagattcgtgtgtatctgcagccacccaaccacacattaaccctgtcacctgaaactatcactatttaacaaaaaagactaatgaaacaatgtactttcctgatatatggcactgaataaaatatacctagtgattatagatagatttttaaaagctggtcatggtggtgcatgcctgtagtccagctgatctggaggctgaggaaggaagatcacttgagcccaggaggtcaaagctgtagtgcatcacggtcatacctgtgaatagcactgcactccagcctggcaacatagcaagaccctgtctctaaataaataaataaaaaccagttagaaaacaaaatgagaaaattgagaaaaataatttatagttaatgttgcttccatctgaatgtgtaatttgataataaagttattttgcatatttaaacataatttctttaacaggaaaacagaaataaaatcagaaaaaatgtaaaaattggaaattttctgccttcctgataatttttttttttttagaaaatcagggcaaaacatttaggaatacttactattattgcaaaaatttaatatcatgggttcaaagacacttgagatatataagtatgtacctttaatacttttctatttgttaaatatagcttagtaaaataaatgaactaataaaattcctaaatgttttactgaacaatgatttttttccttgatgtttagatgaaataatataatacctacaaaaagatactaagtgatgtcaccctgcgtagcttgaataaggacatttactgaaacatttttatgaaaaataaacatatttgattacataatttatataccttttccctccagatgtttccttttttccttccttattcttgaaattacttataaatgacaggaattttatatgagttctaaaatcagaataagaggaagagtggaagaattagaaaaagaaaaaaaaaatgccagttgtgcacttcttcacgatgcctttttaagagtcttagtgacatattaaaaagtacaaacaggccaggctcagtggctcaagcctgtaaccccagcactttgggaggctgaggtaggtggatcacttgaggtcaggagttggagaccagcctggctgacatggtgaaatctcatctctactaaaaatacaaaaattagccgagcatggtgatgtgtgcctgtaatcccagctactcaggaggctgaggcaggagaataacttgaacccaggaggcggaggttgtggtaagccgagatggtgccactgcactccagcctgggcgatagagccatttctgtctcaacaaaatgaatataataaaaattaaaatttttttaaaagtacaaacataatttagaaataaagttttgtgtgtgtgtacgtgtaaataaagcttttctaagaacatcatcataaaacaattgcatttgttttcatgaagaatccaagaaatgcacaaaataatcacttctataaatgcttatcttgaccacaatcaccacttattcagttatcttgatcacaatcaccacttattcaggaacagataagagatacaaatttttaagatctagatccagtagttattgaattaactactttctttctcaaagttttcctacaactaaactgatgatctcccttctaaatgtagcccctttaggatgtttatattagtgaatggccctattctaccttattacataccacttttcctccctttattccacttccactccccatttgcaataaatcatacacaggtacacatatgcaaacaccacacacacacacacacacacacactgctgtgtgtatctgtgtgcatgcacatttttctttatctatttttcaatctcttcacttgtctctagctccacttccacctgcttaaactactattatctctccgttggactatattgctaactgtttatttcacctctgatgttagttttcttcagtctttacacaaatccactctcttcactatagcgagtgatctgttttagaataaattgaatcatgatgttactatttctgcccccttcccctgcccccactggtcctgttccagctttaaaaactttaatggtttcacttagaatgaagactaaaattattatcattggctaacaaaccttggtctctacatacctcctcagtttcatcagcatttgatttacattggcctttattcatattgctatagtctgaatattttaactccccccacccataattcatatgttaaaatataaccccccaacgtgatggtataaggaggtgggctctttgggagataattaggtcatgagaccacagcccttatgagtgggattaatgccttataagaggccccgagagctgtctgtgccttctgtcatgtgagagcacagagaaaagaccactgtcaatgaatcaggaagtaggccatcaccaaacatcaaatttgctagcacctcgaacttagatttaccagcctccagaactatgaacaataattttttgttccttataagcagtttaaagtgttatgtttatagcaactgtctatatcaatttatagtgctatgttatagcaacctaaatggactaagacaagacacttgatctcacctcgcttacttctggtcatggaggcttatatattattccctccatttagaataaactccttgccccattatctttcatagtatctagcagatagtagagaccttaaaaaatacgttgaaagactaaataattaaatgaactgtcaccaaaagcaatgaatatatcagcatattatatgtgcattatcagctatgcaatgaattacagaaaattctgtttctcttactaaagacattatgactattccataccccaaatgatctattaggtcagtttagaggttacagtttattttacattgttttttataccttatatagttattgaaaatttattgaatataaataaaaggacaaaagttttacatttggtaataaatgcccaaaatataatttatataaaaagtatcagtctttattaaaatgactttgacccaagtttattctttataaacgtctgttgtaactctccaatgtaaagaaggcaaattggtgataaaattagttttgttttattttttgggacagaatctcgctctctgtcccaggctggagtgcaatggcacagtcttggcttcctgaaacctccgcctcctgggctcaagcgattctcctgcctcagcctcccgagtagctgggattacaggtgcctgccagcacgcccagctaatttttttgtacttttagtagagatggggtttcaccatgttggccaggctggtctcaaactcctgacctcaggtaatctgcccaccttggcctcccaaagtgctgggattacaggtgtgagccaccacacccagccataaagtttgatgaacctactctgacatatgttttttcatttattttagaagagtctcctcaaatgactttttatattaaacctgttcaaaacgatttctaaacctcaactctgaaaggatgctcaccaaatacttaaatgcacttcagaagtgaaagcaaagatatgttttcttcctacttgcatataatgaaagttaataatagaatcttattgataagtataatttgctaatacattcaaacacatgtgttgtcaaagttggtatacatatagtactgtgaaaggagagtctattttgatattttcccaggatagattatcattttgccttttgtacacacttttctgttgctctcatatgaccttaattgtttaaaaagtgttacttttttaaaaaatacatacttttgttctctgttagagcaatatgtatttggtatagattcagaaaaatatttgatatagattcagaaaaatattccatttgaaatctgggcttttaaatcacataaacatataatactagatgggtttcagttattttcttttttttttttttggcttagctctggttcattttttttaaaattttattttattattattatactttaagttttagggtacatgtgcacaatgtgcaggttagttacatatgtatacatgtgccatgctggtgtgctgcacccattaactcgtcacttagcattaggtatatctcctaatgctaaccctcccccctccccccaccccacaacagtccccagagtgtgatgttccccttcctgtgtccatgtgttctcattgttcaattcccacctatgagtgagaacatgtggtgtttggttttttgtccttgcgaaagtttactgggaatgatgatttccaatttcatccatgtccctacaaaggacatgaactcatcatttttttatggctgcatagtattccacggtgtatatgtgccacattttcttaatcctaacatacttttatatagtcaacaaatagatgaatttttaaaaattaatgccttagaagatgtaaagcatattcagtaagctttgaaaataactgaaacccaaatgtcctacaatcatagactgggttccagttattttcaaagcttactgaatatgcttttcatcttctaaggcattaatttttaaaaattcatctatttgttgactgtataaaagtatgttaggaatctttaacttgcaacatgtcatattacaatatattcactcaaggtcaacaaagagtatttattcttagttgactccttctggtattaagaacatggttgaacattttctgttttcaaagtactttatcttaagcttccagttacttgtcttagcaattccatcattggccagtcattcattctattgaacgtctctaatgacgggataaggctagaaaaaaagattcagaataacagtttctttgcaaagatttttcataatgtatcttttaacattgtattatggtttcaatatttgcatctcactccaaaatttatgttgaaacttaaacatcaatgcaacaacattaagaggttgggcccttaggaggtgattatgtcatgagggctgtgcactctgtaccttatagaagggctgaagggaactaactaggcccttttgcccttctgctatgtgagaacacagcattcgtcttctccaaaggatgcggcaacaggcaccatctttgaaacagaggccaggtcctcaccagacaatgaacttaccagtgccttgatctttgacttccagcctccagaacagtgagaaatacattatgttatctataaattacccagtttctgtttttgttgtggcaggatgactagggcatgtaaatattggtattatactcagaaaactcttagatacaaaattttcagtaaatgaaagatgcatttcttgctattttaaaatttgtaggttggcatgtctgtgtatttttcctttatacctaggaatgaagcagttgatatgcaaaaattattgggatttttggaatttaaattagctagccggtggtagagagatgacaagagtttagcaactgctgagagagacagagagagagagagaaatggtaaatagaaaagtgagaatagaagagacttgaatgaaacctattacaagaaaatgaagaatggagatagaataacacccacacacgaatgaaaaatagtaaaagcatttataagaaggaatttaagaaaatagacaaaaagttgtaggagatagagaaaattaaaaaaaataaaagtacagataccaagtggttgctgagttcctattatttgccagatactttaataaaatgcaacagagaaaatcaaagacaagatggacagaaatttgtaagaagaattgtagcacacagaatgaagtatgtagaaagtattatgagtgttctaagaaagaagtggccaatatattgtgcaggtttgtgtatgtttgcatgtgtgtgtaaatgtttttagacaaagaaaacattaaggaatattgattaatgatgaagaaacattaaatatgctttaaattgaaaatattattataacatactaacatatatttatcatttcttatatgccagaaatatactacacaattttcttgcataacattagttaatcctaacagtaatctaatgagaaagttactattattcttgattatggatagagatcagagccttagagaccactcatcaaaaatcatacattaatattttcaggatttgaaaatgttttatctgatttctaagctcatgctcttaactactatgccttaaatatttattttatattcacacactacatgttttatcgcatgttaatcctctgtttctcttttctttgtttatatgaaactataagatttgaatcatagttcctcaaaactatttcattcttaaaatctttttgtaatctattgcaggtgacacagactattactacactcccactttcgcagtataaataacattctttcaactgcagcctggactcagtgtaaaacactgtattcagaatacaaaactcacgtaaatgaaaggctgactttcacagaaccaactgcaggacttgagtatatatggattttggtacctatggtaggtcctggaaccaagccccaaggatattgagggacaactgtatttttatccccagaacttagcacaaaactgtcatatggtaaatttaatgaatatattttggagaaatagacatataataatattttatcacaacttccatcattttcctaaagttccagggggcggggcccacatcattgtacttttgtgattcctacaccacttattactaaggtattaaaatacaatgattaagagtgtggcagcatgatagggattgtattggatcagtagggcagtattaacaatattgagtcttccagtctgtgaacataggatgtctttccacttgttttcattaatttctttcagaaattatttttaatttttaatgcactaatcatcagaggaatgctgatacaaatgcaaaaatgatatatcacctcatgcttactaggatgaccattataaaaaacaaagcaaaaacaaaagacaagtgttggcaaggatgtggagaaactggaactcctatacatgatgggaatacaatatggtgcagctgctatggaaaactgaaaaacaagttctttaataaactgaaaatagaactacaatatgatccatgaatcctacttctaggtattcatccaaaataactgaaatcaggatcttaaagaaatattagcactaccatgttactgcagcactattcacaacaaccaaggtgcggagacaacctaacttttcattgacagatgaatacataaagagaatgcagtatatacatacagtggaatagtattcagtcttaaagggcggaaagaaaatcctgcaatatttgacaacatggataaactttgaagacattatgctaaggaaaataagccagtcacagagaacaaatactgcatactgcatgataccaatcctacaaagtatctaaagtagtgaaactcacagaagcaaagaatagactggtgccaggggaaagaatagaatggtgccaggggttggagagtgggagaagtgagaatatgctaaacaacatgtgtagatatttagttatgaaagataaaaattctagaaacctgatgaataacattatggtataaagataacaaatacagtattgttaaaaactttaaaatatttttaaaaggtagaacctctacttgactcttcttgcaaaaataaaaaaaggatttggcagcatgagccaggtgcctgagccatctttatggctgttagatgtaggatttgtgtgaaattaagcaagatagcttgaaattttaaccttctgtttccacatctgaaaaacaggaataataataaaattcagcttgtgaaatttttgtaatgattaaatagattaaataagatagtatatacttgattgaccattgatttcttcttcctttgccagaaatctggctcaccccagaaaatgctatttttctgtagccctctcactagtggtgaatgtttttatcatattcttccacaactaggacctgagttgggataggtcctgtttcttactccttcttccctattaccactgccctcttgcttaaaaacaaacaaaacaaataaaaaacacttggtatcatatcatcaaactgcctatatttcctcttcctccattctctcttgagccctctccaaactcagtttccttttcaaggttaggaaagtttggaaagagtttcaattattctttaaatttccaatattttaattcaaactggtatttttgtcaaactatatttattacatattaattccaaggggttcctctgataatctaaagtaaaatgtattctaagaaagagaaaattagaaggaatgttgtccagtgaactattgacactgcacccaacccagtacatgaaatgtgtattcatcactgacaacttgtggaattcattaaacaggacagcagcagtgcctttctccagtcagtgtaaatgtagtttttgagaggaggacaccaaaaatgtgacatttgaagacagccatgatttgattatgtgttttcttgttgctttggattgttatctgtctctatccaacataaaacaaaatccgcaaagatgagattttcatctgttttgttgtctgctatatacacaacaggtagaacagggttgggcacctagtagccccttaaaaataaagctatgcaattttgtataaagctatgtaattttgtgtaacttaaatgtaataatacattattaagtgtgttatctataaaatacaatgtgtgtggatgaaggtatatggtataaatacagagaagagtatttctaaggtgtttggcacttacaaataccacaaacgctagttgttattagaaacctgatgttagcataacaggtattacataatgcttgctatacttgaatgaatgaatgaaaatactcagcataaagcattattaatatttgtttataatgatatatatttttttcctggggagatatcatcagaattgcattccatgaatccagcagatcatgtgtggacaaatctttgatacaaccacataaaatattgatgactgtgttaacaatgttcttttaaaacattatctaagtctaagccttaacagatctcatcagtattccaattgttcaatgaagaaacatattaaatgcaaactagctgaacagtcttcactgagcatttagcggggcagcccttaggggcagtataggatcttacaagagtagggaacattaacagcatgaactgggccactgatgtcaggaacagccactgcattatgatccactagcgttataaacaaatactcagaaaggcagctaataatccgacatgagcaaagaagagaggaaatacctgaagaaagcatgaattcatagtttgagttttctacaaatacttttctaaataatacacaatcatgggataaatactaatttgatctgtaataaattacatatatgaaatataacaaaaatactcaacataaagcgtaaagaattattaatatttgcttataatgctctaatttttcctggggagatatcatcagaattgcattccgtgaatccagaagaccatgtgtggacaaatcttgcatacaaccacataaaatattgatgactgtattaacaatgttctttttaaacattatctatgcctaagctgaagagctctcatcagtattccaatttttcaatgaagaacaatatatatgtaatctataattacacatatatgagagattcagttagtgataacccatgatgtgataaattacacatatacatgtgtgtgtatgtgtgtgtgtgagtaaatttttagagattcacttagtattttgtctacacatataatttacctagatttcttgttttcctaacaggatgcaaaaaaggtacactgtggggtgggtaatatctccttactaaatatttattgactgattttgtccccacgtcattgaccagtgtcatataaatcaaactctcattacctatttttgaattgttgtttgaactccagctactatcctcaaagctcaccaacttgcccttctagctgacgcattttatgtctcaatctactttttattcaatgcttatttatttcattaatcacaaattgggtcattctgccaagtcctgaggaaaatataagtaactgagactgtctctgttcaggattttataatctaaccatgaaaacaagcattacatgacatattataaagggaaagatggacattaattttgattgggtgtcatcagtactaacattggagaacaataaataaattagtatcagtaataagtagaattttagtaaaatctagaacaataaacttttgttaaaattttacattataaaatcacaggacagcatgtggctatcgcatttcaagctgagataacagatttgctctcagatttcccacataatagttgaaccacaatgagaaagcaacttgagttccctgtttctttatagttccctgatctctaaactaggcataataatagtaaaatactaataattattgttataatcacaaggaccctatggagtacttgtgaacattaaagaatataatctatataaatggcttaattaataaattctaaataaatgttggtggttactattagtgactgatgcttacacataaaatgactattgatatgattcataatttcaagagacttcttgagtggtgtattagtctgttctcacactgctaataaagacatacctgagactaggtaaaatatgaggaaagaagtttaatggacttacggttccacatggctggggaggcctcacaatcgtggtggaagagcaagtgacatcttccatggcagcagacaagggagagaatgactaccaagcaaaaggggtttccccttacaaaaccatcagatctcatgagacttattaactactgtgagaacagtactggggaaacagccaccatgattcaattatttcccaccagttccctcctagagcacatgggaattatgggagctaaaattcaagatgatatttgggtgaggacacagccaaaccatatcaagtaggtaggaattatgtgtatgaaataagtaggaacattacttaatgttatatgagaaggcactaaatacaatcagtggcaaaaaagtgaaccctacaagcaatcaatcaagaataacttctaggaaggagggagaaagagagagagaatgagtattgttgtaaactggagttccacaaaggaaattgagcttataaatgagccctggatagatggattacgagaaagaaaagggcaaagagagaggatacagtaagaaaagcaaaaagactttaaaacaatatagacagaaggaaataaaatttaacattccaataatggaaaagaatacaatgtgagtaaacaattggtgtatgttgagaaattctgggaaataatatgagtaggcaaagcaagaatatatcacaaagggccaagaaagcttagatgtggacacaatccagtagatagtggaagaaatgttaggagatacttgagaaaagtactgttttaggaaatagagattagcggttcactgttttattaaaaatagctgaaagacagaagctgagtcacttcaacttctgcagtaagcaaagccatagtatgcaaactggcctttaaatccatgggggaatgtattatctcactttcatggtgcacatctatcatgggtaggtgaaagcaagggaaggagagatccactccacctagtcactcaaagataagggctgactgaggcattaccttttacagctgaaccatctgtgatacatatcttcttaagttgttctggcagaagagcgagaaaatgaagaatttcacatagatttttgttgcatcagcccaacaataatacgtcatacttacttatatttcactgcccagagatagttatacagttctgcctaataggtgaatatttaaacaactcatcagaacaaactgaatatttgcaaaatataactgtttcctacaaatgcaatgtgacaaaggtgtaaaattatttatttatttcacaaatgcacatggaacaccaaatgtgaactaagatttcaatgacaaaaaaaaaaaaccacacctaccttcccagttcttatatgcaaggaatttaatgtctaattccaattttcattgaataatctagactaagctgtcctaggaaaagggagtaaatgtagatagaaaatgacatattcccttgtactgccccatttatctcatcagtcattctgctttaaaggaattatctggtcacattttatcttctattcacatctgctactttcaggacctttctttccctcctctttctttgagattttcagttgctgctctgccttgtcttctgtgtccattcttagctccaatcctgagactcagctggagtctcagaggcttgcatctgagcactctgcattgctcagtgactaaggcaactgaattagggcagggacacctggaatagctcagtcctccacagcaggtggggtctgataaaagccatatgcctaagaccctgcagtatcaaagaactaagactcgcaggcattcctaactggaatctatctctatttcagtgttatgggctagattgtgttccccaaaattcatatattcaacctctatcccctagtaactcagaatgtaactatatttggatatagggcttttgaagagataattaagttaaaatgaggctcttaaggtgaaacctgtaagaagatactaggacacaaggagagacatcacgggtgtgcctgtacagaagggcaacaatgtgaagaggcagcaagagggtagatatctgaaagccaaggagagaggactgaggcaaccagctcaactagtaccttgatcttggataattccagtctccagaagtgcttaaatttctgttgtttaagccacctagtctgtggtatttaattacggcattcctagtaaaaggacaacttttatctctgtttccaataaacatttcaatcccatggtaggaaaatgacaatctgcctaatctctgccacctcctaacaaaaatcttgttttattaagaatacaaacaaaacatattttatataattttcttataattttattaatgtctgatgtaccagaaaatgacacataggtattgtatgctttgccttatttgaactcatgataaccctatgagagaggtagtaccattttcctcattttataaacaagaacagatgacttagatcaagtaacttgactctgataacatataggttaagtaggagagctcattcatctaacacggttacctttcatgacaatgatgatgaaaacagctaacagagtatccacgtgaccattattcatctaaaccccttacattaaataattggacattcataatattcctataatgtaagtattcctactagccgtgtgttatagacaaggaaatttaagcaaagagatattgagtaatttactatagccacagagctacagagttttggagccaggattcagatctaggcagtccaaactgaaggtgtgtatttttaaccaccacattctactgcttctcaaagtttggagtaggtatattagcatctggtaatggctgttgaggatattttaaaacttaggtaatgacttctgctattgtatacttttagaaaactggattgggatcaaaactgtccagtacatgctattttgttacctttggattcttttaatacctaaccttgtgcgattggggtcatagcacagcatgtatgatcatcattgctgcaaacggatacacatcttaaaagtgccaactcagtgttattcaaatttttcctgaaatttccatatgcttctcaagttccttaacttgaaaactcaaaattcttcctgcaaacattttctgattatctctactccaaaatgttttaacagttagtcaattagttaattaaaattttaattggcaaataattgtgcacattacatattttggggtacaatgtgatgttctgatatacatttactttgtgattaaatatgctaatgcacaaatttatcacctcataaacttgtcattttatggtgaaaacattcagaatctattcttttagtaatgttgaaacacacaatgcaatattatttattattgtcaccattgtgtgcaatagatcactgaagcttattcctcctctaactgaaatgttataacttttgatcaacatctcctctttcccatttcattgctcactccacccaccagcttctggtaaccaccaaccacatccagtggacagcaagttaaataataggaagttagagaaagctgacagttacaaaggatatgatgttatttaattgttcagaatatacaaaatgtgtttattataggatacagccccttatggaaaaataaatgagagtggggaaatttcaaaatcagacaaaagtaaaaagtactatgttcaccagaagatggagaagtctgataggaagacactcagaaaaggtcagtaaaaaacctctgagaaaaagaaagttgcaggaaaggtaaatcaataatgctgtttgctgaaatgctacaaaattatagtacttgtctaaggaagtagttactggaagccatagagagtgcactttcagtatagttacaagaaaaaccaaattgcagagcttaagggaattggtgaagaactggtagcaacagatacaaagatttgacagaacatctaactaaagaaaaactctattatgaattgtataagtcattgatgactcagagccaagcaagtttataattacatttttgctcaacttcgatttctatgaagaacatttaaaatgagttctgctttttcatacaattagaatgtgggcatttttcaatcgttctaaaattttcagattattagaaccacaaagacaagcatccaccttaccggatattattgattttatatgcattgcctggactctgaattagaccttttctttcttttccctgtctcagcaggacaaataagaacatctaggccaggagcggtggctcacgcctgaaatcccagtactttgggaggctgaggcgggcggatcacgaggtcaggagatcgagaccatcctagttaacacggtgaaaccccatctctactaaaaatacaaaaaattagccgggcgcggtggcgggagcctgtggtcctagctactcgggagcccgaggcaggagaatggcgtgaaccagggaggcggagcttgcagtgagccgagatcgcgccactgcactccagcctgggcacagagcgagactccgtcaaaaaaaaggaagggaggaagggaggaagggaaagaaagaaagaaagaaagagagagagagagagagagagagagagagagagagagagagagagacagagagagagacagagaaagagagaaagagagaaagaaagaaagaacatctgagcaccaatactgggatattgtaagttacctcagaaataacatccttgggtaaggggtgtgtgtgtggtggggtgtgtgtgtgtgtgtgtgtgtgtgtgtgtgtgtgtgtgtgtgttttagcagaaagagaatcttctaagtacaatgaaatgggcttctatttatcagtaccttttttcttctctctcttttagttctgttgctttccaggatatacacatggctttaacagagtctattactggaatacggagaagctattgaagtaatccttcaaggcataaggtcagaacttagagaagtcacagagtttgtatttctgaacctgattaccagaaaattcttctaaagcaggaaaagatatatgctttcaaactgttatcctacaaccaaatccattttggagacacaaggatccacaagattactcaccttcaggaaaacatgaagacaagaaatgctagtcttggtacaacctaatgaaaagacatagctgagatttcatatgaagataacattgagattgcttagaaaaaaattattggagttaacattgaaagtaacaatggtatttcttgtcatccctttctaaatggcatatatggtatgtaatctagaaatatgtacatatacatgtaatagcttacaaagcttccaataaaaaagacaaaatctctggattttgccatctaacgaaaacaatgtagttactattaaaacttgaatttaacttctcagaataaacatacagtcaaggtttttgtttatttctttgtttttccaacatggttgactgacttgggatgctagttctcggaaagatcaaagttacaggtgaatggtaatgatctgaatgaaacacagtcagatgagagccaggacctgtcagagaacccacaagaagaagctagggtacagaaaaagaaagcaggaagagtctggcagagattgacccccaaggaacttagagaccccaaaaaagtataggtgggggtgcttctctgttcccctcaccctggcaacaacctgctaaccatcgaattattagagagtccttctaccctcacaatcctgggcaatgatgtccgtggcaatttggaaaattcccaaagacagaaatccatgttgttaactcacacaggggtgcccacactcttctcaggcctgaactgagatgtcaagtgccgtactagttgtgtacacatagtgggccactgctgtgcctgtagaacctcagtcattgagtcaccacatcacaagatcccctgcaaacataccccataacctgctctgacatccacaatcaaagggaaacagagaggatccctgaggaactgtggatccctggtaatctagccctcagtgtgacctacccctggggaatgggggtgcacagacagccctccaaagcctgccttgagagaaaggaaatgtagtgtgacacagatcactgaagggagtggcaccggcagccgggaatggatatggagaggtagtcatcttctgctcctcccatctactcttgcagacacagcagaggctctaccagttaaaggccagcccttgtgaaattggtgtaaacttttccagtggttttcacaacagctacacctccattcaaagtaagcccctgccacagaggcttccatgaagagtaagacccatctctccccttctatacaaagaaatagcatcccagcaactgaaggcagacaagctacaaagttgtctgtcatgaacttggggaagaggatttgccctgagcccattttgttggtagctgccggaggggcatacccatggtctccagctgcactatggccaggagtcaaaggacaatgtatatttaaactgaaggtcatgagcaaaatgcaacagcggcatgatagggaagcagatcacattcctgtctgcccaggatgaggacctggtataggcctccaacgctcttccattgaaacattgccacagcccaacaggatctccaccagctacacctgtcagggtgggtgcctccagtcattactgagctaccagagaatgagcaggctcttatgcttaagtgccatcactggactggagagtaaaatagaatacctgttctcagaaaggcacagggctagtgaataagataagcttcctgagacctctgtactctcagcctcgcaggagatagtgtcagctgacacatctaacacatcaaaacaacaggcaacattcaagaaaaccaccatacaaagattacccacaatcaaggaacccataaagaactttggcacactgaaagcaccccaaaacaaagcatatcatacacatcataacataaatcacagtaatcctctaaaggaaaaataaatgatagaaaattcaaaaataagaagtgatatctcctttagatgagaaagaatcaatgcatgaactctagcagtacaaaaaggtagtagagtgttttgacatctctaaaggattgtacttgcactctaaccatagattctaaccaaaatgaaaatcctgaaatgacagataaagaattcaaaatacagagtgcaaggaatttcaatcagaaaaatgatgaaggatataaaaggcaaaatagctatattagaaaatagaacttcatgtattgaaaaagtaactaaaggaatttcaaaacatagttgaaagctttaacaatacactagaccattcagaagcctggtttttttgaattaaccctgtcacacaaatataaagaaaaaataatttttaaaaatgaacaaatccttcaagaaatattggataatggaaagcaaccaaacctatacttagaggaattcttgaggaaggagagaaagaaagaaacatgaaaaatataattgaggaaataattgaggaaaattttcctcatcttgtcagagaggaggacatccagatacaaacaatttagagaatatctgtaagatattatacaaatgaacattactaagtcataaatttatcagactatccaaggtcaatactaaagaaaaaaatcttaaacagtaagtatcaaactatctataaaatgtagtcccattagactaacagtggacttctcagcagcaaccttacaagccagaaggaattagaggtctattttgagccttcttaaagaaaataattttataataaatggcatccaaaatttttataacctactaaacttaatttcataaacaaagtagaaaaaaagtcattcccagacaagcaagtggtaagggaaattttcacccatagactggtccttcaaaaaatccttaaaggacttctaaacatgcaaatgaaaggacaatacttgctaccagaaaagcatatataagtacaaagttcacagatcccataaagcaattacacaattgaatatacaaagtatctagctaacaacaatatgacaggaataaaacctcacatgtcaatattaatcttgaatgaaaatggcctaaatgctccacataaaagatatcattttgcaaattggatgaaaaagcaagaccctaccatttgctgccttcaagggactgacctactgtgtaatgatatccacagccccaaagtaaagggtggagaatgatgtactacacaaatagaaaacaacaaagatcaggggtgctattcttgtatcagatgaaacagatattaaatcaagaaaggtaaaaaaaaagacaaagaaagatacaattcaacaagatttaactgtcctaaatatatgcacccaacaccatagcacccagattaataaaaacaactagacctaagaaaagaaacaagtcatacaataacagctgaagtatttaacaactattagttatataatctgtctggtgacagcaccagatagattatcaaggcaaaagaaaaccaacaaagtaactccagacttaaatggaactcttgatcaaatggatgtaatagacatctacagaacataccatgcaacaaccacagagtatacatttttcacatctgtgcatggaacgttctctaaaattaaccaaatacttggacttaaggcaagtctcaataatttcaaaaaaatcaaaattatgccagttatcttctcagatgacagaggaaataacattagaaatatatatcagccgggtgcagtggctcatgctggtaatcctagcagtttgggaggctgaggtgggtggatcatttgaggtcaggagttcaagacccacaaggccaacatggtaaaaccccatctctattaaaaatacaaaaattagctgggtgttagtggggcatgcctgtaatcccagctactcaggaaactgaggcaggaaaatcgcttgaatctgggaggcagaggttgcagtgagctgagatagcaccactacacttcagtctgggtgacagagtaagaccctgtctcaaaaaaaaaaaaaaatacatatcaggagaaactctcaaaaccacacaagtacatggaatctgaacaacttgctactgaatgattttaggctaaacaagaaaattaaggcagacataagaaaaagttgaaataaataaaaatagaaatataactcaccaaaactctgggatacaatgaaagcagtgttaagaggaaagtttaaagcactaaatgcctacataaaaagataaaaatatcttaaattaataatccaatatcatacatcaaggaactaggaacataagaacaaaccaaatgtaaagctagaagaagaaataacaaaaatcagagcagaactaaatggagttgagactgtaaaaaccaaacaagagattaacaaagcaaaagttgtgtctttgaaaggataaataaaattgataagactgctatttaagttaattaaggaacaaaaagagaagattctaatacgcacaatcagaaataataaaaatgtggcattacaaccgataccacagaaatacaaaatatattcagagtagtctatgtaaattctcagagagtaatcatggtagactatgaatatctctgtgatcaaaaacgagaaaacctagaagaaatgaataaatccctggaaacatataaccagccaagattgaaccaggaggaaattgaaatcctgaagagacatataatgagttatgaaattgaattagtaataaaaaatccattttccaaaaaaagccaggaccaaacagattaacagccaaactttaccagacatagaaagagctagtacccatcttgtataaactaataaaaatattaaggaggaatgactcctctctaactcattctatgaaaccagtatcatcctgataccaaaacctagcactgaacacatacacacaaagaaaactacaggccaatatccctgatgaatagacacaaaaatctgcaacaaaatgctagtgaaccaaatccagcagttcatcagaaagataatttgtcacagtcaagtggattttattccagggatgcacaaatagttaaacatatgcaaatcaataaatgtgattcaccacagaaacaattttaaaaacagtagccatatgatcatctcaatacctgcagaaaaaacattcaataatatccaatatgtctgtatgataaaaaccctcaacaaactaggcattgaaaaaaacatactgcaaaataataagagccgtctatgacaaacccacaactaatatcatactgaatgggaactgtaacaagacaaggatggccactctcagcaatcaggcaaggaaaataaataaatgtcttccatattgaaaaagaggaagtcaaattatctctgtttgctaatgacaatcttacacctagacaaccttgatatttcctccaaaagattcttttacctgataaactacttcagtaagatttcaggatacaaaataaatgcttgaaaatcagtttcatttacatagatcgacaacactcaaactgagaaccaaataaaaatctcaatttcatttataatagacacaaaaaataaaatatctagaaatatatttaacaaaggagaccaatgaggtaaaagatgtccacaacaagaactataaaacactgctgaaagaaatactacatgacagaagcaagtggaaaaatatcccatgatcattgtttggaagaatcaacatcattaaaatgactgtactgcccaaagcgagctacatagtcaatataatttctatcatagtaccaaatttattactcataaaattataaaaaaaaattctaaaatacatatggaaccaaaaaaagagccttaatagccaaagcaatcctaagaagaaagatgaagttgggggcatcacattatctgactttatactataaggctataataaaaaacaaacaaaactcagcatggcattggcataaagatggacacatagatctatggacacaatagggaaactagaaaataaaatcacatgtgtataaccacggttcttcaacaaagctgacaaaattaaacattggggaaaggtcaccctattcaataaatggtgctaggaaaacttgcttgctaaatgcagaagaaagaaacttcactcctatctctcaccatatgcaaaaattaactcgatgaattgaaaatttaaatttaagacctaaaactatagagatcatagaataaaacctaggaaaacctctttagacattggcctaggcaaataatttataaataatacctcaaaagcaaatgcaacataaacaaaagtagacaaatgggacttaattaagccaaagagtttctgcacagcaaaagaaacaattattagaataaacagacaacctatagtatgggagaaaatatttgcaagtaatatatctgacaaaagatttatgtccgaaatctataagaaaaacaaatcaacaagaacaaaacatataactccattaataagtgaggaaagaatgtaaacagacacttcccaaaagaagaaatggaagtgaccaacaaacatatgaaaaaacattcaacctcactaatcattagagaaatgcaagttacaacaaaaatgagacaccatttcatcccagtccatttgtactttttattatcatatatatcctcaaattcaaaacaaaataaaccacaacataaactgtgttagtatagtacattaaagtcagctccactgtgctgtatcacttggcaagtctgaaattccaatgggcttcagaaagttgactatgcaatgcccaataatgacctgataatctcatattagaggcaatgcaaatatatttataagactaagagctacaacaagcttacgaagaaaaccaatttatagcattacaggttaaaccagaagtgatttcctctgttaactaaaattacattactaaaaagtgcatggttcgtggatgtctaatgtgaaaaaagacagacagtgaatactttcctgctcagtgtgaacacttaataagaatgaaaatagaatgccttattatataaagtaataccaatacattgatttccaatctactcctctggcacaatttaaaatgagctcttgaactatagagtcacaactctttttcatttcaatgtgttttccttcaaaatagcagttatttatacatactgcttttaaaaatcatttttaggctgcagattcacaatctccataaatatcaaagatgtgaagttaagttcagatgcacttgaagtaaacaccatgctaactagcagcagtgttcaagagatcatgctgccgatcttatgaaagggaatatactattgtgaattattttgcaaatcccaaaagaagtttatctctcacattattgaagactgagaatgtcttaatatatgcacaacttgaacattgtttgtgaaaaagccagactaattcatctatcttctgatcaatcagtttagccaagcaaagcacaaaataaatgcacatcctttgctgccgttaagagcaaccagtttgcttgtctgtgcatcatgaatgccaaacaaatcttgaataagaacgaggaaaagttaaaagaaaagaaagacaggaaagaaataaaactcaattttcttgaataggaaatttctagggaggaaacattttccatttttgtcttctatcaaatttatatatatataaatatatatataacatattatatatatcctaactgtcattataggctattctaagacagattctgccaatattgaaatatctaagacaggcacaattgggccattgcaaacatcatgtactaaatggattctaaggaacctgaaaattaatgaatctttctaaaatgactgacttactgttaggggaaagcttaagaaatcaaataccaaatcaaataccaaaataccaaatcttttttcatttttctattcttcccaaaaaaaaaaaatagtgggggataaaataacgcaatgcccagttaaagtgccaacaccaaaacaacttatggctgctacttctgaccctttcagggggtcaaattttgttgtcttttgtatttctagctttgtttgagacctttgtttgcatatattcaaaggttagtaaatacaatttaatattgtttccacagaaattaagcatttacctagttagaataagcattcaaacagaggtcttgcattaaattttgtactaaactgtattccttctaccatgctgcaatctttattaagaaacaaaggacatctgatttcacttttctaagcttattttagttaaggttaattattacacagagatactaacctttcaatcataaactacaaattagcattattcatctctgtggtatattttcaatgtaataataaaaatcctggctcgctctaaaggtcaagctaaaagcaaccttaccatcatcatactggcccaagcagatttcaaagagagagcccaggatgatccctgaagctaaacatgtccagagataaaactgtcgaaacatcttctgtcaaagttcactcaaagctgatctgaaataagaaaaggtagaaagaaacatttgacatgttcattaatctgttataggtaaacacaattgtcacagcacagaaaagccttaatgacttcatagttaattacctgtgccacattatccattaacaaagtaacacactggtttaatgcactggaactgtttatcaacataaatttgcagacaagtaatctctaaggaaagacatcttttctgttatttaatttgccagcaagtaggttgagaagttaacatactaataatatcagaagcacactctttaaaatttaagacattatgggtaagtccaatgttaatcagtttaagttactaaacttatgttgtctacagcataattttacaacaaagtgtaagatagtaagccagttgttagtatcctacatgagcatttcaatgaaaatttgtcttatacaattaagtagaaaagcccatcattaaaatgttaattcctttctagtagagtgatcagagattgacttaactatgccaggaaagactaaggaaaatctgtcaattttcactacatctgctttatgaagcatttggatgcatttcattttaattctcttgttttacttttcaatccccagcaagttaaaaaaaaaaaaaaaagaaagaaaacaactgattgagaaattagtggcctgtgagcacatgagaatgtcttattgaaagaatgacatcctcagtttctttgtaaatttaggaaattatccacacagaattgttcaaaatgctcttgattataaattgtggcagactagggattggaacactgtttctctaattcagaggttccaaactcaaatgcctacagaggacaagcagacaaaggaaaagaatgaattagccaaaggggacaatagtgatggtagaggctgtgataaactgtgcaatgcaaggttttctaaagagaccagctggtgctcaacttctgtcagtggttgtgatgtggcaatgcaagccagtgtttctgggtcttctgattttcaaagagaaggcagaaatccaaattttcatgtgatttccaagtgtttacatgattgtgcaatcttctttataagactaaatgcttctagcaggtaatattgatgtctcaagttctccagttttctatttctgcccaggattctctctactagactagctgaggataaggtttatcagagggtacaaaggcacgattttaattctgcttttgtctacattttatttttgatttattgccaagtatttaataatgtttatttgtccagcagcatgtataaatatatatattgcattgtaaaattgtattaaaggtgtaagctctttttttaaactaatgggatacacagttcttgactttaaaagatcactgctctagatcacacacattttaatatgaagtctattcttctttgtttctttatctaagatataaaaggagctgccttctttttaactgggccttccacattttttcctaactggcaaagtgcttggcgcgtgcatttataatttctagggacagaaagcccaaagaagagctcattattagatgccaagagatcatcacaatccacactaacctgtagaaaaaagaaaaataaaattgaccaatgctactggttgtgtagagcagcggataagaatgtggctttttttttaaattcaagcttttcagcttactagttatatgactttgaagaaattaaatagcatctttgtctcacatttctcattatcataatggatataaaatagtatttacctcataagattgtcttaaacattaaatacgtaagggaatataaatacgtgcttaatgcagtgtacttacagaatgagtaccccctaaagcttaatatgagtaccccctaaagcttaatataaaagactcagcatctatggaacctccaaagtcttaaatacagatttactcaatctatctttagcaagggctggaaagtagatattattatccccattttgtggaggaaaggtcaggctcagagagaataagtgactggctcaaggttataaactggtgagtgtctgaagagaccataaagtctgtgagtaagacacttctgctcattccattagagaaaagtattggaaaaattcccagaaaacacagggctcagaagttttcaaggcatatggaggcccaggagagcctgctgtattgcttcccttaaactctgagagagacattctaacccccttcacaaaggattagagctctactaagatttctatatacaatggcttcaaatctttttttatttggaaaaacaaacatgacattaagaaataaaacaatgttatttaaattttaaaaatataaagagaaaccatatacaaatacaaaccagaaaggatatatattggaaaacaaaattaatacaaaccagaaaagatatgtattagaaaacaaaattaaagagacggtaatatcttagcaaaggacaaaaggacatagttgtgttcctgtgtgggtccttgatctgccagcttgacttcctttatagtagtttatagtattatgcattcacaaattatggcatattcttttattcctaactgaagctaatttggtttcatggaacagtctccaatataaaaacaacatgatggatcattattttaaaatcattaatgtcactgccattattatgcctccagaaacaaaacctcttgatctatggctctgcaagtttttagaggattatatgcatatttctgaaagcatcacagacaaaactcataaaaaatctatttagaatagatatagcatttactgcccagaggaaggagataattttaggggaaatattatacttatttgtctttgaataatgataataataacaatttctatagtttttttactctttcatctatatctgcctgatttccaaagaaattttcatcacttcaatgggctcaatatttacagagacctgaaagaaagctatgactcatcacatcaacccgataccccaaaacacagaacacatattgacttagtgagaaaacccagtttctaaacaaagatataatgaaaaggtacctcccacaaagagattgtgtaaatgactacaggaccaagatgtttagtacaatattgtgccaatcaactgacagcctatagtggcacttctgtgattgtgatcaaattaattggaagagatcaaatgctttagacaaaagactgtttttgttactagctttttaatctctagaattaaaagagaaagtcctataggagatgaattccataatcttgctaagtgactgtaggtaaatgaaaagcctgtcaaacaacacctctatggtggtactttacttttactacaaatcccacatcaaactctttccatgttccccgagtatatatttttcctacagaatttattggctaataatgttatgttctaaaaatccaaagcatgttcaattctaaaaagaattgtaggtgacctataaataaatatgttatacttgttttttaagagataattaaattggtgtattcagtactctaatatagctaataaagttatcattttgcaatcgtgacttagaaatagtattctgttgtcaaaatactggggaaaagtgtttttttcctattacagtataatattacacgtaagtggtttgcattccatgtgcattttatgacacaatttccttaggcttaagaatattttactgcaattattcaagacaaacatactaattttgaatttcacatcatttgtatttcctgcaagataaatctcatatttatttatctggcattcaatgttctcaaaaattaatttattcaacaagtacttatggagggtctactagataccactcactcttctaggcagttggaaaatatcagtgaacaaagctgacacatttcttttctcccatggatgttatattccagcaaaataaagatagaccaataacaaacataaataagttatataaaatgttaaaatgtaataagtgacatgaaaatagcagctagcatttcaaaactgtatattgtcactttacaataattttcattcagtaaatgaagtgagattacacaaagcaaccaaaatgctatccgataaaataactgaatgagaactttacaatgaaagtataactattccgacaaccctgacagcatccttgatggtatctactattctgagtacagatttctgtccatctcttggaaggagaataaaggtctttcactgcctttcactttcaaatataaatccaaagtctggaaatacacaaaggtctgtcctttttctgtttatccctgctccctgagtcttgggtgtttgcagtgacacatggcaaaagcagccaaggttgacaccacagcagttttctcttaaatacaattttgacaatgttaactattttttagcctatgtctctgactgctatgtgaataaacactaactttcttgagataccaaaacttggaacacaccgtcattactttgatgagaaaccccataccaatacacaaccatgaagcaagctggagtctcacagtgaagtgagctgtatgtatgcagtctgcccttcaacagttggttcagccaaattactgttattcttgatctgtaacaatatctagataaagctacaaaactaaaacttgtcactgctttgtattccttgtgagaaacgtatgctatctacctgctggaataaagcaaacttcccttcaaagcaacctcagcttcaaactaaaaacatgaggttttccaaagtcactgtatcttaccatactaaatatcaatttgcttaaatgactagagagaaacctgtcttctacctcagcatggtggtaaatattaataatgtcttcatcagtacagagggtacttatcacccttcagcattaccagatgaatcagctgttccttttttaaaatgtgtaatatgaagtttaggaaaataaaatttcagagagcctttcagatatattccttccttctagatcatattatatttttctttactaaatatacatatgtataagtttatatcatatattcatctataaaaatatattgatatttattgacaattttatagtacatttatacatatttatatataaaattatgttacatagtcacatatacaatttatataaagaagtatatattttatttaaatttacattaatgataggtaatatcaatgatattgatattatcgcccacttttttaaagtttgcaatttaaattcaaggggttccgttgtagctaatttgaggtaagtttggaaagtaactaatgtttttataggacactgtgaggtccaacctacctctcccacccggtcctgctaaattcggcttactagatctttgctcgggcttacagttttttttaacatgctactacatctgaatgtgtcttgactaccaaatttaaaatatgtgctaatttggccaggcgcggtggatcacacctgcaatcctagcactttgggaggttggggagcatagataactcgagatcaggagttccagaccagcctggcaaacttggtgaaaccccatctctactaaaaatataaaatattagctgggtgtggtggtgcacacctgtaatctcagttactcaggaggctgaggtagaagaatcgcttgaacccaggaagcagaggttgcagtgggttgagattgcaccactgcacttcagcctgagcgacagagcaagacagattccatttcaaataaaaagaaaatgttaatttgctttttgggtgcactctgtctcaacatatagattcatcctaaacattgtgggataaaataaaattgatgaaaatcatttttaaaattaagaatataaattattaagaactaatcttgctatcacttcaatcatttacaaggtctttcatttcagttttaaacattttaaatatataatcaacagttgtaaacattagatgagactaatttaacccaaaatatatttcccgaaaccacatgaaacacataaggtaagtccaagctctggcattcttatactacagctatggtgaattcttggagaattcaaatcagtgtcttaacatgtctgttgagtctattcattattaaattctggttttaataatagaactttaaataaaagagggaagaacactggttttctttttggggaatactacttctcaagaaaataaatgactgaccaatataattaatctgcttatgtttaaagattgtgtcttcatggaaaaaaactaatattcagtttagtctataatagatacatgccaaatgttataataatgtagtcatactagttggtttaataaaatataaatacaccaaaaatgtttttaaatgagtggaaatttaatctccatgtttactattgctattatattggatattttcttagtgtttatacatacatttactcaattagtatttattttatatttagtgcatatcagacactaagcttctactatagaaataaattattccatttcctcacaatgactttgctattgagcatgcactacatttcatatttttttacctaatatacatttcaaggtactttagtaaaataactccaaattaggagataaataagttttaattgccaatttttttgaggtttccattccatctatgttttcagaaccttcatctaaatctcagtcttttagataaatacatttctcactatttgttagaaaagtcatgggaaaaagcttagtttgaaaggagcaagcaaagggaaatataaaaagagaagcccaaacattatttcatcagtggagtgtttagcttaaaaatataaccaagtaaatttaaaatggagttttaatgctcaagcaaacgcatgcatcattttaaaaaagaagcttgaaagagagttctgtgcagtgttattacctggcacagaaaaatgattctgattaatattcttgtttgatgaatattatagattctaagaaacacaaataaattaatgagtaaatgagtattttcctaaggcaaatccatcagcaaaaaaaatccaaaagtattaagtcagtcaacagagactaaacgtaaaagtatgaaaatgtcagtgacttgtataatgtaatataataaaagtcctggctctggcatgagagagtcttgcattgcattcctagttatgttgcttttggagggctatataagggtaaactagttaaaacttgtgagaatcagtttaaaattaggacaataaaatccattttattcttctgtaattgacagatgaaaatttgaacaaaaaataaaagttaagaatattcatttgttcatttatagcataagtgtttactgagcactgattctggataatgcactttataagatgcagtggctacagctttatgagaaaaactaaatgaattaataataaatacataatagtccatatagagttttcagtctaacagagtgtgacagtcacacctaaagtagctcataatgaatcaaatcctcgtataatactattctatagatcaggggttcagtactggtccatggcctgttaggaaccaggccacagagcaggaggtgagtggtgggtgagcaagcaaagtttcatctgtatttacagcccctccccatcattcgcattaccgcctgagctccgcctcctgtcagatcagcagcagcattggattctcataggagggcaatctctattgtgaactgcacatacaagggttccaggttgcatgttccttacgagaatctaatgtctgatgattgatctgtcattgtctctcattattcccagatgggatcatctagttgcaagaaaacaagttcagagctcccactgattttacattatggtgagttgtatgattatatcattatatattataatataataataatagaaatagagtgtataataaatggaatgcacctaaatcatcccaaaccactctcctgctcccagccccaggtcggtggaaatttatttttcatgaaaccagtccctggtgccacaaacttggggaccattgccatagatagtggaatctatgacttgcttctaatgtgtagaatatgataaaggtaacaagatatcactttattgtttcaattaagttatataagattcagtcttagcacattggagaaagataaatcttcctgctctgtgtaaagaagcaaacgtattgtaaactgcctttggagaaggacatatgccagggaactccaggtgacttcttggaccagaggatggcctccagacaacagccctcagtcatataaccaaaaagaaatgaattctgccaacaatctaaatgagctttgtaaaacaattgcattccatattgttaattatattttgaaaagaaatgtaatttaaatactaaataatgagattttattttatatatgatcaattatatacaataaattattttcttataaatctagttacaacttttctgtttcttatattgaacaaattttgagctataactcagtcatattactttacttgcttttgccattaccatagcttggtaggaaataaggttttaaataatagtcttttaagtaggtgacagatttagaataaaagattcataacagttctaattttaaaaaatgacttcacatgtttaatgacatagcaaacaggtagtatctacattcctaattttttttcttaaatctgcttgcatttaaacaatgtaaaattaattggtaaagcatgtcatttaaaaaaaaaattaaattaaagttctgggatacatgtccagaatgtgtaggtttgttacgtgggtatacacgtgccatggtggtttgctgcaccgaccaacccgtcatctacattaggtatttctcctaatgctatccctcccctaacctccccacccccgcgacaggccccagtgtgtgatgttcccctctctgtgtccatgtgttttcattgttcagctcccacttacgagtgagaatatgcggtgcttggtttttctgttcttgtgttagtttgctgaaaatgatggtttccagcttcatccaagcatgtcatttttattagatatagttggtaatagaaggaaacatataacttttttttgttgtttgtttgttttgagatggagttttgctcttgttgcccaggctggagtgcaatggcatgatctcggctcactgcgacctcctcctcctgggttcaagcgattttcctgcctcagcctcccgagtagctgggattataggcatgtgccaccacgcacggctaattttgtatttttaatagagacagggtttctccgtgttggtcaggctggtctggaactcccgacctcagatgatctgccctccttggcctcccaaagtgctaggattacaggtgtgagccactgtgcccggccaacatataacttttaatagttatttaaatattaatatgtatgtaatggatactagagtaaatactgattgggaaatacaaactgtcattaataaaatatttgttttctatatagctttaatatgtactttttaacatgtacttacaacatttatttaacacgaatagagtagaaaatgtgtactttaatactttgccaggtgacatgtttaagtagaatgaataaaactaggtttatcctccattgcccctcttcttatcagaggggtcatatttcatatgtcatatcttttctacactttattttctacttcacattatatgaagtctaaccagagatcataaagtttcatactatatcaatgcagaggcagaatcaacattctatacatataactttttactttctttgcaggattttttaggtaaggtcttcggccaactgaactgcaactgtttcatttacaataattttaaaacagtaaaattctctcaagaactaagtttgtacatttgatgttgataaaaataatgctaatggtgaatattttttgagtatgatagatgttgatattattgaaatcattagatatgctttaataactttaaaaccaaatggtagactgttccatttcatttctctttgtactttaccaatttatactatgaaaatcatgtatgaaatgtatagtctagaacgtttgcagaaatatcatctcaaaaacagtaactcaaagtctaatacagaaagacatccatataaggaagcatttcacaaatatttctaagctttgatttgatatatattaagcttttaccatttatcttataaatctacatggttaaagaaatgatcaaccttctcaactggcacaatgtgaagatggataatttgacttagaaaaataactaattgtgtagtcatgtaagcccttcatttatgacacaaatccataaaggtcactgtcatatttcttagagactggattttaatgtaaagctgagttttatttttctaggaaactgtaacttttattgaaaatagttcatgtataagcagatttatggaattcaaactcatgttgtccaagggtcaattgtgtgtaattttataattgtaaaactctgtcttatctgtaaatgataagatattacaattagttggttctttatgtttgaggggcaaataaaatttgaataagttgtcttactcacaaagactatgcttcacgaataatacactaagaactttagtctcttcctacaaatacctaattttatagtgtatcctggcatttcaaaattaccaaactgaaaagtagtcgttctctctcttagtgtcaatgctaattgtatggtacgttcattactagagtacattttttctaacttaaatttttaaatttattacattaaatattagattatgctattatatagtaaattcaaactgcctgtataatattgtatcctattaaaatgatacagacattaaattttatgggcattctaatgattgttttccatttttccatacttttaaaataagttgttatatgtcccttggggatggggattattttaggaatactttactacttattaattttccaaaagtcaataatgaaaaatatttacttcccaacacaccctggcaagatattttataagtgaaagacataatttcattctgacctttttaattctaaggccttttcatgttgttttttttttttttttcaatctgatctaatttttaactctctctatttattaccataaccaaatttcattttactttatttttagctagttatttctgcctaggcattttctcctttttcatatttcgacctaagaatttgttcctcatgtaagacttctctgacaagtcacttcctcccccaagtataggtcaaatattttgcgataatccttagcctttcctttgtattcagcgaacacatctcagtttataattacattgcttgtcagtgggtactttggcaatatttgtgtttcactttatgcccctgagaagaggaatcattattagccaagctcctatcccagctttttatcccggagcccagcaaatagcttagcccagattagcattgatgttttgaatgaatgaattttaaaaagaaacgtatcattttcacaaaatgtcctgttatttacattaaagctaatttgttcttgtcaaatctgtattatatatgaaatttagttttaacacttattcctgcagcatttgctgaatatgcaaggatcgataattgataaattctaaggaagttctatttcctttaagacacatttaaggtattgttggagaaagggctatgaatattgtaaattctcacagagagtatggagatgtttgtacataaatatatacttattataaaataatattttaaatcgtcgaacttagataaaatatatgcttataaaatataagaataaaattctaatatacttggaaaataagaaccaaatctcagcctgtaagttaaaacttatggtttatatacaacaaaaactactggggctgtttttatttctgtgacccaattaaactaatcttttctcaaatttcatccctatgtctgagtatactaatattggcaaagccctctctatcctaaaataatgtctattttaatatgtcttcatagaaaagtcattaaaaagcagtgaacatagccactaagtatgattttaatatttttgttgaaatgactaaattaatagaaagtgacaaaaagtaccttaagaagaattttaaaaaacaaaaacaaaagattgaacaaagcatatgtggaaatataaattataattttcttccactttattaacactcttgtctaattagacaataattactttaaaaactaacactttccccttagaattactgctgaagttgaaaggttcaagtttttaattactgctcataaagcatgcagtgaaactttctaaactatgaaaagtctactatcttacgattcagcaagatatttatcttataaaaacatcattaataagtacaaaatctcatttaaattaacagcaagaaactttcattttcctttccagtgtcagagatgggtgaaataaatcaaaatcaaggatcttttgtggatgaaaggaagtagaaatcttaagactagaaactcactaatgtgatgcccatgggcaaagatgaaatcagatattacagatgattttgaagttgcagttttaataatgataaaggtatagtgaaagggagaattgaagcagaaatgaatttcatactgttgcccacaccaatcaactcatcatgcatttcaaaagtatattccggcacaacatggtggctcacacatgtaatcctagcactttgggaggtcaacataaaagaatggattgaggtcaggagttcaaagccagcctgggcaaagtagcaagacccagtctctgcagaatagacaaaataaaaaaattagccgggagtaagggcacacacctgaagtcctaccactctccagaggctgatgggggaggatggtttgagcccaggagttcaaggttacagtgagatatgatcgtgttactgcagggacagattgagagcccaaaaacaaacaaaacaaataaacaaaaaagtatattccactaataccttgtaaatgggggtgtatgaagtttttttaaatcagatataatgataatagcgtgtgtgcatggcagtgtgtgtgtgcgtgcgtgtcaggttgcatatattaagtgtaaacaccacagttatttcaggaagggatcataaatgcataagaatctaagtgtccataaaataccgtaaataaataattaaagctgattgagaaataatgggggctctggagactgtgcagaatttaaacttagcaactttgcagaagtctacgtctattttttccatcttccaattttttaggtaacattgagtgtctggattttcatatgcaattatgcaatttattttaattaaactattttctagtgtatagtgtggccaaggaaacgcagctttatgtgccatccagaccatgttgcaatagtttaaagccttgggcttaaggatctgttagtaacatgacatttgtatgatcagagctatctctccatacgcatttaggaccactgtactatcatcacgtccaaaacttcctttcataatcacaatctttgaaaattctcacactttagagtatcttcctgcctagaaaaatctatcacagtaatatatgcactcaccataaagataatgtaccaggatgctgaggatatactaggtggaaattttagaactgctgttgttcaggattttctcaaaagagaaatattcagaaatatcaggtagttactttacaaagtaacatatataaatatatgtatatacacacacacatatatttatatatgcacaaagggtttcttaaatgcacatgtacctttaaagtaagaatgcattttgggcatagtcatcaccaacacaaagttcattcttgcctcatgtattgatttatgctttaaattttgtaatcatgtgagcaatctttaaaatgataccagattcccaggttaaagtcatttggatgacatttatttatgttttttgtactattttgagtttgagggatggtgttagaaaatcttgtaaactagcttttggtattttctgattattattttttattttttggtgagcaacactaagactggcatttcaacttccaatgagggtccttatataatactcagttaagcatattactgctaaattcaaacaaattttaaaaacaaaaaaagatataaatgattgaaagcatgacaaacgttccctgtagatgttttctaatttttaatacattgaattaaaaatatgcctttccaagtgaattttagatattggttaccaccttcaagatcatcatttatgtatttgtgaaggtgaaagtaggaggcatacataatattatatctgtaataaatgtaactttttaaagtaacataacatctatatatggcaggaaataataatgatacaacattaaatagatatagacctgatgatatagttggaattctccaaactcttgcataacacttatgtaatcaatgtgaatttaaaaacatacaattggccgggcgcggtggctcacgcctgtaatcccagcactttgggaggccgaggcgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcgtgaacccaggaggcggagcttgcagtgagccgagattgcgccaccgcactccaacctgggagacacagcgagactccgtctcaaaaaaaaaaaaaaaaaaaaaacatacaattgacaataatatatgtgatatagtagattgtccaatattttgttggtctaaactacaaaatttgccctgatgattggtgtattgaagagaaaaacaattatttgtatctcatgatacttatcgaaagagtttgtagacaaataaaaaacacactagcaaaacacactctgtttcatgttaattaaagggagaaatactgttcacagaaattagcttccaaaaatcattcttcgtgaaaacacataagtaaactaattttaatactctcagttataactaaaatggtatcatccactatcttccactaactaagtattaaatacagagcataagctattccaactgacatattaaacaactttaagtatggcttatgtctataattttcttgtaatctcattctgaatggagctttcttgagcaacagtaattacagaggagttaagagtctggaaatagttatttgtttatagaaagaaaaactaataagagaatgaacatacttagtctaattagaaaagttttgtttaaactaccattagaagtaaaataatgccacaaactgaaatgaatccctggatattcttaaaacattattgttactttagtttcttaaaaacaaattaagcagacactcattttttccaatagcttgtaaacttttgaatcttgggtataattttaattcttgagagtgtcacatatttgataaagaatgtttgtctaagatttctatgcatatgtgtatttgagtatatgctatattaacatatgtgtattagactgccaagataaaatataactaatcaaagcatttattatttaactttgattaaatctattagcttctttacagattttgctcatttgtaagaggaggttaggtttcttcccccaggataaaagggatgagttatctgtttctcttgggacagatgtactgtggtaaatgcagtgataagagataaatgaaaataaagagaagcccctaaccaaacagaaatgaaaagaacaataatagaaaagagtgtctggggacagtgttcgaggttactttttcttttttctaaaatgattttttgcaattcatgaaaacaagcctgaagcgtaaacttgtcatctcattttaagatgcatttctcctaatattaggtattaaaatataatgatcaggcatatttttaagactcttttcaccttgtttgaaatgtattgcttcacaaagtctttgtggagctttctttttttttaagaaaagaagaaataatacaaatatagtttaggttgtgttaatgcttgaagaaaggtgtaaagggagtgatatgctttggttgtgtccccacccaaatctcaccttgaattgtaataatccccatgtgtcaagggtggggccaggtgaagataattgaatcacggggcattttcccccatactgttcttgtgatagtgaataagtctcatgagatctggttctataaatgggagttcccctgcacaagctctcttgcctgctgccatgtaagacatcactttgctgctccttcaccttctgccatgattgtgaggcctccccagccatgtggaactgtgagtcaattaaacctctttcctttatacattatccagtcttgggtatgtctttattagcagcctgagaacaactaatacagagagagaaagaaggttggagtagggagaagattgctagggtattaaaggaaagccctctgaaaatgacacttgagctgagacctgaataaactaagggatattttagagaatcccataacagggaagcaggcataccactttcaatggctctgagtggggagcatgccagccatggatgagaaacagcaaataggccagattaataagagggagggagtagtactagagatgagagacgtagccaacaagaaactgagagaatggaggtgccacttactggaatgtgatcctccctattggggagcggcaggtttggagtagaaatcaagagtttggctttgattgctcaaataaagtttgaaatatctattaaactaccaaatacagatgtcccatagattgatatgaatgaatctgaaagtcagggtagacaaaaaattgccagtcatgaaatgaacatggcactaacataggctatctacggaggatgtacaaagagagaaaaaatcaggacttgcaaatatttagaggtcagaaaaataaagggtatgtggctaaagagataagaaggagtgagagggaatgcctgaagccaaatgaagaaaggatttcaaacaggagagaatgctaatatgttgagtgccactaataggttgaggaagataaggattgaggattaactcttgtgtatttgcaaaacagaagtcactgatgcccttgagaagagtggttttagtggaggagtgggaacaaaagcctgactagaggttttcaagaaaatagagttcatataatttgttagtgtttttttttactgtgcaagtgagcaaccaaatgcggagataggaagacagtggggacaatgagtccatgaacttggcacatgtgtgcacttgtgttaaagatagagctattaccaatgaaaataatctattaaaaagtacagtgcagacaaaacaggagagagaatggacacacctgcacagtaagagaaaagtcctttcttaggttggtagaggaaattagatcctccagacagtggtaattaaccagagagaaggtccaggataggtggaagtttgcggatgagaaagatgtatcggagctttgaggataaagagaatgtatgaaggattcctttgaaaagtaatagtgtgaattaagtggcaaaatggcatacagttatacagttattgcatagggatgatggaccacttgatgtttgttttttcttttattttccagccacatgaagctgttggcatgtaggattagagtagacaaactactatttttattttttttatgtttagttttctttataatacacttcttcaagtttaccaattaaaatattttgaatctcataattaagtcttaaatatacgtgttcatgggtggtaattacttaaaacacttggatagtagcaagcaatgaaacttctctttctcttctgttgtattcaccaccactttagcctgaataactgagcaaataccaggttcttggaacactggcataaactatgtatctaggactatggctctgtccatcagcacaagccactagtaattcagaaattggtcatttatataatggcatttattgcatctttaccacgaacaatatgattttttaaacatggtttaaactatattatacaaataattcagctgtgtttgatacttcttatatgtaagaatcactttcctttttataggttacttttcctctttttataatatctgaaatttaaggatgctgtctcagagagccctttatttatgcaggcaagataagaatctatctgagatactctcacattcttaaaaactaaatagctacccatgtgtgtgtgcatagtgatgtcagaagttcttaactgagtcgtaaattccaaagaatcttagctaaaatgaagctcatatcttgctaattcttctctgttaacccataagaaaacagaagcccagagaaattaaaagatttgttcaagatttgcttgatagcatactaaggtggatttaggactttgggctctgaattgcttaatatggaagtgttgctcagggaaaagcccaaaccccagcattacacaataaatccatgcaacaaatttatacatgcagcctctgaatctataatttaaaaatgtgcaaaaccaagcatctttgaggaacaaaattctgagatattataagactttgaaagtcatattaggctttgctattgttcagattttttaaatatttttaatttttttcatttaaattttaagattttgttgtggtaaaatgtacataacatataatgtaccattttagccattttaagtttacagtttagtggctttaaggacattcacattgttgtgtagccatcaccaccatccatcttcagaacttttcatcgttacaaactggaactctatccattaaataggtgctccccattaagccctgctccccgcccctggtaaccattattctatgttatttctctattaatttgactattctgggtatggtatatttgtgaaatgatatgaaatttgtgctttcaatggacaagcatttgaggggattcaaaattgaattattttatcacgtttcagatggaactacaattattgagcatcaccattttagacattttactaggaaccttaaatacatgttttattttaaattctggatcaaaattctgaactaattgatttcatttctttataaattggacagaagctgagcatgagaggttaggtagccctctcaaagtcaaacattagaggcaagactagaagtggaatcttcaaacccatgtccattaacatttcacagaactttgaagtacattatgcttgcagtgattaaagcttgcgatcaagtgtctgactaacctgagttgcaatcctgactctgcctcttacatgctacaatattttgggcagttttctgaacttttcaaaccctcagtttttcctttgcaaaatgttaaaatgatagtttgaaaatcatctagaaagggtgttgattatagcatagcacaagacagaaacttttccatatcataaagaaaaaaatataggctttttgagatactaagaagattatcatttatatctgaaagggaattcagattgcttagggaaattatacctaagatgagactcacaatggcagataataataaaatagcgatatttttcacatattaaaatgcatgtgttattgtatataacaattatatatttaaaaattgtccttcagatatactcaaacacgtcttcaaataccttcatataaggatatttactgaagtatgatttgtaatacgaagaggttgtaaacaattagaatgtacagcaataaaggatacaataggttaaagaaaaaatgtattgtaggtatagaatatttgctatgtacctaattttttaaaatcatatttataaactaaaatagatactctaggatatgtcaaggagctaaggaaatcatttagtttactatttggatgtttacactgaatcttcaaagtgttacattttcttaaaagaaaatgttaaagcatatgtggcatttagtcaaatgtatatgaatatgtatttatggcctctttatgtaaatgcatatatgagatgttcttgaagtaaaaaataattctgtgtttttttctcttgacacaagttgaagctattacaaaagctaattatttaattaaaataacactggaaaaaatgttttaaatttcatttgttaagctagaaaatatttaagaagggaggaaataatttagatcaataccatgtgtatatttaaatcagattttcaaagtttgacctttttacagaaaatctaacagcaacaatcatttccagcgttactccaggtcaaatcatttgatagtgttatttcctatagtagtgtgtattagaatagaatgtctgaaaacttaggctacactaaatttataaaatgcattttttaaatagtaaactaactttagcttactgttgtttttaataaaatttttaatttttaacttttttagctttttgactcttgaacacatggtatagccatacaacatagtttctttctttatatttttattctataacctttttctattttaaaaattattaatttaatttttacttttaaagcattttttaaacctagacccaaaaatacacattagcctaggcctacaccgggtcaagataatcaatatccctgtcttcctcctccatatcttgtcccagtacaagactctgagaggcaataacatgcacggagctgtcatctcctatgataataatgccttcttctggaatatctcttgaagaacctgtctgagggtggtttacagttaatttttttataaggagatgaagtacactctaaaataacaataaaacttacagtattgtaaatacataaattagtaatataatcatttgctatcgttttcaagtactatatactaagtgtatgtgctattatttttatcactggcagcacagtaggtttgtttataccagaatcaccacaaacgtgtgagtaatgctttctgagatgatgttacaagggctatatcaccaggaaatagaaatagaaatttttcagctatgttatagccttatgggaccaccattgtatatgttgtacattgttgaccaaaatgccattatgcagagcatgaccatacaaatgtacagatgctcatcaaattacaatgaggatacatcctgttaaaatcattgaagtcaaaaatattgtaagttaaaatgcatttaataaactctgtctactgaacatcatagcttagcttagcctaccttaaccatgctcagaacacttgcattagcttacagttgggcaaaatcatctaatacaaagttaatttttataatagtgttgaatatagtatgtgactgattgaactgcactgaagtaaagtttccactgaatgcatatcacttggcaccatcataaatccaaaaaattgtaaattgaaccactgtaagttggcgactctctgtatataaaatatgtgtgtgtgtgtttatgtattttaaatcatcactgcctctacttttctaatttttgcatggaaatccaaatccaagggagcaagacagccaattttttttttttttttttgtatttttagtagagacggagtttcaccatgttggtcaggctagtcttgtactcctgacctcgtgatcagcctccccaagtgctgggattacaggtgtgagccaccgcactcggccaagatagccaattttaattataacccagagctaaaaatgtctagaaaattaaaatcatcagctaataaccaaactattatataaatatagattattttctagaaaagaaaagttcaaaggccatttaatagttgaaattttatgatgggtgcaaattttgatgcactatgttttgctttagatcctttttaaagaaagcattaaataaggaatgctttacagagttattgagattttttagcaaaaagaagtcctcattatttttgttttggtttcctgtgcttttggtgtcatatccataaaatcattgctgagacgaacatcatgaagcttttccctcatatttctttttgcactttaatgatttgagtcttacatttacgtcaataacctattttgaattttttgtgtgtatggtgtaaaattgtgtccaataccattcttttttatattcttatctatttttccaccaccatgtgttgattaggtcattgtgactttttggcacccttagtgaagatcagttgactatatatacatagatttatttctgagttctgtatcatattccagtattctatatgtctgttgtacaagtggtactatatcaaactaaaaaggctctgtacagcaaaggaaacaacagagtgaagaggcattttgccttaacagaatgggagaaaatatttgcaaaatgtatatttgataaaggtttgatctccaaaatactttatttttgaaactcctgtaactcaataaagcatgtgacttgattttaaaaatgggctaaagacttggaaagacaattttccccaaaagaactataaatagccaatagatatatttaaaaatgttcaatgtccctaatgataagaagaatgcaaatcaaagtcaacaagagatatctcctcacacctgtcagtatggctattacaaaacaaaaacaaagaaatcaaaacaataaaaccccaaagacagtatgtttttagtaagaatgtggagaaagtggaactcttgaaaactgttggtgggaatgcaaaatggtgcagccactatagaaatcactacggaggtttctaaaaaaatttaaaaatggaactaccatatgattcagtaatcaaaattcttggcatttatccaaaagaatcaaaattacactctcagatacaatcatatactagtactcttatgctcattgcgactctatttacaatatccaagatgtggaaacaacctaaatgtccatcaacaagtacatgaataaaaaaatgtgctacatatataatatatactgactaaaactctctcctttgaccaaaactttatttggactcttttgaatcttatgcttggctaggtctaaccttgggcttctctttctgtccttgttgaatccagtttgagcaagattcctgttaagtcagcttaggaaaaaagcttcaatatcttatgacactggactccattcagcaataattccatcaagttgatgtagctagaaacctcgtttttctgtatgtttcctcttagtaattttccattcactgaaccccaccctgctttttggtataagtctccacttgtcatggtggaagtcagaattgagtccaatctctctctgctcctttaagaccactttgctggggtccctatacctattaccatgcccatccttgaacaatatctgccttaacatctttaagaaaattctgcaatatataatacaatgttgtatggcagaaagtttcagtcaagccaggtaaaaaagccctagagatctgccaaacaacattatgtctatagtcaaagattatacacttaaaaattggttaagaggataggtctcacgttaagcattctaaccacaataaaataaaattaaaaaaatttaaaaaagtcttcactagcattaaaaattattaattataaatttattacagagctgtcctcaattaaattaaaaaataaaattgtcagcccaatgaaggcattatcttaaaaattagaattaatgtgcaaagagtagaataatgggagtggtaaaaattgaagttataaaagttatgttctaccctcaaccatcccattagttaggtaggctgggtaagtcatttttttttctctaagcctcaattgtacttctttagacttgggctaatcatactaaacaaatgggattgctattatgttaaaacacagacattaacaaacagcagttcaatctgactctggctaactatatactgaatagaatgcttaatgtattttaaccattctcacagaagtagaataaacaatataaacaataaatttccgaatccaaagtttaagagatgttaaggcaaatactgtattgtctgaaaagtatacacttttgaaaaatacataggattaatattgaaaatatcagaatatgcttaaacaagtatgcttacataggttttctcctttcatctcagtttgaaaatctagccatgtaaaatcagtttctagttaccagtgattcacagataagcttcacccattaaaatttccattcctacttaagaatcacaaagaagttaaaccccaaaagcagcatctcaaaatcaactctgaaaggcaattactttttcaataagtaaaattcatgaggaaaatttgtcactgcattagcaagttgtctctccatagaataaagaaccaaagctttacttgttcattgtgtatgagaagatcaggatcagtcagttaatgcttgtgttgagaacatttataatgtcaaaataaggttaataatcctaaaaattagataacttaataaagcaacattagactacctaaaaattccaatgctcaaaaagtaattcaatatttttagatatgctaaattgggtatctgctttctcagtaacgtttccaaaatacctatcttctcttcacattcaatttttctttcttactacaactctttagccacaactacataaaccttaaaataaaattttctgatattattattaatatatatgtccacataggtagataaaatggctataaaataggtaatttttaaagtttatgagctaagtgatgctaacagaagcaattctacaaatacatatgcaaagtgtattattcatttaaaacaattaacacaaagcactcttttttggatatggtaactaccaaagtcaaaaaaacaaagagctgaaatattatgtaaattgttcacagaaactgttgatctccaaaccagtcaattattatcacggcttgaatgttatataaaatggtagaaaaattcttgatcaacacttacattttgcctctgactactttcctcattaacttaccagccatgaaaagcactgtgcaaaagtcagcaattagggactgaataaagttttaagtggatcaatataacatatttggcatatctatgacacttctattaacattcatcaatttatgaaataacgacattaagtaattgtgttcatcccaaaaacccaaatatcaaatactatttgcatgactgtgttatacatagagcagaaggcagtgaagacatgatctttgcttttgtcacctatgaagacaaatatattgagtcacctatgaatacaatatattggagtgtgctctataagacaagtagatgccaactcctactggtcttggagaaaatgtaaataattctattggatgggagcagcaaagtaggtagcaatttcacagaatgggtggtattggggcatgttcttgaaggaatgagaggtcatcaaacagacaaaaacgttttgaacataggttataagcaataaagaaactgtggagttgcaaaaaatacagcatgatcaagaaattgtatagtcatgtgccacttaacaatgtttctgttaataatggaccacatatatgaggtgatcccttaagattggaatggagctgaaaaatgtctatcttctgttgacactgtagctgtcataacattataacacaacgcattactcatgtgtttgtggtaatgctggtgttaacctactgcactgccagtgtataaaaatacagcatatgcaattatatatagtacataatactcaataatgttaataaacaccatattactggtttgtgtatttacaagactaccttttttttttttttttttgagatggagtcttgctctgttgccaggctgggctggagtgcagtggcaccatctcggctcactgtaacgtctgcctcctgagttcaagtgattctcctgcctcagtctcccgagtagctgggactacaggagcacgccaccacttccagctaatttttgtatttttagtagagatggggtttcaccatgttggccaggcttgtctcgatctcctgaccttgtgatccacccacctcaacttcccaaagtgctgggattacaggcatgagccaccatggccagccacaagactatattttttatagttattttagagtatacttctcctacttattaaccagagtatttgaattttgcattttaagctgtggggagttgctaaaccagtaataactataataagaatatcaactaacgtttgtcagtactgttaatatcattcaccaacttttaaaatcacctattatatttgaaactgtttattatctcagtgtccctagaaaagcaagtactgcattaggtgcataagaagatgaccatcattgaaggtcaatgagcaaaatgtccaatttttttctcaacttggctgaatatgagacagaggagttcctctgagcaggtgagttatgtagcttatgacttacaaatgatccctaaaaacttcttatatggtatggtgtaaatgaaagtacaaaataatttatgacagtacgtagcagaacaaaagaggaaaatatgttttaattatcaattaaaaattacctccaaacttcaaatatgaaaacccacaaataaattgcatctctattgaaatagcacaggcacttcatggtttagatttgtagaaatgtctctgaaaactctgtatttcctacttttatgtttgtttatatttaggagcagcctacacataatttggctcacttaaaagactttcttaatgagtagtaatctacatagttccttgctgctttattttttagattgggctggggaagtcaataaccactagaaactctcaaaccaagaaattctcctgaagcaatctttcagctgtaaaccacctcagctaggaacccattgtattcctataaatttccttcagtattcctaagactaaactaatctgaacctcatgactgacaatgagttgagaatgaccttttgcaccagtgcattaattgtgaaagctttctgcagcaggagctaggaaattactcttctgagtacagcagccagagcactgaaatggctctggctgctgtactcagaggagtattttgaatggcaatgcttaactcttcagccacacatcgtctacatttttatattttacagacattttagatgtgtccatcatcctccaaggaaattggatttctgaataagaaatttcttttcaccctgtgatttctacatgatacttatagaaacagtttgacagctttggagaggatatcctatgcttcatgtagactttctgcttacggagtttaacacactcataaatttagctttactgactttacaatcttttatatgagaacagaaaagtcagcaaatttggaaatagaaagtttatgttccgccacatataaagtatgccaagtaatactttggccacttcacaaggaagaaaaggatatatatccaaatttatataacattcaagaaaatctttaattatattccagagctgataatttaaaatttatcttcaataattttatttgtttccaaactacctgctgctgagaggaaaataagaatatgcaatttgaaggcatggcttgtagtgtatcatagctctatttattatattattatattcatctacatacactgaactgaaattgtagagttcatttatcatttagatcaacttttaagaagatatatttccaattcttacctgtccatctcaaattgagctcactatattcactttatgtataaatggtatgtatacataagcaaaatataaatacaagcagtgatatatttattgcactttgtatcttaaactagtatacgtttgcttccagcagtattttgattttactgcaattcagatattctgattatcttttacctaaactttaacaatcaaaacaacttatcagtcatctaactttaaacttcctctgaaatcatagtctttgtacacgaaatctaactggggttaaatgttcttcttgttctctctgattgagccttccctgggacatctcatgcatagaaaagagttcacaaataaaaatcggttagagctgtgattcagtttacataagatctagaaatataagttccataacttctaaacgaagtcatatccttaagccattcttaaacttaaaagcgaataactccaaacatccctgattgaataactcaaaataataagctcatcaatctgataggaatgtcaatctcagatacattgccaagaaaatgaaaatgatgtagtaaagattaaatgagaaaatgatgccacatacttagcataaatgcaaacacaaaataaatactcaagtaaataaaaccattctttttttaaatgtattctaaaacaacaacaataacaacaacaaccacaacaacaaaacaggatacaggtgcagaacgtgcaggttcgttacataggtatacgtgtgccatggtggattgctgcacctatgacctgtcctccaagttccctcccctcataccctaccccgcaacaggccctcgtgtgtattgttcccctctctctgtctatgtgttctcattgtagagtaactcccacttatgagtgagaacatgtggtatttggttttctgttcctgtgtcagccataaaaagaaataaaaccattcttaggatgatatttctccttacccttctctttttacaccgagaagaattatcactttgacaactgacgctctctttctttctttcctgaaagtaagttacactgtaacttatatgagtaaatgagccctttatatgaagcttaacatttaaattctaaaggattcttaaacacatgtgtaacaacaccatgtgttagttaatcctatcataatatatcatgttcatatattagattaatacaattaatcacattctaaattgacaacattttctgagatcttggtttcttaatatttgcagtagaaacaaatattttttctcacccttgagaattaaaagtgaagcagaaactttagagtcatgttaagttgctgactatctaacttggtttctgaatgataaagtagactctaatggtgattgctttttcagtaacaactttcagtaatatttgtatttttctatcacacctttccctgaagaagaaatgctttcagatgaatagggaaagactctctaagtataggtttgagttttagaattggctagattggagagttttagatggaagagggaggtatcaatcaagtacagaagttaatgctacaataattacttgggaaaattctcacacttcagtgattgccaatcagcctgcactacttactgagtgaaatgtctatggttatcagaaatcgtacaagaaaaaaccaaaccgaaacaaaaaatagtgtagttctttttttctcaacgaagtatatttaagagcattaatttagatccaactaggcctaggtttgagcacaggattttccactgtgattaacttaaactctcttgtttgaagttgtctcacctataaaatttgggacaattgtggtaattccagaatgaaaataaaatgatgtacatacatcatttagtatattaaaaattctcaataagaattgatttttctgttaatacgattataatataatttgaggctacaactaaagaatgaaatgaatagaaatgtaaacagaatggtcacttttgaaagggcttattctgtttagaagaatgtatagacatgatcaaataaatgttcagataaatttatagagatgtcaaataataactgcaaattgtgcaattcaactaaaatgtcgagagacaatgagacaaataccttttttattcaagttttaagaaaaattactgaagtttagaaaatctatggaataaatagaacaatacaggcataccttgttttgctgctctttgctttatttcactccacaaatattccaatttttacaaattgaagttttgtggcaacctggtgtccaacaaatctatcggcattgtttttccaatagcatgtgctcacttcatgtctctgtgtctatgttttggaaattatcataatatttcaaactttattattattattatttgttatagagatcagcggtctttgagatcaactactattgtagttgatttgggccaccacaaaccaggtccatagaagatgataaacttaactgatacatgttgaatgtgttatgactgctccacccacttcagcttccctgtttccagaggcacacaatattcaaattaggccaactaataattgtacagtggtctctaagtgttcaaatgaaaggaggagtcccaggcctctcatttttaatcacaagctaaaaataaataagcttagtgagaaaggcatgttgaaagcccagaggccaaaagctaggcctcaagcaccaaacagccaacttgtgaatgcaaaggaaaagttcttgagggaaactcaaaaagtgctacttcagtgagcacatgaatgataagaaaacaaaacagtcacacaccagggcctgttgtggggtagggggagggggagggggaagggataacattaggagatataactaatgttaaatgatgagttaatgggtgcagcacaccaacatggcacacgtatacatatgtaacaaacctgcacgttgtgcacatgtaccctaaaacttaaagtataaacaaaacaaaacaaaacagtctgattgtggatatagagaaagtgttactggtttggatagaaaatcaaaccaaccacaacattcccttaaaccaaagcctaatccagaacaaggccttaactctcttaaattctgtgaaaactgagagaggacaggaagctgcagatgtttgaagttagcagaggttgtttataacatttaatgaaagaagtcatctccataacataaaagtgtaagatgaagtagcaagtgttaatgggtaagctatagcaacttatctggaaaatttagctaagatcattgttgaaggtggctacactgaacaagagatttttaatatagatgaaaataccttctatggaaggatgccgtgtaaaactttcataactagagagaagtcaatgcctggcttcaaagcatcaaagtacaggctgactatcttgttatggatgaatgtaggtggtgactttaagttgaggctgatacttactgaccattctgaaaatcggagggttgttaagattatgccaagtctactataactgtgctctatgaatggaataacaaagcctggataacagcccatatatttacaagatagatatgaatattaattttttccattggggcttcaaatgaatatttaagccccaatggaaaaaaaaagattattttcaaagtatcactgctcattgacaatgcacctagtcacccataagctctgatggagatgtacagggagatcagtgttgctgtgatgcctgccagcacaacatccattctacagcccatggatcaaggagtaattttgacattcaagttttattatttaagaaatacatttcacaagactatagctggcataggtagcaattcttcttatgtatctgggcaaagtaaattgaagaccttccattctagatgccattaagaacatttataaattataggaggagatcaaataacaactttatcaggagtttggaagaagttgattccaacactcatgaatgacttcgagaggttaagacttcagtgtagataatacctacagatgtggtagaaattgcaagggaactagaattagaagtggagcctaaatatatgactgaattgctgcaatctcatgataaaatatacacaaatgagcaactgttttgtgtggatgaatacaaaaaaagtggtttcttgagataaaatctattcctggtgaagatgccatgaactccattgaaatgacaacaaagaatttagaatattacataagtttagttgacaaagcagtggcaggttttgagaggactgactcccattttgaaaacatttctactgagggttaaatgctatcaaacagcactgaaatctatggggaaatctttcatgaaagaagaaaagtagcactggcagttgaaagttaaaagcttcccatttctgatcaaaaagattctttcaaatcagaaaataaatgaaaaaaaaaaccgccctatttttgtattttaatttccaccctaaatttctacttcgagctttattttagcatgcccattccttaggtttccttttgttttgaataatacttccatagctatcctgaaaacttttaacaagttaaagtaaaatgatgtgattataagttaagtcattgcagggatggatgtttttatctatgtatgtgtatttttccccaacatctcccctgaccatcaggctgtcatcttataggatacagtggaaatttacgtttcttttagagatggtgtatcactatgttgcccagactggactcagattcctggggatcaagcactccttggcctcctgtgtagctgggattacaaatgcacatcactgaacccagctagtgccaatttttgaagatattattgttattatgtctttgcagaaataaagttattttatttatttgtagttactacagaagaaatgactttgatagataaaaaatagtaacaaatttcaaatagaatggaaagagtaaattatctaaaatatcagaaataacttgttttagcttatatatacttgatagtttaaaaaatatttttctctcaaagtagcatactatatttctgttgtgaaattatttagttcacatatcatgatcttttaaacttattttatttacaggtatatctgcatataaatttaaatcttcatgttgaaaatacatgattacctgagaacacagtttaatttatttaaaacagttacattatgttagacttatattttgtttttattttttcattatgtatatcgctatgcttattgaaatgtgtgtatatatatatatatatatacctctttacatgcttgcaatagttaacctctgcagaaatgtttatgcttatttttgcttattccatttatggtcagagagagagagagaaaaggaaggaaggaaggaaggaaggaaggaaggaaggggaagggggaaggggaagggaggaagggaggaagggaggaagggagggaggaagggaggaaggaagtaaggaagaggcaaggaaggcaaggaaggccggcaggaaggaagaaaagcaggaagggatggagggagagtgaaaaaaagaaaaagaaaagaaaaaatagccaggaagactgttcttacataaaaacgttctcacctattggttatttcttactctaacaggcacttacgatactatttaggccacctgctaagttctgtatacagtggcatctgtacattcccttcttatcattggtagagagactcctaaatcaatactcatcctgagagtgagctttaatatagtatgggtggtatttataagtaatgaagcagtcaagaggagaaacaagtccatgtttatctgaaatgactatcttctcattcaatgcagttacagccacctacagaaagggaaaatcatccaaacagaatttaagaaagaaagtttacattcgcttgactggaaatcacaggcaaattgctttgttggcatgggataaatgaaagttaaacacgtttggatattaggagagacaagctaatttgaagtattggaattaaaaaattaagtacatagatttcttgaaacaatcactcacagatacagtgacatgggtttgctcaaagaatagagaagactggcacattttgacagaatgttgccttgggtttattatttgcatcagatctgctcaatagtttagtgctgtatagattctgtgtttagaaggattccgagggtgtctgttgctgagcagagaaaaagctacacactatttgctatatcagccaggggaaatggaatgagatgagatatttgtcattcatgtggtagtgcaaagatctgcagctgtgctgccttacagaacctggttttccaccctctacatcatttcaaaactatataaatttgatcaattacttaacctttttaattctctattttcaattttatcacttgtaaaatgaagataataacagctaccctgattacctacagtgaatttagaggtcatagataaatgttctaacattatgcctggcacatgatagccaacatttacctagtgccttctattatcatgatttcttccctgacaactgagccactttttatctttagaaggcaccattttttaactattgccagtgtcatttgtgtaaaagtttcttagtaaagcagtctttgataatgattatgacttttctgtgtcctcaagaagggttccttgacttatataataaattcttctttgtctttcacatttaaaagggaaagtcaatattaatcaaatgagtgtgttcataaaagtaatgtcctcctcttcggaagaggaaaaacagcattggtttacccaaaatctgtttctgtgcttagaataaagatctagtgtctgaaatcataatggcattctaacaaaggattaaacaaataacttcagaaaacataatacaccttaatgatatttcaaagtatttatcaatgttattgtcaactttgaaaggtgagaattttgtaacatgatttgacaatgcttaactacaggttttatgtaaaaaaaaaactagtcacttacatgttcctcaaattattagttcatatgttacggaagaaaatgtttgccacatttctgaataaaagtcatcaaaatattgtgatctagatgtcatgtaaactgaattaccaagaccctatcttaagtgactctatcaagacccataaccagaagtaacaaaatctctgaaggaaaggatttctgcatgttttcaatatgacagaaaattattttttattgttctatgatgataatgatggcaatgcagtcccacctcacttttgaaaccagacttcagtgtttctctgaatacttttaagtgtggccaacagcaaagtggctgaagtagtaggattgaagactgttagccttaaggacaaaaatggtaatataattttcatcatactataattttacctaatattccttatattgaatgtcaggagaaatatattcatatatattatttccattaatgcattttaataacatatttagaatgttacattatttagcatctcagtagcaataaatagttttttatttctttatctttttaacactttgtaaagaaaatacattttactggtaagttatgcattgcataggggaaaacaaatggacaaaatgaacatatgaaaatcagctatgccttaatgattatattttatgtattttaaatatagtattcctaaatctattttacaaatgatgctcagtaaaatccttaacctctccattgcagcaggttcccagcatgaaggggctaaactaacaaagctaggggcctggcattagccccccagagttactgcaagcaggcctggagtactaaactaatctttggccccctgagatcttccagagacaaagtcaatcgactgaacccaccatattcctctatcaaactcccaagggaatcaaagaagataaaagcaaataccttatccaaagggcagcaacttccaagattgaaggaacatctgcccacacagattagaatgtaccagcatgagaactctggacgctaaaaaatccagggtgatcatcctccagatgatcatgctagttccccagcaatggttcttaaccaggctgaaatgaccgaaatgccagaaacagaattaagaatattgatagggatgaagattactgagattcaagagaaactcaaaacccaatccaaggagtctaaggaatacaatacaacaatacaagaactgaaagacaaaatagccattttaagaaaaaacaaagctgatctgatagagctgaaaaactcacttcaataatttcaaaatacaattgcaagtatcaacgcaaaatcaaccaagtggagcaaagaatctcagaggttaagtctggtactacaaattaattgtcatacaaaaataaagaaaaaagaataaagaatggacaaaacctttgagaactatgggattatgtaaaaagaccaaatctctggctccttggcatccctataggagaaagagtaagaaagaaagcaagttggaaaccatattttgggatataggccatgaaaattctccaacctcacccaagggccaacacttaaattcagaaaatacagagaacccctgtgagatactatacaaggtggccatccccaagaaatgtagccggaagattctcctaggtcaaaatgaaagaaaaaatgttaaatgctgctagaaagaggcagcaagtcacctacaaaggcaactacatcaggcaaacagtggatcttttagaagaaaccctaaaagcctgaagagattaggggcctatattcagtatattttttaagtgataatgcttcagatttcttcctacataattagaaaaaataatcacaacaaattggagaggaaatacaataaccttaaagataatctgggtcttatctaattccaaccaaaaatttcatatctagccaaactaagtttcataagtgaaagagattaagattcttttcagataagcaaatgttaaggaaatttgttagcacgtgacctgccttaaaagaggtccttaaaggagtgttaaatatggaaaggaaagactgttacaagacattataaaaacacactttagtacataaatcgacattctaaagcaactacacaatcaagtctgcataatggccagctaaaaacatgattaaaggatcatatctgcacatatcagtattaaccttgaatgtaaatgagctaaataacctaattaaaaggcatagagtggcatgctgaataaagaagaaagacccaactgtatgctgtcttcaagagaactatttcacaagcaatgacacacagaatctcaaattaaagggatggagaaaaatcaatcagacaaacagaaaagagaaaaaagcatgggttgctattttaatttaagaaaaaacagagtttaaacacacaagcaattaaaaagacaaagaagagcattacataattgtaaaagtttcaattcaacaagaaatcccagctatcctaaatatatacatgcccaacacaggggcatccagatttataaaacaagctcttagagacctacaaagagacttagataaccacacaccagtagtgggagacttccaacagcccactgacagtattagacagataatcaaggcagaaaattaacaaatatatttggaacctgaacttgacacttagccaaatggacctaacagacatagacagaactttccaccaaaaaacaacataatatacattcttctcatctgtacatgacacatactatataatcaaccacacaatcacccataagacaatcctcagcatatgcaacaaaattgaaatcataccaactgcactgtcagaccacagcacaataaaaatgtaaatcaatactaagaagatcactcaaaatcatacaaatacatcaaaatgaaaaaagctactcctggattacaatgtgggtaaacaatgagattaaggcagaaatcaaggaattatttgaaatgaataacaaagatacaacacatcagaatctctaggacacagctaaagcagtgttaaacaaaaataaacaaaccctaaagctagcagaagacaacaaaaaaccagagtcagatctgaactgaatgaaataaattaagacctgaaaaccatacaaaagatcaacaaatttagtggttgtttctttgaaaaaataaataagattgataagtaggctactgaaaaataaaggtctgaatatccacaatcagaaatgacaaaggggacattacttccaattccacagaaatacaaaaaaaaaaaaaaaccttcaagtaatattacaaacatgtctatgcacacaaactagaaaacctagaaaaactgataaattcctggaaatacaaccttgcaagattgaactaggaagaaattgcaaccctgaacagagaaataatgagttccaaaattaaataagtaatacaacgcctaccaaccagcaaaaggcttggaccagatatatccacagctgaattctaccagatgtataaagaagagctgcatcatttctgctgaaactattccaaaaacattgagaaggagcaactcctcctcactgattctatgagtcatgcatcattctgatatcaaaacctggcagaacacaacaacaataacaacaaaagaaaacttcaagccagtattcttgatggacataaatccaaaaatcctcagaaacaaacaaacaaacaaaaactagcaaaccaaatccagcagcattctaaaagctcattcaccatgatcaagtaggctttatccctgtgatgcaaggttggttcaacatatgcaaagttagtaaatatgattcaccacatcaacataattcacaacaaatccacatgatcatctcaatagatgcagaaaagtctgttgataaaattcagcagcccttgaggttaaaaacctccaccaaataaggcattgagtaaacataccacaaaatagtaagagccgtctatgacaaacccaccggaaatatcatactgaatgagcaaaagcaggaagtgtcccctgctgagaaccagaggaagaaaagaatgcccactcctaccattcctatttaacatagtacttcaagtcctagccagagcaataaggcaagggaaaaaaaataaaaatatacaaataggaagagaggaagtcaaactgtctctatgtgcagattatatgattctatatgtaggaaaccccatagtctctgcccaaaagcacctagatctgataaacaaattcagaaaagttttagaatacaaaatcaatgtacaaaaatcagtagcatttctatacactaacaacatccaagatgagagccaaatcaagaaggtaattgctttcacaatagtcacaaaaacgtaaaatacctaaaaatatagttaaccagggaggcaaaaggtacctataatgagaattacaaaacattgaggaaataaatcagaaataacataacgggaaaaacattccatactcatatatagcaagaatcaatactgtaaaaagtgcaatacttcccaaagcaatttaaaagaacaaagctggaggcatcacattacctaacttcaaactacagtgtaaggctgcaataaccaaaacagcatggtattggtaaaaaagcagacacatagaccaatgggacagaatagacaacccagaaataaagccacacacccctacaaccatctgctcttagacaaaattgacaaacaagcaatggtgaaacaattcagtgttcaacaaatggagctggggtaactggctagccatgtgcagaagattgaaattggactcattctattcaccacatacaaaaatcaactcaagatgaattaaatacttcaatataaaactcaaaactttagaaaccctagaagataacccaagaaataccattctggacataggcaaaattttacaatgaagatgccaaaagcaattgcaaccaaaacaaaaattgacaaccgggacataatttaactaaagaacttctgcatagtacatgaaactatcaagtgtaaacagactttgatagtttgaacttctgcatagtacatgaaactatcaagtgtaaacagactttgatagtgtaaacctacagaatgggagagaatatttgcaaattgtgcctctgacaaaggtctaatatccggaatttctaaggaacttaaattaagaagcaaaacaaacaaacaaaaaccacacaaataaacaacccattaaaaactgggcaaaagacatgcagagacactttcagaaagaagacatacatgcagctaacaagcatgtgaaaaacgctcattatcactaattattagagaaatgtgaataaaaatcacaatgagataccatcttacatcaatcagaatggttattattaaaaagtcaaaataacagatgcctgcatggttgcaaagaaaaggaacacttataccttgctggtgggaatgtaagttgattaagccattgtggaaagcagtttggagatttctcaaaaaacttaaaacagaactaccatttggttcaacaatcccattaattgagcacattcccaaagaaatataaatcattctaccataaaggcacatgcatgagtatgttcattgtagcactattcacaatatcaaagacatggaatcaatcaaaatgcccatcagtagtggactggataaagaaaatgcagcacttatgcagcatgtcatattacacagccataaaaacagaacaagattatgtcctttgcaacaacattgatgaatgtcattgttctaagtgaactaatgaaggaacagaaaaccaaacactgcatgttctcacttataagtaggagctaaactttgagtactcatggacacaaataagggattcagagacactgatgcctacttgagagtttagggtaaggattgaaaaactacttatcagctactataattattaccttgggtatgaaataatctgtacattgcacccccatgacacctaatttacttatataacaaacctgcatgtgtacctatgaacctaaaataattaaaaaaaatacatgctaagattaatccatatcagttatttccagaactgtcatttgaatgtggtagagatataattaatataattgaaagaatagttagaatgcctgggttcaaattatggctccatcacttgttagatatgcaattttgtgcagtttatctcatctccccaaacctcaatttcatcacatataaaatattttaagcgtaatatttcataggttgtacttcttgatctataatcagtttttacaaccttttgaatttgtttatgacataagtgaccatagcaccactattatccataccatgagttgttctacaaaaagtgcatagagaccattttcttctagaacagtgatttgactataatagattatcatgaacattttaagctttatctgatttgaagaatatttactttctcaaatattacttaatatttactggctcttggtcaggtggcatggattcacattttgattctatcattcactactgcataagtctgatagttttactcaaattataggtgattatagacaggtatctgatgatggatttttttcaaaaatttctgaacagtattgatagatgtggtatcaacggtacagtgaaacttgccatttctctttctcagagagtggagattaggcatcttaaaaagagaagagcatattgagaggtaaacagcataattactcttaacagtgagccagatattttgaatgctcagatgtataaagctgagtctcatccaactaaatatgaatggttgtctgccttagcagagtattttaatcacattcatcacctccagagtaatgctgattacaaggaactccattaaaataaaatgcatttgatattccaaatagttttcatgatagtatggctgaaatatgtacatttaaattatctttaatatagaaaacaaactgatctttctaacttccaagtcaatacacaacttaccatccccacttttagctataactcaaccctagaaaagtactgttagaaatcaaatataaagtaaaaatgagtgtattgggtttcatgttatttagtcaattatagggctaataggcctataagaatttaaattgcattgaaaacttgaagaaatatgacatgcagagattatcctagtagataaaattccttagatggtatgggatagtaatataaatttttagaattatttccatgtttcctactttaagttttacacctaccatacctggagaataggatatgtaggtatttgaagacttaaccacaggaaatgggggcgaggaagacatattttaatttattttttcaatacggtgtctcgctctgttgcccaggctgtagtgcagtggcgcgatctcggctcattgcaacgtccgcctcccaggttcaaacgatcctcgtgcctcaacctcctgagtagctgggactaccagtgcatgccaccatgcccggctattttttgtatttttactagagacgggtttcaccatgtgggccaagctggtctcacactcctgaccttagtgatcttcccaccttggcctcccaaagtgctgggattacaggcatgagccatggcgcccagccagaaagacacattttaaatcttagaaaataagatgcaggaaatcctgttgagaacatagaagcaatcttcatgatgttatacagacctacttctctaatataattctaatagggtttacacatgttaatagtaagagatgtggaacactgtagctgtacttggtatactcctagaggctgacctctataggtaataaatgaaactggaccatggactacttacctaagctacagaacctagagtaaattgaggtggtaggcttgcctgatcagccccaaagaagggtcagagaaattaagtaagactcaactgacaaaatttgttgcaaactccagggacagtaaagtttcttaggaaaaatgagtagtacatcatgcaacagtaacttagtactatagataccactgttcttgcccaggtccatataaaattgagaggaaaggagtctaaataaatcatattttgatatattttccattggaagtaacttgctggtatagaaacttgaaatttgaaacaactacttctgtccagtttgccatttgcaacagctaccaagactttattctcagaagttacaaaaataacaaatggagactaaataaatacacaaataataaaataattaaaatagtaaaaataaagcagcatgtagatttaagattcctgaaaatacacagcctatctgactttttgaagcctgcatttatttcaaaataatacaaggtctttcaccagtaccaaaactgttttgggacagtattctgtgattctcacttcatgaaaaactggctatttcatttcaacaaacacacattacatgtttaccagacataatgcttagggttgagtatacaaagataaaaaaaaccacatgctggctgtttcatcaaatacatagaaacctaaaagaataaagaaacccataaagagatcattttaagaaggggaataaaggacatgatataaactcagagcaggactgcttagccccaatcactagattggtcatcacttttgggatggcataatttctaacataatctttaaatgcaggtaatgagttaagtaagtaaataagtcagagtttatcatgttttagcaacaggaaaagcatgagaaaatatatgcaattataaaataacatgcatatgttgtaggaactatattctatataattgtaacataaacatcaagttatgcatattagtggaaaaggctgtagaagcaggccaagaccacgacacagaggacatgttgtatgccatatggataatcacaatagagccagagacttgctaaatagaagtggaataaggccagttttttcttgtggataaatcactatggcaacattgcggatggtgaatttcaagagtgcaagataaaaagcaaaaggtcatggctcatatttggtattatatttgcatcaagtaaaatagactaacccaagttggactgtgacaaatatgctgaatcttacagagttgaatattttttatccagatgataaaacatataatgtattgaatggcaaaaattccatctatgtagatatatagaaaatgaagaaaatttttgattagacattatattacatagatcggacattagatctgacattctattacagcagccatgtgaattttgcagttacatggttttactgtttctctttgttttctctctttatagtcaggattttacctgagtatctagattatttctcagcttttattttacttaatctatagtgttggcctcctcttaggcctaaactgaactatttcaaatatctgactcctaattgtgcaaccttaaggctgtcagaatcaccccaatgcaggccagaataacgtgtgtgtgtgtgtgtgtgtgtgcgcgcgcgtgcgtgtggtcatctttattcttggcatgcttaaatagattttcataactgttccctcagataacgagcaataatagctctaatgatctctgaaaaaaaggaaacaaaatatcagaagcaaacatttgttttcattattttctcagaggagttttacaatttttatcgcttgagttagacatcatgttgtaaagtgagtgccttagttttagggaagaataattcaagattgactatcaaaacctgaccgtggatatttgctttaaattcttaccaccactgattatcttctttcattccaaagaaaaagaagagaaaaccaaacaattcattactatatggaacttacacctccctctgataagaaatcagttgctcaagcactgaaacaagatctttgcaaatgcattctttttagtatttgaaacttaatcacatcgtatagaaacagaattttatacgtaagtaaagaatactatgatcggttccaagattctccacttattcttggattgattgaagagagaaggaaatacacctactccatacattattatacattaatgaagaaatacacatttccttcaaaagttatactgcacaatctatttaagcctcagttttattttctgtaaatgaatatgaggataataatatcaataacaattgtaataatatctacttccattgttgttgtgaggatcaaatgacagggggtctttagtatatgcctggcacaaggaaacaaggaaacacacaagtcttagcaattacaaataattcatatatatatatatatacatatatatatatatataaaatcactttaaaacaattctaatacatattaatgtatagttatgggagtaatgtgtgtgtgtgtgtatatatatattatttatgcaggacatatctaaaatatatatattcataaatatatgtgcaggacatatcttaatatgtatataaaataaggcttacattgaatgagtcaataaacacagaatgaaagattgctgaacttatggttttactttaaccagatttttaggaattttccactcatgcaattgactaggataatgtatatgaatgtgtatatgtgtgtaagtgttttttaacacctttatgtatatatatattacatatttatatgtaatatatgtaataaatatgtactagacatgtaataaatatgtatatattacatatttagatgtgtcctgcatatatacttaaataaaaatataaatctgcatctatatacacatttaaatgtgtcctgcataaatgtagcaattcacaatgctactgacgtgatcctaccaagcaaacgtttgagtaatccttcttcctctaattgtattcattcagatcaatgcaatcagtcccactcaagtggacgatcatgcaatgattctttacaaaattggtaaatgaaacatcagttttcctagtgacaaaagcttgtatctaagggttttacaaacactgagaaatcaataaatagtgctggaaaagtattgtgaaggatattgttagtttcaaaattaatcatatttagtttaatattgtttaataatactgattagatttttactgtaggttaaatttctgagcgaagcatttctctctcaagactatgttgcccaccacacagttttagaatagcagtatattatgttattattagcctatttattttctactggctgctgcagaaaataaacacctctataatgaccacagtctagatttcagcctgtgtcaaaaggattttgaattatacttcatttttagcttttgctcccaccctttgcacaaagtagaagagacagaacagaaatgttttcctaattgctgttgcaagaaatacttcatctagaaaaaaatgaggaattaatttattttagcaggaaaaaatgaacaataaaaaatacatagagtgaaaagttgtagtcttctaatacctcttttttacttgatgactcaactttttgggaggtttctgggtctaccacctaattatttttactcaaattttattcctggaaggaagatggccatatgcagtaatttatggttcaaaccagaatacttttgagggtgagagcggtattgttaataataatgcagcaggcataaaccggattgctttgggaaaaccagtatatatgatcacctgtatataagggactacaatttcagtacttgacagcatggcaacactctatttagcaatgttttaggtttatttaatggtcacttcccttgccatgtggtaattacatctgctaaaagggtaagaggctgcttgctgtcacaactcaggctattcacatacttaatagacctgaacaaatactcagaagagtttcattgaatagctgtgtgtaccattgagataatctatcatttaacgtttcaaacaaaaatgatatctttcctctgatacttcaagtcattgcaacatatcagtaaaacagcattaaggaagtgttgataacatatcttttgaatgctgataatgtgactaggtctagtgacatctttcatatatttaatctgacaaacatgaacatacaacacttgaaaataagaggacttcttgatttatagggagtatattgtcactatgagttttttcatgccatagatatccattcctagggcaaaacaataaggacaacgtacaaaatcaaatctgctcatgtatcacatggatgaaaactaaggaatcatagaattctgagtaggtatagaccttaaagttcattctattttccaacattttattaaaaataatcacctttataatatccataatttatgagtatatttttctgactataaatgtccaaaaatgtcgataaattcctcaaaagaaagcccagttgaaaatatacaggagtttattcattcaaccttaatttgaaaaactaataaaagttattatttttttaaaccttacttctaatgtcttgaacaatgctgtagagtttactcagattttaaaattataatccttaagtagtgggactaagcaaacctgtattaaaccattttgcaatgtataatatcttctatttctataattatcatggattaacttccagatatgtcataagtaattgtattgagatttgtataatgtttaattgcttctgagttttctgcctttgattatacaaatgaatattacacatccttaaattctgaaatacttacaggtatttctcgtatatacgtagtagtgtaatttgttccctgaggcactcctaaatttgaatgtaaagagtatagaaattactttttccctttacaaggtacaatttaattatcaattcttttcctttacttaatcttcaaagtttcaaaaagggagagacaaagaaaatctattgtcagtagaaaaatgaatatttaaaaaagcagaaaacatcattgggtagttaggctaaaagaaataatctgttctccaagttcaaacaaagcatttcgaaattcattgttttaagcattaatttatattgctaaattttaaaagagatttaaaaaatcataacagctaagacacaacaagcagtagaagagacatatgaagaaatactacactgatggaagagacaatgatgaaaagaacatgtcatttgaagcaggattgtgataaggagagttttgaaaaagtttgagtgctatagaaaatgtctcatatttatagcagaggttagaaagaactcagatgtcaatgcaaataatggaattataggttgatgggtgcaccctgttctccagctggaaaaagtgtagttggggctttgggtgtacaaaactaagggggcagtaatttagttcatatagccacggaaaataacattctaaactagaattggaggctacatttagcaccccctaagatgatgagaagagctaaccaactgggttgaagattggtaccagtttaaactgaaacactagaaagaattaatcatcttatgagttatagcaagattcatgtcctaaattttaattatcataataattttaaacagatggatagtttggataaactttgaacttcactatgcagtaaaacagattttagtattccatgttttaaatagacctgtaagagatgtatgatagaaaacgttggcacagatgaaaattacgaagatagcttttaatttctacctcaaatttttaaaagattatctctttatgccataggtaatgggcatcataaatcactagctgcaaaagcaggtaagtgtgaacattccttcaatgccttggcataaatctagaacagttatttctttagactttatttcatagaattcattcaatttggcatgtgttcatagatgtggctgtttgtaactgaatgaagttaaaacacacacacacacacatacacacacacatacacacacagggcctgatttcaagtttttttacatttaatagtccacattaaagaaaatattcttcaacaaaattaaatttcaaaactccttacatgagtcattgtacaacttaatactgtgaacagacgcacgagaggaatatatttaggtaaataaaacttgtacaggttggagaacaatattctacctttcatagtagcaccgtagtgttgttcaaattgcagctttatgctaattagtgttgttctggctttttaaaacgtttaagaagtaacagtttaaataaattccgaattgattaagtagtcagtattccacagatcatggaagattttagaattctggatatatttccattcatctgtataatcagtgtctgggcaaataatcaatatgtctaaaatcttcatgacgaaacacttaaatatttcctgacaaagctctaagaacattttaatatatctggccatatgcctgtaaggttgtattacattttacaggtatcttatttatttaaaatttgaaaattgcgttttctaaatttactgaatttctttccctagacctgaaaaggcaaaacatgttttatcaaaaaggttaaatcctttcaccacaaactccattttgacttttcccttgataaacattgaagtaatattttattttgctttcacagaagaaccaaatggctcacattaattctgtgtcttatgtttatcaatgaaccaatagattgtgatgaacagaatcaaggctttgaagttgaaagtgtctctgactgatgctacttcacctctgtgagactcagttttcacatcagaaacactggccacgtagcagcccctttattcttcggttatattttctttcacaacttcacagttatacaggacttagaaagaacaatgtcagacagactaaagtgggacactgaactgtaatcagagaaggagatctctttttgagaaaggtgtcagatatcctgtgaagtgaactgtctatcgcaaacatcactggtgtctctaaacagctccaccagtcgcaactaaaagttagcctttttcagcagtgtagagatgagaagagagactgataggtaatatgaaataatagaacttacagcacgtattcagattgtatttgtgtccagtcgcaatgtataggttcatacatgtaaacttcaaacacatatgtacagtttaagcttcactctttatcctcattaggattcaacaaaactgttttgtaaaaaggccttaaacattcaattaatagcagtataatctaattccaatataggaatcataactttcaaaaagatccatttgattcaatttttctaaagtacataataaaagtcatcttataggcttcttacatatcttaggatatcttttagagtcatagtgaattggcttcattaactggtcttgaggtttgggaagttaagttcttcaagcccatggctaatagatttaacattcaagaccatccatttgatatattttcaaacttcacaggactcctgtttttattcccaaactataaccttttgaggtcaaaaataaaactttttaaatcttcatgtattctattcacttaatgttataatttttataacttctatctttgtggtataaacaaatatattcaagtgtgaaaaattttaacatcatgttgtgtggtaaatttatttacattcagttttggggtagaaagtgtattcttaaaaagtttaaaaccaactgttttcatgattaagctaatagaaattattaagcacatatttgtttgccaagagaaatattgagattgctgatactcatttttttttctccaagagtaaactatagtgagttccacaaatgcagtaaatatatctgttttagttcaccactatatttcaagtgcaatgctcggtttagacttaaaataattttccttatgcaaggtaactgactatatagaaattatttgaatagagtttgatttttctatccattaagaaattaccaatatggaaaataaatttccttaagggaaggtggaggcataggcagattgattctgctcaccctccatcttattcccccaagtgtagattggtcttgttaaatcgcccatgcacttgttgcagaaacagtcaaaatggcgggttagaggctgttagcatgcctcagccactcggaaatagcaaaacagtgcataaagattgacactgtgagctttaattcacgaaggaaagtgggaattcaccagaataacaaaggacactccagatccaagggagaagatagtgggcaagccaccccctgatggcgtttggctggtaaaacgatatgggtgcagtggaacattttctttcatggccagacatatctccaggcttttgatgcaccatatctcctgggataggagcttcagttgccattcttttcccacacagacaatttagtacagcagcactccctccacgtcacactcagacatacctccagtcatttggcacacacacgtccacagattagtagtttgagccattcatcccttcccatgcaaagaccttattacagcagcagtttctctgcttttggccagggtatatttgcaggcatttgacacacacattctcttggcttaggaatctgtgctgcccctcccttcaggtgcagagattgtggtacattggtgctctctcttcttgatgcccagacatatctctggaatttggagcactcactcttctaggttatgatttaggccacctcactcttcccatgcagagaacctgaggcagcagaagtttctagaattcatgcctaggcacatctcctggttctcacaggctgcccactgggacccttttcaaagctgatgcatgtgcatgccattgggaaacctgtgggtgggcctgctcagtctggtcccacacatcttggatctttcctaaggaggaaggtgataccactgtgcattccacagatcaacccatggtctgaggcaacagagagcttctcccattaaaaaaggattaggtatatacccacctattttgaccacaggtggctcatacccataagtgacacctactggcctagagtttgaaatgcaaaacacaatagaaaatgatattgattcttcctatccatgagcatggaatgttcttccatttgtttgtatcctctttaatttcattgagcagtggtttgtagttctccttgaagaggtccttcgcgtcccttgtaaggtggattcctagctattttattctctttgaagcaattgtgaatgggagttcactcatgatttggctctctgtttgtctgttattgatatataagaatgcttgtgatttttgtacattgattttgtatcctgagactttgctgaagttgcttatcagcttaaggagattttgggctgagtgaaaatggccataccacccaaggtaaatcatagattcaatgccatccccatcaagctaccaatgactttcttcacagaactggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatataaatcaatggaacagaacagagccctcagaaataaggccgcatatctacaactatctgatctttgacaaacctgagaagaacaagcaatggggaaaggattccctatttaaaaaatggtgctgggaaaactggctagctatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcccaaaagaagatatttatgcagccaaaaaacgcatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggaccataaatcatgctgctataaagacacatgcacacgtatgtttactgcggcactattcataatagcgaagacttggaaccaacccaaatgtccaacaatgataaactggattaagaaaatgtggcacatatacaccatggaatactatgcagccataaaaaatgatgagttcatgtcctttgtagggacacggatgaaattggaaatcatcattctcagtaaaatatcacaaggacaaaaaaccaaacaccgcacagtctcactcatagatgggaattgaacaatgggaacacgtggacacaggagggtgaacatcacactctggggactgttgtggggtgcggggagaggggagggatagcattgggagatatacctaatgctaggtgacgagttagtgggtgcagcgcaccagcatgtcacatgtatacataggtaactaacctgcacattgtgcacatgtaccctaaaacttgaagtataataataataataataaaaagaaaatgagctgacacaagtcaacagacaagtcaacagcagtggggaatgagataggcttcctgagatctccatgattccagtccaataggaagcattgagcctgctcacatgcacagtgcattgctactaaaaataacattcaggaaagccatcatacaaaggctatatgtaaccaaagaacttatacagactctttagccctgaaagcacccagaaccaaagccagaaggaccctacaaatcatacattatagacacctcctgaaggagaaaaattccatccaaattaaaacaaattcaaaaaataaggagagatagcttatctagatgataaagaaccagagaaacaactatgaaagtatgaaaaacagagtgccacaacacttcgaaagatcacactgattcttttttttttttttttttttcttttgagatgaagtctcactctgttgcccaagctggaatgcagtggtacaatctcggctcactgcaacctccacctcctgggttcaagcaattcgattctcctgcctcagcctcccaagtagctggcactacaggcatgcaccaccatgtccagctaatttttgtatttttagtagagacggggtttcactatgttggccaggctggtcttgaactcctgacgtcctgatccacccgcctcagtctcccaaagtgctaggattacaggcatgagccactgcacccggtccacactgattctttaccaatgaatctaaactaaatgaaatctttgaaataccccatgaaaaattaaaaatattgattttaaagaagctcaatgaaatccaagacaaagctgaaaaaaacacaaagaaatcagaagaacaattcagaatattaaaaaagggtagatatcattaaaaaacaaacagaatttctagaaataaaaaattcattaaaataattacaaaatacagttgaaagttttaacagtaggctataccaactggaagaaataacttcagagctggaagacagatcttttcaattaatccagtaagataaaaattaacaaagagtttttttaaaaacttaacaaagcctttgagaaacataggattatgtagtgtccaaacctacaaactgtaagtattccagaggaagatgaagaaaaagtaaaatgtaaggaaaatgaagaaataattcagcaaaactcccatgggattgtcttttttgtgcaaatggtagctatttttattatttccttttttttttaaattttactttaagttctgggatacgagtgcagaatgtgtaggtggttacacagatatatgtgtgccatggtgatttgctgcacttatcaacctgttatctaggttttaagccccacatgcattagctatttgtcctaatgctctccctcacctcagccgccaccccccgactggccccggtgtgtttttttccccttcgtgtgtccatgtgttctcattgttcaattcccacttatgagtgagaatatccagtgtttggttttttgttcctttgttagtttgctgaggatgatggcttccagcatcatccatgttcctccaaatgacatgatctcattctttttatggctgcatagtattccatggtgtgtatgtaccatattttctttatccagtctactattgatgggtatttgggttggttccatgtctttgatattgtaaatagtgtaaatcaaaaccacaatgagataccatctcacaccagtcagagtgatgattattaacaagtcaagaaacaatagatgctggtgaggctgtggagaaataggaaagcttttacactcttggtgggtatgtaaattagttcaaccattgtggaagatagtatggtgattattcaaggatatagaaccagaaatgccatttgaccaagtaatcccattactgggtatatacccaaaggaatataaatcattccactataaagatacatgcacaagcatgtttattgcagcacttggattgtcttgggagaaatttggacatctagatacaaaaggctcagagaattcctagtagataaattggaaaagcctcactaatgcatatagtcatcagaattttcaaagtcaaagtggaaaaaaaaatcctaaaatcagcaagagagaagcatctaatcacctataaagaaaatcgcatcaaactaacaaaagacttttcagcagaaaatctacaagccaaaagagattggaagactatttttagtctcttccaaaaaaaaataccagctaacaattttatatcctgccaaatgaagattcacaaatgaagatgaaatagtctttccaagacaaacgaaaggaattcattactaccagatcaccttacaagaaactttcagtacaactttcttcacaacaaagtttcaatgcaacaaggtttaactatctatcctaaatatatgtgcatccaacaccagaacactctgattcataaaacaaatactactggtcctatgaatagagatagacagttatacaataatagtggaggacttcaacaccctattgacaccactagactgatcactgaagcagaaaatcagcaaagaaacttaacttaaactggactatagaccaagtagacataataggtatttacattacatttcatcctaaaccacagaaaatacattattttatctttggatagagcattctcctaaaccgaccatatgcttagccatccagcaagtctccataattttttaacaataaatcatatcaagtatcttcttggatcacagtggaataaaattagaaattaataccaagagtaattctcaaaactacacaagtaaatggactaaacaacttgcttctgaatgacatttgtgtaagcaacaaaattaaggcagaaatcaggaaagtttttgaagcaattgaaaatacagacacaatatttcaaaagctctgggatacaacaaagaaaagtactaaaggcaaagtttatagtgttaaatgtctacatcaaaaagaatgatctcaaagtaacatccaaattttgcacctcaagcaactagaaaaaggacaaaccagacccaaatctagcagaagaaaaaaaataacaaagattatagtaaaactaaatgagatcaagaccaaataaataacaaaaaggaccaattaacagctagttctttgaaaggataaacaaaattgacagactgctagttaaattaaccaaggaaagaaagagattcaaagaagtacaatgagaagtggtaaaagtgacattaaaactgatactacagaaatacaaaagattataagagactactatgaacacctttatgtgcataatctagaaagcttagagaaaatgcatttctagaaaaacagacaacttcccaagattgaagtaggataaaacagaaatcctaaatagacccataatgactaacaaagttgaatcatcaacaaacatctaccaacaacaaaaagtccaagaacagaaagattcaaagccaaatttcatgagatatacaaagaagagccaatactcattttactgacactatttcaagccatcaaggaggaaagactcctccttctctcttttaacaaaagtggtatcatcttgataacaaaatcgagcgaggcgacaatgtaaaagaaagctactggccaatatccttgatgtgcctaatgcaaaaatcttcaacaaaatactagcaaaccaaatccaacagcacatcaaatatacaatacaccatgatccagtgggtttatccaaatgatgtaaggatggttcaacatacggtaatcaataaatacggtttaccacataaagagaactaaaatagaaaaaacatatgattatctcaagagatgcagaaaattcatctgataaaatcaacacccctttatgatgaaaaccctcaacaaattaaacattgagaaacatacctcaatataataagagccatgtatgacaagtcaacaaccaaaattatgctgaataagggaaagttgaaaacaatctccataagaactggaacaagacaggatgtcaactcttattcttattcaacatagtagtggaagtcacttgtaatgtcatttttaccatttatcattattcttctgggaatttctcttatctcttggttaatttaactagcagtcaattctgtttatccactcaaataactaattgcttgtttagttgatcctttgtgttgtttatttggtcttgatcttatatagttctgctatgatctttgcctgatctttcttcaggcaaaataaagaaaaggcattgcaattgggaccaaaaaaaaaaaaaaatgtcaaattatctctgttaaatgatggcataattgtgtatcagaaaaccctaatgactcccccagaagacctctccacttgataaatgacttcagtaaaatttgaagacacaaaatctgtgtacaaaaatcagtagcatttctatacaccaataacattcaagctgagaaccaaatcaagaatcaatctcatttaaaatagctgcaaaaaataaaataaaatacctagagatacaattaagcaaaatagttaaatatctgtacaagaagaatgacaaacactgatgaaagaaattatacatgacaaaaacaaatggaaaaccatcctatgctcatggattggaagaatcaacatcattaaagtaaacatactgcacaaatcaatctacagattcaatgcaatgcctatcaatttagcaatgttatttcttacataattataaaaaaaaaatcttaatgtttagatggaagcaaaatagatcccaaatagccaaagcaatcctaagcaaaaaggacgaatctagaggaatcacattgtgtgatttcaaattatataatactataagtctatagtaattaagatagcatgctactagtacaaaaatggagacatagatcaatggaacagaaaagataactcagaattaaagcacacacttacaatcagtcgatcttcaaaatgttaacaaaagtaaatagggaggaaagatgctctattcaataaatgatgctgggaaaattggctagccacgtgcagaataatgaaactggaaccatatctctcactgtgtacaaaaatcaagtcaaagtggattaaagacttaaacataagaccagaaactataaaatcctacaagaaaacctagaaaaatctcttctggacatttgccttagcaaataatttataatgatgaccctgaaagtaaatgcaacaaaaacaaaatagacaaatgggtcttaattaaactaaacagcttttgcacaacaaaataaataattaacagattaaacagataacctaaacaatgggagaaaatattttcaaatcatgcttctgacagaagactaatatccagaatctacaagaaactcgaacaactcaacaagaaaaaaaataattccactgaagagtgggcaaaaacacggacatttcttaaaagaagaaatacatacagccaacaaacacataaaaaattgctaaacatcagtaatcatcagagaaatgcaagttaaaatcacaatgagatataatctcacccagtcagaatggttaatattaaaagtcaaaaaacaagagatgttggtgtggatgtcaagaaacggcaattgtttatacactgttggtgagaatgttaatcagttcatcttctattaaaaacagtatgtagatttctcaaagaagtaaaagtagaactaccgttcaacccagcaatctcatccctgagtatctacacaaaggtaaagaaatcactgtaggaaaaaggcatctgcatttgtatgttcaacacaatactactcataataggaaagtaatggaatcaacctaagtgtccaacagcagttgactgaataaggaaaatgtggtgtatacatcatgacaaactgtgcagccattaaaaagaataaaattatgtcctttacagcaacttggatggaactagaggtcattatcctaagtgaactcagaaaataaaatattccatgttctcattcataagtggaaactaaacaagaggtacatatagatgcaaagatggaaataacacacctcagagactcaaaaatgagcgagggtagaaaaagtttgagggttgaaaattacctattggttacaaagctcactatttggctaatggatagagtagaagcccagtccctaaccaatatacaatataattatgtaacaaatatgcatatatacccccgaatctaaaataaaattaaaattaaaaaaagaaattaatattagctgtagagagtagtatatcttcactgaaaagttatatgttaattttgtatggtgcaccagaatatataaaagtatatttacagtacataaaaattgtaacaaaatatatatttccttttaaaatggtttctggaataaacgactcaacagaaaagcaagactaaaggtaaacaagaaagctatatacatataggtttcttatatatgtgtgttagtatacatatatacatatatataattttagattcaggtggcacatatacatatttgttacattattatattgcatagtggtggggattgggcttctactctacccattagccaaatagtacatatatatatagatatagatatagatatagatatataaatagatacacacatgcacacctatgcacacatacatacatatatttaaaaacacagctaatgtataccttacatatatattacatacacatatattttaaaagcatgttcccattagtccgaaacacagaaatggattttatgaatttgtatgccagaataagacatcacattgagttgtagaatattccaacactgtgggttcatgagccattctgaaaaataaattacaccaataatggattccaatactttaaccatttcttgcgaaattttctatatattaatattactaatttgtaaaaatatttacattatagtcacagacactaaaaaccttaaaatcattgaagaaaatgtccattttcttagtaaatgaatgaatatttaaattatacagtaatgagcgaaatttagtaatgaactgaagtttaattcaaaattacaaattagcagcttagatcaggcatgattcctcatgccagtaatcccagcaatttgggagaccaaggtggaaggatcacttgaactcagaagtctgagacgagtctgtgcaacacagtaagacctcatctctacaattgtttatgtttatataaatataattatatatataattatatatatatataattggaaactcatttctctgattaaacaaaggaatgtaattaataaaacactgcaacctcattattcataaagaaatagtctacaatttgtatttcactctaagcaactcatttaggagcttgaaaattttatttttacagttttttaaagcacaaaatgagcacattcaagctaaaactgataaaatgggaataataccatccatgtgagtggctgagcctagtaataatttgcagtaaatattatcacaaaaagttggaactggaattcttgggaaactgttttctgctgaataatttcaagttggaattcagttctggtaaaaaaaaattactgctgatatgcactaacttgattgtcacaggttagcatgtaaatgaagaaagatttaagcaggtacctgtctaaattaatgtaggcagctgttacaagtacatgcattcaaacctcagggcatagctctgcctctctaaaaaggacttgcccaagatcagaatatagaataagagctttacattttatctttatttaaattctccctcccctttttgtggaattgtgagtgagcagcaatactacatgccttttataaccctttctaaaaatatattgaccacagttttactaacagttagaaaattggagtatgatctcaaatatacttaatgaagacacacattccacagaaaaaaattagtttaaatttagtttcctaagaaaataattattattatagagaaactattttgaaaaaggagataagaatttaaaatatttgtaaaataataaagttgattctccagtcatacctcaaaatcagtttcatctttagcacatttctacccatcaggggtgtgtgtgtgtgtgtgtgtgtgtgtgtgtgtgtgtgtgtgtgtatttgaattgacagtgaatagctataaaataaagtggtatgaaacaggaccgaaaatgctagagaaagagaatgatgagagggcacaggtcaaataataaaatgagagatatggaattcagaacttggttttcaatgaagatcatcgagattcacaacaaagtataaatgcaatccaagtaatctaaggaatctagcaaaatgacataagagctgaaagacaaaatattcatttataaaaggaacaaactgatctgatgaagctaaaaagctgactacaaaaattttgaaaaacaatcaaaagcactacacagcagaataggccaagctgaagaaaatctcagagctctaagactggttcttcaggtcaactcattcggattaaaaagaagaaaaaaaaaacagagtaaacaaaataaacaaaatctctgagaaatatgggattatgtaatgagaccaaacctgaaattaatttgcatctctgaaagaaagagagagattgcaagaaacttggaaaatatttttgtgggtattaacattaaccatggaaatgtctccaatattgctagagaggttgacatgaaaactcaggaaagacatttgagaactatactcaaacacttgactagatgagcctaacagatatctatagatttctccaacaaaaaacagcagaatatacattcttcttacctgcacatggtacactaaaatcaaccagatgattttccatgaagcaattctcaacaaattaaaaaaaacacatgcacacaaaatcatatcaaccacattgagaccacagcacaataaaaatagaaatcaatacacgggagatctctcaaaactataccattacatagaaatgaaacaatctgttcttgaatcacttttgggtaaacaatgaaattaaagcagaaaacaagaaattatttgaaactaatgaaacaaagatacaacataccagactctgggacacagctaaagcagtgttaagaggaaagtttctagcactaactgcccacatcaaaaagacagatttcacactaacaacctaacaccacactgacaggaactagaataacaagagcaaaccaatcccatagatagaagaagacaagaaataaccaaaatcagacctgaactgaacaaaactgagatgcatcaaaccatactgaagaccaacaaaaatatgttggttctttgaaacaataagattaatagactggtagctagactagaaaacatgacagaagatccaactaaatacaatgagacgtgacaaaggggatattaccactgatttcaaagaaataaaacaaaccctcagagaatctggtgcagatttctagtcacataaactagaaaaccttgaaggaataaataagttcctggaatcacacaacctcctaagattgaaccagaaagaaattgcaaccctgaatacagcattaatgagttacaaaattgaattagcagtaacaaaccaaccaaccagaataagccctataccagatatatttacagctgaattctacaaagtggcttaacaaaatctggtaccaatcctactgaaactattccaaaaaactgaggagggacttctccctaacttactctatgaggccagcattattctgataccaaaacctggcagaaacatgaaggtaaaagagaacttcaggctaattactgtggtgaatgtagatgcaaaaatcctcaacaaaatactagcaaactgaatccagcagcatatcaaaaagttaatcaaccaaaattatgaaggctttattcctgggatgcaaggttagttccacatttgcaacacaataaaatgattcagcgatccatcgtataaacagaactataaaccaaaccacgtgattatctcaatagacacagaaaagacttttgataaaattcagtgtccctttatggtacacatcctgaacaaagaagacatcattttgaatatacctcaaaatataatagccttctattgactgacccacagagaacatcatactgaatcggcacatgctggaagaattcttcttgagaactggaacaagacaaggatgcccagtttcaccaatcctgttcaacatgatattggaagtcctaaacagaggcataatgcaagaggaagaaataaaatgcatccaaatagagaggtattcaaactatctctgtagacaatgggattctatgcctagaaaaccccatagtccctgcccaaacactcctagaattgataacgtcagcaaagtttcaggatacaaaattaatgcacaaaaattgtagcatttctatacatcaatagtgtccaaggtgagagccaatcaagagcacaattgcattcataatagctgcaaataaataaaatacctagaaaaacagctaactagggaggtgaaaatatttacaattagaattataaaacactgctgaaagaaatcagaaatgaaacaaacaaatggaaatacataccatgctcatggataacaagaatcattatagtaaaaagggcatactgtccaaagctactacaaattcaatgctattccattcaaactaccaatgtcatttttcacataattacaaaaaactattcaaaatttacatgaaaccaaaaagagcctgaatagccaaagcaatcctaaacaaaaacaacaaagttgaaagcatcacactacctgactttaaattatacgacaaggcaataataaccagaacagcatgatactggtacaaaaagaaacatataaatcaatggaacaggttaaagaacacagaaataaagctacacatttataaccatctaatctgggacaaagtcaactaaaacaaccaatgggaaacaactccctattcaataaatgaagctgcagcaactggctagccctatgcagaagactgacactggatcctttcctttcaccacatataaaaatggatttaagacttaaatgaaaaacttaaaactatgaaaattcttgaagaaaatctagaaaatactagacattgtccctggcaaggattttatgactacgactacaaaagcaattgcaataaaaacaaaaattgacaagtgggacctaattataccaaatggcttctgcacagcaaaagaaactatcaacagtgtaaatagagaacctacaaaatgggataaaatatttgtaaactagacttctaacaatggtctaatatccagaacctataaggaattcaaacaattgaacaaccataaaacaaacaaccccattagaaaataagcaaaagaaatgaacagacatttctcaaaagaagacatatatgcagtaaacaacctataaaaacattctcatcatcaataataagagaaatgcatatcaaaaccacaatgagatagtatcttacaacgctcagaatgactattattaaaaagtcaaaaacaaagatcctggcaaggttgcagagaaaagggaatgcttaaacaccgctggtaggagtgcaaatttgttcggccactgtggaaatcagtttggagatttgtcaaagaacttaaaatagaacaatcattcaacccagcaatcttattcctgggtatatatccaaaggaatataaatcattctaccatgaagacacatgcatgcatatgttcactgcagcactacttatagtaacgaagacatggaatcaacctaaatgattatcaatagtggactggataaagaaaatgtcatacatatataccatggaatactacacagccttaaataagaatgaaatcatgtacttttcagcaacgtggatggaactggaggctattatcttcaacaaattaatgcagaaacagaaaaccaaatgccatatattctcacctatacatgggagctaaacattgagtacacatggatacagacaaaggaacaatagacacagggcctacctgagggtagagggtgggagttgaggatcaaaaagctacctattgagtactatgctcattacccaagtgatgaaataatctgtacaccaagcccccatggcatgcaatttaccttgtagaaaacatgcacatgtaccccaaacttaaaataaaagttggaaagaacaaatcataagaaagtaatcaaagtagaacccagatataaatccatgcattcacagccaactattttttgaaaaaggcaccaagaacaggaaatggggaaatgagattttcttcaataaatgatgctgagaaaactggataaccatatgtaaaagaatgaaaatggactcctatttctcaccatatacaaaaatcaaataaaaataaagacttaaatttaaacctgaaactatgaaactattagaagaaaatattgaaaaaatacttaacgacactggtctatgtaaagagttttctttgtgtgtgtaatatctcaaaagcacaggcaaccaaagcaaaatatagacatatgaaattacattaggctaaaaaccttctgcacagaaaagaaaacaatctagaaagtaaagagacagccagagaatggaagaaaatatttgcaaactatccacctggcaagagattaacaaccagaatatataaggagctcaagcaactcaatggcaaaaatagatgaaattaaaaatgggtagaagatctgaaaagacatttttctaaagagacatacaaatggcccacagttgtatgttgaacaatgaaaaattgttcaacatcactagtcttcagtgaaatacaactcaaaagtgcaatgagctattatcttaccatagcttaaattgattttatcaagaagacaaggaataacagatgctggcaaagacgtgaagaaaggagaactttgtacaccgttggtaggaatgcaaattagtgcaaccactatgaaaaaaagtatgacagtttctcaaaaaaattaaaaataaaactactatatgatccagcatttccactattaggtatacattcacaaaaaggcagtatattgaagagatatcttcactcccatgtttattgcagcactatttgctatacccaaattatggaatcaaccaaagtgcccatcaatgaataaagaaaatgtgagatagatatatatatatatatatacacacacacacacacacacacacacacacatatatatatagttgaatattgttaagtcatacaagagaatgaaatcctgtcatttgtagcaacatgatggaacaggaggtcattataagtgaaattagccaggcacagaaagacaaattgcatgttctcactcatatgtgggaactgaacaagtgactatcatgaagataggaatttgattattgggtaccagtggccaggaaaggtagatgggaagggagggtgaagagagtttgaataataggcacaaatatacagtttgagagaagaaataatatctagtgtttgatagatcaatagggtgattatagtttgcaatgattgatagtatatttcaaaatactaagaataatttgaatgtttctagcataaacaataaatatttaatggatatctcaattacactgatttgatatttacaaattatatacatatatgacattatcacatgtaacctgaaaatatgtacatctattatgaatcaatgcaaaaattggaaaaaaaaattaaaaataaaaataaatataccaacaatgctgtgaataaaggtaatcaaagcagcacagtagaatacagagagcatggaatgagaagcagacaaacttaaattcaaattcatattaggagacttctagctaaatgatcgggggcatatcacattaataaaaattattaacctccagagagccagagccagagacagagcaagtcagacacagagaatgaaaaaacatccaaactaccaatatccttatgaaagacgggacatcactatagaacttaaaaataacaaaaatataataaggaaatactgtaacaactctacatttgcaaattcaccaacaaatataaaatggaccagtttccttgaaagacacaagactcactcaagaaaataatggataacctaagacatgtcatatatttagtcaagcaattagatttagacttaaaaattcttccaacaaagaaaaattttgtctggatggactcactggggaattccactaaatgctgaagaaggaattttaacaattctgaacaatcccttccaaaaaatagaagaggaagtaacaactctcacctgattttacaagggagcattgtcctgatactaaagtcagacaaaaacatgatcaagtaaaacaatgaactaatctctctcatgagcatagatgcagaatttcttaacaaattattaacaaattgaatatggcaatatatacaaaacatactacatcacagtcaggtggagcagattccagtaatgagagcctgtttcaacatcagaaattgagtctacataattcttaatattatcagaataaaaagaaaaatcaatagattcagaagaaaagcatttgataaaattcaagatttgtttatgatatacactttcagtaaactataagtacttccttaacctgatagagtttgtctacgaaaacgtacagctaacattataatggcgaaagactgacaaagcaagtatatctcttcctcatcactactatagaacattgttttggaacctagacagtaaaataagacaaagaaaattaataaaatcctccagattggaaagaaagctctctctattaaaaagagaacatgattatctatgtagaaaatatctgaaatctcaaaaatgaaaagaaaataaactttcaagaatagcaaaagaatttagtaagtcacaggatacaaaaatcaactgcatctctgaatgttaacaatgaacatctttaagtcaaaaactgtaaccataccatgtacaatatcataaaacaattagatatttaggttaaattctaacaaagtatatgcatgatctatattcagaaaaatacaaaacacaaaagaaatgaaagaaggcctaagtgatgggtatacatattctgtgttcatgtatttgatgacttattaatgagataaattattcccaaattgattctatacatttccaattgaattcttagcaggatatttttagataccaaaaaactgattataagtttacatagaaaaggaaaataattataatatccaaaacattttgaaaaagaatttatttcaagatctcccactacctgatattcaaacttttttaaagttatagtaatcaggacagtattttattggcaaatgggtagatacacatatgaaaggaataaaataaatagaatataaatagaaccacacaaatgtttattttctgacaaagttgctttaaagacaataataaaaagacttaattttaaataaatagtgccagaaaaattagacctccaaacgtaaaaacaaaaatggaccttcacctgtacttcacattttttatcaaaatcaacagtaaaggatatagatataatatagaatgtaaaatgttaaaactttacaaaaaaaaacaaagaaaatttggaacataagtttaagcagccattttatagaaagaatatcaagagaaaaaacattattaattggactttaacacacttaaaaaaatgctctgccaaaaaacatatttaaaaagtgaaaagactagtcaaagattagaaaaaatatgtatttgtcaatcccctatctgacaaactgtatgcattcaacacagagaaagagcaattatgacacgataataaggaaaatatgtgggcaaagttcagtacaggcactttaccaaagaagaaatatggactgcaactaagcaaatgagaagatgctcaacaacagtcattaggggcatgcaaattgaaaccacattataatatttttttaaaggctaagattacaaagaaaacaaaaccttgttacactaaataccagtgaggaagtagagcaattgacacactcatgcattgctggtgaaaatgcaagataagacaacaactttggaaaatagtctgccagtttttaaaaagtgatcatttaactaccaaatgaccttgcatcaccacccctaggtatttacccaaaacagattaaaacttatgatcactcagaaatctatgcaaatggctatattgcccttattcataatggtgaaaaatggtaagcaatcgaaatgcctttcagctaataaaaagaaaaatgagctctggtaatccatacaacagagtactattgagtggtaaaaaaagaacgaaccaactattgatacctacaatccatgtggatgagtatcaaatggatatcctaactgaaaaaagtcagattcaaagggtcatgcatgatttaatttacatgacattcagtaaaaagcaaaactataagaaagagaaaattttgctacaaagcagcagcatggaagtttctttggggtaatgaaactatttcagtatctttattgtgatggtggttacaagactacatgtttgtcaaatataatatttcataccctaaagtgtgaattttactatataaaattcagttaaaatcattaaactatacatttcaacttattatatgaaaactaaatcataatacaactgacttttaaaaaacatctggtatattaaccactttattatactatccctttatagaaattctcatgttaaatctatatattttatgcatagaaaaatctacaagaaaagatagtctcaaaagtatatttgtccatgaggattttgcttttgaccaatttggttaattctactattttattatttgagtgtcttgaaaaatattctgtgtattttctgtgtcagtcagaatgattgccattctaactggtgtgagatgatatctcatagtggttttgatttgcatttctctgatggccagtgatgatgagcactttttcatgtgttttacactgttggtgggactgtaaactagttcaaccattgtggaagtcagtgtggcgattcctcagggatctagaactagaaataccatttgacccagccatctcattactgggtatatacccaaaggactataaatcatgctactataaagacacacgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaagaaatatactttctgaatgtcaagatctcgactttctttccttaggtcaaactgcattttagagttatccctcttgagcacttagaagctgcaataatcctggcaattggcaaactggagactgaatctaactctgtagcatgtgaccatagacaacagtatcatcacattatttctctaaaaaacagccaccttgctcttgataaatgctgtaattcccattttagtagacaatccttcctttcagaatcaggtttgccatttgattttatcaatcacaagtttcaaatgatcaataatccattagaattattttcaaaaaaatagcttttggaagatgatttcaacatatttctttctctctcacccaccccatcccccaacaaacgcagccctcagtatttataaatgtgccccatgctgctttcttggtcatgctatgaccatcaccagcattacacatgttgttgtacttatcttctttctaagaatacttcaatcatcatttagtacaaaataaaattcatgtttctaacaaaaactcttcttcatctcggcaaaaggagaactctttcctctgcagttgtgtgtagtttttgtatgagtttagtaagatatattagatggtacttcatagtagttacgtaggtctgaatataccttcttctactaggttttaaggttcttaaagacagtatatcagcatttttgagaaagaactttaggcgaaaattcatgtcccatatttttgttaggaactatgattctagagaatagggtgtgagggaaaaggagagtgaggcaggaagcaagcagggtcaatatgacaatgcattactgagctggtcactgatggcatcaggtataacgaatcacttgattttgaaggactgtcttcaaaaaggtcaaataatctctttccaggggggacaaaatcataggccagcttctgtttctctctgaattaaggtttaccagagggagcactaccttcctgtacaaatggattgcacatccatgagtgctacaagggtcccaaagcattacatgcctcagtggcagcactgaattctcacagaagacatgaaagaagcacagaaaggacctgatgttagacctgccgggtgcttcttatgcgaaactggccagaggtcactcatattcgttgctccaggtgctggcgctgacccagtggctatctgccctggatataggtgacactgaaagaacctgaagtggcacataagaggtgtctgattgagcatgcatttgtggtaaagctgtaaccataaagctgaagttcatctttgaatcacccactatactacaaaatggtgtatacatcaattattaaaatacttgctaaataaataagatttctaagaatgtataatggaaaggtaagagtgaatgctcacaatataggtgagcaatcctgcttacagaaaaggtaatgagttagtaaattccaaatgtatgaaattgaaaagagtgttaactactagtgtaagtacaaaattatacaaatactttgctgaaaagtcagggccattttcttattctaattttagtgaaaacagctgtgtgacctctctgggcctcactttttttcatctgtgaagtcaaaagcataaatttgatgacatttaagattttagtcaaactttgaaactgatgtgtttgaagttctgaatctatggcaaataaataattaaatattaatttattaggtatgattgagtacaaattgtgagttaggcacctctccagttcctaagaatacagtaatgaaaaagcagatatgaatactgccctattcgagtttaaatcctaatgtggagagtcacaaagcaaaataaatatctatgcaatatgttagaagtggggaggccagagaactgcattgcatgtttactcgggtggccagggtaggagtcactgaaaagctgagctgaaagatccagccaaatggataatgggggaggagcactctaggccattgtctgagcagggggtgaacttcacatgttctggagaataacgaactctttgacttgagccacatgatagaagttagagactgttatgaggatgatgccaaagagttaagaaggacagatcatgtagcaccctaggacattttgagaaatttgggttttactcagaatgagtcattgaggattttgagcagataaatgtatagcttgatttaggtttataaaaggatcaggatcaaattggctgctatattgagaatagattataatggggcaagtgtgtaaacagagatatggaaataaatagtttccaaaagacacatctagcataatttctgtaaggtaacaatgtggctaaaatgtgttttaatttagtatttttatggtcgtcagggtggttaaaaggttttatttattttaaagtaggtaaaacatgaatttactttacaaacatgtaaaaaacaactaataaaagttctactcaaactatttcaaaaaattgaagtggagggaatacttcaaaactcattctatgaggccagaattaccataccaaaaccagacaaacatgcaataataataataactataatccaatatctcttataaacacagatgcaaaaatcctcaaaaaacactagcaaactgaattcaacaacacaataaaaagatatttcaccatgattaagtgaattcatcccagagacgcaagtatagttaaacatatgctaatcaataaacatgatacatcataacatatgatcatttcaatagatgctgaaaaggcattccataaaatccaactttccttctttaaaaaaaaatttcctttggttattatcttgattaaaaacacctaacaaactaagtataaaagaagtatacctcaaaatagtaagggccacatctaacaaacccacagctaacataatactgaatgggaaaacattgaaagcctttcctctaaggtctgtaacaaggcaaataggctaactttcaccactcttattcaacacagcattggaagttctagacagaggaatgaagcaataaaagtgaataaagaacattgtaaaggaagaagtcaaattgtccttttttgcagatgatatgatcttatatttagaacataaatattgaaaaaaacctaaggattccactagaaaccgttagaactgatccatgaattcagtaaagttgctacaaaatcaacatacaacaattaataacatttctatattccagcagtaaacaatctgaaaaaaatacaagaaagtaattcaatttacacagctaccaaaaacaaacaaacaaacaaaaacccgggaataaatttagccaaaaaagtgcaagatctttactggaaaactggaaaagattgataaaataaattaaaaaggagacaaaaacatggtaagatacctcatgttttgggattggaagaattaacacagttaaaatgttcataccagctaaagtgatctacagattcaatactatccctatcaacataccaatgacattcttcacaaaatcgaaaaaaaaaaaaagctaaaatttgtatggagccacaaaagaccacaaatagccaaagcaatccagaactaaaagaacaaagctatagtatctaaaaaacagcatgatgccgtcatagaaatatacacataagccaatgtaacagaatagagaacccagaaataaatccatgcattttcagccaactcatttcaaaaatggtgccaaggacatatgctgataaacaaatacttttcaatgaatggtgctgggtaaactagatagccacatgcagaacaatgaaaatagactcttacctcttactacatacaaaaatcaaataaaaatggattgcatacttaaacgtaaaacctaaactataaaataactagaagaaaacattggggaaacacttcaggactttggtctagacaaagattttttgggcaagtcctcaaaagcacaggaaagaaaagcagaaatagagaaatgggattacactgagctaaaaatacttctacacagcaaagaaagcaatcaacaaagtgaggagacagtccacagaatgggagaaaatatttgtaaactatccatctgacaaaagggttaataatcagaatacataaggaactcaaataagacaatggtaaaaaacaaataatcaaattttaaaatgggcaaaagatcttaatagatatttttaagagaagatacaccagtaggtatgtgaaaataatgttcaaaatcactagccatggggaacgtaaatataaaccacaatgaaatatcatctcaccccagttaaagtagctataattaaaaagacaacaaataaccaaagctgatgagaatgtagaaaaatgtgaccctcctacattcttggtgggaatgtaaattggtacagccactatggagaacagtatgaaggttctactgaaaactgaaaatagaattagcatatgatccagcaattccattccttggtgtatgtccaaaaaaaggaaatcagaatatccacaaaaaatctgcagtctcgtgttaattgtactactattcacaacagccaagacatgacattaatctacgtccatcagcaaatgaacagattaagaaaatgtagtatatatacaaagtggcgtattaatacattaaaaagaatgctactctgtcatttgcagcaacatggatagaactggaggtcattatgttaattgagctaagccaaatacagaaaaacaaatatcccatgttctcactaatatgcgggagctaaaaaacttggtcttctggagataatgactataacagtggttatcaggggctggcaagggtagggtagaggatggatgaagaaagattggttaatggatacaaaaatatatatagatagaaggcacaatttctagcatttaataacacagcaggagtatagctaacaataacttattgtacatttaaaaatggctagaagatttggaatgttctcaacacaaagaaatgataaatgtgtaagatgatagctaccccaattaccttaatttgatcattacacattgtatgcatgtatcaaaataccatatgtaccacataaatatgtattattatgtaccaatattaaaagaaaaaatataaacagaaatatatttatacattctcttttttatatactaatatttaaaactaaatcatactatatactagtatacaaaaactatatattaatatataaaactaatacatataaaaataaagccatgcatacatatttagtaactaaaaatgtactctttctctttccaagtattatgttgtgtattcctctcaatgccatgaaataagtaatttttcatttacagatgaggtcacatggtcaaggacatatagaaagtgaaaggaaggcttacatattagtgaagcataatcactgatggcagaaaaaaaatgaagaatggggtggtagattcctattactgctattaccaatgactacaaaattgatggtttaaaacaacacaaatgtatcttataattttggaagtcagaagtaaaaaataggtctcactggactaaaatcaaggtattgacagggctgtgttttatctgtaggcttgaggcagaatccatttatttgccttttctagcttcctgagtctggtcacattgcttggctcatggctcatggcccccttctatctttaaaaccagcaatggccacctgagtctttctcaatttgcatcattctgacttctatttctgcttctctcttcgacttcaaaagaccattgtgattatattggacccacctcaacaatccagggtaatgtccttatctcaagtcacttgagtggtaatcctaactcaatcttcaactttaattcccacttaccatgggctataacatattcaacaattgtgaggtataagacattaacacctttgagtggctaatgttctgcctactacaaatggtgagataaatttgaggtgatgggatgctagataagtcttttcctttcctcataacttttgtcagaatctatgtgaatatatatagcagaatatgtaccatcactatttcaaggctatcccatttaatttttgttatgaggtcattgactctttacagaaaacatctaacatgtcagcgctttgtccttattattgtatttatctgtgtggtcatgaaagaagtggtctatgtgggagacttttccaaattatgaatctagaatacccataaatatttagtctcacttattcctacagtgtgtatgggtaagtgtattatttttcataagatgatggctggggaaattgggaatacagaacatgaagacagttaacatacgtgccagcctagttgttacccctcattatattacagactggtaaatgtatctacctaaatggaatgatgatgctactcaagactgaagaaggtagccttagaaaattttctaatgtagatcgttgaatgttgaagaccttgccatgttaagtgatgtagagaaaggtcctagaatactggctttctcctgaagagacaatagatttccactgatgacgtagagtgacacatcctgagtaaggctataaggattgtggagactgactttataccagggtgaagtcgggacatgttctttcttcaaaagcttttctttaaggcctgcattctagaaaggagagacagtcccaagggtactttcctaatgtcatggtacactagctcctgtgttaagttggcagcctggggtgagggaagaagtcttcgtcacaaagaatacattgcccagtaggaaaccactatggaaatttatggacttaagttattcaggaacagtcatattgcatactgagtttcaaatgaccttgtgtagaaatattcatcaatgtcttacaatattcaccataagtctggtaaaagttacaaactggtctttatctaaccgtttgaaaaaagaagggataggtgtccacaacacagtgcggagtgtttaaaagagagccatacaagcactaagaaagccagaagtgagtaaccagcagaaaagtagataaaggttctgatctggatccagatgataaatggaatggcaagtgaaaatcgggatatattttccagaagataaatgttcctggatatcttggaacatcaagtaaattattaagttcttatatataataaagcaagattgtagattcatctttttattcaggcatttgaggaaagtgtgacttcaaggactattgaaatctgagacatatgttctgggtacattaaggagaaggtatagtagtattgaagaatataaaaatatatttaggtctcgtaagtcagcacttctccttacattaactatatgactccttcattgtggattattattccatccaaaatttcctatttagaaggccacatttggttcatgcaaatacgaaaagatgccataatcggagaaaaaagtttggagatcatgaagatgcaaacaggagtatttcttaatactttattaagcttatacgaatacactaaagtacagttttaatttggcttctaagtatactttactctatacaaattaccaccacttgaaagaaaaaaagagagccagagatgaatatatagtttccaacataatatagaggcatagtagcatccttaacatgacatacactgtgctcctaaatactgctcctaaatattaaggataacatgctaaaatttgtctttatccccatgttttgggttataaaatattagatttagaaaaaagaaaaaaaaagaaagtaaaaagaaaccactctaacacaaggaattttattttcataaaacatccatatccatatactttgtaggcagttttcaaaatggctttcagtgatcctcttctcttaatattcatatcctgtcctttcagcttgatagttggcttgagattaatcacacttgagcttaatcacttccaagtctagatgacaaaagcctttgacttttctcttgcacattcttttttgccttcttatttattagccctgtcaaagctgcttctatgttgtgagatgctttatggataacatccatgtggtaaaatagtgaagtaggcctcttgccaaccaccagttaggaataaccatggaggaactgagtcccaccaacagctacttgagtgactataaaagtggacccatcactggttgaaccttgggataactatagcccaattgacaccttgattttagccttgtgagatattcagaaacagaggatgcaactaagcattgttttaatttctgacccatggaaactgagataataaatgtttgctgctttatccagtaagattttgaataatctgttaaacaaataaatagtacacatacatatacaaacttgcaagataaaacataactttagaggaaaaaaagaaatcaagcaagaactagatacagttaacataaacaaaactcatcatatttcattacagcatgtggaaattgtgaagtatctttttcttatatatgttaattactcagtaaaaaattagagtatcgctgaaatctgtataccaaagttgaaaaagacaaagaaaacttatagaatgtatgggaggtggtgaaaagataattaaaagattcaaaatcaaaatttatataacagaatttgtattttaagaaaaatgtaaagtgttacaaaaagtatgtctccttctctggcagtaattatcctatttgctataatataataaataggttttgagtaactgttttgtggccgatttaagcagcaatccacgtaaacagacacctggatttccttcagtaagggagcaggaaatgacaattacattcttcagcaaaaacattttatctttgtttacagacattttgtgtgtgtgtgtgtgtgaatgtttctcacaaattgcaaaggccccccaccagtcttaacaaagaatttatttgaccattaactatatttcatgcgtaacatatattttatgacatgaattatattttgaatttagatttttacattttgttaattactacttcacaagaaggggaaaaataaaaaatcttcaaaaagcaattatagctcaatgatttaaatcaattcaccgggttatggttgtggcagataataaaaaattaaattcttcttccaaagctaagttgattactctgagtacctacctgtgttcttccaaaattttataaattacgtgtgattggagctcagatgaaatttagattgctgattgactttaactataggaaaaactattcaaagaaaagattaaatgagaaccaaatccttttatatacacacagaaaaaaaaacatgaaagtgaaagtgatctaatcagaagtattacaaaaaatagacaagaagaaccaacagttatacgatctctctgataatggtaaattctctctttaagtaggcatgttgctattgatgtatgctgaatgagtgtgttttagttttccaacatagcaaatctgacagtgaacttgaaatcagttagactggtaaggggtttctggctggattccacataatgctgttggctcatgggatttccttggtctagccaggtttagaaacagtttttaatcagttaatactggatttattatgttaaagaatgggggagggtaaaactcactgattcagaaactggataatatataagtgtataatataaaattaatctgcagcgaaggccagagtgctttcaaatataagccagtacatttctttaacagtttccaaatgtctgggaattttaatcactaattatagcattaagtgagccaagaattttagaaaagaatatacttttattagatattttcttgaagatatggcagtctaacaaggaacaattttagataataggaaaacttattggaatagtagtcaaaatctccttcctgaactgtgagataaatacttaaaaatttactaaatccttcattcataaataattcttattttccacctattaatttgttaggtgattgaatgttatcttgcactcttatgtacaatagggtttctcaagcacagcactattcgcattttgggccagatgacaccttgttgtgggggtgtcctatgaattttaggatgtttaacagcatcctggcctttctccacctgctggatgatttgcgccctcccagttgtgacagccaaaaatgtttctaagcactgtcaaatgtccttttgggggcaaaataattgtctgttaagatatactgctcaaaaagaaagaggggaggagagcaggtagtggcgatggttaatgggtacaaacatacagttagatgaatggataagatctagtattcatagcaagaaagagtgactacagtctgcaataatttgttcacattttaaaataaccaaaagagtataagtggattgtttgtaacagaaagaaaggataagtgcttgaggtggtgattaccccatttaccctgatgtgattatcatgcattttatgtctgtatcaaaatatcttatgtaccccataaatatattcacctattatgtatccacaaaaattaaaaattaatgaaaggtttctatgactcatgtgcaaatataattataatcttagtggtcacaaccagtatatatatttttatccttcttgtgtcagggttccccaggaccactctaaagtttgatgatatacatattcacaactatggtttattacagcgaaaggctacacagcaaaatcagcaaagggaaaaggcttatggggcaaagtccagcggacaccacgtacaagtttccaagaaacctctcccattcgagtcgcacagatgagagtacagatggtccccaacttacaattttttgactttacattgggtttatcagagtattataggcatttgtgacttacaatattttcaacttacaatggttttataaggtgtaacaccactgtaggtcaagaaacatctgtgattcatagcaatgagttgtaacaccagttgtggaatgtcctctagataagttcattagagacttaatgctaactgcttagcacataccacatttccagactttcagaaataaagcaattgtttagaaaaaccatcattgtttttacaaactgtttaggtactacacaccatgcttatcagttagggaatgacgagatccctttcagaaatccaagttcccagacaccagccactggtcaactttgcaaaaagatcattctaatcacagcagtctcaggtctgttatgttaaccctttctctatgctttcctacaaaatgttttgtgacatgtcagctgcattttaggcacccaaagacttatacaataaataggtgaactaattaatcaaccagtgatgttttcagttagaattccttaaatgtctctattgacacgtttgttcctaaggactcttacacctacaaagaggaaaatgttccacataataaagcataactacagttttataatagaggaaaattttagttaatcaaattgtaccagcattaacctgcatttccagaaaagtcttcaaacaactcaagatccaatgggaggaactcattttcagtgaaaagaaaatgatgtatggtaatattctggtcgatgtaactttcaaatgcaaccactaagagaaagaggaatttaaatttcttgaatctaagactccatgaataaccattttctgtcaaggagccaatattatttttaaaaataaaatcactcaatggttacatttttttttttttttttgagacggagtctcgctctgtagcccaagctggagtgcagtggcgtgatctccgctcactgcaagctccgcctccagggttcacgccattctcctgcctcagcctccagagtagctgggactacaggcgcccgccaccacgcccggctaattttttgtatttttagtagacacggggttttactgtgttagccaggttggtctcgatctcctgacctcgtgatccacccgcccccgcctcccaaagtgctggaattacaaggcgtgagccaccgcgcccgaccactcaatggttacattcttatttgagatatggagttgtctagagcccttcactcaagacgatctgctttagattaataggatgctttgagaaaataaacttcatgttacttttgagaaaatatgatgcacattaattttatgataattaatgttgaaacacctcccataaccacacatccctcttttatacacgggataaaattgttagtttagattttattacttaattattgtctggtcatcaccccttatcccctcctgaatatttaatgagaccaaggtccgtgctcttttttaattcacatttgtctctccaggaccttgcataggatgtagtaaagagtatttaacaagaatctgttaaaatgatttttttgaaaaagctcagagagataactgtccataccccatgtgtccccacggtatattcgatctttattttgaaggcaaacactatattttaaaaatcaaaatctaataaagataaagcaccatccctttacaggattgatttctttgattgtaaagtgtgcgaaaaaagggtttccggtgcactctgacaccattcataaaatcctaaccaggacctggtaaggccttagtttgtcaacactgtaccagaaatctctaatataaacaggctcatattataatcttctgcatttgtaatttttgagaacagggtggaaaagcactcatttaagtggaggatttttcttttaaatgctgtacttgagaatgtatcattattccagatgagacagataagacgcgttgctcccttgccctggcagtggatttgtttgtatattatgctttctaactctctttctttgctgagctagctattttatgtttctttgtgaatgactgtaccttaagggaactatattctgtatccattattttataaaggtgagtgggctcagtaaatgcctgaaaaagtaccttgactaagatcacagagttaacataataaacctgatagtgctgtaggaagaaagacctagttaggtgtggagtaaaacttagccttataattcccaggccaaagtgtttccaccatcaccaaatcagcgtcagtaactaatcaaataacaatttatttaagccattaaaaaatgtaatgctttcactgcaatgtgaacatatatttaaacatgatgacgatttgtaaaaacaaagatttttagaactaagaagaaatatatattacaaagtagttagtattaaataaactgtttcctggatcctgaatgatgataaaagtttaccccattaacactagggagcatattcaaagaatccaaaattctagcaattctttggtttagtagaagccacaagaagataatttatatctgaaattctgtaatattacagcatcccagttccttttgtgaaacccagagttccatttactcattcgaatggctatacttttttagaatctcttcaaatttgttccatacatactttttagatatgaactaaaattaggcagagtaatatagttttctcctcaatatggaattgaaaaaagaaatactccagttacattttccagctgagtactttggcttattattggatttgattttacctttaacagtgatacaaaggcaaatgcaattgacaaagttaaatatgtggtagcagagtttgaagtttaaaaccctacgtgcttgcttgcttgcttggttttgcttttgttttcttgagcaattgttgactactcagcctgctctgtaaagttaagagcatagactctggagtatcagatgtagattagaattctatttttgccactacctatatttatgaattaaaacttttttttaacttccctgatctcagttttctcatactttaaaagaaatttatgtgtagacaaggaggggtcttactactctcattagcaataaataatattattacttcattgtcaagtttcctactacctaggtacatgaagcgcccttgctctgtctctctttctctctttctctcctctctttcttccagtttcctttatttaacagcaagttaaaaatgcagttggagaaatcaatttattattctcaaacaatttattttacatttataaaaccgtagagatggcttatattgtttatgtgacattgtttatccacaggataaaagaaaaagagttaaacagtaaataattaaaattgttagtttatccacaggataaaagaaaaagagttaaacagtaaataattaactcccacagctatagtcattcctctttaaaaactctagtcaactaaccaaaggaaacacctttttggtgaatacaggtaagttagggcaaagttttggtagtgaaattgtaaagaatcgattactactgtgatgaatcaaatcataaagaatttaacttcactgtactatacaatctattttcaagttgaaagttagttaaaaatgtttcactttattttctttgaagacaataagttggaggcaattcaaacattttattatgaattatcaactaagtttatttaaataatgaatttatctttatgcttaatgcaaattgcatatacattgtattcaaaataaaatgcaaataccaaagaaaaattgttttctaaaataatgttacaagtttatatttgtttcacagtaaattatttttaaatttttgtcagtttacaaacaaaagattgcttaacaattgcaagcagcaaatttaccaatatataaaattcaaaatgttcttccaaacacaaatataattaagcagcaataaaagcttagtatatgaactttattaatagtggttatatctagtttgtagttgccaagaagtaccagctttacatgcactggcaacagtaataaacaatttatggctttctaataaacagatacgtgttaaaagcacatttaaaagaaataccagaagagtttataacatttagcgagcatatggtctctataaagtagtaaattaagtactttataaaactgttagtattaatactatattacaatattttatatttgtgctgcatagttttcaaagtatcatttagaaggattctaatatttttagaacttatttattcttcccaactttgccagataagatttatctctactatgttgaagaattaaaactgagactcaagatggttaaaattttgactgacgtatttcaccacttggtaggagggccaggactcataattaggtttgtgtaattctaagtcaatgattgttccagtttatcttgctgttgctcaaacaggtgtgcttttaaatttgcttataaaatatgcacaaacagatggcacctgctaaatacataactggcaataatatcttgatattttcaaatactcaagagtaatctagcacaaagagctcagaaatttgcaacacaatatattgcacccagaaaaaacccttaaaaccgtctagttcaatcatctatgttagagaaaaattggacaaatagaattaaatgtctagccaatttactatctagaaaatttcaaagttcagactcaaaaatcacttctttgaatccatttctagagctttctgtgttacatcaagaaaacagatttttttccaaatgtttatgtttctttgtccaatctaaaggatgaaagatactaattctctgtaatacataagaagaaaagagaattagacagtatctttatcaagtcccatcagattagcaacaaatttacaaaagtgatgttataaaactttttgactaaaaggctttcccaatattataaaaagggtatcacattatactgccatttaatgctattaagaaaacattacctactacaaataaatcttaccgtcatgtttctcaatctattataattaataaaatattaggaaaagacttgttttattgtgaaaatgttattcaatatattttattccagataaatggatattaaaggatatttatagtactttcaatttgttctgaaagctacatctgtattatcaggaatatgtataagcactaaacattgttgcagaatttgtctaaggctaacaccattttcaacaccatgaagaataaaacaggccgggcgcggtggctcacgcctgtaatcccagcactttgggaggccgaggcggacagatcatgaagtcaggagatggagaccatcctggctaacatggtgaaaccccgtctctactaaaaattacaaaaaattagccgggcgtggtggcgggcgcctgtagtcccagctactctggaggctgaggcaggagaatggcgtgaacccgggaggcagagcttgcagtgagctgagatcacgccactgcactccagcctgggtgacagaacgagactccgtctcaaaaaaaaaaaaaaacaaaaaacaaaaaacaaaaaacaaacaaacaaacaaacaaaaaaaaacaataaaacaattttcctatatgtcagaaaaaacttctttacagcttttatgaagtgtataaatccctgcatgaatatattcaactcagtgactctattacattctttgatgtccctcatgtttctaaaaaaaatgatgccgagtgtatctttaggatttgaaagcaatgaaagtatataaagccaactgacaggacctcacttatttcctgctggtttatcagccgtcaggaaggatttgcactcaaactcttccacctttccccccttgttatcaatggcatacatggagccacaggaagagtaacgcatagtgtggccatctaaaacagggtaaaattcagacagtcttatagaaataaagtcacaaatgaggttcgaaaataattaccaacagacacaaaagaagaatctttaaaactccatgatctaaatatatattgacaatataattctatgccaatgagtagttttgaattcagcaccatatactgactgcctatttatcacatactaaagatacaaataagtaaggagttacccacatataaatattccatcaatgtttgcacatccatggtatatattataaagatacatctagcaccagaggatgttgggtgctatggaataagaaaatagagacgtgatttttttttttattttcgagacagggtctctgtcacccaggctggggggcagtggcctgatctctgctcaccgaaacctctgcctcccaggttcaagtgattctggtgcctcagcctcctgagcagctggaattacaggcgcatacaccatgcccagctaactttttgtatttttagcagagacggggtttcaccatgctgcccaggctggtctcgaactcctgacctcaagctatctgtccacctcggcctctaaagggctgggattacaggcgtgagccaccaggtccggcagaggcatgaattaaaaacaaacaaacaaacaaaaaaaaaaacttaaattacattctcaccccatcaacttatttgatcttaccaagtcatttcatctctatcttccattttttaaccacagtgtaaaaacatttgacttttcttcccactatattgttgtaagtataaaatgccacaatatatgtgaaaatggtctgaaaatcctaaagcacttctatattgctctatatacactagagcaagaagaggttaaatggtttcccctggtagcaccttcctgagcacagaaaggtgacctcggcaccagggtgtactggctcacttccctaaatctggaatgtaatctgaagagtattacccaaatcctttttctattgttttttttttgttgttgtttttttgtttgtttgtgtttttttttttttttttgagactgaatctcgctctgttgcccaggctggagtgcagtggcgccgccaccacggccggctgattttttttttttattattattattttttatttttagtagagacagggtttcaccgtgttagccaggatggtctcgatctcctgacctcgtgatccacccgtctcatcctcccaaagtgctgggattacaggcgtgagccaccgcgcccggctccccaaatctttactgccaagaaaagtgacaggtttagtaatttcatagtggtttggataatttggctttcaaatttcctttagattagttcctttagattataacattgctaacactataaaactctagtttgagtgaaattcttgtggattcagatactgcaatcaacgaacattgagccaaggatgaattggtgctattcctggtcaattctctttggcaaataaagatagactcgttccatgattgaaagctacataaaaaatatctaatatcactacatatcaaatataatttaaaatataaaatcaaaattaagtccttattaagccttggtagattaagaaaatacaccattaatatgccgacacacatctaattattaaattaaggaaaatttttgtatcaatttttgattggtaatacagaaataaattttcactacaaagaaattttgaataagtattgacactgatataaagtacatcatttaattattatcattattttttcaaattttagttatatttagaagattagattaccttagattccaattcaaagactatatcccatatgattatttcagcttttttcagaatgcattatttaaaaaacaaaacgtttatggacataaccaattataatgtgctgctgctcacaaaacaattgattataaacatgccagaaaaaatgacacaagtcgcatatgtgttctttccagattcaagctattatcttctaaatattctaagtagatagtagattaagataatttatttgccatgtttttcacacttagagtttttctttcttttttttttttttttttttttttgggagacagactcactctgtcacccaggctgaagtgcaatggcacgatcttggctcactgcaacctctgtctcttaggttcaagcgattctcctgcctcagcctcccagtcccttgccatcacacctggcttattttgtattttcagtagagacagggttttgccatgttggccaggctggtctcgaactcctgacttcaggtgatgcacctgcctcggcctcccaaaatgctgggattacagccttcagccactgcacccagccaggtttccctttatgcagaaagcagcttgcaggcaatgctaatattggtttaattttcttaggaggaacccagtatagtacgggaaataattaatataatttgttcttaaaaatatagcttagtattgtattaatttttctagagactgagccaaatcaagtttattccaactaaaatactgcaaacatttacttaagctaatatgtcttattcttaaaatgcttaagggtgcagctctagaattatatttcttagtcacaccttactgcaaattatattaattggagaataaatttatttataatcctagacacgttttaggaagagaatttgaatggaataaacagggaagagaaagatacatcttcttatgataaaataaagatactagagatctttatgacacaatagtaaacatatatatgaattatgaattaatctaatcatgctcatacataaagatctaactgtgtatttttcattttaaatcagttaaattagttacataatctactgtataagattaataaaaatgaactaaaaatatctgttggctcatcagaataatgcagcacttttttcattgggttattaaggataatatttataataataagtgcatacaaagttcttattacagtgcgtagagcacaatggatgctaactggatgttactttctctctctctatcgtgtaaacaccatgagacaaggcgcggtagctcatacctgtaatcccagcactttggcagcgggtggatcacctgaggtcaggagttcaagaccagcctgaccaatatggtgaaacccccgtctctactaaaaacacacacacacacacacacacacacacacacacacacacaaaattagctgggcatggtggcaggtgcctgtaatcccagctactcaggaggctgaggcaggagaatagtttgagcccgggaggcagagtttgcagtgagccgagatcacgccattgcactccagcctgggtgacagagacagactctgtctcaaaaaaataaaaaagtaaaaaataaaaacaaaaaatagtaaataccatgagtgcaaaaagaaaagctatcttattactgacgtgtccctatcctttatatagtgtccattacgtaataagagcccatcagtcatttttttcaatatgtaaatacggagaaatatcttgactacagtgcaggactccatgtttgtttggctctctgctcaaattagacttttcttccatcaatatagaataagccatgcatagacatagtttctattaaaaatctgtaccctaatgagtagaatgggctcacacagatcttggaaaaatacatttagtaggcttggtgaaactgtaatggctttgtacagaactccactgcaacccacctgacaaactaggatatgctaaacaaaccagtcatttatgtgagcgtgtgtatgtgtatgtgtctttctgtctgtctgtctgtatgtatgtgaaagagagagagagagagagagagaaactatggatacttcctttataaattctggctttgccttgccttagaacaggacaacagacttcacaatttttctacatatatgcaaataaattctcggcactttaactgtctttgagttacactttgatacatccacagtgcaatttatgtcaataaaaatgaaattcctaagtaggagggagctgtgtcttaacgtgattagtatttggacttcctattattgtatttgaagacagaggatgcttggctttatgaagcaagctcccaattggattaccatatgtctcaaaaaacatgatagtaaatgtcttttgatagcatgagatataaaggagaaatataaaaatttgctttatgaatgttctgcttccagccggggtatattcagttgtagttaagatagttgtgttctattagctggggacaatttgtaactgtccttattagaaacatacatgtgtatgccaaactgctaagaaatgagaaatttctgtctatatcacctgtttttggcttgctcagaattctaccttttttttttttttttttttttttgagacggagtttcgctctgtcgcccaggctggagcgcagtggcgcgatctcgactcactgcaagctccgcctcccgggttcacgccattctcctgcctcagcctcccgagtagctgggactacaggcgcgcgccaccatgcccggctaatttttgtatttttagtagagacggggtttcaccgtgtcagccaggatggtctcgatctcctgacctcgtgatccgcccgtctcggcctcccaaagtgctgggattacaggcgtgagccaccgcgcccggccaattctaccttcttaaaaattggctttcctttagaaaactacttcatttgccttctttatggtagtcacagtgctatgcccaccaacaatgacaagtaagagacctaaataagaccaattagattattccttaaagttttatttatgccgagagagagacagagagagagagaagggctcctttccttagtaattgcaattatgaatttaggttgagttgtcagcagccttaatatatagctgcatggacaaatattgactgagagttaaagccaaacatcatgggatgcaagcaaaaggcatcaaaagaaacagattcctcaggaggtcttattgggtctctgaatacagccatgcctgaaaaactcactgtaagacccttcattgctttatattatttgagctgcttttctttcccttgtaatcaaaggaccactgacaaatactggctaagtagaatattaataagaatatacacgaaaaagaaaaacatgaatatgcttttggtataaatttacctaaaatattttaacatgcaaattagataccatgtagtttgttaactttaatagttcctcaaattaaaatgttttagtatgtaaatacagatggtttccaactttaaatggttcgacttataattttttatttgattgtgatgtgaaagccatactaattcagtagaaatgtttcatcaaattttgaattgtgatattttccaggctattaatgtatggtaaaatactctctcatgatgctaggctgcagaccccagccagccacaagatcatgagtgtaaataagtgatactctacagtgtattgtgttgctgacgctttttggatattgtcttttcacatcccatcatgtttacaaaatggcatttttgacttacagtgttgtaaatgtatgatgtgtttatcaggccacaactccatcataaatcgagcagcctctatatacacaatatgtatataattttgagtatctcttcatattaatgtaaagttttattttacacttcatttgtggctacttttttcctttaaataaaggcaatgaaaccagatcaatgagagtacttgaattaattctagttgtagaaaagcttggatgatacccttacaaaggaaacccaaataaaaacctaaccaattgaacttttgggttgtgtttggaactatctcttttcaatgaattaacatgtgttatgtgtttatgatgacaaatattagactatattctttaaggcttatcatcagcaaagactttccgggttataggacttctctttatgatttcatctttccaatttttctgacttatgcctgtattttcttttatctttgcctcctataggtctggcttcttctgtcctctcatttcctggtctcctactgactcgcctcttatctctatggcatgtgaccttgggcatgtctttcagtgcctgtcattcttcttatacttcacttcctgtctctgccttccctccccctccatcttactacttctcagcatccttatatacaggtgaaataaaatcacttaaaattatcaattagatttctagtaggaaattgaaaagtactatcatcattttctttataataaagaatgtgacatgatatttaaagaaaattatttttagaagtgttcaattccacttgaacactaccgggcaaacacctaaattttcctttgttcaggttgcaaaatgtgagcatttcctaaatttgctgtgaaccctcaggaataaagcaaaaaacaattttcaaaataaaaatgaacaatttaatagatttaaatatgaatgtttcctaaaaaggatatattaataaagttctgtactaatatatataaatcctaaataaatttccatttcaatacttccttttgatatttctgtcttctctctcttgatatagaaacaacctgcatgtatgcagttcagttccttaggcatatatgattcattcatcttaatttagaaaatatcaaggccatgcctgggagcagaattggggcattatttgtctttcggcagcgtatttttaaaattgttatgaataagtaaattgacaaaatcctttctaagatgtacagacattttcaatcaataatgcacactatcaggacataaaatcttccctaactttttgagaaatctttacgttttctttagggaatagattcacacttaggttttatcacctatcctacactgacgtttgggggctgaactttttgaggtaatgggtgcctctgtacagctgcaacccagaatgattctttcactactatgccctgagcaaaaacagtcttgggttacaggagtgaattagtgccttctcctgtttcctgcaccctttatttcatgaccttatcccatgtatagggcgagtaagagtagtcagttcatactgatctcagcagatagcgatataaacagatacttggctcatagggcataacttacatttactaagaaaatgctcaaaaccattcattgaagtttttctatacagactttcaggaattttaatgagtacttgcttataaaatgttgacaaccttaatcataaagtggtaaaaactaatatgcaatgtatcaagggaacaatacctccaactgttttcccagaatatactttacaaattaccaaagcagataactgaccacatttcctttttaatttacctcactagttctttgaagttctattcaccattagctctttgaataactgttttaaaacagatgggatgaacatctggataacacaacatatatattttttttatcaattgcctcactgatgtgaggaacatctcctcccacacacaccaccctgtgcctcatctaatgtgttaacactttggataatgagaacaacagaagtggatactaaatatcttattcaaattaactcaaatctgagtgcaaatgtggaagtatccatgcaattcacgaactgctgccccagactgtgtttttaacagcagtgtttgatgatgttggcactcttgatcattttctgtttttgaagttactgagttcaatgatccatcctttgtgtttatttatcaggactgtgaacatcacaaacaatttgagatgtttagaattaaatgttgattttagctggcagaaaaaatgcaaagttaggtaaattgatgagcatcattttcatgtatatattatctctttgttaacagttatctttcccagacataatggaaatggctgaggagtatgggtaaactgaagtatctgagttcaaatttatgcatgttaagatagaataataaacatgctactcttctgtgcagaaattcaatgccaaactaattcatgaaatactgtacaatactatacaatacaatatagttcaactatattggctcgaatcaatataactggtagtttaagtcactggtagttcaaagaaagaccaactagattctgagcctcaaacagcattattagggacttgcctgcctctttgtctggcttcctctacgatggcttacttttcaggctgggtttcttaataatgttggtaaatatgatcacaacaagctctaaaattctacactccttgcctttctgcctgaatcttgcccccccaaaaataatttatttcaggcacttccagtccaaattttaaaactgatactaattttgtgtagtttgggtcatgtttatgacctactaattagtcacagttgccaagaaaccgaatgacctaggtaatatgctcaactctgaagctaggctatcaggttttgaaaccaatggattaagaacaggtaagtagctgggcgcagtggttcatgcctgtaattccagaacttgcgggggccaagacaggtggatcacttgaggtcaggagtttgagacccgcctggccaacatgggggaaaccctgtctctacccaaaatacaaaaattagcctggcgtggtgatacacatttgtaatccaagctactcgggaggctgagacaggaaaatcgcttgaacctgggaggtggaggttgcagtgagccgagatcatgccactgcactccagcctgggcaacatagcgagactctgtctcaaaaacaaaacaaaacaaaacaaaacaaaacaaaacaaaacaaaacaaaacagttaaggggtaattctccaaaggaaaactatcattattttatcaaactaatgaaggaagcatgctggtcagtcaaaccaacctgtgtctataatcaaagtgcaagctttgcagaggagcttttaatacataactgaaatattattcataagtaattggagtattctggggaatagatattagtaaaagttaaggaaatagaatgacaacaagtgataacaacatatatatatgtatatgtatctcctaacattagtctaaacatagagtccataccactgacagcaggcactggacatggttagaggaccattctccttaccataaagtgagaactcagatatactctccaactaatttaaccttgaatcacattttacctatgtatgagctatagcataatgtcagagcatattaatcataaccatatagcaagaatattacagattaaaattgtcatagcttatttttcttgtcttataagaaatgctaattagggtgaaattcatgttataaaagtatttacatataaatacttcaagaaaaaatttgctggagatattagcagaacatgtcgtacttaaaaaaatgcaagaatttggtctaggctgggttgaatatgtttaggaaaacacagtcttttgaagaaaaagtagattgcaatatctcaaataataactagtgacaatgaagaaaataaagtgttcttatgaacataagagttgatatttgtaacttttatggcatagctgatgaatcattcagtaaaaccaaatgaaacaaataccttcaatctctcaaatcaaacaccatactattgagattttagctataactttatgtttgtcttgtttgaaaaaatacttcaaaaccccaaaatattttttgttaaaccatcttacatggttaaaacattccttttagagtaaacacttatgaaattcttaagcattgtaacttcatcattctaaaggattaaaatgtttattttaaattgaacatttatgaaatgcttaagcattttagctagccttttttaaagtgcaatcataaaaacaatggttttataatgaaagaaatatttcataattgcattcatacatttgaactgtttatacatgtggcaataaaatgaaatacaattgtgaaacacatattttatataaagtatagttgccaatgtttttgttttcttgaaataatctttttattctttttcgcttttaaagcataagtttgtgtcacaatttaaattcattctagaaacttgcagttaatccctgattacttgtcatgattagatattcagctaaggtatacatcacagaccatctgtgagaggacactatttcatttgtcttctgggtaatagggaggctcattttgaggatgaacccaccctgctcttttgtgaaagcaggagagtgccaggtggttggtagagataaacacaaagggtaataccggggaaaaagaaacgcagggctttcccagcaaacctttacaatattggtgcactacaacaggtggaaaacagtgagatgtcatatatgtgtgcaaagccagaacacatttcacaatttgtagctcagattccatgagacactaagaatacagatgttaggaagtttcaaatttcaataagggtagaatgtaataccaccttgaaaataccctttctcaactgcatgtacttatattgctaactggagaaaataactctggagagtaatcatggaactgtgtggagtttatttggttaatgggaccaaacatacagttaggtagaagaaataagttctagagttcaatagcacactctaaggtgactagttactaattcattgtatatgtcaatatagctaaaagagaatatttgaaatgttcccaaaacaaataaataataaatctttgtggtgatggacaacctaaatatggtgaattgatttttacgtgtggtatgcatgtatcaaaatatcacatttactttttatggatacataagagttgtactatataaatatatatatatatagtatataaatatactatataaatatgtacaactcttatgtatccattaaatgtaaatacatgaatagattaacaaatagaacaagaaaaaatgattagtacagaatatttagcctttttctaagtttcatgagaaatctgcagatttcctagggaaacttatgatagcctattaacatgcaaatataacgtattagatctaatttttaaaagtaaaaagggatttttttaatcgactcgaagaagaaaaagatcttttaccatggttttcttgtcctgggctcaacatgtaatgatgaaagcaaactagaatagaaagtaaggcaaagaaaaataaatatatatttttttcagtggtctctaaatgtcttataaactttgttatgtctcttgtctagctttattccaggcacaaactgatcaaaaattggttcactgaatgagcttgccatatcagatatagaaattttgagatttgctaattcaaagtacaagaacacagtaaatagtaagagaatacatgagcctgtgagtatattaaattcactggcatgttttttcatctatttccctttagaatctattacaaaacctagagaaatgtgactcctatgaaccactgttatgcaaaggtgtgccagattcattgtgtttagggtagaaaatatagctgggagtaagaaaataaaaaataaagattttaattccaagaatgccccaaactaagtaaatgatgtattaccaaatttttattgctgcataaaatacctctttgtgacaacccagtttacaggcaatttcagtgttgactattagagaactattaagctgagaaggtcatgtagcatagggtaaacctcatgacctcatctgttagaacatgtgttgatacgatagaccaaggaaaaaatatgctctgagtaagaggtaagcatgcaggatcaattcaaaatggtcccagatgaagatgccttctgagtatatgtcagggaagtgaagacaatgaatagttccatgcaagcaattcaagtgagaaagggcaatgcgtaaggcaaaataaatgagataagaagcaactgttgccctcaaagagcctggtaagaggaagaatttttgtaagtcttgcttatttttcattagaaaaaaaatttagaggcaaatctttttatttaggcatattataaaaatatttctgtatcctaactatgaatgagaaaataagcataaactcaaattataaaaagatccaacaggcaaaaagctatgacatacaacatttgtttgaggttgatacttgaaaagaaattacccacaagttgtggagaaaataaatagaaatctgtttttctccactgctttaagaatctatactaatttcaactctcttagacaaaatttcacataggccacgtgcataaatatttttatgttgccattataccttatatggcaagtaattcctgtatccatactaactttactctgttgagctaaatacctttttagcaaaaaatagaatgtatcaaaatcgtaaatgctgacatttattgggaaaatggaataaattacatgcgctataattctcaaacctgtttagtgcaaaatatcttaaaagatgaaaaaagttcagagagagcaatcacaaatggatagaaaggaaaattcaaaatgatgtcaagaaaaaactggaatattagctccaggagagcaaaaacttttgtcttttattttttaaactactctcaccctggtacccagaattttgtttggacatagtaagcactcaatagatttagtgaatgagtaaacacattttaaaacatcaaaagtattacctgtattacagtgaaaaatacctaatgaccttctacaatgtgccattctttatgcaaagtactttatatataacagcctgtataatcactgttaaaaccacagagaaagataatcatttattgatgagaaattagaagttcagatctattaagaaagtcatccaaagccatgctgacttcaaagtacagactctttactttaggacatggcataacctccagagggtaatgatattgagaaagctttgccattggaaacacaatttcatagacaagaagagaaggttatgttcacattacttttcatgcttcacatggcaataacattctgatctttaatgttaggatttataactttacactaaatactccatgatctgttgtctaaatggtaacaccaagaatcatcacttttcctctgtaataagatgtgcagtgtctttgtgtgaaatatagctatatacattgtatatcttctagttgagaaaattaatcatgcaatgtatctggaataagaaaaaaatacagcaacaataaaaataggacaataaaatgagtaatacgtttaaatttctattgccagaaaaattgttcaaaatagaacttatgaaagagaaatagtgtagcacaaaacaacagcagaggagaaatgatgaaaacaatgagagaaagagataaattagtgaaataaagttgaaaaaagtttcattttaacatcattgcattttgtgaaaaaattttacacttttacattaaagagtttaagcgtatactaaattgaatttcttacttgatgcttctgctttaaattatatcaacgcttaattaccatttaaagcttattattagttaatttatatatcattactaatgtcagcatcttgtcaggcataagagttaaatataaatttatattccccaggtgaatgcaattgatacaagaaaaaaaaaaaggagttcctttctctaaatgtatcacatagtgatacaactttttatacactacaaatagactgggtcagaagttaaaaaaagtagtttgtagggccaggcgtggtggctcacgcctgtaatctgagtactttgggaggctgaggcgggcggatcacaagatcaggagatagagaccatcctggctaacacggtgaaaccccatctctactaaaaatacaaaaaattagccaggcgcggtggcaggcgcctgtaagtcccagctactccagaggctgaggcaggagaatgacgtgaaccccggaggtggagcttgcagtgagccgagatagcaccactgcactccagcctgggcgacagagcgagactccatctcaaaaaaacaaaaaaaaaaatctatccactatacacctttttgtgttcttaatataatcttcccactgaatacacaatcatatttactaacgtctataaccataaatgctatattttaacattatagacttagtagggttgttacttaaacagaatacatgacaacatcttcatgttctctaatctgcagacaccttttcaggcttttgcaaaatacgtaactgtttggctcaaaatttattacgagttcaaaaatatttttaaatactgaatacaaacagagagtattgaaaagctattttaaatattcaagaggactggagaaaactcctccattaattttaatgatgaaattaaaactgaacctattaaaactaaacctattagtcatcaagaatgatgattaaatgaaagtatcaaacagaatctatgagtccatgctaataagtgtttagatcaattaataaatgagggagtagaggaaaagcctcccatttagaagaattccaattaaattacatagacagtccacactaaaggagggaaagcataaatccttacatcttaagtgtgccctggtgtaagaaacttctttcctaagagtacagtatgggaagggggaagaacagtgacatcacagttgagaaatccgacaagtcctatttcatccaggagatcaaggtcaaatttaatagtcataaattacattggtagtatgtaccattgatacaatgtgaggaaaataacaaattccctctgtaatatacctcccccaagcactagtcttatcaataggaaaagcaccaacaaatcccaacacatggtatgtattctacaatatctgactagcatgcctcaatactgtcaaggtcatcaaaaacaaagtccaagaaattgtcatagccatgagaagcccaaagagttaggacaactaaatgtaacatagtgtcctggtgccaccttggtatagatagaagacattacataaaaacttaggaaatatgaataaactatgaatttcagttaataataacgcatcaatatttattatctaattttaccaaatataccatgctaatggaaaaatgttactaataggtgaacctgtatgctggggtcatacggggattttctgtacaatctcctctatttttctgtaaatctaatttttttctattaaaatgtctattaataaaaataacttaaccaaagagtctaaatatgaatgtgattatatgcaggtctgaagggcataacagcatgagagcatagagagaatgcaaattacacagtccagaggatttgacaagaagtcttcttgctttgcaataagctgcttgggcacacttagataagtcatttaagcctcttttccctggtttgctatgaaatgaatgaacaggactacaagagttctgaggccccactgagctctgttgtccgttgatttacctacaaaatgatgtcaccctcagagagattacaatctacttgagaaagtaaacttgctaacattgaaacaaatcaaaacatatttaggaacatagttcaaggctgggatcatattctatgtagttcatattctcaggatttcagagaaactaagcagcattatgaaatacttaagaagtaagcgagacttaaggaccattttgaaaaattggaaaatatgaatgaagaagtgaaggacaccccatatcccaaataattggaatctgactcttacagcaaattctccttttgcttcagttttaggttctgaatggggtaaaatattccttcaaatccctctatgctttattatcacatatagcatgaaacccaagtgccttacatggtgtatcccaccttccttgacattgtccttgttagttttccaaacccatgtcatgccacttgtaaagtgatctgcattagcacagtcctgagctgtctttagtttcctgcacagactatagttttagtttgaaacctaaatagtgttctgtgccaggacaggactctgtctgggaaagaagtgtaaaacttttggacttggtttggaaatgctcgttcattttaattcctcagtttgttttgattatctgagcctgcagaaatgatgcacccaacatttctctcaatcattcaaatgatttaaaacagatgaaatttttgtatataatatatcagatttcagtgagttgttaacttctgtataggagccaacaggaattttaaaaatctgttgttaaacactaataataatcaaagttgcaagacacttcatgttgagaactacaaagacacagccatagataaagttaacagcgacctggtgtcactgctcactccagggtgtaagcttattgaatagaatggcaggcatgcttgacagcagagtacgcaatgcctttttttttttttttaaatctcccactctttttctattttatcaagcatacataattaaatttgttaagtgaaaggatgcttaaaacacttgcagggatgtttctcaggaacatcctgagatttttttttttttcaaaaattagtgactttaaagaaaccagcatcctttgcaaactcaccaaattagtgtgtgcgtcaccaagatagaccatattttcttatgggtgggatgctagcatgcaacctgggatcccaaaatgtgatatatttacaggaaacatcatcacaaaatgccatgagaaagcagactgtgtacagaatccattctgctaaaggtggcatcagagcatccatctttgggaagtagttgtgacaaagtttctagaatccagtgcctgagggtcagcagtccagctctggtgtctgtatccctcaacagtatttcttcctgcataagccagttagggtgaaatctgttctttgcaactcagagcactgatagacaatccttcttttcttctggtgatacgtttctctaattctttagcaaatacctttttgtctgtagttctcaatttttggttccctccttaactgaaagtaaaaactaatactctgttgtccagtattgtagtctaaacacatatgtatctatttacattaaattagttcaaattgaataaaattaaaaatttacttcttcagtcatcctgaacgcattttaacggcttaatagcaacatgagctaccagcaacaacatcaaacaatgcagatacagaaacatttccattactgaagaaagttctatcagaaagagctgctctaaggcatagaaaatttgactagggcatatgtttctgcatctacatcagagaatccccttttaatgagttaactgattctgttaatggtttcaaattatgaccttgataccatgacatattacattcatctttcactctattattcattttgattttgcaagtaagtttacaaatgatcagattagattcagagctcattttgttagaataacaaaaatttaatctcattactactcattcctaaacattgaagttttcctcccagttaccttctcatgaatgatattaaactccagagtaaaatctgaaggctgacactaacagagccatccttttcagaaagtacatccaactatgttaaagtgttcattttagttcaacgatacctgaaatgcaggctgtgaggtggacatttaggatatgtacctgcctagcatacatttcccatccttttactaagagtactccaatttttgaagtctcccctagtatacaaagtcttggtacttctgtcagtcaagttattttctcactctcccctggccttgtgcttgacttaggaaacaattaaccaattggattatgctgtagaaacttacaaggagggaaattaaatgaagttacttaatctcaacgaaattacccaaatatatgctcatgagttccccttcactagacccccagagctgcccttattttgtccttcctgagttttgattgttcaaaatttactttgcatatgtgtcctcctgcaagattttaatgataatttttagattttgcttttagaatagccagttggcttttgcaaaagtattagatgatatcaatgtgcccatatttttacctacttgggaactttttcaaattacatctgttcttgatattctgaaatgccacgcttacccctttcttatctgtcttggtagcctaccacactattgacacactcatcatgaaccagataggtactttgaattcatctgcctgagaataatttaaccttcatggtctatttctgccaaaatactgctttaatacccccaatatttgttaactctatttgaagttaaatttctatctgtttgtgctttgagagatgttggcaaagagaaaggaggaaaataaactattttagataggcctagccttgtcaaatgtgttggagactttatagaaatcatgttgtcaaagtgatcaatttaaagaaaaacatacttatgtcttcttattttctgtatcaggatgtaactgaatatcttttggttagacatttgatcatatgttattttcccaaaccatcatttcaaggttattatcataagacaaatcactctaaaatctaatagttcaagccagtcagaattgagtgatgaaaatatacagctttatttataagtacattttatcattaggcttgaattggttcagacgtcatgaaaaattttgcatgctagtagtaattcctcaaactccaaagggattagagtttaacaaaattgccaatccaaaaaaaacaccaagcaaacagacatttattttaataagtacaaattacacataattataaatattccttatactaatatttaaactcagcagacagaggacaggttgaggtttgatttatattcacacttccgtcttaaaattttcaaaagacatcttttatttgcttacacatgaagaatgatcagtatcactatctgaatataaattaataagtgaaagtatctgtatatgtaaattcaggcaaactcaggcttaaaaatctaccttattgtaccacattgcaaaatagaaaggattgtaattctttataagtattcggtggaattaagtgcaatgcaaaacatgctatgaatgtcagctgttatatggaaaacatctaccagaaaagccacccatgagtccactcagataataatttttcctcttgtctgttttataagctgttgaggaatatataaaagaaatggaaatttacaaatttcaaataaatgaaacatacatatttttatagctatataatattacatacatttaaatagttacttgtattttattggctcttcggctacattccaaaacttaagcaagttaatttaggaagagccattaaatgcacgttctcaggcatattttcctacttgtaatgttcatgttcaaacatatttttcaatatgtaaaagtaaagtctttgtaaaataaataatttaagacattccttgtattataactgcattcagaatgtataatacaattatggcttggaaaaatcaccttaaaattttgtcttatctttttgttgtgcagaagctccactcaaaagaagacatacatgcgtccaacaaacatatgaaaaaaagctcaacatcactgatcattagataaatgcaaatcaaaaccacaatgagataacatctcattccagtcggaatggctcttattaacgttcaaagaaacaacagatgctggtgaggttgtggaggaaagggaaagcttttacactgttggtgggagtgtaaattatttcaaccattgtggaagacagggtggcgattcctcagagacctagaggcagaaataccatttgactcagaaatcttgttactgggtatatacccaaaggaatataaatcattctactataaagacacatgcatgcatatgttaattgcagccatattcacaatagcaaagacattgaatcaacataaatgactatcaatgatagactggagaaggaaaatgtggtacataaataccatagaatactatgcagcataaaaaggaatgagatcatgacctttgaagggacgtggatggagctggaagccattatcctcagcaaactatcataggaacagaaaagcaagcatttaaagtgggagctgaattatgagaacacacggacacatggggaacaacacatactggggcctgtccaaggggtggggggcagggagaacatcaggaagaatagctaatggatgctaggcttaatacctaggtgatggtatgcatctctgcagcaaaccaccatggcacacatttacctatgtaacaaacctgcatatgctgcacatgtaccccgaacttaaaagctgaagacttttttttttcttagagggagaaactagatctaaatgagtcataaaatacaaatgaatacaaatgcttaattctcctaatacgtcatttttaataaattaaaactatgcttatcagttcatgtgggattgtctaaaaattataaatgaaagatttaaattctctaccttcacaaatcaggtacagctagcattgatgtcattgagatttggctgatggtacatcattagattctataattaatcaccaacacctgcagatgcattctcaacatgaaattacttttgatatcacatggagaaggagagatctcactaaatcttttaactatgagtactttggaggtaacagagatgattgtcatcttgtcacactgagacatgttgattctagcacttttggattcttccatgaatatgttaaaccattaccaataggtcaataacctgcccttttcacccctgactagaaacactattttaaaagagttcttattgatttttttctagctgtttttatttttctcactttctaaaataccaagaaaatatcattcaatgctgcaaaaataacctaaagaaaaaaaatctaggagcatcatacaataaaaatgaactgatttcttatgaagtcagcttcaaaactgtgtaaggcccaattcttatctctgacaatctgttacttaacatttgctgcttaacacttcataaaagtcaagtctagatgaactggcatacttcataggctttttttttttttttttttttttttttttttttttttttgagacggagtctcgctctgtctcccaggctggagtgcagtggcgcggtctcggctcactgcaagctccgcctcctgggttcacaccactctcctgcctcaacctcccgagtagctaggaccacaggcgcctgccaccacacccagctaattttttgtatttttagtagagacggggtttcaccgtgttagccaggatggtctcgatctcctgacctcgtgatctgtctgcctcggcctcccaaagtgctgcgattacaggcttgagccactgcgcccagccacttcatagtcttataaataatttactgtaatactcattaagggcagtaaaacaatcagcagttactacacactgacagattcaagtatagagtgaatgagatactatgtatctactatatcttgaaactaaaacataaataagtgtcacaaatttaaaatatacatttaaaaaagaatagacacacacacaagcacacatacatacaatcacatacacatccaaacacaggcgtattgttatacatgcatataaattaatattaaataaaacttatgttttaacaaactctgtatacttaaattcaccagtggttagttatcccaggcagtattacctactaagccttagggaccattattttcatttaaattccagtagtaggtaaaacctaaatgtcaaaacttagcacaatgtttaatgagtggataaatattagaaaccacgtctcctgaaatcttaggtaagtcattattaggggcttactactttcagtacctgacatttactcctttttttcatattagttttattttttattaaatgtcctcctgccttgaagataatctatttaataaagaagaaaaaaaagtgcttttttactttgaggtttacttgaacataagcatcacctttgtaattccacacaagcgtcacctttgtaatttgtcctttaagacaattagactgttttatatcaatgtattattaaacttgattgcacttatgcaggacatattataaaagaattatgagggaagtacacagatgctgttagagtctactaaaaaatagattatttactattggaaacccaaaggagagaatgcctcaaaaatgtggtaataaatacctgtgggaaaatcttaagttgaagaataatcctggacataattttatttactattgttattatatctttatcctaacgagattaatgactgatgttttcactgcaatttcagttaataggaactctatacaatgaaattgcttgatcaactgatagttttttagtttattgttttattgacacataatagttatacatgtttatggagtacatagtgatgtttagatacacacaacgtatagtaatcagatcagggtaattagcatatccattatctccaatatttatcatttatttgtgttgaaaacatttagtatcttctagctatttaaaaatagatattattgttaaccattgtcattctacagtgctataaaatattagaacttgatcattctatctagctgtaattttgtgttccttaacaaatatctcggccgggcgcggtggctcacgcttgtaatcccagtactctgggaggccgaggcgggcggatcacgaggtcaggagatcgagaccacgaggaaaccccgtctctactaaaaatacaaaaaattagctgggcgtggtggcgggcgcctgtagtcccagctactcggagaggctgaggcaggagaatggcgtgaacccgggaggcggagcttgcagtgagccgagatagcgccactgcactccagcctgggcgacagagcaagactccgtctcaaacaacaacaaacacataaaaaaaacaaatatctccacatccttcctttccctctaacctttccagcctgtagtaacctgttttgcattttacttctatgagatcaacttattttagcttctgcatatgagtaagaccatgcagtgtttaacttttggttcttatttcacttaacataatttcctccagttccatccatgttgctgcaaatgacagaacttcattttttatgtctgaatagtatttcatgtgtatatgtgtcatattttctttattcagtcatccactgatagacatttaggttgattccataccatgacaatcacgaatagtgctgcaataaacattggggtacagatttctcttcgatgtactgattaattttcctttggataaatggtcaatagtgagattactggtatgatcattttaatttaaggaggtattcatcaaactggttgataaaattaactagtcccagcttaagatatctgggatctagaagcactgtttatatactttgcatgagacacagttctaaccatacaattaaaaaaaaaaaagattccaagcagttcatacctgtagcctcagacttaagcttaccctctaattagttaaacattagggcaatgattttctgcctgtattttataaaatgtcttcatgctggtggtagagtgaatgtggaggaaaagaacatatttaagtggaggccattcatgatataagataccatggaaagcttgagttttcagtttaggctacagaaaatgcaaataaataaattaaacagttggtttaaaatattactacaagtaggattttcccctgaaggaaggcttggttttgtcatgttttatgctcggtttgttaggttttattgttggcttcatatgtctcttgctgatgggagtatgtgacgtcaccacacggcatagagaggaccaagaagctgtcccagtatcataacagaaggagactggaggcaatgtgagaaataaaaatgcagagttaagaggaggtttatacaaagaaagaactagggagtgcgaagaagagacataatttaaaagaaatgttttcttttattatggaaaaatatgctgtttatagtataatgtgaatcctcttctcattatttttactcaaacttcattaaaatatcaatttctggttgatgcgttgtgctttttaagagataccacgaaagaggacttaggtggttattctggaatatgggtatttacgatgagtaaggtgactattttcatgcaatcatttcagaatcagcactgtgagctgtcctgccttaagacaatcgttgcgcacatctatacaatactatctatttcactccaccaccataccaatcatcgagcgctggctgctcagcagggtgcggatgtgtacttgaccatagccatagtggttctcttgagatgcagacagtttctacactaaaaatgagttgacgtttaggagaaagaaagaacaatcttggtggtatccatttgaaaaagggaagcggaacttcaaggaaatattggcacaaaaactaagactgcttacaagaggattacctcatctgggttagaggaggatttcaaggatatgaggcgctctcatcacaataaagcagacattcccaacagtcacagaagcaggcaaatgaaagatgatgtaaacttatataagacttgagttgcttcatcttaagcatccatccaatttcagtacatgggttcttttgctgtttcaaagttctttttttttcttttagtactgtacatttccatataaactttcattcagagtttttacttttaaataatttctgtagctgccttttgtacttatttgaagaataattgaaaagaaaaaaattgagaaaattaaaacagatttctttttgccaaaagaaagtattggtaatttatagcaaagctggaaacgagggcctcttaagagttttccaaagtatgtcagctagtagcatggggttttagatcttttctttactgcaatcaatcctgctggaaatatgaagtcagttcagaagatcagtagagttgagctagcaaaagaataaaaatcctgaaaggagttattaattatgtgcatactgtgtgcagacagaatcagaagatactggccaagacattatgaaacaaggaagaattcacgagaaactttgaaattgccatatgcaagatgcaagttccctttacccaattttgcactcatcttctgatgctagaaaagcaaatgagaatgttgctaacacaaatgttatgtatttgcactgatcgagatgggtgagttcaacaagggaatccagtctcagtgtggattactgataaatgtccttgcttttgtgctagcctaaatttctagtgttgagagacacattttgtgtagattccctatttatattacattaactaagtatcttgaggatatgatgatttcagtaaatgtcattcacacaatccatcaatagtcccggggtggaggggcgttatcagctattgtttctctgaataagtattatcaaacattgcttttctgctatacagaagcactatggaatgaaaccacaaagtctgtagacaatgtttttgcacactgtaaaaattttataaagtcaggtttcatttaatttacacttttgtttctggttagtgtttttactataatttgggaataatgtacagtggtaaatcattgtgaagtaacactgcattctccttaaaattgggatgtattcaggcatattaattatttcaggattcattaaatataattctaaaagagtttctctttaaatatttatctactcttgactggtcgtattgaatctcacattcattactaaaataaatttaagaggccttgataattgcagaccaaatatatagttacaattgtcgctatttataaagaggttcaagaactctaacctataattcacattaagttgaggcatcaaagaaaaaaatacacaaaaaaggcatgttggcagtgatggtggtactaccaaaggtagagttgggtttcattcctttcctgttccagcctatctattgcttttaaataacttatgctgctcgtgtgtgaagggatttctccttttactcacatatttacaacctctaattcaggagagagattagagatagagaatctaatacccttttaagttgcaggactataaaaacaaaataggcctcactccacttttctaaggcaagattctaggaaaggataaatatattcatgagtcaaaatccactacaatgaaataagtaaccaagggtaaatatattcatgagtcaaaatccactacaatgaagtaagtaacctaggttactgaccagaactctgcattgaggataaagccaaattctttataacctcaactctgtcagagttggtagtaatcaggactaggattcagtaataagcacttttatttaatatatatatttatctgtctctctctctctatatatatatgtatatatatatatatacacacacatatgtgtatatatatatacactcatatatgtgtgtatatatatacacacatatatatgtatatatatacacacatatatgtgtgtatatatatatacacacacatatatatagcatttcttcccctttctgttcaatacagcacactgattctttcctactatgtgatgctccgggctggtatgtaaatcaagaggcctgccttccctagccaaaatgtgaacacagcagagagttagcagggtgtaaatgaatcctactgtcattcccaataatttgaactgtgagtacaatgacacaagaatgagaaaaataaatggacttcattcattcaattggtggtgctctatcaacattgtcgatttgtgcttcctacatagacccctgaggctttactgcagcatttttataaactagtctcattctcaaaccttctcaacatttgtgtgggctaatattctccagaaaagatccttttatgattaaattggccactattggtttatgttcatgcaactacagaatcataatttatagcacatggcaagcatataagaaatatttgcacttattcttataaacagcagtggtaaattctacattgtttagccctttggggtggtttgcttgaattctatatagaattacaaaatgttccgcagagaagttctcaaataattcttgctgtcattcatgtaagataagtaagacactacttcgtgtgaggtgccacacataagttctagggaatacttcatcacttttgagcaagccagcaagaaagcccttaccacaaggaggatatattttaagagaaagagaaatgtgagtcaatcagttttgatagcttatatgcaatggacagttatcagtctgagcttacattacatttactaacgtaaatacaaaaatctttgggacatggtgagagatgtcagcattagctagctgtgggtcagctgtttactgcaaaacctgcaaggcttgggaactgggagaactgtttgttctcaagaggagacgtgaaacccgaaatatctcccttgaggatgggattttttaatgtacaattctttatatttttcactaaaatctatgtaattttctttcacaatcaacataatctgacaaaaatgagctgttcctcataatattgagacattcttggaaacattttgaggaaggaaagcttaggaaaacactatcaagtttctggccaaagagtagggctccacacatcaggatttgaggtatgaataaaaatgaggcatttttacactcatcaggtgataaagcaattgtgtaaaaaaaaaaaaaaaaaagaaaattctagaatataaattatcttttaacgaatgagaacaaattactttggagatatttggtagcttccttaatcatagtagctttgaatgatatagatgcccgattgtcaacagagatcaaaactaaatcagaaacttaaaatggcccaataaaatgtaaagctccttagaaaaacagcattgctataaagtctcaaatacagtaatgtgggagaaaatgacacgcacagcctatggtaagggataagagctgcaatatggagaagtttatcttggattctattttattacctctacctaagccactttttaataaaaatcatcaacagttcacaccataaaacattttggacctagcccaagtgagaaaagtcaaatatatttatatatgttttttggctttttaagagattatttattttttattatactttaagttctggggtacatatgcaggacgtgcaggtttgttacataggtatacacttgctatggtggtttgctgcacccatcaacccatcatctacattaggtatttctcctaatgttatccctcccctagcccaccatcccccgacaggccctaagtcaaatatattttatatgagatccatagtactcacaaaatttaatacatctatgtagacattgtcaaatataggaagacacttaacatatttctttgaatatactgaccctttttatatattaatgcctgtgtatcaaagtacatttcatacacagtttatcttctcctgaaatgtgattataaaattgatactctacaactgatgaaaagctagtaattgaaatgaagtcattctaatgaagcaataacactaacatagttttccaataaatatactgtgaatgacttagcctatggaaaaaggttttgaataaaaattattattttctaaatatctgaactgtaagatattagttctctaaatctatcttttttcttttccctggatttgaatatcatagctcactaaacatctttacaatttgcttcctctaaacacattctttcttctggaaataaaatggtgctttgaaagaatattaccaataggaagacatatttcaaacacgaggttcctgctttcaattacctaacagctggtactatgcgtttacatttagaaagacaaaaccttacaaagatgtattatgctttttcaagtaatttagatttgtcacagtgcaagaaaaactcattggcaaataattcaaataggcttgtaagtctcagagataaggggctttaaaaaaagcaaaatacattctttaataagcaaagttatgagacagatctataaaatagaattgagaaatctttcaaagtattccatgcagaacagctgatttagtaacctactgtgaaaagaactattgatactccaatagcagcggtgatacagtgaaaaggtaaattttgaggatgcgatatgactgcttgatctagtagtacaatactgtgaacaagcagggactttgcagctagacgtatttaagttccagttctgactccataatttacactgctgtggttcacttaaaactctgtgagcctcagtttctatatctttaaaattaggctaataatgcctatgtaagtgttgtgaaatgctcagaaatataaactaaaatcaatgctattgttttcctgtcatctggcaaagagtattgctccaattttatgtgtcaagtaatgtaaaacgtaaaagtactaacctaccaaatctgttctttttctaattgattacagaagaatccattaactttagtggcaagaatgtctgttatctctcaattgttctctcccttcaggctgatttttttgctaatatctttggtgctgagataatccaaaagagaacccccatctcctttagtggcagagctggcacaagcttatacacgacctcagggacctaagaactagcccaccaagcttgctaccactggagtccccaacacatccagtggtagtactgccacacacaggagagctggccagcccaatatctttctctccagcaaggcctcaccacagtctctacaaacaactgtagtctatgctaccaagacactcacccataccactgatgttaattgaagtcagagaaatcacatggagactatactaatgtgcccaccagaacccaagccaaagcactctaccaaaccaacactctaggacacatctacaggaaaaaaagtcttttcctataaaagctactccataaaattggaagaagaaactattccaccagttgcacagatatcaatggagggatacaaaacaggtaaatgcaaggaaacgtgacactttcaaaggaacaaaataattttccagtaagagaacccatctctaaaaggaaatctatggaatgcttgaaaaagaataataataattaacaaagaaacagatacaagaaaacacagaaaaaatgtttaaataataagaaaaataatttatgatctgaatgagaaattcaacaaaaagataggtatcatgagaaaaaatcgagcagaaactctggaactggaaaattcagtgactgaaatgataaatactactgagggctttaaccataaagtaggaattttttacttgaagacatcttttgaaataacctcatcaaataaggagaaagaaacaaggaaagaaagaatgatgaaaaggaaaaaagaaagcaaagtaaacatagtaaagaaagcctgtgagacatatggaacatcattcagcaaataaatatttgcattatgaagtttctgatgaagataagaattcatagaaaacgtgcttaataaagtaagagctgaaaaattcccaagtcttcagagagatatggacttccagagtcagaaagattaaagatttcctagtagattcaacccagagggttttcttatcgatacttatagtaaaactatcaaaagtaaaagacaaagagaattatggatactggagtctccaaagtggggaggctgggaggggaataagagagacaaaaagccacatattgggtacaatcttcaccactcaagtgatgggtgcactataatctcagactttaccaattgtattaatctgttttcataatgctataaagaactgcccaagactgggcaatttacaaagaagagttttaattgactcagagttcagcctggctagggaggcatcaggaaacttacaatcatggcagaaggcaaaggggaaacaaggcacctttttcacacggcggcaggaaggagaagtgtcaagtgaagggagaagaacttattacaccatgaggtcctatgggaactcactcactatcatgagaacagcatgcaagaaattgcccccaggatttaattagctccacctagcctcttccttgatacatgagggttatagggattatgagggttacagttcaagattagatttggttgaggacacacggcctaaccatatctccactatacaatttatccatgtaatcaaagaccacttgtacacctaaagctactgaaattttaaaaaataaaaaaataaataaaaagatcttagaataataataataaaaaaaaaaaagcaagagaaaagtgttgtcacatgtaggggaatttttaccagactaagagcagatttcgcggtagaaatgtaacaagccaggaataatgggataatagattcaaagtgctgaaagaaaaaaataaaagttggtcaaaaatactatgtccagcaaagctactgtttagccatgaagaagaagtaaagtctttcctatatggacaaaaactaagagaatcaattcatcaccactagattggcctgaaaataaatgcttaagggagtccaacatctggaagcaaacagatgatatctaacatcatgaaatcatgcaaaagtagaattactgatggagaaaaatgtaatccaaggaaaattgtggtgctatgatcagaaggcaaaaataaatactgggaaaaaggcaatatatatttgtataactctgcataatcatataatatattactgctttttgttttgtttatatctttatacatgctggttttggtcttgaataatctgaagatgaatctatgtgaatgaattaatttttatatattttattttttctacctctgacttcacccagctcccaacccccatcgcatactgaacccattaatggcttcatttccatcatgtcagtcatcagtccttctctaagccccaagacatccctgaccaagacaggaagtgtgcctgcatttcagaacggaacacagagttcatctacccgatatgacccaaatatcagatcagaagaagatacagagcaggcaaaacacaaaaaggaaaggcagcataaagtcagttccattttataaaaatgcctttcttttttactcttcttggaaaataacttcttgttctcaaacttttggtgatcagaaaaaaaaaataactttatttttttctttctgatacataggagcctggagcctgcctcaacatttttttctcttattgttctacctagctgcatacctcagtattaatactagaataaaatgtattttgcttttctttcacaatcccctcctcctttcttaagcttcatattttagctctctaattaactcccaagtagggtaatacctaataagcattatgtatacaattcctgagagactatttaagaaacaacccatagagttatcccttgcatacctttgatgagtttcctggatccccttttgatctggattaattaatgttcctgagggagtgctgattttctagcattcttccacctttgatgcagaatctcaaaattcccttgtacaataactttgggtagcaacatgaacgcaaatggctgttcagatttcaagaccttctatactaattctttgtaaacttaggctgagacaagggggaaaaaagcatgtagcaccctggataaatcttaaattctgccatcagagctaagatttaccgtcatctgtttctgcagagacagacatttttttttaaaaggcatcctatgcttgactctaaatcctcacttatatcttcatcaccatctagagatggagcacctcagggaagttccagggattgccatcagcacccccttctctctgatacgttgttaaaggtttcctttctaataaataatttattgagttcctagagctatagactgaagtgtttattttggattctacattttttcattcaataaatgtattgagtgtccacacttatgatataatatgcacttatacttctccaggtaaagtaatataagaaattgtactgattggtgcaattactgaaagtgaaagtcccataatcaccgtcagttataattctgtgcttttagaatatatgacacaaaaccggcagcttgatgagagcatagcagtcatgcattcatctgtatatcaatgctaggataatatcatctgaggagtccatagttaaagtctcgaatgtagcttttgaatgaatcatatatgacatacataatcagcaagaacagacacatgattctactacttcactctattccaccagttaaagtttgagctcctaggagaagatctttcatatacaagacttttccaaaataacagataaaaacatagacacaatagtcccaaaaatattttcagagaattcaggcaagttatttttcaagtatccatgataatgctctgtttatagaagtcaaagacataaagtacagattattcacaagaaacagctgtcttgagaaacaaatctgatttattcatttaataaacatttgttggcaccatgcaggtcagtactgttgggaatatagtcataagaaagatacgtttttattaaagcagaattttaaatgaagggtatgctttgtggaataggattttatagatctttgaatttatgtcaatacaatgaaatgacaaaccgtagtttcttatcatttagtcttcaatatatgactttaggttttcttcttatcaatctgttcctgttactaagaaaacaatttatagtattttataataatgagaataaaatcaaatagggtatggcaggtcttcatattattattacaattgttcttttataacttgtatccattgcaattttctttgctaatttcctcaaaagttaactatgtaaagatattatatttctatataatatctctagatttgtttgttctaggttttacttgtctaacctagaagattatcctacaaagtccatggcctttaattatctaactttgaaggtatcatctttagatagaatgccaattttgattctaaaaaacttgatcttgctgtacatgtgaatcacataatgcagttaattggttcattaattatctataaaaatgtggaaaaagtcctaaatggttgacaaatatatgctaaaagcagggtataaatataggccaacatttaaaaggtttccaaaatattctacataaagataaaaaggaaaaaaaaacaatttttacaaaaatcatcttaatgtatgctttgtgacagttacacaaatatataaagtgtatgatacaatcctttatctaaaagcatttatttttcaagttttgaacttgactttttagaaaatatgtctaagtttttacatatcattatgtgatagtcaacaatagtgtcaaaattctaaacaatttgattcaatgtgagaggctactgcaatgtttctcacttcagttactcttaagtattctcttctgcaaggcaagttacactacctctatattatctaaaagtgactcttctccaggcatcaagagtgcagaacatgacaggatgagccagtatggacttttcaccttcccttcatggggcagaaaaacattcaggaaatcagagattttcagtttaatcatcagggcatgaacctcagggctcaaagctgctgagagccaacatacggattttgaggacagattcaactagcaaagccaatggagagatgcatcccaaattcatgtttgagccttaagttcagcgaagcttgtagcaagccagttatatatcactaggttttcaattagttagaacaataaatttatttatcttctcttttgaataaacttatttaggcagaaagagagtatccgagagagcgtgaataaacagcatgagaaaacttggaatatcttagcaacgcaatgacaccataagactggcagcactgtagagaaaacagagtaagaaagaagagaggcacaggaaggggagaaacaaaaaataggaagggtgaccatcaggtgaaaaataatgagaactttcaggaacatatgggaggaaggtttgactctaaagctattaaggggatagaattaacaggaaaaaatatagcatttgaaatacgagcagaaacaaacagggataaaacagggctgatatatgggtttcaagcttgtaatatgatattagatgttattagtagacgaaataagattataatgaagaaaaattagaggttaggaagcagggatggagaagagatcatgaacttagttttacaccttatgaatctgaaataatcatgggatatccaaatgaaagttccaagagacagttggttatgcaggtctgagctatggaataaaatttggagatgtcagagatacaattttagctgccatctatagacagaaattagttaagaatttaacggtagataaaataaatcagaagtaatatggaaggctggaggggaaaaaaataagaaagtatatctgagaacattaacgtgtgagatatacatagagtaagaagagcttgaaagtaaacctaaaatctgtcttcagtaataagatttaaaatgtaaataattataaacaaaaaataaacaaaaggtgaaagttatgctatgtaaaagtaggcagaggagagattctaagatgggggaaaagtcagcaatagcaagtaatgcagatgggtcaaatcttccattgagtttagcaagtcattggtgacaactggtatggggcatctcagaaaaatagtaaaggtggaagtaagattgcagtagagaaagtggaattgcattaataattcactcaatgggtcatcgagtttgaagttgaattcaaacttatgaatctaattctttatagaatcaaggtcctctagaaacttggtcatttcctatatgaaactttcaaagaagatatttatattccccatgagaataatactaactacatggaatatggggtcacattgaatgtctcaggaattgttgctgattttttttctatgagaaagcataagtacgtctaatatagtgaatggctcccaaaacattcatatttaaaattcatttgacaaccaatatataacataacatttataagaatgtctttggtatgaccaacaccaaagcaaatacaaaaacaaaaatccttaaagacatactatgtgtgaatgttataagttatccaaaaatcttgtttctattttgtcccttgttaaatttttaccctatgacttgctgagaagctgcaggagagagaatttcctgatgagttgtctaacagcttattctttcctcctgctatgtcctcaacatctatgttcaatattaaattgcactgcagcggagatgactgtgtgtgtgtgtatgtgtgtgtgtgctttaagcaaaagacagaggcttgagtgatttagtagctacaaatataaatcactgacaagcaattaacatatactttggttcaaaaccaaatatttccttagcaacaatcataatcactattttacagtgaaaattggcatatttatgatatgttgacattaagatattcagtaagcatattgatgtttaaattccatgtttaaatgcaactatttataaatcaatcatcccacaatcaccttttcttaattttgaagtgcaaatatgtgagtttaagattttagattgaccaaagtgcttatttgttttcttccacatagctcagtttaaaatttgtaaaaagtattaaaccacaggaaagaaaagtgataaaagcaaatatgtgattcagcaagtttcttaatgtttgaaagtaaatggaaggtcataattatttaaagcagaatacaaaaatatcacattgaaaatggcaaaattgggtgagtatggataacatacactatcaaattgactggagaaaatacgacaaacttaacaaataagggtagcatgaaaatcaagaaagattagtggtgtcagttaaaatattaaataaaagtataggtaaattagggggatccttccccaagttctgagcaattttcccataagacttctccttccccataactaagattttattttctgaagaaattgtcagagagccaccagacttttaagtcaaagaaagtaaggccaattctttgcttgagtacaggaatgtctacctgctgacaagctctgctcatacacagaagatttccaaagagcatctcagtgcccagccactagtgacagtgacaactatctattaaaaatccacacacacatttttacatatgtatatatttacatatatatatatacctatatatgtaaaaaatatatatatgtatttccctcatcttttagaacacaacaagagtatttatctcaacttcccaatagttaaacttggccttgtgactgagttctagacaaaggcaggtgagaagtcccatgtgccacatcccatcctatcttgatttatgaaaccttctttgcaggctgcttatttttttcccgcagaaagttgtctggggtaacaaatcctctgagcgagcttggaagccatgtgttgcagatcattcccctggccccaaggtcctgttgacttaaaatccacccacacagagatacatgaaaaataataaacactgaacaattacacgtgaagatatatatgtttccattgcctacatactcatctaataatttaatgtgaatggagaagcaggattaatcagcctctttgaataaaacctgaaaccctaaaaatggaaaataaaacagaataaaaaataaaaggtgggaatagggagaggaaataatagagaggtagctaaataaaactgctttaaaataaacatcctcacaaagataagaaaatataattttaaaaaagcaaatgacttagaggataagaatgagatcttgagagaaaaatattaagacccacaaacaaaaataacaataacaacaaaaatactcaaaatactcctagaccaattatctttcaatcctaacacagcacctgaactgcttttcatgtttactaataacctccatttttgaaaccagtaattatttatcagttcctgtctttttggaatcattaatggtatttgaaacaattgatccttataagggcccagagctcttcttttcttaaaataaaagaaatatgaggtagtactcagcaatcaagtagtccagataggtcaaatcttccattgaatttagcaagtcattggtgacaacaggtatggggcatctcagaaaaatagcaaaggtggaagcaagattgcagtagagagagtggaattgcattaataattcactcaatgggtcactgagtttgaagttgaattcaaactggagaatctaatcctttatagaatcacagtcccttagaaaccttgacctcttcttttcttaaaatttaaggtccacagaccttttcttttcttaaaatttatatccagcccaacttctcttctaagctctaaacttgcagggttatctaatttgtatgcattatactcatctcaaacgtaacatgtttaaaaatgagatcttaatttgcctttctaagctcatgctaatcttcccatctcagtgacaattttaaaaatcctgaagtcatccaatctctctctctacttcatatctcacatttaagccatcaatacattatggtgattctatctttaaaatgtattcagaatcaaaaccacttctgaccaccgcactgctaataccttaggctgagccaccatttctttgtgcctaaattattgcttgggctccttaatttctcatttctgctctcatctacctgttgactatttccacagagcagggagagtagcacctttacaatgtgcattaggaagacttctgatttcattaagaagcccctcttgttacaacacaaaagccctgtacacaacacaattaatgagcatagaatgaccctgagaagtagaaagaacaaggtgaactggctagagacctaagggccaacaacaacatggcagtgagccctctgggtttccttattctggcccataatctggggcagggctccaaaatggactggaatatagatgcaggtccaaaaagctccaagaaaaatatctttactctaaacaaaggaccagaaaaatggtggtctaaaaacagaaaaagttttgggaaatacttgcctactccagccaaataccaaggacaaaaattgcaccatctctaccccactagtgacttcagcaatgtcaagtagggagcagatttttcacaaatgacaaccttgcttctgagaaagcaggtagctgccactaaattcatctactcaaggagctgtgatgaatggttttgtgtgtcaacttgactgggcgataagatacccgaatacttggttaaacattattctgggtgtgcctgtaaaggtgtttctgaatgacattaacatttgaattggtaaactgagtaaagcagactgacaacccaagtgtggatgcgctttatctaaaccactgaagtcccgaacagaacaaaagttgctctccctacctgtcttcaagctgggacgtgagtcctttaccatcagacttgaactcagactggatcaataccatcagtattcctggatctccagcttgctgactgcagatctagggacttctcattctctgtgattacttgggacaatttcttgtctatctatctacagatagacagacaaataggtaacctatttgtcacctatctaatttcctattcattctgtatctccagagaaccctgacaaatacagtaatatagccaggttgagcactggcagggtgggatcttatatctcattcactaccagaaagaaggaaatgtactgagtcccccattcccaactcctacccatatcatgctgttagcagagtcctccacctggaccaccaggtgagctaggtgagcctctattcctacccagtaccaagctgacttaattaaggaggcaatatgaggatgatcttgtcaattgtaggctccactccactactccatgtcaccaccagcacccaatatcagtaggctcaggggaactgaaccttcatccccacctgggcatcaatgagattgaaactgtgttgcaagtctaggctagttagcactgcgctttatccccacccttggtgtcagggatattgagtagctgagcctccacacccattctgcagcaaaaaagtattgcaagtcaattctctattttcaatatctctggtggctctgggatacaggagggaagctgagattttatacacccacccagaggcaatgaggcagtataagtctgggtcttaaaactgctgaaaggaggactgccattctgaaaaatcatggaatttagtggccagcatttttgaagacttagaaaaatttatttttctaagtcaatttatctattgactatcatgatctgtggaatgtctcaaaaaaatttaaagatacaggttcagcaaagtaagctgaaaaaggcatgaattaatgatagaaaaataaaaaattagaaaagaatcacaatctatttttgcatattgtagtaaagtagccataatttatatatgtatatatatgcttatatatacatatatacacacatatatatacatatataaacatatatatacatatatatacacttgtgtatatatatgtaaaactgtgcttagaacttggggtaggataaaaaatgagctgatggtataaaataaccaaatgttaaatagcgtaataggaagaaaacaatatcttgaatcagtaaatcaaaagataacatcataatcatgttatttaaaaatatgtgaataaataaaataagaaacatcacaaaaaagggtttacaaagttgtataggaaaacttgactaaggggcaggaatgtgttcttttttttttcattatactcacaatttaatgttcttttttgaaaacaatgcacagctatttctttgattaaaataatcatgaattctaagaaactgctttgagatatatatatatttcctttaagatatatatttctttcctttaagatatatataagatatatatatatcttatatatatcttaaaggaaatataatctacatcaaaatggcaactatttactaaacatgcattttattacataaacacacagcaatgctctttgctttggcattttctcaattacacaatatcttccattcaagttaccatctcctaaaaagttatttgagaaaatcttatttctcacaatgaaaccttattatctgaagctcagctgaatattgttctatccttagccctaatttacaaatacaaaataataattaatataatgtatgctattgaaagctcagtatatcctgagtggaaatttttcaataaaccttataaatatgcctgaaatgtttgctgtcatttttttgaaaaatattagcacaccaatgcaactatagctaatgttccaaatggagtattttatttcatgcttaccgtatcagatggaatgtaaggttaacagactttcaacacctcttaaatgaagggcttcatgcacacacattcagaagtaaaattaatcagaggggcaaaatctgtacctacctggtagaggttaaatggatggcatatttaaaatcaccattcatagctcctggcacacagtagactctaaatattttttccttctatcatttataagataaattcaacaacacatcaaagaaagtaggaaaataaacattcaaaccaaactcttgcattcattcctagattgctttttttaaaacatagtcaaacagtagtaataacaaatttagtaaaaagttctgaattgtaaaattcaaaaattgtttaagttcaaatttttaacataaaattgaaaatcaaaatttgagtactttactttctggcaaatctctttatttatcataatctgccttatagctagggatagccttagtactttcatattatacattttcacttacaaaccatacacattctttatgatgatatttctcccatcttttcttgaaattcagaaaaagaagtatatgtgtgtctcatttaaaattctccacacttcttagttttatactttttttctaacttaatggtccacttttccttgtccttggtcgatcttcactcatcttactataaacattcacttactttttaaaaattcctaccgcctctctcttccaaaaccagtccttatattaagtaattaaataaaaatgaccaagtcaccaccaggacaaaataaatgtccattctcaaaactattacttcagttggccttaagaaagtaggatggacagtagggagatatcttttctagtaattctgcaaatcaataccaccattctctgcaaagcagacaggaggaaattgattgtttcattgcaatgtttcatattaaaaaaccaaaacatcatttcagcttttccatactctatggaaactaatattcagagcaaatatgtattctttcatcaaatatttattgagtacttaccaaattttggacactgagctagttagtggaattactaaaatacaacgtgcaaggccacaaatgaaatatgctttttcatttaattgagagcaagactatgagatagaaaataatacctgagttttccaggtgatgcaactatagcttatcaatattaaattactcactatattctgtgcagaataagggttgaaacaaggatttaacttgacctctgatgccttgacctctgatgacaatgcttttgctttcaagaattatacctaaataattatgttgatgtcaaggatgatgatgatgataagtatcaatctccatttactgaaatataccttggtttcaggtcctgtgcttgcatgctttatgtatgtgaattacatccttttatcaccctttacagagagaaaccaaggctcagagaagttaaacaacttgatccttgctggtaagggagtggaatagaattaaagctcaattccatctggttctgtattcttttctttaccatcaattctctatagcaacagttattgaaacttgaagacccatctcacagcctctctcttacatacacacatttaatttcattctccatgcttggatcacaggctctcttctctgtctttctacattatctatctatctatctatctatctatctatctatctatctatctatctatgtatctatgtatctatctatctatctatctatctatctatctatctatcatcatcatctaggtatctatatctatatatcaaccttcctattatctgtatgtatgcctgtctcagtctccctttctgtctctatctctcagactttctgtctctatatccctttccctatctctttacatttttttgtttcattttgattattatttgtctttctggcaatctgtctatttctgtctttcttgaccctgtgttttcccggcctgtctgtcactctgcttctacctttctgtctcaacctatctccacttctctctctttctgttcttttctaagtgtatatctcagtttctctttctgttccctttctctttttcttatatttgactgtctctaacttttattatgtttttccctgtgagtctctctcattttctttgtgtgactatccctgtatctctctttgagtttgtatctctgtgaatatctttctgtgacttatctgtgtctgtctctgtctctcggacagagatgtaagattctaaagtaataaaaacctctcatccagttttaatgacccttttctggattccagtgatgtgctgcaaagttgaagaaataagtcccttaaatgataaagcaaaaagaaaagtcactgtccttggataaacaatttgcatttccataaggattcagtgatgcagaatcagaaaaggctcattctgacacctccatgaaaacaacagggagagcattcattagctgggcttccttttgaatgatgcacttcattgcacacaccgctgtcctcccccggtcaggaaacagtgcttaattctatcggaagtttgccctttcactaggcatgagaatgaatgacttttcaaagtaataggaactacacatctgccatggcctgagaatgcttacactctaaaagccatacagaaagttacacctcctatcaatttcttatccatcaaggaacacaataaacaagctttgaacttttccatttaccaacttgaaggaaagaaatgcttcattttctttagttttttgaaataatgactgcttttgcctcttacatttatagcttcaatagccatgatctaattttaagggtgaatgcaacctttaaacaaggtttatgatataaaaggaaatttgtccattacagtgctcagaaacttttactctttaggtgaaaattattttgttgctgttattgttgaaacacacacacacacacacacacacacacacacacacacacacacgatcatcttaggaagtaattggacaagattaaaacaattaattgtatttaaaattatttagcaatttacaggtttcttattcattttgctggcttcatttataagttatgtattttaaatgtggacactgaggaacaaatgtttagagggtgtgctgaggttctcaaggaaaataattgttgtccttcggacagaatatgatgtttctatgctccttatattaataaatagcacacatgtgtatgtgtgggcagggggggagcggggtgtgtccatcttactcagcgtgactgacttttaggctgagattaagtcatactcgtctacatattcttccaagtctctcacttcagtttatacaccacagttgaaaattgtattttaaggtcaagctagtcgctctcacattcaaaactacctcccatcctgcccctgccatccatacatgcaacgaattaacatgtgcatttggaatttctgggtgtattctcggttcttgtcaccatttcaacctaagtgcttccagtattcaatttaaataaacgttacagtttctgggtgatttacacctctggaatttctatggcgactctatcaagagaaaataatctggccataaattactcacattagctttttttttttcctcactcaaaattgactatgagcactaatgagtcaccacacttccttccaatacccttggatgcaactcagtcatatttgagtctgaaactaataaatgaagccccacaggtcactgttagttttgaatccacattctctcatgctatagtgttaacgacaacaacaaaatcccattacaaaagaaaatatatcaaacctcaaacaaagttttagttgagagtaacaaaaatagtttttggatgccatccctgacaagtaaaacaatcttttcaatattataattgtatagtcttattttgcatgtgaaaaccacagatacatagaatgacaaaatgattctagttcacaagtggtcccgatactaagaactcttttaaaaaatggaaaaatacaaacaaaatgactatgaccaaaacccactcttaaaatagagtctgaagtaaaattaaacttttagataataaatatgatcattttatgaagtagtgtggtctctttgtttagattattatttctgctaacttttccttgtgttcaaatcctgagtgaaacttaaaaccatgtatttctcccagcattagggctacaataaaatgtaaatgtatatggggggcttctgtgttaggaagaagttaatataacagctcgtttatgaaaagctattgttttacaccatttaagtaggaaaaaaagttcctacagtctgaaattgtatctgcacatttacagaaagggggagtacactcatctacccaataaagtagtcacatttatgaaattactttataatttttggttttacattttactattttgagaaggttcataatttgtctaaggagtaaaagtcctcatgataaagtgataacacaaaggaatcattaattcctcaacatgtatttgcttgacgtacgttttgtgatcaaataattatagtgatttcctttgataaaaataataattaccttttgcctttaatttcaaacataagctatgaaccaaatactggagaatttttgcaagtggcataaaaacaatttatgtctgcctatctgctgtgaaagttgtataataaaaagatacaacacataccatgcaaaatttaaatgtgaacaaattaagagcaaagttgtaatggacatttatttttcactgggtttttttaaagcataattattagtgttttttaaaactatagttcagatacttatcaaatattatcagtgggtataccatatttttaaacatttcctagaaaatgaaatgttttatttaaatctttttgtgaataatattcaaaacttcatgccataattttccagagaagttgctgacacttaggtagcacaaactctgacctgttcaggtcacttaatgattatgtttaagggtaatttggggggcaaagttgtagggattcacatttcctgctcagcacataattgcaacagctgaggggttaggaggtcgccactcagtggaattgggcacccattaaatggcacttttatttcataggagaatgagtccacagtcaaggggatcaagttgctgaaacttgaagacacacatgtacagatacattcactcattcacacttagccacaacttaagcaaactaaagaaactaatagtaaaaccaattttctgtgaaaagaaaacaaaaaaacagttcacatgagcatatacaacaaagcttcatacctgctgtgcaaaccacagcaagcattttgcgctcaaaatatgcctcttttacagattatttgtttctctaatgttaagcaacataataacttaagtatttggttactagatttgacaattggctcttttgtgaaagcaaatgagtatgacttggagttaaccttacaggaggccatcatattatactctagttaacaatggctttctgcatacgtgctacaagtccatcaaatcgatggccatctgtgtgtactagagacacagagtatcaacacactgaacctgaaacttgttattcagggcccacccactctatagctaccaaagtatattttttaaagtaaaggccacatcacaaagtgggaaagctgttaatactatctagcattaattctgtattagaaggatacagttgacctagattcaaattctaaatggttaatgcttccagatacgcacaaaggaagtaaatattctaataaactaaaacatccacagtaaaaatatcagtatactcacaaaagacaaaaaatactgttcattgtgaggcagaattagctactttaactcaactgccaactataacctccagcaacaaccactcataaaacaaatcatcaatatttgcacacagaaaaacaaaaagtcaattctgatgccatttttctgtattttttcaggttggaggaagtagaagaagtggttgaggactaaaaattcttttaaataacaaaccagagttataattcaaaagcttgtgtctttgtaaagattacattgtcatctaaacaaaattacaataccagacagtaatcaggaagaatgaaaggacaggcagttgtgttcactcttccagcaaataatcacttgcaatcattactactctattctttcaacaagcatgacagaaagtagcatcatgacagagatcattgtactgaaagaacatcttaactttctctgtggttcactgctgccttaaatttgaaaaaaataagagaagggcgggggaagaacttacttgcggtttaaagtttcatctttagtccatgtaagattatgcagcaagttttcttgccaaggctgcctcttgcacatccctttaaaaagaaccagtgctcataatctagttccaagacgattcattcacatgttccacctcttgtttctgtgaggcattgatatccactctcatatcatcaagaaaatgttactaggaaaatttttagaaaagcaaaacagttcaacatgttaactcagaaagcataccatcattctccacgttctgagatgtatgccacctgccttagttaccacaagcaactaacactaagctgctagcaggaatctgtctgccctctatctgtcgctattagctcagcacgttg

SEQ ID NO: 1179 - DNA, 980193 bp, Homo sapiens; identical to SEQ ID NO: 1177

SEQ ID NO: 1180 - DNA, 980193 bp, Homo sapiens; identical to SEQ ID NO: 1177

SEQ ID NO: 1181 - DNA, 980193 bp, Homo sapiens; identical to SEQ ID NO: 1177

SEQ ID NO: 1182 - DNA, 998520 bp, Homo sapiens
tttcaaatgaaaatttatttttgaaacattgtgtagtgaataacaatgcattttaacttaaaacttctaattcagattcttatacagtaacataatatttgttaaggaagaacaggtatttggataaagaaattgggaaagcagtgaaggtgttgatagatttttcaaactatagacaatgttcgaatcttccatacatgtgcttaactgaccataaatttaaagtagattgcaatgaaaaaaataccagtctataactaaagcttcttatgataaagatcaaaattaactattgaaaaccaataaaaaaaatagaacaaaaatttcacataccatttgggaatagaaagaaactatctataaaatgtgtaagtcctcaacattattttgaacctatccttcagccttatcgctgtgtaatttgcaggcaccaataggcatctgccctgagaatagattattagcactttttgcctattttgctaattaaattcaagtggtatataaatcccacttaaggtataaagtgcagaaggtgaagcagagaaagagaaaaatcaaagctcatgaaataaaagacagaaaatgtcttccctcgagagtcaatattcaattacttctggctctatgatataaaaatgtttttaaataatattttaatggtaactactgaatcacctttggaacaaccacttaagtaaataatagtctttaacatccctgtgaacaatgtggtaaaataacatgaatgacatatcacatataaaattcaaggcaaactttcttctgtattttaaaaagatggttttggccaacctacggttgcaattctatgacaactctcagagtctgtaattaatgagaaagacaaattgagagagggagattaacacctgtgattcgatggtcattaagtcacaaatgtcctatgtcactctgaccatattttctcattcttcctctgctttcccttaatgcccacaagaccttctaaaatcaacgggttgcaatattagtcattacatcattctgttctcacctcgattagccaagacctgctgtttcttctgcctgattgaagctagtgctgattgagaacaacaagaaaaccttcctacaccttcctaggaaaaataacaaccaatttctttataaatatttacattgaaacgttatttatatgaagtattcttaagattaaacatacctgggtatttcctctgggttccacagttttaatcctgagtcagggatttatagactagtgaaagttctatgaaagtaactatttaattgatccagatttatttagttagtaataattttgctgctctacgttacccaaaaatatactgaccaaatatttggtttggttgctctgtgtaaattctgcttctctttatactatctccattaagtaacagatgattgacctcatgattgtttttactgaaatgatcaagtttaaattactgaaatgtgtctgctaagtggcttgtaaaattttgcatattttctcataaaaaatgtagtttaaaatacagtgacatctcatatgtcaggccactagacttctgccaacatcatatttccaaatctactggtaaccaaagaaagcgtctaagagtcgcaaaacatttggttgaatccgtgtacctaattcccatcttaagcttcatgatttttcaacattaagaaaacaaacaaaaaacacaaactttcccatcaggatactagaagctataaactgaaagaaaaaaatgtgagaaaggcacaacaacagaataagttaaatgtcacagccagaaatcaaaggacaaaaacgcagccatgaagctgtatatagagagaatatcaagggatgctgactgagatgatctgggggtatcaagataatattaaattatattcgatgacctctgattgaattagtagggaaatatatgcttaatctaattcctatacaaagtatcctatactaaaaaccattgctttggtgcctgaaggaataagccccggacttcattgcttccaaaatttaatgtgcatataaaccaccttaggatcttttgaaaatgtggatgcttgtttggcaggccaggaggtgtggtcatgattctacgtttctaatctagctaatgccactaggtttttttttgtttgtttgttttgttttgtttttttggcaagggtatggaatgcattaattctcaataaaataaggtagatgagatgttactgtatttgatctcaaatattttcttggaaatctgaagtaaaaacatactactcttacaagtcggcaagtttatgtcagtacaattcattcactttggaaatgaggaaatagcataataataaacaatttttaagacgcgaaacatgtaagaggggaataaataatagtgcattattcagtccttcaaccatatattaagcatgcatgaggaaatttcattaaaacctgaacttggtcaatactgtgcaaaatttgaagtgagctacatctatatcatactaagtaatattcaatagaattctgaattctcttaatctatattgtttcattctttttacatcatctggaaaataagcaacacacaaggcaagttttttaaaggatattctgttttcatttctacttatgatgaaacactgtgctttgttcaatggtaaaaaatcaagaccatgttctttgattttaaaaaatgcccaggcaatgatttcctggttctggattttaggcacataaatatgtgcattaaaatattctataaataacctgaaaatggaagaagttaaacacaacatttgaagttatgaattcatagcctttataagctttatatattatatacatttcaaccctgccaaattcctttactctgatatgctgggtttacaaactattaaagtctagtgacattaatgtgagacttccctaacctcaccatgtcttccattatgaaattgtcgttctagatgcattactgcttactcgaacctttctcacttccctaaaagcttttgctaagggtgagatttccatgttgctccaaacaattatttaacctcaagtgattaaactaaactaaagtatctaccatatttgatatgagatgaagggacaagagaatattgtaaataatattgataaaaagacatacgacttcaagtggtttcctaaagggtcaagatataaatgtatttatggtaaaatgtgaaaacctttatacaggacaataaagaaagaaaacaagctcatgatttaaaataattaattatttacaggtgattccctcatttactttactttgcaattctagctttcattttaaaaattagggcagtatagacagcagctgtataaactcattgcctgtaaatatcctcttacttcttttttgcccttttggctatggaaaataaaattacatgtactaaaaatgttttgtggagctagaaataaagcataatctatgttaatcaataaaatataaatgattatttagtaattatttcttgtttattaaaatgaacaaaaattcaagacccaacaaaacagctaaatgtttaaacgataggttatttagtgaaagtatgtccaaaaggattttctgggaaaaacgattaattgataacaatgtgagtgcaaatctgtctcttaaaattttaaagcatattgttcaaagttttagcttgtgtgcatgatataaattccatacattgttttctcagtgacaataaaaagcacagtttattaaaaatgtaagtaaaaattaattaaaatatcttttaaaaaattggtcacagttttgtcattggtatatggaggttgttccaggggcccatccaaagctcttcatcatcagactgtgtgtggtcactatgaaattccaaagcctccttgatgttcttactgtcaatcatggactcctgttcaactgtgcttttcagcctgttccttagtggcttcaccgctgtattgtcagtccccacagggcaaggggcaaatgtaaccagagttggtcttgcattcattttttcagtagaaaatggcccctttgataatgtgttcagaggtacattctcctcatgtgtcactgccaacttgtctagtttcttaaagggccctcccagtcgaacaggggaagcaacttttaagttgtccgtgaggcaggcacggcgggttctcaccacagaaccattctgtgcaatatatatattgccgttgatattactgtggatactaggatggtgaagacggtttctctgacattcaggagcactgtcttctccagttgagctggtttcatactctcgatcaacaactaacttgatcattctttttcttgcccactgataaaataaacaaaaatatgtgagtcactatcaaataaattaaaaaggcaatgattacattgcctgtgaaatccaaaacaatgacatttagaaagctgtcaaaggtaaatcactcaagagagatagaaggaagccagtctttattaacatacatttcctttcatcaatcctttattggctttagatctttcttattaatgtttgaaaaatgtattgttgagttggaaagcagacatttcaggaaacacatgtattcttttagatcaaattactgatccacatggaaaaaaatgtattacttttatttaaggagctgatccactatttgacagctgctctactattcaggaaagttaaattgaaaggaatgaacagctttagtatattctgttcatattaacgcttctattcccaatatttaaaaaatatttttaaaccacatcattctaatttttaatgtattctctagttagcgaaaacttttgtataatttaatgcattttgtataatttaagcatttatttacttgactttacttatttacttgatgtataatttaatgcatttatttacttgacatatcctggttttctgggttgtcccatttagatatactaacttaaaaggaaatatcttctcagcctgcatcatttacctagtaatacacaaaactgaaagctaattattatactaaactttccttttgtaagcaactggacattttcacaaattcatttgacttttaccaatcaacattaaaaatagcaagaagcaagggttaagcaatactgtgtttttctcaaaatagtatcgcatttttggaatatgtgaactatcaacacattgcatgcattctcattttcagaactatatttcaaaattatagtttatttacctagaaaaaattttatgcctgttacatttatttttaaatccactgtagctaataataacagaaaataagctgtaataacttttaattaattgaaaaatgttatttcattgaattcctaatacttgaagttgcagatacaaacttacttatttgaacatgttcatgatagtttttataatacctttgccagttgaaacgtacatatatgcaaaagtagacgactgttaaagatataatttgttgaagcttgtcttagtatttattttgaaagatgatataaaaacatatatagtgtgtgtgtgtatatatatatatatatatatatgccatccattccaatagacagagtgtcactgataatacataatgccacattgcattaacaaaaatcctaccagtaaatattaaatattgattagctgattgcatgtgttctgatttactaatataggaaggattagtcagttttactctaatacagtctaatatacaaatggatttggacaacatatatattcacttttctggcatgcttctgatcataagtcatatcaaaatcttgatcaatttcctccctttcaagtgtcactttggagaacacacagaaggcactgcacacgagagcactcatcacagcaaaacttccacctactgtgatctctttcaaagtgctgtgttgtaaccttcagagtttgctcctggcgacttcttttggtttgcattcttgcttctgtcatacgctggtacctgatagccccatggacctccagactgactttcgctactactgctactactacctgattctgattcctcctcactttccacacctccttccaccgaagctgattctgcactgccctcttcagggatatcttgagcttcagggtctgtactttcttccacaggggctggtccactttcttcttcttctgagtgttcttcttcttccatcttaggttctttttgttcttcttgtggctcctctttcctacccttgacttccttgacctcctcaaccatgggccttcttcttgcaagcacaatgtttttccttgctttttctccttctgactctgtggattccgattcttctgattcaggggtggaactctcctcctcctcagagggtgtctctgactcagattcctcttctgtagtctcagactcactgaactcagactcttcttcactgtattcagtatagtcgctggaggattcctcctctgattctacagtgctttctgttgcttcctcttggtccagagtgagtttcaaataatctttatcttcttcctcaaggcgtctctgccactcttcaccctcaaggtcaacgattcctcttttatcagctaatcctctaactttcttaaaaatcatggggaatattctggctctcttccatgttgtgtatgtaggctcagctgctggtggtttttcgatagttacaactacttcttcctcctcactaggctctctaatttcaacctttggttttttaattttctttggctcttcctgaaaattgtgaaaatgcaattgaagtgtcagcttggagatagctatggtatgaccttgtcccacgaaagctacgcaggaatgaatctgtgggtgatagcttcatgcatgttatataactggcttaagaaaataatcacaaaaatttctactgcatatagacagaaggtgattaagagaaagtaaattattttattttagcttgtactttacaatacccaaatatattaatttccttcttgttactcaacgtttaattttcctcttagatcaaataaaaaagaaagaattattgtctcttccttccttccttcttctgtcactagacttaggttaatagctttctgtattcccttgaactaaattttcaagaattttcaataatcacgaaaatatgacgatttatctcattttatgagaaatctattttatgaaattttgcacatgttaaagccacagtgacatttatttcttgttagtgttgtttttgtataaatttgccaagtaaatagtgaagacaaagtataagaattttatagaaatgagtcatgctaatttaaacataaattacattattccttgaaaattatttgtggaaataatttacttttctctgataattgaaaggtggagactatattttttcatgacttttagttttgctagataatgtgggagcaaaagtaacctttgtattgcagaactttaaaatatatttgcttataatatctttatggagcaagatttagaattttagaaaacataattttcattgtgccctttccaaatgtttaacacttttagaaggaaataaattaaatgatcaagaattaattttcctccaaagacaaggcaatgaaacggtcagcactgtgaaatttctatgggaaatacgtactaagtgaaaggaatttctaaaagctgaaatgttctacagccgctagtcacgtagggttaaacaatatttttcttggaatattatcttacataataaaattacagtaattacctcttcctcctcatattcttcctcagcttcaccaaccacctcaccatattcctcctgtccagctggtggtaacaatcgacggcgactcccatattgaggcatttcatacctgtaatataaacttacatctttaaacagtttgtcatgtgatttctgtagaatctaccatgagtgatctgtttccttctttttcttccgccattcaatcgacagatatttacacagcacctatcaggctccttgtaaactagttacaaaactatagagtaagaactgctacctgatgaccagtgatttttgccataatggtaccctggaataacaataaagagagttgagttatttcagatactcgtttttggagaaactagaacgagaaaaaagccatattgtgtcttaactagctgaagaatccagaacacaaaatagatactttggaacagtgtaatggctcattcaccacattaaatctgtatgttggtagcaagaagttgcttcaaacatggtctgtaatggttttcacaatttcttcagtattttttttgaaagtggttaatttatatgtgtacaagtgacttttgagacacttatcagtggattctaaggtgtgttttctgtttcctaactgctcttgggcaaaactttaaactgattagataaaacattaacatcttatatgaaagaaatggtgaatttaggaattgagcaaatatgtttcacatctatttcccatataaataattttgaataattttaccgcatttctagaattgcaatcgatatcaatgtaaaatatcaatatggaactcaatatagaaaaatggttaaaacttggttaaaaataaagctagatatactattcattttcaagtattatactagtgagatcgacatgacattaaaaacaaattctagtaataataatcatttaataatttcctattaataaaatattaaaataagaatctgaattttaaaaatctgaagatgtacccatgctcataactgtaataatcttgtccatattcctggccaggatcaattccagactccatggataattcctattgttcaaaaagaaaaattgcatttgaaaacgaattcttatcacgtttcaggtcaaagtcagatttctacacctagaattccatgattctcaaaacattcctgccaaaataactttaaatacaagtgtcagttaaagcaattaaaattactctatttaaaagtgttagtcaaatctattcatttttttctggctgtaaccatttgatacaaaataaggttatataatttgacctgaagaggaaaaagtaatttttttctaatggcaaacctgttaaaacttgcagatgagcattttcacttgtttttggatgtcttttaaaattatcaatcaatagttaatatttaactcaattttaagttaaattattaagtgatgttggccttaagaaaaattataacactatctacagcattttttttcatctccccactaacagttttctagtacccagtattcttctattcattgaaactgttctgataaagtcatctgagaacaagaatttaagttaatgtgtaatgcttcccaaggatgtttatactttaaaacatactgctgattctaaatttaagggttttttgtttgtctgttttgtttttttgagacggagtctcgctgagtcgcccaggctggagtgcagtggcgtgatcttggctcactacaggctctgcctccagggttcatgccattctcctgcctcagcctcccgagtagctggggctacaggcgcccgccaccacgcccgtctaaatttttgtatttttttttttggtagagacggggtttcaccatgttagccaggatgttcttgatctcctgacctcgtgatcagccccaatcggcctcccaaagtgctgggattacaggcgtgagccactgtgcctggcctctaaatttaaggtttttaaaggaaaaaaagaatttgttagaatagaggtccttttaatatttccagttctaaactctaaacatactgattgatttctgtcaaactctacttatagaaagatgtttttcttgagatatacatgtgaaaacggtttctgataactatcaaatgcaatttctctacatttcccttttaaattctactttaacatgttaagcaggttaaatgacaaaggttaaccaaattcatttcgcaatggaatacgagaagagaggggggaaaaggataggtactcacatgaaaatagattggtacatatttctatcatctattatttataaaaatttaattttgttgatccaggaatagtaatgagtcaggaaataaaaagccctcctctgagggcacaaatatgtcatttgcgaagtgtggaaatttacagcctgcatgattgatatggataaagaccctcagttgtgcttggtgtggccaacatcattttaaaaaattgaattcattactaacagtgctaatcagaaaatgacaccaacactgtggatgttggtttctcttgaaaaataaaaagatggaaacactaggatcatatttttacattccaataatctagttggctagattaatttttacagcaagcatgtcctctcctgtttatgacagtatccccaacgacacttttctacattcataccctagtcactatgaaatctgtcatctgctattgctttgtgtctaataaactccattcacttacattactaccctagatcctgtaggtattgacgcttgcattacttcttctatcttataattttgccgtttacaaatactttgtgaacctactctaaaggaatccaattttgatgttaaaactagtatagtttattcaccagaataactaatatttagacaaacccacgatgaacaatactatgtatttgcagggacacagaagagctaaaactctcatctaagtctggagagattattacttggtaaaactttttagaatatgtttggcaatagtactaaattaaatataaccatttcttctttcacagaacttaaatttgtagttaaatacccaacagaaacatgtacacttgtgagaaaacacattattcgtaacagtcccaaattggaaacaatgcaaaagtccatgagataaacacgctaccacatcgcacaacaacataaatgaatctcccaaacagaatgttgagcaatataggtcaggtaccaacgaaatatattatatcattctatttatataaatttcaagaactgactaaagaatatgttacaggccagaaggaaaactgatatctaggtgttgacatagaagagcttgaggggcatgtgcactctgtaaaaattcatctagttatacagtatggtttatacttttcttatgggcgtaggttttatttcaacaaaaatatatttattataggaaggttgaagtgtgggggaaggaatgaggttaagaaagacctggaagaaactgagacaaaaagtctagatttaagttatttcaaactaagtactttgtaaaaacgtttcctggaggtaagctaagaattttagggtatgtaaaactcagtgtaatgacactggtttaaatgaagcaaataggtctcagaactaatattttcaaactgcttgaccaatgcacgtttaattaaatacatacagatactgagaaaataacttcaaacagttttgaagtagacttttaacaacattaggtaatagtaagaaacacgaaataaaaatttcaagtaaatatttatggagaaataatgcaactgagtggattttggattttagaagtcagcatcaaagaattttctttacataaatactttttcttcattaagggaaaataacgctcagctcttgctagctacaatgcatatggcatcaattgcattaaaaatgtaataagaagtatagaagggatgcggataggaacccaggaaactcagcaagatagcccttgattcaatcagtcactctgtatttctgagttgagtaaagagggataggaactagcagaaggaaatgatctaaaaggtccctcttggatgcttccaccacccatgaatgaagagcagagccatcagtcgttaaaaaaaaatttgaggaaagagcccgggtgcggtggctcacgcctgtactcccagcactttgggaggccgaggtgggcggatcacaaggtcgagagacagagaccatcctggccaatatggtgaaaccccgtctctactaaaaatacaaaaattagctgggcatggtggcacacgcctgtaatcccagctactcgggaggctgaggcaggagaatcgcttgaacccaggaggtggaggttgcagtaagccaagattatgccactgcactccagcctggcgatggaacaagaatctgtctcaaaaaaaaaaaaaaaaaaatcgagtaaggaactgctgaccagtcagatccatgagtcaacctcaaccaacaagggaatgctggccctttttgttgttccacacagtcccagtagactgtaacaaccccttagttgatgaattctagattttagaaaagtatgcaaagtaacacactagtgattttcttgggtagatcaaacacttaatgtaatttttaatattcatttttgctgtccacacagggaaaacatagaattaacttaatatttaattattataaacatttatactgatgcaaaacaaaaacaacaacaataattgtaatttactgaatttcttcctgttacattccagttgttgagctaggaacttacacatttattagatattactgctaacattttatagaagatgaaattgatgttcagcagatgtgtatcttgactaaggtcttgcataaagtcattggtgtttggatttcaaccctgagttttccaattcaaattttatggagccctctccatggaaatttttgctaaaaccttataaaagtttaatattcctgccacacaacctccagattttggagagtagattctaaccaagaaatgcctctttttagcaaagacagaattctgtactcaaggaaaaggaataaaatttttgtaagtggagcttatgaaatactaaatttgccgtaaaattaaaagtaggatgtctgtgtttttatttttaattacatatataaacataataagtaaatacaataatatatatttattatacaaaaaatatctttttcacattgcagaagaaaatgccataggcaattggtaatatatgtgtccaaaagaagtattttgaatcacataaaatgatatttaagtacagatatcagcattctgtctttaaactttgcataatctaaatctgatgtcaggaatggatagatgaattcagattgattaagacaagtaactgctgatcgggttcattaattgcttcattcaatgaatggcccgtatttattaggaataatgggcttgtctcattcccagagaatgaggctaaaaatttggaagttgagctaccagcaacttcaggaggtgatttcttggtttcttttttttgaagttattttgaaagactcttttcttttcctttaaaattatgccacattggcagacacccactctgcctacaagaattaatacaatagatcttaaagtcacagtgaaggctcagtgaggttgaaaagaaaatgaaaattgatacctctggtttaagaagagagggcctcagcagttgctgttgctgtcaaaggaaattaaaatagaaaaagatttagaaaataattcagatgggaaaggtagatcatgattgagaagagaggaaaaaaaggcgacagtttaaaacgtgtttccttgggattattcattattcatgtgttagctaccaaaagcattaaatattttaactaattctttatattggaacataaaataagaattcatttgttatgttttaatttcatcattcttctagttaatgacaaatttaatagccttaataaacaggaatctatacagatttttgttttgttaagctccacagtacaaagagttatttatgtttctaaaagtactgtgtgtcatataattacttttatcaagtttaaccttgttttaagttgcccttctttttttccttcccaatcacattaaatgtgataagattcattgggaagaagagcagaacacacaaaacgataaagttgtaatgtatctatcaacatattgaagacatgctctccatttcttcttcttaccaaagtgtggatttcttgcactaaaacattaagtgtgttttcagaatgattaggaaagtcattaattatcagatttggtaggaattgcttcctgcctcttccttctttcacttgtatttatttaaagctaatacagtcaccattgatctgtttcataataatacacactttaaccagataaaaacaagatacacaattcaaattttggggttagtaactctttggagggaaaacagcatattaaactaagtattggaaaagtgggtagtgaggttctgggaggtaattccatcattgaacccactgtttaaactggctagtagaacaaccatttgactgaagggatatcctttttataatacagttgttggtgagttagttattttacttataatgaattctaaactacaatccaattaggtcgtatacttctcttgattgagaagctgtatgctaaatcaaactaggttcgcagtgacttcattggtaacatcacctgcagtacagctggccaaatactactggccagaatgcccagtaagttctctgcagacagaatcaaatgaacacagtagaaaacccagagctttctaacattctgattatttttaaaatctttaggatctcaagctttaacctagtgataggatggcgccttgaactggtaaaaagatcaaaagttaagtagtcctatatatatattctttgttttttttttctttttcttttttttttcttttttttttttttgagacagagtctcacttttgcccaggctggagtgcagtggcctgatcttggctcactgcaatctccgccttgccggttcaagcaattctcctgtctcagcctcccaagtagctgggactacaggcagtaatcctagtttctaaattatatgtatagccttagacaaataaattttggggaaatgtcagaatactgagtaatagtaatgcagaacaaaatacatgtatccttaaaaaggtaagcaagtgatctttgaccattgaataagagatttaaaaccttaaaacagggaagcaacatatataaaagaaaataaatagcataacatactaatatgtttttgctgaaatcaaagaaaataaactagttcaaaagaatgtacattagtcttgcctattacacaagtattttcctagtatgcttgttacgacatcaacaccataaagcccttacctctgatccataacctctcctgcaaggcagaaataaataaatcagtattaaacatcttagattttcgttattaaacaaaatgactgacagataagggctttaaaaaatgtctgagtaaaactgagaagacaatttctactaaacactatctcagtgggaagtatattttgtggaattatcaaaacaggaagatcatggtttcacacctgaattactaaaataatgatcaacccagagcctcgttccatatgagcaacaaaacatgcaaaatctattttatttcaatagtgtataatgacaaactttgactctattattatcaatcaatttggataaaaaatattatacatgatctctgttatacacaagtcttgatatatatactaatccttaggggaagagatatgctttatacatgaagaatgtaataaacataggatgaaaattatgtctatgattgaatatattcttccaaatgattgtatgatattttctttatgttaattctaaaaataatacaaactattggctgtccttgcagggtcaattataatattagaaattaagtgaagaagtttttagagctttaatagccaaatattcaatattacataaagatttataaagttcacacatcacaagatggtgaaacgtttgactatacttgagggggagaaaagaatatagagttttcaaagttgaatgttactaataaataatgaaaatgttctatgtgttattttttaagcagttaaagtgttaaactgatgctgtcaaccatgttatgtagaattaatcaatcagtgtaatgaagaattattacaaagaggcacatattacaaagaggcacatgcataactttctaaaatccaacaaaagaatctctgtagaaaaatttttaaaaaatgttgaggccttcacaaagtaattctacttatcagaaagcatcttgtatggtttatgcattgtatattgaaactgtttgtaaaaaaaagtaaatacaatgcttacttaagcttctcaattgattctttaaaatggttctgcagtgaatttcgtagagtgcttacacggttctgccaatatttataagactgataattcttccagagcctttagaaattgtagacattttcaacttttaccaaatttatatttttcagaaataattcaggtagggaaagctcatatttaggtttaaacaatgacaactgagtcatataccttataaaatatccaaccaaagccaggctttattttttagacgatttcttctgactccttttattagcaatgttttccatcaatgtgaaaaataaaatatcaatagataaactataactcaatgttaatgtttccattcacatttttgttgccttttatttggttatttgtattgcttgtcttggctcaaaggcagaaagttacttgaaagaggtacataacagaactactactttacctgtgtgctttcaaaacatgactattgatacttataaagccagttcatataatatcgatgcacctctttatgcaattcataatcaattgtattatttattttatatcatgtatatgtatcactgtttacttttaacaataaggacaaatgtttggtcatctttcttaagtctttatttaaaaggtatctaataatttcttatgcattaatgagatcataataaatattgagaaaaaagtgttacttttctcctctctggttgtcaggttgtaagcagttagggtttgagaggaggaagaatatttaggcttgtgtactcaaataatactaaaaggtctcatatagaagatattttaactgacttttataatgtatcataatgacattaggaatctccaaatacaatgtgtcagaaaaagactggcttaaatataaaacacaggtatctatgtttcaattaaaaagtacagaataataacaaaactttcagattatgtaaatagtaaaatgttatagaaaaaggcaatataacaatttaatagggctgtaggtacctacacaaatatgttttttggacttctcttatttcttttgttactatttatagatttatcaagaaattataaattttacatttgcaaaaagctggtgtagatattagcttagaaaagacacactcacattaaaggcttacacaattgtgaataccttgtcagagtccgccaaatagcacaagttctcatgcatatgaccagctgccaacaaaaactccaactgaagtttttcagtgaaagaaagaaaaaaatcacgttcaagaaccccaagaaagtaattactcttgatttcgatgaaaagattttgaagcagatgggctaataaaaataatcagatttacagattgttttctgtctgatcttggtaactaggaatgccaggtcaaattattgaagaaatatgagggatgaagaaaacctctgaaataacgcattgaagggggctctcaacttatattcatatacttccaatagtaattatcaggtatgagttttgcctgtattttagaattgtacccttctccatgcaaacttatatcttctaaaatcttaaaactccagagtgttttataagtatttgttttaaacacttacatgtgcattcaaaatgtgaacttccagtaaataaaacctattccatgtgtttcatgggaaaaacaaagtaattacttgatggtcacatattatacattatatactaatattgaaagtatagtttccttaggaaggaagggacatagatagtatctagcttaagtgatgctgttcgaatttaacaattggagcgctaagaactattactacaactacagaaatctcttcccagagtatacagttttattttctttgtttaaaacaaagagcagaaacctaggtaaaagagtgattgatagttcagcaaatatcacttctcttggtttttctatttaagctttttatatttcatttattaaactgaagatcatactttctttaaaaaggaatcttatgaaaaaatttaaattagggagatgattaataatatgaacaaacaaaattaaacagcactttttaagcatctgttggaacaatgaaatgccttacaaaagtcaacgactcaagatttattttcattataaagaagggaagggaaagcacaatgagaaataaagagaataagacagcaactgaaaaagtataagatttatcaaatccataagcatactactaaatccataagcatactactaagataaaagcaagtcagagtaaaagatgttcttatcagaaaacagatgactacatgttatagcacctgagatttattttgaaataccttatgtctgtcatctcctacaatctaggtacattatattttacttcggtagtatttcttcttaccaaatacataggcttcaagaaaaaacagaacctatcaatcatatcagttttaacttatttgtaacagtctgcttttttcttggaacattcatataaaactacgatcaaaaactaaatgtaaatgttactgcatccacatgatagacatgcctttggtttaagttgggtatctaattttcatgcccacatattcccactaaaaaagagattaaaattacttacttttcaaataaatgtagaacaaattatgctactttgtagtttttaaaaagtaaggtaaatctattatatgagtgagttagtagtgatgaggttaatatctttttaaattaaaaacgagaaaaaaaactgcatttcattgaatttggggtaaaataatagagtcttctttgacgttcaaatttgatgttcaacttgaagactatgatcaacaagaggtttgcccgactaaaataagaaaagcaacattacagtgaagtagattgactgtgagattgtttttcagttccctcgacaatattgttcaaactccccttgttttgttcagatgtgatttccatatttgttacttctgaagggcacatagtttgaagttctgaaacatttgtgcgtagatagtttttttctatttgactgtacatgttagctactgatttttcaagttctgctaagtttttaacgtgtctgaggatgccttttggttctctctgagggtctgttttacacactgtcgttgttgatagctgtgtcatagaggacttaattttctcggcaggcatcaagttggtcgtgcatttaacacctgttatacagacacactctgtggacagaaatgaagctgaaggaggtggagggcaaggaatagaaggaggtggtggaggaagaggagttggaaatggaggtagaagaggtggtgttgggggaccagacgttgaaacggaaagtggaaaaaatgtaggaggaggaagaggaagagggatagaaggaggagagggaggaggacaaaaaagagaaaaaggagaaatgtcaggaggaggagcaagaggagcaggagcaggaggaggagaaggaggagaaataggaggaggagggggaaggggacaggcagaaggagagatgtttggtggatgggcaaaattttcaaaaatatttctttcggtttcaataggtaacatacaaataggtgtctctctcctagagagtgaagaatgtaaaacacaaggccttgaaggagaaagttccaaggaacactcagcaggagaactgatgacattaggttctgatttgagttccacagttcttgaaacagttggcaaagtggagaatgagaagtgaggcctgggaaagcaaaatgaagagtctgaagagagagatttcaactgttctgttccttctatcatcagtgtttcaccttgccttatttcctctttctctgtcaaatttgcctcttcagttgtaagcaatggattgctgctacctcttttgtttgtacagattccagtgttttcattttcagctttctgcctggtgccttgccactgctgcagatctatgatctctggtctatttggaactttcctcatcagcctcctgggtaagctgactgactgactccacagcctctgaatcttttctcttgggcccctcagagacttactcttggcttgtattttgggtgaaaatgggtctacaaaatctgttctctgtgaaatgtctgaatttgttgatacttgacttatgttttccttataaaggggattatgggcacttaagtcatcctcatcagatagaaatgtgaattttcttgcagacttcagtttgttgctcttaagtgatccgtctacatgagctgacttgtgagcctcaatagtattggaagaaaagggcatcacaacttgttgatgtttcctgtcttctgagactgagttatttcccctgctttgttgaaaatggtagagaaggaaaagacttgaaagaaaagaagataatgaaatgtaaggaaacaagttgtgacacagctttcatgagaaagatgtttttatggctctcattactattaaatacttaaaaacatcaaaggccaaacaacactaacctactaaagcaagacattattttaattccctgctcttagaaaggcagggcagaaaaatcttagagttgtgagaagaatgagaaatgtaaatgaaaaaaaaagtactcatctctagattattttggaagagagtattttttgtttttgttttttttcagctagtgtgatacagcaaagcatccatgtccacacgtaacagttcccttatgcacaaatcacagttcttcccattgcagaacaccatccttgcctgaggatgctcagggctgcctgttacgcatagaagattcttagctgtatctgattcagtacttctgtcctagagccaaaagtaatctcctctctgagccatcatgtggaatatcctgttctccaaattaagagaattaaaatcaccaaggacagatgggagtttgtctcacagcccaaaaatcacaattgagaaattgaatgtatgctagaattgtgacagaggagtttttcttctgtttaaattttgtgcttaattagttttaaaaccttatacataataccaatcaggaaaaattgttttaaaaccttataaatagtaccaatcagaaaagatgttgtcagtaatttcttagactgatctggatcaaattttacttaaaactcaccttaacaaaaagattgatgctaaaaaaaaaaatcactttttgatatcactgaaaggcttacttatgcacggaaactgaatcataggtagttgtgagtcataaataaagttgcatacatcaaagatcacaaattaaatggctctaaggaaagcatttggacccttctcccaggattgttggctgattgataggtggttccgaattctcattagcttttactctcaagccaaaacagaataacatttattttagttactgcttaatatttacccacttagcaggaatgaaataaaaaagaaatattctgaatagaaattaactagccatattgaaaaattagggtgatagtttaggcaacaaaataataaagccacagttgttaatgtgtcttttggcaaagatacgaactataagaaagagaaagaaacaattcacacaggtagacctggagcatcaagcctacttggacaacaaagaaaattcagacaatctggactaatcagagtgcaaacaaacacttttactcttcgaatcttgaaaagtatttttcaaatatggcacgaacaactgggattgatattatatactggttgtttttgtaaacaaacatttgttcgtggtttgatttctcttggtaaagcacccaatggatataacaatatcacatcactttgactaaaagaaatctataaataggtttctatttatagatttgtaaattttaagttcttaaaatttaagaatttttaaaaactaatttaaaaaaattaaaaacaaggagaattttgaaattcctttcagtaggcacaggtaccatcacagcgaacacatgttttaagctcatgccatcaaaaggaaattgggtgtggaagacaaaactttccttttaacagtaagtgagtctgtggcaaaagatgaagatcactgtatttacagtacaacagcattttaatctgttctattgtatctatttttctaacgctcttctattagagtgatattatttacttacttatgcctatgtatccacaggtgagaaacagaaaacatgtgatagaaaaaaagaagtttttactagagttaatttaaaacaattctgaaaatatgagcaggaacttgctttaaacaaacacttagtacgtatatcaaaaaaaaggcatgtttttatattttgttattattcatatgaatgacatttaatagtagatgaaatcaaatgacattatttgaatgtcttttcacagaaaattgtatctaataaagtctgtttactatacatagataaaaattcacttctattaaacctggatgatgccaatcctaaaataaaaattttaaatgagagtttaaaaattgcttctatgatgtcttaactctgtaaaactggttaatgcacactgacttttaaagtagatatattttgtttggaagaaagtaaatatacaactactatgatgacaattaattacaaagtaattatagcattcataggaagttatcatacgaagttattactttgtgaagtagtttttccaaaatgatctttgactttgttctttttaagataattgataataatcatttaaaactaattcattttctagtaacttaatgcttagaattcctgtaaaaagttcttgaatagatagataggttaaacatttactaaagataagataattaaatatgtagaacttacttaaactatttcaatgaatacatatattacaattgcaaaatctactgagtctactacaattgttcaagtaaaaataatcttaggtattgctatttgaaaattactgtcatcaaactatgctgattccagatgatgttatagtatacctgttcttattaatttaaaatgaatacataattcattaatttcatatataaacacacaactttacacataatccttttttttagtttctaaagatctttgcttgagagaggtcattaacatactcaaatagaatcaaatcatattggctcaattcctacattcaccaataattaattacaaaagaaacaatcatttttcaacttacaaaaaaggtgaaagcatatatctaaagcatgaaccctgtattatgtccttattttggaaatagaatgtcatgctttaacctattataaattcagattttgtgttaaaataatagcattaagatcaattttaacattaatacgactatcctaaacaaaaccttgtataacattattaatatggtaagtaacctgaacacatttgtttaaaaccagcttttccattaccaggtcaatttcatgattttttaggcttttcttattgctactagtaactgatacggatgtcacatgtaataacatgttatagtccttctactccatcaaattccagttaataaaaggttttctggatttaattgtcatattcaaaattgtaaaatattcttggttgttttacatatcatgtccaaaagcagttattcttgaatttttaaaatactgacaaactgaacatcaccataaggaatccaattatgagggtagcatcattatacaagcaactgtgaggtcttttaacagttaccagtgtctttcaaaaatgtatgattttttaaatagtgactacaagtttcaaatcgtgcaggagaaatattcggtaatcaccgcagtctgagagtaataaagtgaaaaaagcattttctaagtagttgggaatttaatatagaaattctgtaatttcattgagattttaatttctatatcatataacgtcctaaaagtagtatctcagaaaatactacgattttaaaccagagaatttggttttgattaccaaatagggatcggtttggatacctaatcaggattactattttatgattgtgctttatttctctcgtctcctatgcaaaaatatatttttcagaatctatttatatatttatacatatatacatatacattatatatatgtaaaaatgcatgaccctgaggattgagatattaaatattatactcaagctataaatgtgcaattgtctcctgaagttgaattctgcttttctcttagctttctttaatttctggtttggttttggctattatttttcaacttaacctttcttagattttcgtcttaacaaattttctcttgaaaataatagaataaaataaatagtccatgtaggcatttccacatcagattgaaattaaatactcaccacacagaattcagtaaaacccaactacttctcagagttcctgaacggtctacttacattgagctgtctccaagttcttcatagagatgcgcacctggcggaggcggcggcggcggcgggggcgctgccactggtgcaggagccggcactgctggtttagccgcgggtaatgcggcctgaattcgtgcagtctttgtacactcagcttgacgtcttggataaagtaaggatggcttgtaaaactcattttagaaatcataatgcttatcaataagccaccttttaataatggggtccagttatcaggggaacccactaaaattattttacacaaacatcaatttataaacagatgtaattacaaaagcatccccacagggtatcatttgcatataatccctgctttgttcttgaaaatagctatctcttgaataaggggtagaattcagcagacatatttgcaaattaaattaaatgataatcttagagaaagcaaaattttaattaaaatgggatggataattaattggtagtttaatgaatctctttcataagatgaggcatattaaagataagatagataatttttctttattatttgtcttttaaagttatttgaaatgatttgaaacatttttgacgttatttcacagaggctgtacacacatgtacaagggaaatttggttagcttgtatatcctttaagattcctaggaatgcctaggccgggcacggtggctcatgcctgtgatcccagctactggggaggctgaggcaggagaatcgcttgaacccgggaggcggaggttgcagtgagcccagatcacgccattgcactccatcctggccaacaagagcaaaaagtccgtctcaaaaaaaaaaaaaaaaaaaaaaaaaaaaaaaaaattcctaggaatgcctgtgattctcatgttacagctacactgctgtttttggatttcctggacactgattaatttcttcctcaaaaccaagatgttacaggatggaagctataggcaaactatctttttcacatttgtgcaagttacgtccaattgtctaaaatcagctcaattctatatatatcaaaccaagaaataaactattacaaacgcaaaacaagggaataagatgtggttctgagcaggctgacttgattgatataatctcgggtttctcttttcctattacatgaaaaggatgtgtaaaatgttaattatacttacactttaaacctgtttgggaaagcaagagtaagaaaaatagaaagctacattagaactattgcattaataacattttaacatctgatttattctaaatcatgaataatttatacgttaaattcataatgacagagttaatgacagactaagaaaactaaggatatcaattcaaaaggtgaaaatagtatcgttaccgttagagtcattcaagccattaaaatatccataacagaaaaataaagaaatgaactacatagaataagaaaactggattaaaatgtaaatgtgagaatttcaactctagtggaaaaatggaatattaaagatgacctgacctttataattggcttcttggtttaccctgcttgaagaatattacaggaatggagagaggtagcaagccctgattatactcttggcttcactttgaagctgaagctacaattggaaggtcctactcttgggtaataaatttatgacagtttttacatatttgctttttagtttccattcatagaaaagttcaaaggcatatcattatataaaaggatagctattcattcttaccttatttgcaagcaaatatcaaggtacaaatgttaggtctttaaatattagaattttactttgctatgtgagcagagaaaaactcattttgtttaattatgttaatctataaaaagcagtaactaaattcatatggtattgagctgattatcaaactaaaggagaattaaataatgcgtctataaattatttaaatattaaacatctcaagtatttgttgtatttcagactaccttgtataacatccagagcgcttcagttttgatcattgcatactgtgccaaatacaagaatttttctcactgatttgcttgctagcaggatataataaagctcctttggaaaatagttaagtgtaaaaagataactggtaatacggaatggatttaacattataattaataatgggttgatggcttaataatttaaaacaatttgttcagtatcaattttgttcatcagctttagatttagcatatcaattgattggttaaggacacattaagctccagtatatcaaccttaatgctgtatttgcaacttcacattgcttttgaggtagaaaatatttctgtagtttcaggttggaattacttgaaaagtaatgacctgcttgaaaaatattaaaggaatggagtcatgcagcaagccctagttatactcttggcctcactttgaaaacggagctagaattggaaggtcctacttctgtgtaacgaattcatgatactttttttcatatttgctttttagtttccattcatagcaaagttcattcagagcatacatttggattttcaggttggaattaccttaccttattcaattcacaagaaaattttaagtatttgagaacaaagatgacagtttaagaatacataaggactattggctgggcgcggtggctcacacctgtaatcccagcactttgggaggctgaggtgggcggatcacgaagttaggagtttgagaccagcctgaccaacatggtgaaaccccgtctctactaaaaatacaaaaattagccaggtgtggtggcgcatgcctgtaatcccagctactcaggaggctgacacaggagaacagcttgaaccttggaggcagaggttgcagtgagctgagatcacaccactgcactccagcctgggcgacagagccagactccgtctccaggaaaaaaaaaaaaaaagtaaagaatacataagaactattttagtatttcctctgtaggtagtttaaatgatgaatagcagttctaccattatttcttattgtttattacataaagtaatttacatgatttattattactgtctgctatttattttctttttgtggcacactcagggctacttctcttcttaatcagctccccaattttttcaagtcattgtctatagaaatatacttaaaatgtgtggctctctatcacaaagcttccccagacctagtgtcaaagaatatattactaacctacttcaaatatggatgtttaaattagtgataattacttgactactctagataagttaaatacaattttaaaatatggatattgtcaatggatgcacttgactgcaggaaccagaaaaattaagagcctgcacagccagaacatgctgtcaaatagtacactaaaaactctggcaaagcacccaggaaggaagaaaccacatagaaaattacatcttacatgctatgattttacaatgcttttgctaacactgtgatcatttgcacaaaggcaaatttaacagtttggataaaaacctatcatgacaatgtcgcgaagttattgaccttcctttggagctgggcagagtgggtatccgcatatgacattccattgcttttaccccaggatacctgttaccttctctcccaagttggctcttaaacaaaagaagagcataaacaaagccacaggaactaaggtgatatttctattgaaagagaccgaattagaatcacaggaatattgggccatcagtgaaaaatgtactgggagtttgtactgttttccttttgaagaaaatcatttggtacgagatagacagacagataaagcaatctcagagtagttgcaccatcaatattttacaacgcaaagccatgttaccagagatggttttctgcaatgacttctgaggaactatccaggtttaccatccttgaatacttactgtctgtagctgaccaaaaccaccaagatggcaggaatgcagcagaggatgatgatgaaggccagagccaacaaggccccttctgtgtatcctagactttctcctctctttttaatgctggtcactgcctctggagtccggatctccagaatgcgtcctccttccccataatacggctgaaagtctttattgatatcaagtagtttgccatccaaaaatctttattgttagataaatagtaaaattaatgatgctagcagagaaagagcattttaaaaataaaatctttttgtaagatctttcaatattttctctaattgaaacacaagctgagtcagaagtctcatgaataataagaaaagcatatataaaaagcataagcaataaagaagaggagtaattacacatctgtatagaaatatcaaaaatattttaaaacacagctcttgatctgcttatagacttaaaaaatctaattatcagtatcattaagcttaatattactgtgtcaaaataatttaacaacattttagatggaataaaatataatatcctaaattatataccatagtttatatttatgcattttatctccttgggtcctgtaaccttcaggataaccctgtaaagatcaaacattacaatactgatttattgcaggccaaaaagctatacagttataaaaacaaatctgaggcaccaaactaagatttcagactcaaactctgtatttgtttgccataacaccatcttaaaagtaaacattctcaagtttcaaaccaaaagaatgttttatggtcaaatggtgaagacatttaaaagacccttctgcctaggaaaaaaagactaaataaatgatgcgagtagtatatcagtgttgtaagaatgacaggaagtggtagtcaatgtaattccttcctctaaataatgcaattccaactatgagtcttgaattttggaagagaatcaaggaataattattcctaatcttatgagattgaaaaaatttgttatgtatttaatatcataattagcaggtgattttttaaacaattccttgggaacttttgaacagtcccttataagctctacatattgatgcagcaactgtgttcttaatacaacaacaccataaaggtcaaacgtcttactatagaatattggaaaacaaaaatagttcaagaaaaacacaattactcatagtcccatgatctacagacagtcataatcacttctaacatcttggtatatttaagtctaatatttttttggaggggtgatattaaatattttatatacttgagtatactgcatatataaagtgcttatgttgaaaaatacagaaaacacaaaaaaatgcaaaagaaaaaattaaaatggccctaaatttcattatcaaaatataatcaatgccatgcttgtgtacttttttcagtctattttatgcccttttgagacatttaattttaatattcagagtgaccatgctgattttaaatcccgttaacacactgttcattgcttaaaaatagaagtgcctggtatcacatatgaattccatcacatatgtaactcataaactaattcatatcacacatgtggcaattagaatgcttttttgctttttttaaacagatacgcttttatagattaaaaatgtactttttatagcaattttccaagctcattgttacacgttaaaagaaaataaaaatttagccatttttatgattactagaaatagaatagtgaaacttcttgtttgaattgtttattagataaaggaagagattctaaatgatgcatagatcaagaattgcttcacaggaactatattattagaacaaggaagaatcagatccagaagaggatcattaatttaagggaagaatatacccctacaatgtggagttcagttgacagatcaaaattctattggattcctggatttcatatccaaactctctaaagtaagatttgttagtctttttacactgcaagagccctattacttagatacttattttcacttatcaatgtgatgtcataaacaattttttactagaaggatggatcacttttgaacccacacctgatctagactatctttctttactttgtgtatttaaaacaacttgtctgggtaaaaattcttgagtcataacattatcccttacaaaacagcaaaattgcttccattgccttttgtcattttatcatgcaaatgagatatgcagggcttacctaatttttgttcctttatgagtaagatatttttatttctgtttcagtgatttttaaacatattcagatactattcaaagaaacatggctaccttttcattgatttttgcctgtaatataataaactcttgaattcttttttcgattttttgcttctgttataaatactacaattttaacctcagaaataactgtcattatcaggttgtattttaatcgtcctataaatatattttgatctcttttattatttatatgttttttcctttttcttaatattgcataaattttcaatggatacacttcatgttgtcaatttaattttcacatgccttctcatttcaggaaaggttgaatccaggtgctcaattgattttaggagataaaatttaatttataaattaggcacagtaagatattaacaacaataactaataacaaaatagaacaattatagaactatagtgtaataaaagttatgcaaatgtggtttctctctgtctctgtcaatatcttattgtattgtaccattggtaactgaaactgaagaaagcaaaaccacagaagagggttgactgctatactccagttggactgaggggaaggcactttagattaaagactaccaccgtgtaggaaagggacaattctcacgagagaaagtggaattcttttaccagaaacaggagaaggactcaagccatgtaaaacacacacaccatttcaccaatccataccattctgttttctactaaaaatgttaaactgttttccaatggtttctgtaggagaaaatttccagagttatatattctccctctgggtcatcaggttattatctcctgattttccatatttattttgttttttagtatttattgctgatcccgtttttccactgcttacttatcctaaaaaagagatagatctgcccaaatccagcatcaacacagaaatgtgttttttttttttttctcgtcattttcatctacagtgtactcagttactatatgcaaaccttttgtaattctaagggaagggtatacaggtcccttcccaggatgtagccaacatgaattgattactgctatgttatcctgaaatgagataagttgctaaaccaatgtcatgtcttattattttctcaagcacatgcaaacatgtatttctgcctccattgatggatatggggcctaatgttgtgttattcagcatataattaataaatacataatcaacaatctaccctgcatctcaccttcgtgactgattaccttgatgatgatgattttgatactgcaatgtacatatgaatgtagaaataagtaaagggtgagcaggagattgtactctagacagtagagggacaactgtctatttcctttgtaggtacacaatttaggcgtacagagtgggcagtggttaacatatctacctacattcattacactgtataagatttttctgcttaatcaagcaaatcatggttagatcatcaactattttcttttcacagtttcataactgtttaactagattctaataattagtattccattgatttggattttcagtattttgaatttatatgtatagttttttacttagaacattgaaagaggctttatcagagcctgttaatcagataccgtttaaggtctaagtgtgtttttaaacattgtggtttaaaggcagtgtataaagtctttttctgccttctccatctttctcttacgatttggacatactgtttttaaataggctggatataagacagataaacaagctaaaatgtatttgcttatttttaaattttaattaaactatattttaaagtagtgtgttctgttttgtgtagaatgcagaaagccacaagagaatatggctattaacagcaacaacaaaatgacaaaaaagtgccaggttatactaaaatcataaatttccttgagctgaagtcacaatgtgagcaaaaaaaaccaaattccattgagtgacaattaggataatttcatggtgagatgtgaccatacattgtttcacctttggcagaaaaggttaaaagtggctgccataggctgggcacggtggcttatgcctgtaatctcaacacattgggaggctgaggtgggatgattacttgagctcaggagtttgacagcagcctgggcaataaagtgagaccatgtctctacaaaaaacaaaacaaaacaaaacagctaaaattgtaataaataaggttagaattatagacacccacaaacacaaggggagtctcccctcatttgaaaacttctttgcgtagatttctgtaagatagattgggggacaaggcaggacacaagagaatattccttcatggtgtaagaataggaacaaatcagcaaggctggtgcacaggcagcaacccttgtgcaattccccagacctttatctcagatgaaacaagggccgtaagtattagagggaggaggaggaagtgtgcccatccctggtgctcaggcaaaggtctactgcttctggaaaagaggtataagcaaaaatcccctacccctgggggaggagcaggaagtcctctcaggtgtaagatcttgcaccaatacaaagtagaggtctactatggattgagaaggggcagaaaattctcttgcacccaagaccccctgtaaatgtgaagcagaggatggctgccatgatgccataagaaagagggggaaaaaatcttgagaaagcccataccaaggcttacacatgcaggctgtacaaggagaacagaggaacccctattccatgacccacctcttccttataagagtggaacccagcagcaaggaggagcagtctaacactgtgggacagatcagagtgtgggcagaaacctcttctgtggcacaagcatatagagagcactgagagctgaggactgagtaagaagactgagaaaaccctacagcacgcaggcctctattctaagactgagttgacaccattccaccaataaaagaatttttgaagcttttggcacagtggaagtaataattgcaacagcaaaatccaaataattcctgaatagctttacttaacagagtaaatgtctgtaatgtccatttacaggcataaactctatttacctcacttcttactgttcttccacaccatgtctggcattcaatcaagtaggacacaaaaagcctacaaaatataaaacaaccattttcaagaaatgaagtaacagagccagatagagataacccagatattggaactgtcagacaggaactctgattcaactctgattaatacattgcaaaatagcagaaagcacaaacatgcctgaagcgatggagaaattcagtagagtggtggaaataagaaataatctaatagaaatgctagaaatatctttctaaaaagataaaaagatgaagaatttcttcagtgagttcatcaataggctaacacagatgaatcagtgaattcaaaaatagggcagtaaatattattcacactaaaatacaaagaaaaaactgtgtgtctatgtgggcgggggaggggagcagagtcagaacggaacaaaattatgagaaaaatcaaattgtaattggaatcccagaaaaggaataaagagaaaatgggcataagaaatattagaaaaaatgtctgagaatattccagaaataaaaaaagaaaaaactcaaaatcaaactcacaaaaaaatgcagctccaaagagttgagaactacaaggataaaaaagcaggataagagtaatatataattattgcataaaatctaagcaattcaggtaaccaaaaataaaaaaattaaaataccgataagctggccaaacaaaataagttattaacatatcactaaaagtcattccagtcctgtctatgcatttatgagcttttttatttttgattgccaaaatatattttttcaaatcaaagtaagttcccaggacaaattattattatgatgatttctaatcctttgacctgagcattccaacatcctcagaagcttagattttaaggtgaaaggaaattgaaagaacacttccattgacctggaccggcatcttaatgttctagtacatttatgcagtgttaaaaactaaataaccaataactctcacaactacagaatagataccaatacttgggcactggcattatcagccttggaaaacacacacacacacacacatacacacatatacacatgtatatgtatgtgtatacaattttattataaaatctttcaagaaacaattctagagtttcaaatagaccagtgactctaagcttactataatacttcaaggtgaagactgctaaggcaaaattttcatatttcatggctattctatcttttcttcaatataaacatatattatttatttatttatttatttatttatttatttatttagaggcagagtcttgctctcttgcccaggatggagtgcagtggcatgatcttgctcactgcatgctcggcctcctgggttcacgccattctcctgcctcagcctcccaagtggctgggactacaggtgcccgccaccatgcccggctaattttttgtatttttagtagagacggggtttcaccgtgttagccaggatggtctcgatctcctgacctcgtgatccacccacctcggcctcccaaagtgctgggattacaggcgtgagctaccgcgcccggccaaaaatttattttatgatttatatatattctgttttttccttgcctgctggctatgatagttattttattgaatttagatgtttactgtccataatataatttaggtttggaaaaacttatttagaattaattaaagatgttcatcttgtatttcatggtgtcacttaaaacccaagtggcttttttttccccaaatatttaatctctagaaggtttgctagttaaattcaaattctaatcaccattattttactctttaaagttagcccaaatataatacatatttttatattcaggtaaaaacaccctaaactcaatcaatcgtgaaatttaaaaacaaaactaatgtatgcaaaaaacacagaatgcaggtagattcacataaaaaagaaatgtgttgattttctgacaatcgaaagaatatatatgaattactttggaagtttattcctaaactttttaaattaataaactttttaaattaataaaacttacaaaaaattggcttggtagatctaaatgttgcttcattttggtggtgactataaaatcagagtgcgagctattacttcattcatctatatttcctccacggttagtatcctgttttgcacatggcccaaatatctattaaaaatgaattgatgagccaggcacggtggctcacacctgtaatcccagcactttgggatgccaaggcgggcggatcaccaggtaaggagatcgagaccatcctggctaacatggtaaaaccccgtctctactaaaaatacaaaaaattagctgggcgtggtggcgggcgcctgtagtcctagcttctcaggaggctgaggcaggagaatggcgtgaacccgggaggtggagcttgcagtgagcgagattgcgccactgcactccagcctggggcacagagtgagtctccgtctcaaaaaaaaaaaaaaaaaaaaagaattgatgagtaacatgttaaataattatggcttttaaaaaattttagctgatattaaatcattattttattattgccaaaatagaagtgatgaaattttgtcgatgaacacatttaaaataaaactaaattcagaatttattaatttgaataaaaattgaatagatatttacaaaataaataaatttacatacacataatatagatatatttgtaaatgtgtatatggatatgtttatatgctgtttaaaaagtatagacaaagaaaaactaaattatgatgtttcacatatagagttcggcatgactatatatacaggcacatataaactattatgattgtatatcaatatatatttttaactaaaaatgtttcattgagatagaatttcattacaagacccagttggacactaggtgtcaccagagtaaagaaaattctgttaacaatttttttttttttaagtatttaagtgtgctcgaataacatccaaagaaagtaagtagcaggattttctttaagattctgcactttatttatttttaggatttataactcaaatttttaagttcctgctaggatgaaatttcacatagagcatgaacttaaatgggaatgattatcccacctgctctccacctgtaagttaaagaaaaaagcagatattgatttttgctgatttagtagacctgtaagaaaggtggatttcttcttaaaatgcaagcatatgaaaatcattgcagaaaaactgcctctttaagaatctgtgctttcctcattaatagccagtgcccttgagcaagagtgaggagctggcagcaggtgatttcaaggagctgttccttgttcttaagtacaaaaggtcatctgatgcccataaagaaaatgggccctctgaagtcactgtagcccacacttagacctgaaaactttaaggcatgagaatcctaggtatttcaggttctttgcttacacttcactttcagtaactatttggtgggttttaaactttaagtacttatagcctcaagtcagaatcatctatggttgctattgtaaccaaagagctgttacagataacaaaaagcacttacttaaaaagctcatttctatcgatggctctgttggtttgggggtcaattgcatagacagtcaagtcacatttggtgtaatcttctagggaaaaggcatctccatgccggcgagctccaatggactccactacgaccttggcaccaggaatttgttcctgaacatagcgatccaagatcctataaatcaaacaaagtacaaacatgacagtccaatgggctttctgggagtaaaaaattactcttaacttgaaaagacatttagtaaatgaaaaatgatgacagcctagttttttgttaatgtttactgaatataaacccttgaaaaacattctctatattttttcagcatttagctcccaatgatgctagaagctgaatacggtagaaaaggtcaccaaccatgtcctatttaactttaggctttttgaatttatgatactatttgagcttttacatgagaaatgccaaatatgctgtacaaataaagctgtctatgctttataggaggcatggggtcttagaacccttgacttcacatggttggtgtcataaattacatctcccactaaagtctgtgacacatgacacgtagctatatgctaagaagcaggactaggatgcctgttttcccaaaggtataaaaatccttgcagaatcacagcaacgggagaatgtggagatattttgcaatggcaggattaccacgttaagataaaaatatggcatgcaaatctcagacactatttaggtgaataaaaacaacatataccatctggtataaattagtgatatttaatttaaaaagcagagacaatattaatcaataagtaattttcccatctcatgactggattttaattgaaagtatgaattattaccatttcccaaatgtctcattccttattaaaaactttatattattaacccaagtatataaatattaagagcatataattcagtatttacagatgtttaaatttaaataattttaattactatatatgataaatattctaaaattcgtagactcaatgctcttttctgagtctatattttgaggtttttttagggggagaagggcaatatattctaaagtcctttgatacatcagaaaataacttttgcttctaatgccacaattgacatatttcttgctcgactgaaagtatattcccttaagagtcttgtatgtgcttggtttgccttgttattagaacaatgaggttactaaactttggaggaaatggctctaccagtgcatgccaggagacactaccaatcatagtgaaatgtttgcttgcttgtttttaaatgtttgtaacccagtactgttgaagtctgtcttattgaagtactattcattattttccttttctgtcaccactccacgcccactggtctctcggcttcgcaatttcttttctgatgacatccttgaagtagactaagaaaagatgatgtgtaaaaaaggaggaggagcaaattcacttggaaaatatcagttaatagttgaatgcctgcaattccagctagtcgggagatgaaacagaagaatcgcttgaacccgggaggtggaggttgcagtgactccagcctgggcgacagagcaagattttatctccaaagggaaaaaaaaaaaaaaaaaacaaccccgggaacctgaagataatggatgtactgagagacacagactagtctaacatcatttggactgtgtttttcagattttttttcctgagagatttatgctcatttaacaaaaataagagaggcctcggagtcaaaccatattatactcttgacattttgtaggaggcacaaacaataatgatataatgttgaggagtacagatgtctggctggcttcaattttaatttcctttgcctttcaattgcataaccttagacaagtaatcttaagctctcaaagtctcaggtttgtttgtttgctttttgagatggagtctcattctgtcgcccaggctggagtgcaatggggcaatctcggctcactgcaacctccacctcccgggttcaagggattctcctgtctcacgcctggattacaggcatgcaccaccacacctggctaatttttgtattttttagtagagacagtgtttcaccatgttggtcaggctggtctcaaattcctgacctcaagtgatccgcccgcctcggcctttcaaagtgctgggattacaggcatgagcatcacatctggccatgtttccttaaatagaaaacaaggaaataatgtaccacatggggctgaatgtgcattcggtgaaataaagcttttacacagttcctagcacatagtaactattcaacaaaatgaatcttatttttattaatttgactgaaatatttccattaataagcttcttccttgtctcaaattcattcaaggcctttaattaatttgtggaataggaaagtatacttctcactagtataatcaatcagttcacaaatcaaaacgcaaacaggagtacctagttaaatacaatgcaatagatggctctctgtcccaatactttggtctaacaatttatgccttctccagtgcattttggcattgatttgacatgttccaaggaaatccttcatataagcatagattaattgtgtgtgatcctacagtgaagaaacatatctattgtgcttgggttcttttctattttcagtgcaatactgcagaatcatttcactaaaaaaaatagatgtggaataaaatataactgtaccaattccttcatggtagcagggaatcatgaataaaagaagtctaaaaacaaattatgtcatttaaaacatgcaataatgtcttcactttgagcatttttttgttaaacttttaaagatcttttgggacaaagtatatcttatgataaaaagagatatagcctaatcttaactgcttctgtatctttttcttataaatgtaagtaaaactaaataccttttaattgagaacacatttcataaaaatctatcttttcatttatcatctatatctatatactaagtattttctacatctatattcattacctatatgtatataaatttcctcacatatatacatatacccccacacacacaaagaaaaagagatttgcaatgatgtttatctaacccataatatttgtatcatacacacacatatcaagaaagatgtccataatgatgtttatgtaatgttaataatgcttagagctggatggtatgattttgagtttaccttttataactttcttcttcatatattatattgcttatatttctttataatgggaataaaagaacaatatagttatatttttaaaaaatctccttaactccctatttcctctccccaacttcgtgataaaaaaagtcttcatataaatctatattttctagtttaaaaatgaaaaaaattaaattggattcagggcttttcataaaattatagcaaaactcactcagggaagtgttaagtaggaaaattttcatttattcattccttcaacagatgtttattcaatgcctatcctgggccagaagccattccagacacatggaatacatcagtgaacaaaatacaatctttgatgtcaaagaagaatttacattcaaattgaacaagacaagtaacagatcatggattgataaaattggtaaaagtgttcagaataaatatcattgagactttgatatttgagcaaaaactttagggaacaatgtgtgctgtggctattctaggaatgagtgttctaagaaaagagaattgctaactgcttgtataaatgtgctgatgtagtagtgtgtggccagagcagatcacgtggggactttgaggattgtaagagcattgttttttgttctgagtgagataagaatctgttgctggttttgaatactaaagtaatatgatctaccttacatttaaaggaggcacactggttgctgtgttgagactaggctgagtagaatcaggaaaactagttagtaaagaacttaagtacatgaaggttcattaaatgctcagcctactcaataatttagaagaaaagacacaacccaatccatgactattagccatatgaaataaaatataaatatcagagcagatataagcaaaactttgaccaaaaagaaaacacaaaaaatcaagaaacagaaaatttgcttttttggaaaaaacatgatatgaccataaaaacagacacgtacaccaatgaaacagaagagaaaactccaaaataaatccacactcttacagccaatcatttttgaccaagatgtgaagaacatacactggggaaaggacaatttttaatgtatgatgataagaaactggatatccatattcagaaaaataaaaatagattcccatctttttctatgtacaaaaatccactcaaaatggattaaaagcttaaacataagacataaaactgtaaaactactagtagaaaatattgggaagagacttcaggacattggtgtgagcaaagattttgtaagactccaaagaaatataaattttccaatgaaagcaaaaataggcaaatgggattacattaggcagaaaagcttttacacagcaaatgaaacaattgtcaaagagacaacctatagaataagagaaaatatttgcaaactatccaatcaacaagagattaataaccagaatatataaggaactcaacagataaaaaccaaataatccaatttaaaaatgggccaaggatctgaatagacaattctcaaaagaagatatacaaagagtcaataggcatatgaaaaaatgctcgacatcactaatcatcaaggcaatgaaaatcaaaatcacaatgaaatattatctcatcccaactgtaattgctattgtcaaaaaacaaacaaacaaaaaataacaaatgctgtaaggatatggagaaggaggaacatttatacattcttggggggaatgtaaaatagtacagccattatggaaaacagtatggaggttcctcaaaaaactaaaaatagaactataacatgattcagtaatcccactgctaggtatacatccaaaagaaagaaaatcaatatattgaagagttatctgcatgcctatgtttatcacagcactattcacagtagtcaagatatggaatcaaccaaaatgtttatcaacagatgagtggataaagcaaatacagtatatatatacaatcaaatattatttagccataaaaagaacaaaatcctgtcatttgcagaaacatggaagaaactgaaggttattatgtaaagtggaataagccaggcaaagaagaaatatcacatattctcattcatatgtgggagctaaaaaatggatctcatggaggtagagagtagaatggtgcttaccagaggctgagaggggaagaaagatggggataatgataaaatggttaatggatacaaaaatacagatagagaaaataaataagttatagtattcaacagtacggtagggaatttatagttaaaaataatgtgttgtatatttcaaaacagctagataagaagaattgtaatggtcccaatacaaagaaaaatattggagttgatggatattccaattatgctgatttatcagtacacattatatatatatgaatccaaatatcacatatatcccaaaaatatgtacaactaggttatatcaatagtgtatgtgtatacacacacacacacacacacacacacaaacaaaaaaagaattaaaaaatgaatgccaaaaatttccctgaatctgacttcttggtagcaatatacgtatttaaaatgcaaatagtacaatcaagtatgaagcaaaacagtatctgattatgtcgagcattctcaaaacagagaactggctgtgattggtcttctaaaaagtgaaaaatatgttaataaatttggatgataattacaattattgaataaaaattacattttaaggctatattgttccactttactttgaatgctctctaacatactcctgttaatgtctatttaattatgtcacctttaggaaaagttttaaaaacagaaaacttctaaagaaatacgttaatatagctaatacaaacattttatgtaacatatgttagtatagtaccacatactaattaatgtccaatacaaaacagtttatctaaataaccttcttagaataaatgctgaaaggtttatttaactgattttttttcctatgcagatagcattattttaaaatcacaaactaagggtgtcaataaacaattggttcgcttaacttacttattcttgaaccaagttatttttggtagatgctctaaatttcaatttacagcattaccttatccagttacctgtatatacatcttcaattagtttcaactagaaattgcattatgaaaaactgtagtgtaaggtgtttactgatagttttatagctgggacaggtatttactcatggttgatttagctttttatttatttttttacactaaaattattacagcagccataatctcaattacccatttgtctgtgtgaatgagttgagttaaaattaccatgtgatgagaatttctggttttgcatgctcagtttactcccaagaaaagatgggttgggtttttaattaggtttgcctcctaagaggcagtgtaacagaggaaactccatctgctggtggctggtagacgtagattaaaattaaacctccattattgtgtctttgtggaaattacttaacttttcaaagtttcagggaatttatctgtacagtgggaaaagtagtcaaacctacctcaaaggtcctctgtgataggttaaggagactacacccattaaatgcacaaaaatctaaccaatatgaagcgtgtcataaatgttggctacctgttgtgatggttacaagaactcttcagatttcatgattataaaccctacttaggcttttgttgaggtaaatggcttatatttatctagcatcatagagagttccaccccaagtgcttatcaatatttttacacaagcttagctaaattaatcaataggcattgcagctggctggagggataaaaatacaggcatacagttcctactgttctgaacttctttcctccattaatacagacccacagggactctacccagaccatatcctaagtagtgctctagatgccatggagcattttgttcattacattacatggtaacctctctgtggtatcccacaagataaaaatattttcctctaatctggaattagactttgaaagagttcttttgtcccagaagagatatggttttgttaattttgtaactgagtctgttctttttgtttagcttgtttgcttctttcactttggccctaacaaggtgacagtcaagtttgtgactactctatatggactatacaggcctttgcagcatctctgtaattacttactcttactctgatcctttctttaacttctttctcatctgtttgctttatttttctacactcatttttaatgtattttacctttttttctgtgtgaatcattgtaaactacttctgtttttctttggaataaggtagaaaattaaaacaaaattaaatttagcctttaatatttattagacatatatggaagcatctaaaatataatttatgactttctgatacaaacggaattctcttgcataaacattttgtggagtttatgtctcacattaaaaaacagcagtacagactgcggtaaattgtgaataaattgaagaaagtatagaaaagaataataaataggattaagagaacagaggaattgactcttgatgattaaagtggcctctaaaggaagtgatatatctaccttgtaccatgagttggggtgaattacaaaaataacaagctgttcaatttgacaaaacttctaggttataaaaaaaaaaagaggaggaagagaggaaataattttaaaagaaataaatgtccactatgtattttagagatctccataaagcaactgtgattcaaatgttttgataaaataatatataatgatgtccttatttttacactacaactattttctagttattttctacttggtacaagcaaaagatcttaaaaataaactgaactgaatgatatttgaggggagaaaaacagattataatacaagttaagattaaccgctcaatctttctttgcttttcttcctaatttctagatcttaaaataaaaacataaataaagttgtctggaaatgtttttttccttagtgttttataagtgaatttcacttttgaacatgaataaccccttaccttcaaatctcaggaaaaaatatacctgtatcaattattttttctccatcataagttgataagaacattttaaacactttaaaattttgaagcacaattcaaagattcagttaatatacgggtaccttcattacgatgattcattgtgcattaattaattttatttctttaatgtatctttcgatcatgctattttcttaaacaaaatagtttccccaaaattttgtttgtattattttcatagtgcaaataaaggcaacataaacatatttatctttgatttaaaactaaacacatagtgtttttaattgatcttccaataaaatatatttttaatctgggaagatctcatttatctctttttgaaaacaacaatagctcaaagattttaaacttttttcacctaaaagcaaaatgaaaatgtcctcaatgttcatttatttgtttgtttgttttggctttccattgtctccaaaagtttgaatactaaaaaagtaaaaaagataaaaagtagaaagaatattgattctgacaaaatacaccacctaaatgtagcagccctgcctcattctttagtttttaatctttttttttctatgttgctgagaaggcatggagaaagtgtgcaaatatgatttcttttttttatattacatctctcagatggcaagtgttaactaagaaagttgatttattttgtatatgtatatatattttttccaaacagaagctgttataatagactataagcattcagaaatgtgttaatgaatgaatgaatgacgaccattaaaataagaaacatatctatctgaagcaaacatgtcagcatacaggaccctttacggaatcaatatgcaatggaatcttaagaaaaaaagtaaaacctacttgataagtgatttgcttttggttaactttgcttatagaaaaatatgtacaaattggccggacgcggtggctcatgcctgtaatcccagcactttgggaggctgaggcaggcggatcacaaggtcaggagatctagaccattgtggctaacacggtgaaacctcgtctctactaaaaatataaaaaattagccgggcatggtggcgggcacctgtagtcccagcaattcaggaggctgaggcagaatgacatgaacccgggagacggagcttgcagtgagccgagatcgcgccactgcactccagcctgtgcgacagaggaaggctccgtctcaaaaaaaaaaaaaaaaaaaaaaagaaagaaagaaaaatttgtacaaatttggaaaatccaagtcatacaaaataaaaaaaagcttaccttaatatacgtgaaatatattatcagagacaaaacactaattattgtgactttgagccatgtgacagatgattaatccttaaagtaaacaatttactcatattgggctaagataacattcctccaaataataactaagaatccacgtaaaataaaaccttttaactctcaaaaatagaacagaactgaaaatcatggagcaccttagtttataatcatctttgttccatgtgattatttcaatactaaagttttggaaacaattaaaaatcctgccatatttaactaaaaacagaattttaaatctgtgctttttctacatttcaaagagttaagcattaaagatgctactgcaatgtgcacaaggattattataaaatagtagcttttaattgtataattgcatattggggtatcttcagttctgtaaagaactatgatttctttaatcataattaacctaatgagttaaagacaagtcattcttcttgtaaacagaggttacttctctactaaataatgctccaaatgaatatttcaaaaagtagcaaataaattttctttctgtcaaaacaatgaatttccaaggctttgaataaagcttagtcacacttaacctttttttaaagaatagtaaattataccttgaataataaatggtaggatttattattatatttctggtttgtattttatttttatgattgcttttagtttattttatagctattacattcctattacagaaacattattttcaaaaattgtactattaaaatgggtgtgctgcattatctgataaaaattaaatcattcatggcaattctctgttgataatatcttcaactccaactatatctttatgctaagtatgctgagagaaaattggcatgtaatagacaatacagcaatttaattgtagaatatggcagctagggagaagactacataacaaaagaaactcttaaggtatctagtggctaccatattgaacagatgggtctaactaaggactttccatctcacacagaataaaacttgaaatcgtccaagtgatctatcaggtcctagaactgattttctaccatgatatctatattttaataagccaagcatggctctttctctgggttttcataactgcagttctctatcaggaattgtgcctcttcctctctcatagtcaaacgactttttccatcacttaatatagatgtcttctcagatttcaacttatcagaaaggctttctttaaccatcctatttaaaacagcacctctcttccaaaattttctacttgatacttgtatttatctgtctttattacagttatcactacataacttaatattacatatttattaatattgttattttatatgccatttttatgcaatcgaatagaagctccatggcagcagggacttcacactgttcactgataatctccagtgcttacaatctgtaactatttattttttaactaataaatccccagctctaagatacaaatgcaaaaactcaaagagtttgatagactggcccaagacttcctagctagtctttggtggtctgggaaatgagcctaggttctctgaaacaaaaaggagctcaaactttccccttaaaaccaagtttttattacattgatttaagaaaatgtgctagcagttagcgtttcataggtatgcttcccgagagaccttctaattatcctcctagaaatatatatatatatatatatatatatatatatatatatatatatatatatatttacacacacacatatatacatatatactatacaaataaataaattctatatacgtaatatatatcctggctacatttctaatgtaggttttgtaaccttaattctaggaactatagattgattacacagcacatttcaggtgctacataaatatttcataaagttgaggctcttcctcatcaagtcagtaactacttcagtaaagctctactataattgaattttcatattttattcagaaggtaagagatgggtttgagcaactctgagaaataagttgtcagttccgattcatacaaaaatactctaactcagtgtttctaaactcgagtttataattttcaaaatatctcttttatagatgcttaaggatttaaattttagaaccacagattcctcttatttgagtttcatggtgaactgggagtagaaagaagttataaaatgcaaacatttcatagtttcttctttagacaattatttgccaattatttgtccattgtagttacgtgtccctactgttattctcacagctgtttctcctataccttaatttaaaaaaaagtaatttaaaaaaccacaagccttacaaagaggtgaattctaagatcaacttaaaatacgtcagagcacagatattcaagggtatctgtagtggatgcagatcctcactggaatttgttgaatatattaatctaattaaaaaggtatatgtttccttacttaggggaattggtcaattttataagcttaaaatctaaaaagtagtaaaaaattttcagtatagtcatttcagctgattcagtgaggtgaggagtaatcattacagcagctaagatttattacaagcattccattttccaggtactgcggtcttagctatcaaagtgtactgatctttgtaaaatctgctccattgtaaaatggatatgtcaggtcattatttttcctttcatcaagtgtcctcatttgtactgattacatacttaccaaggaaactttatatttttgcctaaaatattggtctaccaaaaaaaaaaatgatcacatgacattccagttttccacttcatcggatagggatgtctcaagggaaatatagaaatggctttgatgataactaacttgtcacctaagaatgtcacagggaattaatgtgtttactggtctcgtcactagaacaataaattcttctatttaattaactatttggcaccccgatggctacctgagttatgtgtgtattttcatcactcatcccagacatggatagggggagcactggggcttcacagtgctgactcaggtcttacagttcttatcactaccacttccatctactaatgtaggtttcaaaaagagatcagaaatatttctgcttaagaaaactctaaatttacataggttttaaaaaaaatctacaaaatgaaatcagacatggaagggacaatttcttaaacaactagtattgaaaaaatggaatatccatatgtaaaaaaaaaaaggctggacccttatcttacaccatatacaaaaattaactcaaaatggattaaagatctaaatataagacctccaaaccataaaatgcctagaataaaacgtatgagaggtgttttgtaacactggatttgacaacgatttattgaatatgacaccaatagcacaggaaacaaaagcaaaaatagacagatggactacctctgactttaaaactttttgcccaattagtgacacaatcatcagggtgaaaaggcaacctatggaataggagaaaatatttgcaaatcttacatctgataagggattagtatctaatatctaaacaactcctacaactaaacaactaaaataaatcaagtaacccaattaaaaatgtgcaaaggacttgaatagacatgttttaaaagatgatatacaatggccaatagcacctgaaaagatgctcatcatcaataaccatcagagaaatcaaatcaaatgacaatgatatatcatctcacacattagtatggctactacgtataaaaaaggaaaaagaaccagaaaataaaaagtgttgataggaggttgagaagttggaaagcttatgcactggtggtgaaattgtaaaatggtgcaactgctatagaaaacaattttctttaaattagaactaccatatgatttagcaatcccacttctgagaatgcactcaaaagaatgaaagcaggatataaaagatatattttaatatttatgttcatagcagtattattcacaatatccaagagggggaaacaacccaaatgtctattgagaggtgaacagatgaacagaatgtggtatgtattgagaactattcagctctataaaggaatgaaattctatcacatgctaagctgtaacatggatgaatcatgggaatatcatgctaagtgaaataatccaatcacaaaatgagaaatactgcaaatttccacttttatgatgtatttaaagtagtaaaatttatacatgtaggaagacaaaaggttgttacccagagtctaggggtaaggctggaatggaaacttgtttaatgggtaccaaatttcagttgtgcaaaatgaagaagttctgaaaatctattttgaaacaatgtcaatatacttaaaactaccaaactgtacacttaaaaatgtttaagatggtaatgtttatactatgttttttaatcacaacaaaaggaatggggcatgtatgtgctgcttaataaactcgcagatttatatttaattcttttaaaatcaacatgagatagaggtctttattccaattttcatgaagaataaaagtggctctaggtgctaagtagcttgtccagaggttacagagctgtaataggatctaaatctctgtgtctgaaaccataatctgcattccattaccaaatgcttaataaataaaatgtacaaaactcctagccactctccacctaagtctactgactttgagctgctagctccatttatatggaatatttaccattcaccgaatagtcatactttctattgtcctagatacattatataattcagttttcaaaataattctatatgttttattagctcttaacagtgaaactgaggttgaaaagattaaattatttgcccaatttcatgttttaaatccaaagttttatgaagtcagagcttccttcacaatgatacgattctctcaagacctgaaagttacctgatttttcctatttatatcatcctatctacttaagaagcattaaaatcttataaattcctgcaaaactatacttttgctattttctttttcagtttgataaattttgtctcaaaataaagaaaatggcatcatgatttgcttgtaaaacatcctttcaataaaatgtatcaagtgtctactatataactggagttatagaaataaaacacaagtctcatacattcgtagagataatattctagtggaaattgactataataataacattagataatgctttgtagaaaaataaactagaataaagggttaaaatttgaagctgggtatcatttcttacataatagacaacggaatcagagaaagcctgtctcaataggcttttattaaagcagctaaaagttaggcacaattctaattatttttaaagtataatcagctattattttgaaaaggctcagtgtatataaactacttctgcagaaataaacaagacactgtacaattgatattccatgcataaatgttgataaccatcaccctcataaaacaatttacatgacaccaaaaggttaaatttgtgaactatcctgaaataattgttatgaatcatatatgcttttcttatgggaaaatcacatatgctttaatccgtgcctactgtattttatttggcatataattactaaaagtttagttatctgactctttaaagcttcttctggcaagctgaagtgatgatattttgctaaagaggcaaattgacagtgacgataattgacctctgtcaaactgaaatcaacagaagacacagaagaacaacctaatgcaggcagagcttaaaacctagacaacgggttgataggtgcagcaaaccaccatggcacatgtatacctatgtaacaagcatgcatgttctgcacatgtatcccggaacttaaaagttaaaaaaaaaggtgatatgtatatatatatatatatgtatgtgtgtgtgtgtaatgaaatagtattcagccataaaaaggaacaaaataatggcatttgccattattggagaccattactctaagtgaagtaactcaggaatgaaaaaacaaacatcatatgttttcactcataagtggaaactaagctatgaggactcaaatgcataaagatgatacaatggagtttggggactcaggggaaagggtgggatggaggtgagggataaagactgtacgttgggtacagtgtacactgcttgtgtgcaccaaaatctcagaattcaccattaaagaattattcatgtaaccaaaaaaagaaaaaaaaatttaaaataatggcagctaaattagggtaattaagggtaaaatagtaaagatattttaaacatcttttacagtatcaaaatataagaactgcagtttaataaataatcacaactagattggagttaactataacatactcagccatggtgagtctacactgttaaggaggcagagggacatgccacatattttacaataatttaaaacatatatattgcttaatattagtcaacttggttttaaaagactaagctctaggcatttagacacattgctttgagaaatgacatatttcctggactggccagactgctttttgagtaaattggagccacaaaatcaaggtatatattcaatccatgaatgttatgatttctcatatgcagcattttgaggttctgatacatcaaagcattctgaataataaaatctcacatctaatttttatccttatttgaagacactctcaaaatcttcacatatttccaattagactttgagaaaacagtaagctaaattattattaaaacactcttaaactatatgtttaatctgaacattgtaatgattaaaatgacccactcagattaaaattgtggttgttcaaatactgcatgttattatttataaatgagagtcaacaatgggtacatgcagacataaagaaagaaaataatagacactgagggctccaaaaggagggaggatgggaggggcatgagggctgacaaattagctattggctacagtgctcactatttgggtggttggcacactcgaagcctaaacctcaccaatatgcaatatatccatgtaacacacctgcacatgtatcccctgaatctaaaataaaatttaaaaaatacagttaaaaatcatggtcatataaaaataaatatataaggagacaaaatcaattactctgtaagatcttctatctttttttccactagagtaggaggcacattggaaacaatgacttgcatatccagctgattgaccacggagacctgaaagaagaaaaaacagaattcatttaatttttactcactgaaatttccataatcagaaaacccccacattacctcttccctactatgcatagacacagtggtttctgattttcaaattcaggaacaaatatatatacatttttaattatatgatctacacaaggggttggagactaactggggcagactgagcatgagaaactatttgttgtttacctagaaattaagaatcctgagtgatttcaattgtttttggttatgtgtttgttttattggttatttactgagacatgaagggtggcatttttttttaatttgattgttaaggaacacccaagataatgaaaaatacgttttatattttacaagtcttgagaaatcatttattcattataactaagaatctgagatatgactggttagaataattcattctatgaggtcatcacatatagttttcttgtctatttaaccaactttaaatttgtgtaggtagaggtatatatttagaactttacatatgggttaaatgagctaatttaatggctgttgataactatgtatcattcatttaaaatctactgaatttcttctatgttcttatatttgaaaaatagaagaaaaataaaaatatttattctgtgcttacaacatggcatttcatcttttcctcaatattctacaggtttaactcattgaaatctatcaacagaatcaggttgttattaatatcatttcgattttaaaacaaaaaaaataaattgaggatatatttaataacttaatcctaattaaatgcagtctgccttacaccagagcttgtgctctttactattatccaatactgatataaaaattctaaaaagccatatattatcatgcacatacatttatacactattaaaatataaatgcatttgtaccagaatcataaattgaacactctgagttaggcatatttagcaccgtatctcaatacaatctacagtagggagtaatttcacattgccacacatgtttttataggctccagattctttacatatagagaccccattaggggtcacaaactcaaatgccttcaggaaccaggcaggtaacttaaatgagaaaagtagccaaaagtatgaaatgatagaaagaagtgtaagtaacaaatccaagagcacataactctgctgaagaggtcagctactactcacctctaaggaatattgcagtgtgggaaacaaaatccagatttcctagatatttcagtttttcaggaaaaaaagaaatccaaaatattttgtaaaatgtttgcaactagttagaaatctatcaaaccattgtgtgagcatgatcaatcatgtctgaagactgtattaagacaggagtaggtctgattattacttctgagcaagcagtttatgctggcagttctaaccttgtacccctaacccgtcataggtgtctgggaccaaatgactaaatttcccttcaacatgtaaatgagtcttgattatctttttacaaaacactagctacttcactagcgaactagcgaaagggatcattacagtttttgtatcactttgtcttttcttattggtcttgagttaaagaggatatagaagttgaatagaaatattttttgttttattgtttttgagtttttagcagtaaaattacatgataaaaatttctagaagtatgtatatgaaacttgcataactgttccctccctccctcccctccttccttccttctttcttccttccctctcctcctttttttctttcttttaacattgggccagaaacggttaaaaaaaagttttgataaaaatcaaaccacccggaacaagtagtaactatagggtgttatcccaacgagaagtataatcactaggcctcattctctgttccctgaagctcccatcatctcctctaactgctggactcagaagtactggagtcctggcctcaggacagaggagcttttgcagtgggactagtgctgaagcacttcctaattccaccatctgttgggagaaagctcctggaccatgatgtgggttatggatagggtgagtagtagggaacattagcaggatactggaaaagagaagaaaatgagtaggagaaataactctttattactggttctttcagtggagaattgttaggactgtctgccctgtcaaactgtcctcttctcacatgtctgtctcctggtctggtaagcatgtgcttcaacccaccttttctggctgacagactgttacagatccgtactattagtatcccttgaattttccactgtctcttatttccctacattcatcctgcccaggccttcaaaaatagacccttcattaaactgtcttcaaattatctgactcttgcagcggagacttaaaattaaaaaaaaaaatgtttcacatgtgcatgaattttctgccaggtccttactgatatagatccgaaaaaccatacaatcaggtgtcaggctgtatataccagaaatcggtcacactttacaaatatgatatatgatgtgaacaaaaacaaaagtgggaaaggaactaagtagtaactagtggaggatagattcagcagcctcagaggaagaccaaacataagccttcctatcttagggtagaaacaggatttaatcaaggaaatctcctgctcccgggatggggatctacattatatatacccaacaggatttcagaattggcctggacaattccatatgtctaccattactgtcctcttcaaataggaatttctagtggatattctgtatttttccatcatctatactgggtgaatgtgtttgctggatcactaaaacatcagaagttccctctagacctgataaaaagaacagcatgacatctgagatccaggtgttaactttgataagactttgttctatttgtgtggaaaataatgaaataaatatttggtaatcagaagtatagactggttagctgttcatccagctctttctgtcttcccactgggaacacacagtcgatttctcagccttctttgtagtttagtggagccatatgatggagttctgaccaacgtaaacttagtggaagggaaggaatgaatgttcttaaatttgaaggatagtcactgctttctcttcatcagaaagataggttacttattcaaaatactttaagccaggcgtagtgcctcacacctgtaatcacagcattttgggagactgaggcaggctgatcaattgaggccaagagtttgagagcagcctggccaacatggtgaaaccctgtctctactaaaaatacaaaaaatagccaggcatggtggtgcatgcctgtaattccagctactctggaggttgaggcacgagaattgcttgaacctgggaggcagaggttgcagagagtcaatatcacgccactgcactccagtctgggcgagagactctgtctcaaaaaaaaaaaaaaaaaaaaaagtgagattttgtgcaaaattctgactgaaatagtaggagctaacatttaaggtatctagaatatatccattttaaggttacattttattaacaagattttatgatgttaatacattttgaaaatatacttttatattttattttaaggatataaaaataaaaaacatttaattctgataaattaacagaagtcgcactaccgggagtagttgtcccacacttacctctaaatcattactttaaaatttttaaatctcctgaatgtgctaatgtctggtttatgtagaacacacacattttgactatgcaaatgaagaaataagatattacagtttacatttggtctttgacagaaattctacatcctaactctggtttgttttatcatctataacaaggatatttagctgtttaagattagtagattttatttatgctacttttccagtatagcttctgcaaatatgcaaatatttccagaaatttgcatgtcagtttattacaccaaatatttaataattctctgtgaaattatttaattctgtagcttaataactaatgaaagctttataaatatgtttccatcatcattgagattgatatttgtaatggattcaaattactaggtattgttaaaaagaagagaaataacatttgtgaagcacaaaattaaaaaagcaatggttggaaatttacatgttactatttctatgtcctttccatttattctcataagtttcttttctttcttcctctatactctcataaattttaaatagtgctgtccaatagaaatacaatgtgagccacgaatacaaatcacatatgtaattttaaattttctggcacccacattagaaagataaaaataataagattaattcaataacacatttaacccaatatgtttaatatatgtttagtaaaatatcattttaacatgtaaagaacattttacatatttttatcaaagtctttgaaatctggtgtgtattttatacttatagtacatctccgtgtgacctagccatgttgcaaatattcaatagctacatttggctgatagctagcatattggacaacccaactttagagatattcatcatctcctgcttgaactgtctttcctaactaactaactggtctctgctgcaaactcacattttattaaataaaagaggtgttttaatagtccatttagataattatgtattttcttttttaaatactataccaaaatttagtttccacatgaaatctgaaaccatgttcagttatactacaatctatttgtctgtcttgtactttttttttcttttttgcgatggagttttgctcttgttgcccaggctagaatgcaaatggcgtgatctcagctcacagaaacctctgcctcctgggttcaagcaattctcctgcctcattctcccgagtatctgggattacaggtgcccatcaccacacctggctaattttgaatttttaatagagacgaggtttcaccatgttggccaggctggtcttgaactggtgacttcaggtgatttgcctgcctgagcctcccaaagtgctgggattacaggctgagccaacacacccggccattgtactttgaattgattttttacacgtgcataattttttaacatcctgcattggccacttggaaaatacaagtttactgaacactgcagatattgtaaatatcaacacacttcattacacaatatcaataaataaatcacattatttaatacaaccactgactcatcaagaaagtctaaatattcggaagctagtcaagtttacagtgacaggtacatttttttaatattctaatttgtgcttcaaagcttcagtattatcattagttggttgttttcaatgaaatgacaggctcccttcatccattttgtgtaaatgcctaccaaatatttaagtttgaataaccatattttgtctctaagttgctctttcatataaaaatgttagtccataaaaaaagcagcttgttcagcttgcatagtgcttttccttgaggcaaccatcttccacatacagcagatgtactctatgcatacttctcatttcatcaacaaaataatgaaaaggtgtttaggacactttcgttgataggttagctagctgcctagatagatatacagtatttactaagggaatgaatgtgaggtttaggagagaaaggagtcaagaaattttttgcctaaggaactcaaagtgatttggtcatcaaataaaatgaggaagactacaggtggaagaaatgtgatgaagaagagaaatccattaggaaacactaaataaacaccttttaaaaatattcgggtggaattgctacatgtacagataaatatgcaaatctggtgttcaggaatgatctttagtgtaaagatgtaagtatgagcgcttttactatgtagatgatattttaaagttatgggactaagtgagcttaacaagtcagtgagtgcagatagaaaagagatttaatgtctgagccctgagaaacctcaatactacaaggtcaggagaagaaaatgaaccagtgaaggagactgagaaggagtaaacagtgagatagtaggacaagggagtatggtgggtggtctgaaagcatagtgagggtaatagtcaagcattgctgatggttcaagtaagataaggactggcatcatcagtacatttcctaacatggaagtcattggtagcatcgacaagaatagtttggaagagtgtttggagagaaaacactcttatgattagagggtttaagagagggtttaagagagggttcaatagtgagaaataagtcaaatctaacatagaattttgctaaaaagaagaatagaaaaatggatggcagctagaaggtgatatagatcaagggatgttttataatttttggaagatagaaaaaaagcattgttgtgagaataatctgatataaggaggaaatttatattaataatgtagaaaagaaatgggagagctgctgaggcaatctcctagagctggcgagtgggaattgaatctactgcataagtagaggtacaggctttagataaaaacagaattcatctaaaggagccagaaagaaggcaaagaatgttggtctagatcctggagggtaggtaaatttagtggcaggagtcatagaagtgtccttctaaatgctttagtattatttttctgtgaaatagcatgccagttaatcaggccatagtgagaatgaggacaaggtattggagattcaggagcagagaagattttctaggacatcgaggcaaaatagagtgattactgaccaaagcaaaagctcatttggagggtttgttttagtcattaatttaaattgatactgatgcaggagaacagggtctggaggcagggaacctaaggccaatttgtgctgacttcctaaagctaaatcaaagggaaaacaccaaggtctggggtcagggaatctaaggccaattcatgatagttttctaatggtggattaaacaggaaactcctgggtctgggggcagggaacataaaccaattaatgccaacttcctaaagctaaacaaacaaacaaacaaaaataccatctccccacaccccacctgagtaacaaaggatcaaaggctactctccctaaaaccttcccccttcccccatgtctcagatggaaagggaaagtgccttggagtggctgtgggccaagcaggggccatcctttcatttgcttagggcatcaatccactcaggccttgggtcaattcagctcagcctttagcctcaggccaaatccttcatccagataaggggtagcccacagggacctcaaaaggagtattaaaacccagaaaactttgtaaccaggcccttgagtcacttgcttgagtccactcccaacttgtggagagctttcttgctttaataaatccctgctttccgaggttgcagtgttgcagtgagccaggatcgcaccactgcactccagcctgggagtcagagggagagtccgtctcaaaaataataataataaaataataaataaataaataaataaatgcccactttccttgctttgttcctttgtttcgttcctgtgttaatttgtgtgttttgttcaattctttgttcaaaacaccaacgacatggacaattcacactcaaagccgtcatgtaacaatactatagctaggcatggtggtgagtgcttgcagtcctaggtgctagggtggctgaggtgggaggattgcttgagcccaggattttgaggttgcaataagctttgattacaccactgcactttgacctgggtgatagaaccagaccttgtttcttagcaacaacaacaacgatactaattatagaattttgtatgtttttgcagacataatcagcatggatataggtctggagaaaggagacagttggaattaaccaaagtggaggttttgctaagtgaatatgacatagagaaagaaagcaagaaagttaaattttatatgatgtactgcttattataattggtaatgcattataaatccagtaaacaagaaagagaacatgagaggttctcatgagagaacacaatggaagttaaaattattcggctaattggactggacatcctggtaggaacaaaagaatgatgggtttagctgcaatgttaattaaatgttatggacaaagagtgggaggtttgaaatggaggttataaaggtaatggcaaggtaagccaagaacagaaagttaaacaccacatgttcttattcatatgtggaatctaataaaaagtgtttaccgatcttaatttgatcaaaaatttatgtcaaacttaatatctcctatgtcaaaagcttcttggcttagagtggccttcatttactctattgcagctttactgttaaaaatgagaatgctcctggaggactgttttggccacaatcatggtgattgttcttcaccattatctaagaagaaaaataaagcattgatgtctgcatgtatatgaaggttacgcttgtccagggaactaaatgagaagaactgcgaaaaaatgaaaatttatgatgtaaagaacaaaagacaacttattcttgatctgtttttatgtgacaaatatttctaatgaatatactttgtattagattcatcagacaaaactccaaataacccatgctttcaagttggtaaagagtccacaggatatatgcactggtgttaaatattttcaatacaagctaatatcaaacttccctttcaaatgatctatcactaaacttctgcactgcctaagtgaaaattagaacagtgatattattgactatagccaaatataacttagtcaaggctaaacaatgtcatcattgggaattttgatagaacaaagaaataaatactattggaacaaaatttgtccccaaacattttctttgttttctcaattacaaaatgctgaaagtaatttaaacaaataatttcatagtttaatttctatagtataactctgtgaagcatttaaaatttttatgtagcactggacaccctatattaaacatgagctttgaagacaaaatagaaatccagtgcttatacctttgctgttacaatcatattttttcaaatattataatgtttttctcaaaggtcaagaaaaataaacaccttacggtgtttttgtaaatatatatatatatatatatatgaacaatatatttacatattcctaaactatagtgactaacaatctgagtgaaaataataattatgtttttgaaaacccgttttaaattaatcttagaagttctataaactgaaaacactgacctatggctagtatcgtagctacttccctttcctgaagttttatctacttacgagtacatcggctttgccgctcagtcccttcccatagtcgtcagttgcaataacttgaaacttgaagtaggatctcctcatattatggaagagcatagcagttttgataagccctgtatatgtttccactacaaatccttcttttccctctttaattggtggtattatgagtctgtaggccatgacactataattgccagtatctttatcagtagcctagacggaggggaaaaaaaaagagattataattaagcaggaaaagataacccttatgaaatggcttacttttgtttgtaagaatgaggtttcttatgtaataataacacaataaagccctcctaaatgtctgttttttctggatatagttatgtagattaatagactttgtgtccacagtttcgaatggttgctattagaatgataataactgctgaagtatgaataaaagggacataggtataattctgtaccctttaacaaatttctccctacccctcctttccttttacccttaccagcctccagtatcttgtattctacactttatttttatgagatcaccttttttttagattccacatatgaataagaacatgtatgtggcatttaactttctgttcctggcttatttcatgtaacataatgtcctagatagggagaatatgttctagtgctctataccactgtagaataactacagttaacaatagtatatagttccaaatagctagaagaaggatatcgaattttcccaacacaaagaagtgataactgtttgagatgacagatatgctaattaccctgatttgattgctatgcattatacatatagaaacatctatgtacccaataagtaagtactattattatttgtcaattttaaaaatagattttaaaaaataaacagacatagacactaacagagtcaatgaatcaagacttttggtttacaggtttgttgagttcaactgtgtgtgctgatccaaattggttgaaagatgggattggttgtttacctaatgtttgtcttgctgtaataggcatacagtgtgatggtatttttgatgtagtatatagcctaaggaggataaatataaaagaacgtagtaaaatatctcgaatgaaataaaataaagttgagttataacaaatttagagatgcataaaaatattctaattaattaatgccataacataattctctaattagagttagaatactatccgacttcctttttaatcatcctgtatcccgattaaacatatttgttcctggtgataggtacttatgatccacatattaaagtttcctaccatttagaattaaaaaggactaacacattgtttagatttttttcatttgtttttaaatacagctatgagaatcatatattgggctggctttatggtgtctaattaggggtaattttttagaatgtctatttcagaaccatttcatagtgaaatacttggaaaataaatggtagataggagagttttagaggcttgataaaagactatatataccttattcatgatactagatatgtaagttatacattttcatttgttataacaatgattattatttttattatccgattattcttatttttacctatgctattattattaagtatgagtatgcatttatgatctgccattactaagaattgctaagaatcatacaaaatacaaaatacaatcacacaaaataacatcatacaaaaatagtcttatctaataacaatataaaaaactgaggaatatattgttttacttatataaattagtgatattcaataaaattttctgaaatgatagaaatgttcttaaccagctctgtcttatgcagtaggtactagccaaatatgacaaatgaaaagtggttgatgtgacaaagaaactgaaatttcaattcaatctaattttaatttaagttacataatgaaagactacataataagtagtaaagttgagacacaaatgattaaaatagtaaatcatagcaaatgtgtattaaatacagcatcaacttgatttagcttcaaattctatatatattgtgaaccatttaaaacgtttccagataatcatatctacttgttagaaaaggtaatttaaactactcaacacagataatttcacttcaggatcagctgtttcatgaattttctagggagttaatattctcttttctttatttttttctctgtcacccaggctggagtgccatggcataaactcggctcactgaaccttagtctcccaggttcaagctagcctcacatgtcagcctctgagtagctgggactataggcactccactacgcctggctaattctttgtagacacagggtctcgctatgttgcctgggctggtctcgaactccttgactgaagcaatcctcccatcttggcctaccaaagtgctgggattacagacatgagccactgtgccaaacctaaaattatctttagaagaggacaagctcaaactaccggctaatcactttagatagtttatatggcttacagcatggcagagctcagttttggtattagagtaatagtaattagttatcaatgttaggtcacattctcacttaaaggaaaaagaaaatgaacaaagaaagaaaaacagtatcaaaattttttgtacttaaactttgaaccacaggtttataatcactcaacaaaggatagcataagatagaaaaaggcatattcccagctaaaataagtcaaagtctgagtcaaggtatccaagacatttcttccacatagaatgagcaaatttgggcctaatgtcagatcagtcagatttggttacatattattctctatcttcttattaacatggatatttctatgaaacaaactttttattattaatgtaaactttataaaggaataacaaacatgcaaaaagtgtacaaattataaatgtaaagctcattaaaattttgcaaaatacacacatctacatgaccagcatttacatcaagaaacaaaacaagccaggcatggtgactcatgcctgtaataccaacactttgggaggctaaggctggaggatcacctgagcccaggagcttgaaaccagcctgcacaatatagtgaaactcttatctcttgaaaaaaaaaaattacccatattccagaatgcacttcatgcacttggagtcacaatctgagaccttcttaaggaaaaccactttcctaatctaacattgttgattagttatgcctatttttaaaactttacattgactgaatcataaaatatgttctattttctgtctgacttctttcattcaattttgcactgtaagattctaagcccttatatttaaaataaatactgtataacaacactatcacatttggaaaagaaaaggtggttaccataaaatcaccacagtgattgcttggtatattaagctactttacacagttctgactgattaacttccaatttcagtaagcaggtaatttcactttgcaatattcctaatatattaaattatgataactacaaaatagtcatattccatcttaaaatattaaagtgttctgttaaatgtgcctttcctgaaacaaattatcacttaatgcaaaagtttgggtgtggaactagacaatttaactcagaaataactattttcttttatgatttttcatataaatgccttaatatttgcagaaaatagtcaagaatgagataaaagtttttttaaaaatcttgtctactggaattaaaaaaaataaaaccctattgtcatatgtatgttatacagtaaggactctaatttttatttctttgaatgaatatgatagtctttgggatcttagagatcttatttcaggagatattcatcaaagatgattgccaggatcattagcatatttttcaaatctcccctcttcctcaagtatgttcagttgaatactagtaatttaaacagtgactgatgaaaattccaatgggtgccatacttaagagcaattgcatggatttttaatttttagtctccccaatttataacaaatacatattttaaaatccgaaacctctcctctaagatgtgactctgattgatgtggagcatatgcaataccatcatacatagataacaaccaaatgttctttctataaaatcaataacaggatacgatatctttaaatacacactgagtcacaccagagataccaataataaaattcagagcgcagttttaaatctgggtcaatatgtgaaaaataagtgagagtttcagcacagagtatattgtctctatttgttgttaaataattttaaacttacttttttgcttgttttttgcattatgttttggagtgaggtggactccaatgtcaggtgtgactttgaaaaattaataactcaaggccgggcgcggtggctcacacctgtaatctcagcactttaggaggctgaggcgggcgggtcacaaggtcaggagatggagaccatcctggctaacgcagtgaaaccccgtctctactaaaaattaaaaaaaaaaaaaaattagctgggcgtcgtggcaggcacctgtagtcccagctactcgggaggctaaggcaggagaatggtatgaacccgggaggcggagcttgcagtgagccaagatcgcgccacagcactccagcctgggtgacagagcgagacgtcgtctcaaaaaaacaaaacaacaaaactaataactcaaaatttcagatttctttattcataagataaaaataaggatgcccaaaaatagtattttaaaattttatatatattcatacgtgtgtgtgtgtgtgtgtgtgtgtgtgtgtatatacacaaaaatataaatatgaccaagtccagtgtaactattatagttacctaagttgtcataatggtgattcaaaaggtttaacattttttcatattatgtttatccatgaatatgtaaatttatgcaatcaatttagacccttattacttcagacatattatcacacaattgtaactcccttataactctacttttcttaattttcttttccagctctcctttattgcttccagttcttgttttgttttgttttgttttgttttgttttgttttgttttgtttttgagatggagtttcactcttgttgcccaggctggagtgcaatggctcgatcttggctcaccgcaacctccacctccctggttcaagcaattctcctgccttagcctccccagcagctgggattacaggcactttgggaggctgaggcgggcggatcacctgaggtcacaagttcgagaccagcctgaccaatatggagaaaccccgtctctactaaaaatataaaattagccaggcatggcttccccctcatttttgaagcaattttgcaaaacctcttcctcagttgaaatccatgaacttttgtacagtacacactctacccctccttgttgccaaacataatgaggatgttggtatcttgctctcagtctaccccttctacttcaacttcctccctctttacaaatttcagtattcattgagatgacacatccagcaacttatttttaaagtattaggcatgaataacattcatcagtctttgaacgacctcactgcatcgatttaattctacagtcacactttagtcttttgccttagggagatattccgcttaaagaaacactccatatttaatttatatattaaactttcatgtctaaattctgaccacaactttaatcatcatacttagttaagacctcttctttgatatcagtgaattttcagttctgcaaactgccttttgctcccattacttcagggtttatgtccctttctgctttatcatagaagtcagagttgatcacattgttctcatttctctctccttccacaacacctggatctttctcctcttggaccaaactaaccatcagtttactcctggtgactgaagagggcgcagagaaattaaataatcagtcagactagtgttactgtaagtccatggtctctgagtttcactgtgcctttgtctatttaggaaatccttgctatatgtaataagttctctttctcactccagaagtttgcctttttctttagttcacagattctttcagtcttctccagagataaggaagctctaattcccataaaatttgaggatatcaaatgtgagatctctcagcttttcatcacataactaaaaaagtacctatatctgtacttactttgactactttcttcaaatctcagaggagcagctgacacgtatctctcactgaaggtacttatgccttaatctgaatcactcccatcccttctgcatttaatgcttcatcagctctattgatctctgtccttttcacctctcctctacagactataaaacacgttatgtctctctcattaaaatgaaatgaaacttttcttttactgagtccacactcgtgacactagcccccaaacttccatacctatttttcacagttaagttcctcagaaaatttttatagaatcaccatctgtaattccttactttacaatcatgccttaaccgcagccagatctctgcccctgccatgccatttaatttgctaacatcagtgactgaggctggactccatctcagatcaacaatcagtctggtgttctttaaattaccaagtccatttatgttgtttgtataatgctgttgctgcttccgctgtttgctaacatttattgaacacttacaatttgccagatgctatgtaaatacatatattattacattatctcatgacatcctttccattgagtagattccattattattttataggccaagaaatggaggcacagagagattagtaacttgttcataatcacacatatggttgttagcacagtgggataagtctcactttaaagccactacattccacatgtgagactaaataccagggataaaactgcagtttaaaaataaaacaacaaatgttcgataaaatattctaagaaatcttcctagatccatcaagaagatggaaagacaataaatatgccagtcaaaaacaaagtgctatggactgattatttctccccaaatttatatgttgaaacataatactcaatgtgatgtcatttgaaggatgggcctttgcaaagcagttaagttcatgatggcagagcccccatgaaacggattggttcctttttgaaaagaggccccagagacttcctttgttccgttttgccatgagaggacacactagaaacgcagccatccatgaaccaggacggcctcgctaggcacttaatctattagcaccttgatcttgggcttccctgcctccagaactatgaggaaaaataaatttgtcttgtatataagcttccaagtctatggtattctgctatagaagtctgaatgcaaaagtaaaggtaagaatataaaaaccatagtactgatgggagctttcatttagaatttttttgttttttttactgacctgggtaaaattaaaatttaacttgtctggttttcagtagctcagacaataggaggcaaggccccaagcctactcatgaaagtgagtctattaagatttccctccccagaaagttaaattctcaccgtaagagtaaaggagaaatttacttttccccctgctaccactgctactatcaccccaaactgcaacgaaaactgtaaacttaaactttgctattgaggggagtgaagagaaaacttctttgagaatctaggacgaaatacagcccctcattttagtttgcagccattatttgccggccaccagtttgcccaactcaaggagaaatcataatattccattggtaaagtctaataggcctgatctccacctgaatggacagaaaaaccacaacctgagaatttaagagaaatcatctatgactgaaaatggcctggtctcctgcctgacagaagcaggtgctttttcaaaaacccctcctgcaagccatgcctaaaataattctaacaaataaagttccaagaaagatgaaaagttataataattatcaaaacaaacaagaaacaatcataaaaaagtccgttgagataaaaaaatcaaattcataacaacatagactttaaatatttgaattagtagacactgaatataaagcaaatatggttaatacatttcaataataaagagctttaaaatgcggaataaaaaatgagactcgttgaaaagaaatgaaaaagtatcttttagaaataaaaaaaaattagaattaaataccccaagatgggattgttagcaggttaagcgcagctgaccagggaattagtaaatgaaatgatagggcaaaggaaatgacacagaatgtttcacagagctacgaagatgaacaacctcaaaaaaaaaaagtttgagatatggagtttagaatgaaaattttggcaaatatctaatcagagtttcagaaagagagaaagcgagaatagaacagaattttccagaactgataaaagattgttatccacagatattaagaagcccaataaactgcaaacaggataaataacaagtaactcacacctagaacccacatgtcatatagaaactacagaaccacgtactgtaaatataataagtattgttttcttaatattttgggaaaattcatagagatattttagtaatggcataaataattcataaatatattctataatttattaatagtaataaggagatgtctaacaagttgggttaaattaatgcataaaaattaaaactgactcactgtggaaacgctaaatgaatacaatttactaaagaattaatatgatattactttttccaccaatttctctataatcaaacatttatgctcagttcacaacaaagtcattaatatctgggagaggtgactctggaagatttgattcactgacttttatgagtttcccttagtgaacaaaataaaaaaaaaagttagtctagagttcttttaaaagaataaaagtcagaaatgaatattataattatacttgctataattatattttaagtgaaagcttagatacaggaaaccacttacccatttctaagacctcatctggaaattttaatggatacagatgtacaacattaaaagaaaatcaccaaataattgcctctatcatacaggggagtaggggagaccattaattttctaatagcctaaataactgttcccctctgttgcctaaatgaataccatggatgcagaaatattagtgaaataattagtgatgtcctaagaactttcaaacccattaaagttcagtaatgccaagtttaactttagcttctcaattagacccattttaacatttaacggtattgaaggctcacttaccctgaaatagagtgaaagtgttttagactgtctggataaaaatactcaaatctcacatttccacctaccaaggtcactatgtcaagtttgcaaaaagcaaaaataacagagctttggcaggttagaaccactttaacttgagtcttgtttttttttttgtttttttgttttttttttgacacagtcttgctctgtcaccaggatggagtgcagtggcatgatctcagctcactgcaacctccgcctcacgggttcaagcgattcccctgcctcagccacctgagtagctgggactacgggcacccaccaccagatccggctaattttttgtattttaggagagacgaagtttcgccatgttggccacgatggtcttgatctcctgacctcgtgatccacccggctcggcctcccaaagtgctgggattacaggcatgagccaccgcgcccggccaactcttgtatttttagaaaccagaaagaaatctttattttaaagtccttaaagacaatatacccagaacatgataaaatatgaataagaaaaatgtcaggtagattgatctacttttagggctattcaaaacttttgcaaaaaaaaaaaagaagaaacaaggagagaaagagaaaagaaacattttaaatatgcaagctcaagtgtttgattttgcataagaatgtcaaacagtgactacaatgcaatattaataatttctaagttcaacatacctatttactttttgtagagttaagtaaaagtctaatataattctgagagattctaaagagtaaaatacaactcattgtagaaacagcaatgtaataatggaaacacgccagtgcaacaataatagagacatgccatcatagtttgaattacaaagacctttacagggctgggtttcggttagaatttatcaaaatttactcttaatttaaatcatggtgcaaaaaattacaggataacatctatttagaaaattaaagaaagaaactaaagaaaagccaaatgttccttttattattttaaaaaattatatggtaaattctgaaccatagaaggcttgagagtacaaaacaagcaggacttgcatgtatgttataattgaagtttccttttttattttttcctttcttttaaaaatgttttgtaaaataaatattaccctataaatggttttgctttttccgtcattattgctaataataaaatgattatacctccctcagagatgctttaaaataaactctgagctaattgttctaacttttcaaccatgtgaaaaagaaaaaaattgtgctctattatatagacaagttaacaaaagaaaacacacatgtaatttatgctttttacttgagaggaaacactagtttaaatgttggtttggttttgaatcacaaaatgctattaatttttaccgaaaatatccactcttaaacagcttatcttttacaataattctgtagttatacatcctaaatccttcagcattcaaagcaaattaaataacatacttgttatttttgaacttcctgatttttccttagttacattaggttcaatcagtccaaaccaaattcagctgctgcttcttggctcccaccttgctgtccctcttctgactatcatatgtggttctccttctgttttttctttttgcataggaagggcaacaccatctatgaactgaactgttctaaaaaatttcagcatcctccccctcggtttaatctcacctcctggctcctccctacttccagtccatcagcaagcattctgatttctacctatacaatatttctcagttctgtataatactttaggccaagcttacactggccaatttcaggctctcatcagatctcacttttaactctagcgatagcttaaaaattactgatagctcccacttgccagagatgaatgttaaaacaagtcctttaaatattctcaatctgattaaagttcatgattccaactttttgctttacatttattctacttcccagaaccatattattttgtttttctgaagaatgtgttctttcaggtttctatttctttgtatacattgtttcttctaccttaaatgaaatgtcttttgtctgctaggccaaatgatgttcacttcttggctatactatggcacacacacacacacacacacacacacactttgaatatatatatatatatatatatatatattctacatatacatacagtaaactatggcatacacacacacactttgaatatatatatagactatatatattctatatatatagtctatatagtctatatataatagactatatatactcatataatatattctatatatagtctatatatatactatactatggcgtacacacacgttgaatatatatatatatctccatatatataaaatgtgtgtgtatgccatagtatagtatatatataaatatataatatattatatatatacgtgtgtgtgtgtatatatatatatataataaaacactgaataaagcaatcaaacctcagcttaaatgaccccttttctgaaggtgttcttatctctactagggagtgctgcttctacttacatattttcattgttatgttacataaatgtgtgtgtatatattagcatttattatgacacgttttaattttgtgtgtccattatacgtcaaatttgtttcagttcatatttttcactgtggtaccacgtgcagtcagtggtcaaataatatttggcttaaatgtctatagaagactatcatagtggttgagacatcaataattagaattgaaagatttgagtttagttctaccacttattagatacatgagcttgggcaagtgattctctaaggctttgctcctcatttgtaaaatgaggaaaataggacatgctgaataagttggctgtgaatattcactcgggtgtaaaatgcagtgcctggtacaaagtaaacctaaatcaaggttagctgttgttttactattgcatttactactgagatctttgaatactttgtagctatcttcctgatctcttctatttgttctttttttttttaaatcactttttgtacacttaaacgtacctttcactttctgcatcgtgtcactggctataaattctttggaagcaggaccattttctgaatcgtctttggatctcataagtctcatggccagtagaatgtaattagaaaatatttgctaaagaataaatctgccactgaggaaagtatagttattgatgtctctttactgaatgctatataatttattgatagcaaagcaaaagcacttaaatagaaaatatttataatgatacagatataataagatgcttataaggagggtgggagccaagaagcagtagctgaatttggtttggattaatgaagactaatgtaactaaggaataatatagaagtttggaagtttgaaataacaagcatgttatttaatttgatttgaatgctgaaggatttacgatgtatacctacagaattattgtaaaaggtataccattcataaataatttaagtataggcatttttggtaaaaattaatagcattttgtgattcaaaaccaacattcaaactaatttttttctctcaaatagaaagatcaaattatacatgtgttttcttttgttaatatgtctatgtgcctcagcctctcgagtaccagggactacaggcgcgcaccaccacgcctggctaatttttgtatttttagtagagacaaggttttgccatgttggccaggctggtctttaactcctggcctcatgtggttttgccatgttggccaggctggtctttaactcctggcctcatgtgttccgcctgccttggcctcccaaagtgctggtatcacaggcttgagccatcgcggctagccgtaactttatattctatacttaaaatttgcttcatgataagctgataaatcctgtttgtaatttctgcattttgtatttgtactttttcattcattttaaatcttcttcatgtaaaacaaatattttgtactccaatgcagtgttcaatattaacttgtaatttctgaaaattttactgagaaaccactggaatatttagaaattcaaataaaataggtgttatgcatattacatataatgaagacttcacagttcataataaacatctattttaaaattacatggccacagattcaacccatgggcccaaaatttgcaacagagcaggaagacttgtattttaatatgctaacagtacaagtcatttgacctagagataaaacaatttaatattttaagaacacagggttcacgaagcaaacttgaacttactgtaaaatgaacttactgtaacatgatttcaaatatgaatagtgtataagaagtctattcatcttttaatttctaaatttaatggaaagtcaaaggaaagtaatagcagggcaattgaaaattaaatctgaatgtcgaatcctctgtaaattctgacaattttactgcctacctaataaatttacaaacagaaacaaaaagctctattacaaaaatttttaaaaaaacctttcttattgctttcatagtaaaagagtatgtcgaggcaaatataattcaatttataaatgttttaccttggaaaataaatttataattttcaaaatagactggatatatagggctatgatgaaagtaattattaccaaacaaaatgcctttagtattgttataatgacactaattgtaaagaagactgtatttatggactagaatggtactatttgtacatgggacaataagatctgtctcctcgaatttatataattgtaacatgttaatataaacaaccctcaaaaaaacagtgtctgtcctcagtgtccttcatttaaattgatggtattttggagctctccctcgtgctctctctctctctgtatgtgtatgtgtgtgtgtttaaaaacacacatatgtatatatcacatatgtatacacatgcacacatatatagttatttttatattttataacatgatgtattttgtgtcatgagtaccaacttacaagtttgctaaaaagaaatggctccaacaccagtaaaatttcagtgaaatagtcttgctgcatgcagctatactacctaaaatttcaggatttgttagccagactcaaatactgcatgttcttacttatacgtgggagctaaataatgtgtacacctggacatagagagtggaataacagtcactggagactcagaaaggtgggagggtgggagagggtgaaggatgagaaattacctaatgggtacactattagggcgatggttacagtaaaattgggaatttaccactacacaatacatccatataacaaatccacttgtaacccctaaatgtataaaaataaaaaaagtaaaaataatcattgataaaattttcttagcttaggcagcagaaagtaattgagcatgaccaaaaacgtttatgccaatagagcaaagagaaaaactgagtacacataataaaatttatcttttgaagttcacacctggactaaattattagacatacataatttttaatcattgaaaaaaaccaagccaccatgtatttatattcttaagaataatatttctaaaatgtgtatgctagattacttttgtctacataaaattatacatatttttaacccttgcgatgttttgatgtgaattgtggttcacaaaatatactgggaactaagtaaaaaaattacaacaggtaaatgacacagatctgatcaggactgagatgaaatattgtggaagcatccatggtcagagattgcagtgatttttatctgaagagttggccccaaaacaatttactatacaggatgattaacattacaattccattttgagataatttggtaaaatgttaatattatgaattgcccacttgcttttttttttttttttttaacatggagtttgtttctgttgcccaggctagagtgcaatggcacaacctcagctcactgcaacctccgccttctgagttgaagcaattctcctctgttgggagaaaagctgagtgttgggagaaaagctgagtgttggcagagaagctgaggcagggcttgcatgtctgtgagacttgctggctccttgcttctagcactccccttatctcaagcagacatatgtttctcattcacttgatacactgtttcctttcaacccccacatccacatcaccttttttgtttgtttgggcaccaataaatagcatgggctcccagagctcggggcctttgcagcttccacactcgtgatggccccctagtcccactttctctctcaaatgtctttttctcattcctttgactctgctggacttcgtcgcccccactacctggtgttgggtctgatcaccccaacattcctgcctcagcctctcaaatagctaggattacaggcacgcgccaccacgcatggctaatttttgtatttttagtggagatgggggtttcatcatgttggccagtctggtctcgaactcctgacctcaagtgatctgcccacctcagcctcccaaagtgctgggattacaggtgtgagccaccgtgcctgaccccaactgctattttttaaaaatatggttatttttcatgaaccactgatggaattgtaatacacgcatatctctttgcaaagttattagaatgtatttgtttttccctctgtttttcttttaaaatattcccaaatcatttacatctaattattaatgttctgtattatgtgtaaagatgaaaaattgtaaaaatgtaaatggccaatagtcttttataatgtgtttaatatataaaatgctttgtgcttcttgctttttagaaaaataccattaaatgcaaatggaccaaggaatacaaaaactttataattttatccatttacaggcatcattaacacattggtgtttgttcctttatgtttttttgatgtacatatgtatatacatatatgtacatacacacatatacatataggatattatgatcctagtttactgaaagaatacacatatgtatacatataaaaatacataagaatacacacacatatatacacacatatgcatacacatacatatgtgtgtgtattctatgtattcatatatgtatatgtgtgtgtgtattcttccagcaaactaggatcatgccatcctatagctttgtaatccatttttttgtcattagccagccattaagaatttttttgttttaaccattttctattttaaacatcatacaacagaaagagtaggataaaaatatcataatgatcaggtaaaattatttaaagagatatatttttttctttgcatcatcatctcctttttctcttttcttattcgttaaatctttgtttttacaaatccctgtgctaagggctgatactcggtagactgcagggaggaaactgctctgccacttaaaaaacactgaccaagaagcaggtcatctacactagttcctcacaaatgtcctttgtatggcaggaaggaagatatgtatgtttttaagtgaatacatacacatctataaattgttgtaaaataacccccagagaacaccaacattaccaaagcttgaaagatagtttctaaataacattcacatttaaaaggcttttgttttgtttgagatggagtctcactctcttgcccaggctggagcgcaatggtgtgatcttggctcaccaccacctccgcctcccaggttcaagcgattctcctgcctcagcctcccgagtagctgggattacaggtgtgtgtcactgcacccggctaatttttgtatttttagtagagacgggctttcaccatgttggccaggctggtcttgaactcctgacctcaggtgatctgccctcctcggcatcccaaagttctgggattacaggcgtgagccactgtgcctggcctgtttttgtaaaaaaacaaaacaaaacaaaacaaaacaaactggtttgtttttatttgatttggccaaaaaatagcactgctcaatctgtctttaacttacttgcctttggccaacttgctctaaaccaaattgttcttcagccaaatctgcaggggctgacactgacaactactggggcgattaaatgcaggttgagttttgtactgaaaaggagtaagagacagaagactatatttgaggaagatctgggaaatgtaagaaatcatctgaaagttgactcagtgccctgctctgttttacaccctttaacaaagagggtatcataaaaatttcttaattctggtagttagaaagaataaaagtcattccgtgggtgccatttctaaaccatggaagattaaattaatgaccccaaatcacacagttggtgagcagaacatatagtctttaactccaagcccccatgcagagttcgccaaaaaactgactgtactgagaaaagtatgtggtgggctgaagattattatcaggttccttggttcagaaacagataatacctgtactgaacagatagctttcattaaaaattacaatctaatatttctcacatttttccctctgtgtagatactgttaagtccagtaggaattagattaagacaagcagctttatctctacacctctttttcaggacaaagcagaagacaaaactggcaggacacagagttgcttgtatccttattagtgatgctacttcattaaatttcatgttgaaagataattcaatgatttaattgcatttaatgctaatcagacccttataaatgtaggtgagatacacattctcattgtattatttttcatttctcattagttacccctaattttcatgatgattactaacataatataccattaatactctcaggaggtggcagaaaagattatgtgtcatgctgtgattcattaatgccagagaaagagctgcttcgtttttcaatattttataggtaattcattctttaataatgaaaaataaattttctgccattcagaactttctatcaatacatttactttgaaaaatggcaatgttgaccatacctatatacaatggggtacttatggtctctctataaacattcttaacttgctggcctttcccaggctgggcttattttttatatagattgtgccccctccttctaaagaaaacttatttaataaatttcactgccttttcccttttttcctactttaattaagagaacttcaagatttatttccacttagcagatgtacattaattagtataatataatttcactccattttatgatatactgtggtataaggaccaaaaaaccttcaatatgccttttaaaaaaaagaaatattattttaaaaactgttctctggataaatttatactgatactgcttgaagactgtttgaagtgtttccagctgtgctgttagggtttgtttctcaggacttcatgcctgtacatatagagataattatttattttttcttaagcttaccatactcccagaaagaaaaatatcaagctacagataaccattgacaacaagaaaattctatgcaaaaatactttataacatggtgctaagataatactactcatttaaaacatataaatatgcctcacacattttaatctggtcagtattcatataagagaaccaactatctcatttaacatatacaaggatttagaaaagttatattgagtattcctcagtggaataatattttcatgtaaataatacactaaggtgtatctcaaagagaactcatctggtgacttaatggaggaatctattatgttgtattcagcttcttataattattccttattctactattaagaagacaaattagcattctatactaatgctgaaggtgaattctggaaagagaggcccagtattcagttttaagggcaaagaaaaatggctgtgtgttcaataaaactgtgtttttaataacatgtatgcactgtgcatgctgtttgaaacattttgattttgagattactatcatcttacagggaaaaagaacaactcaggtaacaggtaacaatgactattgagagatctattgagagaatgtctatttagagaatgtctaagttcagagagaggaacgaaccgtgctcagtgctttatgtgcattttctcatttatattcagataaaattcattagctagtgttgtcatcactctgcagacctgttgcttacagaaattaagaaacctgtccactcctggttacacagcccactcatggttaaataaaacctcacatttgtccttattatgcttttggaaaacggttagacttaaatatatcaaaactttatttttataatgtcctttatatattatattcattaacctttctttcacagtcttccgatttagcatacccataacatttggttaaactttaatcaacattgacttaaataaaatgttcttgtagtaattcctatcatgacttcatgtttttggggcaggagctgctagtcgtttcctgcccacatgtatgcctcttttttttttttttttttttttttttggcacctttgggctcagccgcatcttacactcatatcttagctctgaaccagaatattgagcccaaaaagagcccattcctcaaaagaggttgtttcagtatcaactggtcttgttctattcaaatgttacttaatctcaaagtgaatatgttcagagctcactgccttctgggtctggaagccacactgtttactttttcctatgatgtttgttctctgctgagtgtcgaaatccctccaactgccttttctaagatgcaggctgttccctttcacttatttttattgcccattttgggctctttatcaacgccctatattataaaacatcagcaaggactgtgtctgtgcttacgtttttgaaggatttatgaatctgtttttgacatgttggcatgattatgcaattttttcaggtccaaatgatactatactagctcatgatcctggattctgaaaccaagaaccaaagtaaacacatatgctagttcatactgactttcattctccctaccaccctgtctttcagatccaacctaaggtatttgattactggcacctctcagctactaccacctgtaatatagtatttcgtcttcctaaaacatgcattcttgctataaatgacaagaacactatgtggcattgttttaccaagcattaaatatcgagaattccttaacattaagtaaagagaagactaatatttagatggaataaactatgctaaccaataagaaaaatactagcttatccccttttgtcagaattattttatcttccatgaagaataacttaaaattaacagaaagttgaataatctttttccttttccttttaatttcaagcttgttaaacatttttagaaatgtaatatacatttctaaaattgtgtctctacagcttcacgtttcttctttgtttctacagtactctcatgaaaattcaattctcttccctgtatttttaaaaactcattaaacaggtcgggcacggtggctcacgcctgtaatcccagcactttgggaggccgaggcgggcggatcacgaggtcaggagatccagaccatcctgactaacacgggtgaaaccccgtctctactaaaaatacgaaaaattagccgggcgtggtggcacatgcctgtagtcccagatactcgggaggccaaggcaggagaatggcgtgaacccgggaggcgtagcttgcagtgagccaagatcgcgccaccgcactccagcctgggcgacagagcaagactccatctccaaaaaataaaaataaaaaacaaaaaacaaaaaaacaaaaactaactcctaaaacataggtaataaaagaatacaggatcttcaaaaaaagaaaacagtcattaaaaactacagaaatactataataatttgacatctactccttaatttggcagtgccatacaccatgggttgtaagaaagaagagaatatatagtttaaaaaatgctattaatacttttctccagcccctaacccaacccactcatgcagtttttcttcatagaagaagagattttgctggtttgtttaaacacagaccaaaaatatgttcacctctgctcaatattgtatagctgacattctctttaaatatatctgtagaccaattggatacaaataaacattccaacactatatatacatatatatatatatatatgtatatatgtacgtatatatatgtacgtatatatatatacgtatatatacatatatatatatattccatatcagttgtttggggtttcttaatattacaaatttgtcttacaaattacataggagtagaaattctaggtaaggagatatgcataagttcagatgtaatagatagataatatcaaactttttccaaaatgtcttactaatttttatcccctcagcaatatctgagaacttcagtcgcttcacaatttgattttgtctgttttttttttttttttttttttagtcattgtgatgaacatgtgttggtttcttatggtttgttttcaattccctagcagttaagtttgatatatatatatatatatatatatatatatatatatatatctcctgtggaaattgataagctgattctaaaccttatttggtaatgagcacacagagagagccaagagaagccaacaaaccttgaagacaaaaaaataagcagaagacttacactatcagatattataaaactatagtaattcagatagcagaatgatgcaaagacaaacaggtcaatgaaatagaataaagtattcagaaataagcctttacatccatgaccatttgacttagaacagagagaacacgtcaagtagagtggagaaaaaaaatggtctctttagaaaatgatgctggtcaattaaatatccacatgggaaataaaaaaaaaaaaatcttgacctcctacatcactccaaacacacaaaaaaatcccatatggactgtaaatctaaacataaaatatgaaataaaatttttggaaataaacttaaaaaagtcatgtttttgtgttactcaaagagcttttaaacaagacaaaaagttgctcaacatgaaaaaataataaattgtattaaaagtttctgctcatgaaaaagcataaaaaatagggtgaaaatgcaagccataccttgggagacgatatatccaatacatatattgaataaagatatgcaatccagagtatataaagaattctaaagacttaatgagaaaacaaaacaaacaacagaatgtccagagaaaaatgttagaaagagaccaaaatagtcgccacataaagaggatacaaatactggcaaaaaatatataaagagacatttgactatcttaactactagggaatggtaaacgaagcacaagaaaccatcacatgttcatcacagtgactaaaaaaaaaaatcagacaaaatcaaattgtgaagcaactgaagttctcagatactgctgaggggatataaattagtaaaacatttttgaaaacagtttgatattatctatctattaagtctgaacttatgaatatccccttacctagaatttctactcctaagtatatttgtaatattaagaaaccccaaacaacttatatggacagtatataggatatattaactgtaatatatttgtacaatgaaattctctagagcaatgaaaatgaatcaattattactacatgcaataataacatagatgaatctcacaaatatagtgtgagaaaatgaatctaaacaaaaaatacaattttcctaagtctataaaaatatcgtaaacaagaaaaacaaatttatggttggaagtcatactagttattcttacggggatgtggagcaggaactggtaatgctctgtttcttgacctgggcactggttacactaccgtgttcactttgtaaatatttatctagctgcacacttagaatctgtgtgattttgcatatgcaggttgcattatgtatgcagcttgtaataaaaattatacatcaaaaatattcttttaggctgggcacagtggctcatgcctgtaatcccagcactttggaaggccgatgcaggcggatcacaaggtcaggagatcgagaccatcctggctaatacggtgaaacaccatctctactaaaaatacaaaaaattagctagacttggtggcacatgcctgtagtcccagctactcgggaggctgaggcaggagaatcgcttgaacctggaggcggaggttgcagtgagctgagatggtgccactgcatgtccagcctgggcgacagagtgagacactgtctcaaaaaaaagaacaaaaaaattcttttgatatcagcattcaacatatcttggggtctattggcttcaggtgttgatagtctttcaaattactatgagcctcactgacttttgtccttttctagattactgggtttctaagagaccataaatgtctagggggagaaatcctggaaatgagtaaaatgaaacattattaaagagagaattatctttataaaaactagtgtagctaccacataaagtttctggatcaacttgatggagatgcctagtttagatgttatttttgttcactagaatgcatttttgtgaatccaggcatttcattgcctgtttttgaaaaaaaaggaaaaataaaaaaattttaaagtctctgcaattctcagattttcagtgaattacaactaaccagtgcaaattgtattctctttatgcataaaatctctctccaggcctgcgggtttcccttaaggtaaattaattgaaactaataggaagaatcatttatttcttatggcttatttggaactaaactttcttcataacgcattttaaggaactcttgtactttaccgttcttattggaaatattgatagacaattcaaaattaagatacatttatagaagtatgaataaacaatttttaaaagctcattttcctcattttttccccttatattcgtgttatagatctcctgtgtcaggtcagtacagcacaaagttaatggaggttcaagacattacaggacatcttcagacaaaagtaatttttatttgcccaatttatcttctgaattgtgccttgcaatgcagccttcactttcagaaaaattctgagattttcaaagggagaaccaaatgtcagtattcttgctctacagatgatggaggatgtggcctttgaaacataatataggagagtacacacaatcatcactactctaaaacttataaaacctcctaaaagtaaatgcaagcttacctccaaaaatagtattccatacctataccttggattgttacacatttaatcatctgagagatacaaagacatttaataaatttctaatactgctagagtgcactcaaactttaaaatatatgagccaccagcaagtttaggaaaggcaaaattatttggccatttaccaaataaactactttattttcatgtatcatgtccaatggctcttcaaattcataaaaagtccttaaactctctactttaaaaataaagtatccaggctggtcgttgtggctcatgcctgtaatcccagcattttgggaggccaaggtaggcagactgcctgaggtcagggtttcgagaccagtctggccaacatggtgaaaccctgtctttactaaaaataaaaaaaaaaaaaaaatacaaaaaagttagctgggtgtggctttcacctgtaatcccagctacttgggatgctgaggcaggggaattgcttgaaccagggaggtgaaggttgcagtgagccgagatcatgccaatgcactccaccctgggtgacagagcaacactccatatcaaaacaaacaaacaaaaaagtttccagttatcagagcagctttacatctatgttttttttttttttttttttttttccaagacagagtctctgtcgcccaggccggagtgccgtggtggcatcttggctcactgcaacctcagacgcctggattcaagcaattctcctgcctcagcctcttgagtagctgggattacaggcgcctgccactgcacccggctaattttttgtagtttttagtagagactgggtttcaccatcttggccaggctggtcttgaactcctgacctcgtgatccacccgccccggcctcccaaagttctgggattacaggcgtgagccactgggaccggcctcatcgattttgaaacatccaagcttccctcattcttcagataattatagtctgggaaaagtagtccgatttctattataagtaatacgaattaaagcaatttttaattaaattacattcaaattaataggcataaattgtttgctaggagaatgatattttttggtgtcccttctacaataacaaacaaactgatttgtgtggagagggggaagaagagtaaaacatatgcagaattatttcattgtatactcaactgacatctaaaatagacttcatcttgtccacttatattaaaagaacataacaagaatgttttacttgttcagactaataaggagaaatgctatgtatcagcaactggtaatgttttttatggttctcaactagtacaggagaaaatgcaggattagactatttgaaacggaatatcaagtttcagttatataggaggaataaggtaaagggatatattgtacaacatggtgactatagtaacagcgatatattctttaaaaataaaatacagaatacagtgtagaaacagaatagatttttttgtaatcatctgtctgcatttgtgccacagaatttcaaaatgaatgtgaagtattttctaaaaatatatgatataatctaaaaataattgaaagaaaagatgatagagagtaaacgtaaaatatataaaggaaatcagagaaagtcagtataccacaatttgtattgcattcatcttctaaaattgccaaagatggatcaaatatttgactttgagtgtcggtggaaaaaaacaaaaggaaaatattaagtacagtatagcctgtgatcatataacaaaaatagcccagttgttcaggaaaaaaaaaatcttcacatttgatgtcaccagtgaggctaaataaatgtaaaactatgatacatggataacattcataaagctgtcatcaagtctgagtttctaatttggcaagaagtgaaacccacagggaagtccagggtgatgttattctgtgttgtaatcagcccaaaagagtttaatgtaaaatgtattttactaatttgaaatgatcattcatgcaacatatgttaaacaggttaaaagacatgagtatatgtaaaaataaataaataaaattttaagaagtcattatatgaaaaaggtacttgcacacacgtttatagcagcacaatttgcaattgcaaaaaatctggaactagcctaaatgcccatcaaccaatgagtggataaagaaaatgtggtatatatacaccattgaatactagtcagccataaaaaggattgaaataatggcatttacagcaacctggatggagttggaggccattattctaagtgaagtaactcaggaatggaaaaccaaatactgtatgttctcatctgcaagtgggagctaagctatgaggacgcaaaggcataagaataatacaatgaattttggggactcgggggacagagtgggaggaaggtgaggggtaaaagactacacaatgggtacagtgtatgctgcttagatgacaggtgcaccaaaatctcagaaatcatcactaaagaacttatccatgtagccaaaaaccacttgttctccccaaaatacttttttgctaaactttttttaaaacccaggggtacaagtgcaggtttgctatatgggtaaacttgtgtcaggggggtttgttgtacccaaaaattattgaaataaaataaactaaattaaaatcaataaataaaattttaaacaaacaccaatttgaaatgttaagcccaatatataatgtctttaagttgatgggaaaacataatgtctgcttagatgaaatttaaattctagtaggaaaatcatgcacacagataaacgataacagtataattggtttaagtgctaaactagacatatagtgattcagttacagggtcatagtcaagaaggcaatgcaccctcagacacctacatatgtttgctttgttcaaagtacaaaccacacaaggtcaaacaccgtgccaaaacatgaaggaaaccagacgagatcgggcgcattcagggtggtatggccatagatggaaggaaaccagtgattagtaagaccttgtgaaaacacctctcccttgaaaccatgagagagtttcctcatacttggcaatggggaaccaaaattagtgttttattggacctttacttcaggctggttcttgtttgcatctgttctatatgtaactaggaagaaaattgtcacaaaataactcactagctttcaagtaacataaaccacaaatactgtaaaacataaatggtgattttgatttcagaactaagtaatctacgctatttgacctctaaaatgtggttctcaagtataacagttgtcacaggacacttgacattgtaacagtaaataacacataaataagcaaaccatcagcttaaagattttaaagggcacctgcttctacagcaatatttatgtgagaagatatctgtggcacagagtgatggagcataaagtctcacagagagataagagcatgcccagaactaaatccaggtgattagaatgtcagtccagtgctcttccactggaaacgtggttgagcttggtctcggaagcagaatgccaggctgtaaattgtagcctcactcccaattagctgcacatgttgggaaggttacttattgctcctgtgatgcactgttctctgtaaattaaagagatgctacttggggaaaatacattaaaaattcagaaatgtgctggagatgttttacctaagacccaggtgagcaggtatagggctagagaccaggagcccccaggagcccccaggagccctaacctctgtctagaaacattatgtattaccctacattgttaaccttgtacatttctataccttttgctactaaggaaatttgcatcctctgaccatgactgtggcttttttctatctacggcatcactctgctgaaacctctcatcaccagtttgtgcttttgaaaatgtaataaacaatcagccattaagtgttaagtcttttttcttgctgctttttcacaatattattttcttttagtccataaatttcttaaatttggcatctttaataattcaaaaatagaatattcaaaatctttttaactttcagtagagatcaaatcaacattataactcaattcttctgacactgtttttccatatgtgcaacttgtaaagaatgagattaatcctcactgcattaacttctggaaaatatcttcataattcagagttttttaaaattaatcttgatcacatttaacatctccctgtatttgcaataaatgctatttttgcagttaagacaacatgcaataaactggaaaaattagttaacaatttgaaaagtgtttttaaaatcaaatcttacttgttaccttaacagggggtgtcacaatttacacagttcatctcaagttgaaaagaaatcggttgcctttttacttgtctcctaatttttcacagaaagttagtatgttctcttattttctagcaggattctacgcctcatttctcctgggaagcaatgtaagaggttacaagaaaagttcttgaactgaggtagacctaactttaaattccaacttcactgggtatttggctgagtaatactaggaaagttatccagacttactgagcttcaattttcccaaaagtgcaataagaaataattgcatctactgcataaatcaatgtttaaatttacttgttttattttaattgatattattttatttattcattttatttatttatttaaagagtgtaggctaaaataagtaaatgacatttcacagttctcagaaaaataataatgacaaataaaccacagttattattatgaattagggaatatttatccattaacatttcttcaaagcccagcagaaacaaaaagttaatgttcaaaggcctagcttcaactttccttcttcacacaaaaaattacaaatattacaagtattcatcactttttctatttcttttttgttgactacatagttgcttttttacagttctttctatattctggatactgctcctttgagatatatattttttaatagatgtcgtgagtatttgcttttaacatattgcttcactcagtcatttatagcacccttgttgcaggagtctgctattctgatgtaaccatattcatcagtcatttttcattagtgtaggacaggggtccccaaccctcaggccatggacaactaccagtcggtgacctgttaagaactgggccacacagcaggaagtgagtggtgggtgactgagtgaagcttcatttgtattaatagctactcttcatggctcacataacctcctgagctctgcctcctgtaagatcagtggcagcatcaggttcttataggaacataaaccctatcgtgacctgcgcatgaaagggttccaggttgcacaaaccttatgagaacctaatgcctgatgatctgtcactgtctctcatcacacccagatgggaccatctagtttcagaaaaacaagatcagggcttccactgattctacattatggcgagttttatcattatttcattatatattacgatgtaataataatagaaataaagtgcataataaatgtgatgcacttcagtcatccccaaaccatccccctctgcactcctgtctgtgaaaaaattgttttccacaaaaccaggccctggtgccaaaaaggttggggaccgctggtgtaggacatttcagttaatgatgttcaactaatggcctgccctagagaaggaggactcagaattgtggggaggctttttcaacatacaaggtaatgcagattctatatggcctcctgacaggctgagaggattagcatgttcccacaatgcacatcactcccatattgttgcaactggtgttttatgaaataaaatgtttaaaaacgcagtacatagtcaagaaaaataaattgactaatataaatctttacttctgaatttgaacataagcttcacattcataagagcttcaaaggaatgaattaaattaaatatagtttaaaaaattttaaagtttaaaacattttataaattaaaaatagtttaaaaaaggtgttcacattctttcaataaaagtgatgccctctctcctctttttctttactgtggtaaaatgtacgtaacacaaaagttagcatttcaaccacttttcagtgtacagttcattgacattaagtgtattcacattgttctgcaaataccactgccattcatgctcaaaacgtcttcttcttcccaaacggtaacagagtagccattaaacaacagcttcccatttacctcctcccacttcacccctaaaccctggcagccaatattctgctttctgtctttatgaatttgcctactctaggtaagtagagtcatacaatatttgcccatgtctaggttatttcacagagcatgatgtcctcattaatccatgatgtaacatgtattagaatttatttccctttaggactaaataatattccattgtatgtgtatatcacattttgtttattcattcatctatagatgaacatatgtgttgtttcttttccctttttttttttttttttttttttttgagacagagtctcgctctgtcgcccaggctggagtgcagtggcgtgatttcggctcactgcaagctccgcctcctgggttcatgccaatctcctgcctcagcctcccgagtagctgggactacaggtgcccaccaccacgcctggctaattttttgtatttttagtagagacgggggtttcaccgtgttagccaggatggtctggatctcctgacctcgtgatccgcccgcctcggcctcccaaagtgctgggattacaggcatgagccaccgcacccggccccatatgggttgtttctaatttttagttgttgtaaatagcacttctatgaacatgggtgtacaaatacatgatcaagtctttggtttcaattattttaagtatatagtaagagttatattttaactgatattaactaattgttttaaagactaaagaaaaacgaattaccattggattttcttttcgcactcctcataattaaaatgactgattacttgtcactaacggaaatcaacttcgtagaaccagttgtgacacagatacccagcatgaaaccatagtaaatatagatcttctcagataactttttgttctgtgcacttttgatacaattcatgtacttaaatgtgacatgagccttcaaattattgagccagaaatcaagtatctacatgtctgtatatatctttgtcctagaaaatcctcaggagacctcccttaacaatcactgctcaaaaatgactcacatatccacgtgcaaaccaatcatttgcaaaggtaacaggacaggcatgattggctctgaccagccatttttcaccactttggaataggcttcacttcccctgaagcacatgatccccaaaaataatacctaaataaaactgaaattctgttaaagtgtgaggtaggagaaatagccaactaatggtgtctactatactcagacaatgtgagtatattaaaaccagagacttcacctaaattaactcagtggtacaaacagaataatttaaaactcaccttcacctaaatttcagataattatattattttccactcactatagtataaacatgaactgaaactaaattaggtattttgtccatctagatttaattataacatatgtttttatttatttactttttttcgggggggggtggtctagtttactagaatgtggcttctgtaagggtagagagagcctatttttgttgcttccatattttcagtacagagtaagaacacagtatatattttctttaaaaaaatgaacttagaacctaagtttttaagtatattaggtataccacttcagagcagatatacaattgtctttattatgttattacttatattggataattcacttcaacaatgtttttattgtgtcactttacctgtagcatattttaaaaataatgccccaaattcactactcatcttttaagctaatatagccttattcactgctatttcaaagtcttatcttactttgtcaatcttattctatgtcacatttcttctttcccttcttacacaaagcacatatttacatttaacttttatcattctgcgttatatcatggaccaaaaaaaattaacttgtatgcatggtagatgatctaccattacctaatattgtatagcaattggtagaaacacctctttcacaatcatgggctacttcccatttttaaaatcatctttccttccttcaaacaccacagctgaactggtcctgattcagtgctgtttgcattaatatttttgttgctctaagtataaaatgagaagaactgcttaactcatgctctgattaaattctggaaaggagatttcaggcttcaaggctaaaggcagcaactggaattgttaaacattaagtatttattactcccttccgctcgtaaatcccttgcctcctatcactcagatacgctctgcactttgtttcttctgagttttggcttacttagtttgtttcctctacttagactgtgtcttcctcacatatgtttcactttggaaaaaaaaatctaaccacccttcagtgctagtcttaaattcttcatcctccaggaaacctttatgttcattcaccaactgaaatgttttcttcctttgaatccacaagacaatttgcgctctgctacttgactttattattatagcatacacttgcataaacacattctttctctctctctctaaactttctctctctctctctctctctctccccccctctctctgtctgtctctctctcccctctttctctcactattgtataaagtacctagtatattatattgcatgaagttggtttcctagaaaggacccctttccctagtctgaattacccactgatagtttgaagggggagggttccttagagttctcagtagtctggagacacaatcaatcccaacactgtatacttcatctgaagaagtccatgcattctgtccagggcatatgtcctcaccctgatgcttctttcaatgcaatgtctttacacaccttattaagactcagtttctcacctgacttttacactactaccaaactttcgccagaatcccttggaaatcacagaccatcatcaacaaaatcccctaaatgttcaactttccctctgagtattacctatactttttgattccttctttctccctctaaccatcctcgacaaaagatgctgctttctgtagatctcccagtagtggctaccataatttacatagcacagagcccaggagtacagggcaagcatccttctgtctcctttgacactctgtcccaattcctctgaagtaaatcccatcagataatgccacccactaaatttccttgttatagtcatcacatgccttttgagtaatctcctttattaatggactagtttaacatttggcttatctttttttcctacatcacactataggattagtaacataagtggtgatgtaaaaatccacaagggcattctaatcacagtagcatctgacagtcaacgatcctcttttatcaatcttgttctttccatggttcagggaccttgcattttccctgtattcctgtcacctcatggcagcaacatctcagtatccccaaacccttcttctcctgatctctaagtgctgaaattcccaaagcttagtcttcgtattttttttgtcaaacccattttcagggtgatttcatcttggccccttatttctctctcaagtctagatcagcatttgcaaatgccttgccaagaattaggtttctgtattgaaaaagcctcccaaaccttgattactgccatcacaataggcagtggaggaggtatggggatctgttcaggacaaaaaccaccaagtcattcttgatttttcctaatgtcccatgtatgattcatcggcaaatcctatatgttctatcctttaacccccttctcaaggtctccatagcctatcaacgtcgttcaagctaccgtcaaatttttcctggactcgtcatgcattaaactctacttgtccaaaacactgtgttacccattcccaacatcccccatgcagcatctacaataatctttttatattggatgatgtcataactgtttaaatcattcaaaggctttctttccaacacacctagaacgaatcccatattctagccccaggtacatttctgatctcatttcctaccagactttttcattcacactagcctccagctccctgtctacctttagggctttacagagaaatcccagaatgctgctcacttaagaatccatgtcttgatcttttcctttattcaggtcactgtttcagttttatccaaaaagaactatcttaactttcttatctaaaattgcaccactctcattcttcccttatcaaacttttttgtttccttagaatttatcactacataacttactcatctattcatttcttcaactagtttgtctgcattactcgggtggaaactttgtttgtttgtttgctttgtcaattgctctatatcaaacttctagaacagtgtttagcacattataggtactcaaacatatttgactaaatgatagaactaaatcaattaagagttaatgagactaaaatataaaataagataaaaatcagctacaaaggattcctacttgtggataacaacataaattaaatgtaatgaatgacagatttgtggactacttttagttaaactggtgattcaggtcaggggtctgtacttagcatagtggaagagctattttgcaagcccaacccaattaggttgaattttttttcttactgagagtgtttgataggtgataaaactacacgtaagaagagctctaatcatggtgctcctggtaataggaaaagaaaggcaattactcatgtgcaaaactagaagcaatcaaaagctagatttgccagagatgtttaggttttatgtgcaatttacagctatttacaagttaaccattgaaatgctgtccaaaattaactccgcaattgagaatccaaaatgtttagcatctaaactttttcctcagtaaaattcaatctttaaaattttttcttagtaataaaacattagtaatacacagttgattagaaatagtcataaacatttgattataaactattataagagtaattagtaataaacatttgatgataaataaagaaaaaaattgaaaacttacaactttggtcttagatactgcatttttgaaattccaagtaagccaacattctctgagacatcaaggtttttgtaacttttagtaaagtactaaaactggtagtgttatttttttactttcattcaatcagcatttaaaattcacaatttcagaaaaaaatggttaatttattccactatttcttctattagaagtggtaattttatatttgtcattagagatttcattttgagaatcttttgagttatcctactggaggaatacaaaccattaagaaaagatatacatttcaacatcttattcaatgtaaaacatcgtaagtattttgttaccattttcatagtaaaatgaaactcaagaagttgcttagtgtttacctgatataatctgtattgagtttagataactaaactaatatagctccaagtttcaggcttttgtttatacagcataagtatgcagttaatgcaaactacaggcttacagcttatctgcaaaacctgagcttttactttagttctgtatattaacataattccgcataccttcactctgagtacagaagtaaacattcttgcatcttcagatacacctccgatgtagaattttttctgaaacactgggggatgattattttcatcctgaatctcaatgtatactttagctgtattgcctggaggacaagaaacgatgcattttttattggtggttattcatgggggaaaaaatgcactgaagtaaatatttgctgcacttttttttggaaacattgaaaataaatcaaaagccatttctagatgccatgcctagcacccccaaattcaggggacactgataatgatgcttctggtataaaaatgttaagttgctgttatttcttttaattacaatgtcctggtagttcactttacttgatttaatttggcactaaaatactgcaccctgttaattttaatgaaacaactctactgttcacgttcacaaacacttcacacacaataccagttataccaaagggacacaaatatataaaccccttatgaaatagtagaaactgccataaactattatatgaatatatatttattcttaagtataaaatcagcaatggcatttctttagcttaaaattgtacaataacttttatgttttaagactaaaagtaacagtgttcgggtgaggtgtttatttccacaaatggaaaacaagttttatcatgccttggaaactgtcaatgttagaggctaacattcattgaaaacaatggagctgaagatatgattatgactcataaatgctgcattttaccatttaaataacagtaaatgtaccataaatgatatgtcatcatcaaatgttagaacctccctcaaatcatcacacctttaatgagaaatgtggtacttgtcactagtccaataatgaccttttaaaaaacaatttaatatgtataaaaataacttataaaccaaataaaatgggaaataagtggctattcattttgtaaaaaaatagtcaaataagtattgctaatgtattacataagtcgacttttctgattcatttcagttatgaacaaacggcaattaacgtacatactatttatcaaggatgcccttattttggtgttttacctgtgtttaatgcctcctgtacaattttaagtaattaacaccagcctacttgcaggatacatcatgggtatacatttgtatttgttgaataaattaatgaatgaatagcttgtattagtaagaacttagaaatagtcttttttttttttttgcttgcccttggaaaggtcagacagaacagtgagttaacctcaagattttgctcctatcctgctgctactcattcagcttttctctgtttgtcatctgtgacctggaagaggtagaatcaagaggaaaatcatgctagcgcaacagattagagaaccaacagcgaaatagggctaatagcagattatgcttctctatcctgcagtgccagggctctgacttgtaccttagtcagccaccacaaatcagaattcacccaaaatgaaatcatttttagttcagtagcagaccacttttatctctagaataaaaaatgcgaacagctctaaatttaaaaataaaaaggaattttagaatatgtcacctttccaataacttctttgcactttcattcagaaacatatacaattcaaatgtgctatttcttttcagaactcttagagtgacagaggtctcggaaaaatactgatgacgtatattttcttctttaaatgggatgagtcatttaaaatgttatacaatttgcaaagaacaagaactttgtcatgacctgttcccttacctcccaaccctaacttcatatctggatggtaaccaaatcctacatgtcagcctcataagcaggtaaatcatcacctaataaatatatcttgtgtcatttttctctcaactccacagctgcccatatacttaagtctgttgttgtctcacctgagtgactaaacgtcatctgctcccctgtcgtgtctttctaatgtgtcctgcattctgatataacaaagacatcacaaaatacaaataggatacattaaatcaaatgttaaaccaaccaccattcatatgtacatttttttctttttcttgttttttgagatggagtctccctctgtcgcccaggctggagtgcagtggcacgatctcggctcactgtaagctccacctcccgagttcatgccattctcctgcctcagcgtccctaatggctgtgactacaggcatgcgccaccatggctggctaattttttgtgtttttttagtagagacgggatttctccatattggtgaggcttgtctcgaactcctgacctcaggtgattcacccacctcggcctcccaaagttctgggattacaggcatgagccaccatgcctggccgacaattcttaaaaataccatgtgtatattcatatccatacttatatgtatactttgtgcatataagtttaagattcaaataccaaattgttcctatgaaagctcctttgattcagtggcctgtatcagatattaagtggtttgtgggaaaaggcctatggataacccaaaatatgattatataacctgaacataatggggagagatgattatacttaattataatattttaattaaatgatatttatttatatgaaaactaatgactatacaatacaaaattccagaatacttcacaaccagcacacaaacaaaatctcaagaacattgtttagacttaaaagaacttatacatttatttattttaaaaagccacgatcatttagttcttttcacaaaagagaaacagttataatgcgatttataacaatactgtatcatgaattttgaaatttatgatgttagctatatagctaattatgtaggatagtttgtaatagtcaactaaaaataaatataaagttgtgaaaaaggtgttttcattaagtttgtgacttagatgttagaataaaaaaaattgttaacttttattttccataatgtaaaatagactagtcttcctttttttttgcttctccctgataactttaggcagttgttatgtatccctcctttgaaatgctatagtgcactaaaaatgtttctttctataaataacctttccagagcttggtttacattgcatttagttataagcatgattttattcttattagatttcaatattcttaaagatggaaattgtatctcctacatctatcagtactataatgcctcagtttgtaggtaatttttccgctcagatattattgtaacaaaatttcttaatttttgttgaacaaaaaagttgatattcaattaatttgttagctttctttgattataatcatgagattatgattaactgaaacaaaaagttaactcttagaaggatatgagggagctcactaaatcaaagtgaagtaagtccaaagaaggcttttggtaccacaaaataatcaggaagttgtagagcctttaaagcagcagatgtttgattttcttgcagatgaaataacagcaaactctcttcttttatgttattttaccccaccccttattcctctttttttttttttaaagaaacaaaccaaaaaacaacccactaggcttaagaatcataccctggggacacattacctgactgtcctagtttgggtcatgtgcttgctccttgtctcgggaaggagaagtcaccagattatccacttgagaagtcactgggacaattataagaaattgtagtgtgtctacttaaagaatgtaaaataaatgttggccagtaagaaaaggaaaagcaaataagtatacacctatagttaaatcactagaacagcgttctttttgacttttttattcatgtgtatacaatgtacatgacatcatcaatttccttggctcacgtgcttccccactaaggattgtaccatgttcttccaccaaatttggatattgattatttcaaggcagaagcttggaagcaactctgatttaaattcttttaagatagcctgctttttatctccttgagtacttacaaaaactttttttccatgttgtatcctttatttaatgtagacatcaaacacataacaaaagaaagatactagaaagagaaaggaaagcacagatagaaaaataatgttaagggaacaacgtgcgtgcctaatatcctagtattcccctccagtctcccttctggctcatctaaacaatgcaagtattggaaagagaaccacaaacagtgaaagaaattacaaagtaggcaaaaaagttatttggaaagtgttttggttaagagacattataatttttctgtgtgctttggggcaccctgccttatttttcttccattattaacttttttctccaattttctatgggacaatcttttctttggctagaacttttggctttagtaagccagaagttttaaaaatgactcctgaggtaagaaaatgtgagataccttcttgcaatgttttaaagaaagagaaaataatacttttatgtagtcaagctcaggggaaaatgtaagtcttagtatagttacctccttgaatagcacttctgttctattttagacatttaaacatggtagaaggagttcagaagagtgattttaaatacccattaacctcaacttgactctatgatttttaagaccaaatttagtttgatttttcccttcccttacttttaataatcaagactgtgatgctagttttttctttttaggaaggccctattatcctcaagatgaatccatttcatttatccacatgactaatctagtgcctacactgcactggattttcaaagaaagccttactgaataagaagccaatgagttaaaagtgttctcaactgggatcaatttggctgctctagagccatttttggtagtcacaacagtgtggataggggaacgtagtgctactggaattaaatgagtagaggtcaggaatgctgagaaatattctgtgatgaacagaacaggctcttaccccaaacgaacaaacaaacaaacaaaatatttgggccaaaatgccattagtgatgaggctgagaaaccccaagttaaataacaagagaaagaggaattagatgagttaagataaaatggaaagtttccaaatgctatagtaataccctctcctcaatccatctgcatgcacatgcctttaatgtggaacttatcaaaatatgctgtaattatttgatcacacattggttatactcttttttgactgtgtcctataaagtcaagggctcaagcctgtttacctccactcttgtcactgccttctggcctctgttcctgacattctctccatctaaaatattcttaattccaagccatttctctagtcattgccagtaaatatacatcacagaaatatttattcctgtacttgggaatgtagaagtttagtctgattaaaaaacatacactagactatattttcctcaaaccttaaaggaaaggactgtgcttttcttattgttacgtatcgttgcctaacacattaaatgatttttaaaattgttatcatgataaatgatttatagattcttcaaacagtcctattgcagagaattttttaaatgcttggaataccagatttatatttgttaatttgttggtatcaggagattgaagtcagttcctcactttaaaaacacacaaacaattttttatgctgtttttcttttaagacaatttttgtttaagctttacgggtatattaattatggaagcattgtgacttccacatagtaggtgatatggtttggctctgtgtccccacccaaatctcatcttgaactataatcctcacgtatcgacggaagaacctggtgggaggtgatcagatcatgggggcagttttccccaatgtgttctcatgtagtgagtttgcacgaaatccaatggttttataaggggtgcttccccctacactccctctttcctgctgccttgtgaagaaggtacttgcttctctttccccttccaccatgattacaagtttcctgaggcctccccagccatgtggaactgtgagtcaattaaatctcttctctttataaattacccagtctcggttatttctttataccagtgtgaaaacagactaatactgtaggtgttcaataaatgttaaattaaattgtaattgctaccacttcactactcccaagggtcctcttaaataaaataaattactctattttattcctgtaaattaaatgaggtaacagatttttaagcatttaaaaatcaaataacagacacccccattccaagacagctgaataggaacagctccagtctgcagctcccagcgtgcttggcgcagaagacgggtgatttctgcatttccaactgaggtacctaattcatctcactgggactggttggacagagggtgcagcccacagagggcaagccaaagcacggtgggacatcacatcacccaggaagcaaaaggggttgggggatttccctttcctagccaagggaagtcatgacagattgtatctggtaaatggggacagtgccacccaaatgctgcgcttttccaatggtcttagcaaatggcacacaaggagactatacccacacctggctcagtgagtcccatgcccacgaagccttgctcactgctagtgcagcagtctgagatcaatctgcgaggcagcagcctggcagggggagaggagttcaccattgctgctgcttgagtaggtaaacaaagtggctggggaagcccaaactgggaggagcccaccgcagctcaacaaggtctgctgcctctgtagactccacctctgggggcagggcatagctgaacaaaaggcagcagaaacttctgcagtcttaaatgtcctggtctgacagctctgaagagagcaatggttctcccagcacggtatttgagctctgagaacagacagactgcctcctcaagtgggtccctaccccagtgtagcctaactgggaggcacctcccagtaggggccgactgacactgcatacaggtgggtggctctctgggatgaagcatccagaagaaggaccaggcagcaatatttgctgtgctgaagcctccgctggtaacacccaggcaaacagtttggagtggagctccagcaaactccaacagacttgcagctaagggacctgactgttagaaggaaaactaacaaacagaaaggaatagcatcatcatcaacaaaaaggacacccacaccaaaaccccatctgtacgtcaccatcatcaaagaccaaaggtagataaaaaccacaaaaatgggaagaaaccagagcagaaaagctgaaaattctaaaaaccagagcacctcttctcctccaaaggatcacagctcctcacaagcaatgaaacaaagctggatggagaatgactttgatgagttgacagaagtaggcttcagaaggttggtaataacaaacttgtccgagctaaagaaggatgtttgaagccatcacaaggaagctaaaaaccttaaaaaaagattagacgaatggctaactagaataaacagtgtagagaagaccttaaatgacctgatggagctgaaaaccatgcacgaaactacatgacacatgaacaagcttcaatagccattttcatcaagtggaaaaaagggtgccagagattgaagatcaagttaatgaaacaaagtgaaaagagaagtttagagaaaaaaagagtaaaaagaaatgaacaaagcctccaagaaatatgggactatgtgaaaagaccaaatctatgtttgattggtgtacctgaaagtgatgaggagaatggaaccaagctgagaaacactcttcaggatatcatccaggagaacttcctcaacctagcaaggcaggccaacatacaaattcaggaaaaacagagaacaccacaaagatactcttattccaaaattgaccacatagttggaagtaaagcacccctcagcaaatgtaaaagaacagaaatcacaagaaactgtctctcagaccacagtgcaatcaaattataactcaggattaaaaaactcactcaaaaccgcataactacatggaaactgaacaacctgctcctgaacgactactgggtaaataacaaaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaattaaaaactagagaagcaagagtaaacaaattcaaatgctagcagaaggcaagaaatcagagcagaactgaaggagatagaaacacaaagaacccttcaaaaaaatcaatgaatccaggagctggttttttgaaaagatcaacaaaattgatagactgctagcaagaccaataaagtcttgcaccatcacaagactaaaccaggaagaagttgaatctctgaatagaccaataacaggctctgaaattgaggcaataattaatagcctaccaaccaaaaacaaagtccgggaccagacagattcacagccaaattctaatagaggtacaaagaggagctggtaccattccttctgaaaatattccaatcaatagaaaaagagggaatcctccctaactcattttatggggccagcatcatcctgataccaaagcctggcagagacacaacaaaaaaagagaattttagaccaatatccctgatgaacatcgatgtgaaaatcttcaataaaatacccgcaaactgaatccagcagcacatcaaaaagcttatccaccacgatcaagtcagcttcatccctgggatccaaggctggttcaacatacacaaatcaataaacgtaatccatcacataaagagaaacaacaacaaaaaccacatgattatctcaataaatgcagaaaaggcctttgacaaaattcaacagcccttcatgctaaaaactctcaataaactaggtattgatggaacatttctcaaaataagaggtatttctgacaaatccacagccagtatcgtactgaatgggcaaaaactggaagcattccctttgaaaactggcacaagatagggatgccctctcttaacactcctattcaacatagtgttggaagttctggccagggcaatcaggcaagagaaagaaataaagggtattcagttagcaaaagaggaagtcaaattgtccctgtttgcagatgacatgattgtatatttagaaaaccccattgtctcggcccaaaatctccttcaagctgataagcaacttcagcaaagtctcaggatacaaaatcaatgtgcaaaaatcacaagcattcctatacaccaataacagacaaagacccaaatcatgagtgaacttccattcacagttgcttcaaagagaataaaatacctaggaatccaacttacaagggatgcgaaggacctcttcaaggagaactacaaaccactgctcagcaaaataaaagaggacaccaacaaatggaagaacattccatgctcatggataggaagaatcaatattgtgaaaatggccatactgcccaaggtaacttatagattcaatgccatccccatcaatcggccaatgactttcttcacagaactgggaaaaactactttaaagttcatatggaacaaaaaaagagcccacatatcccagacaatcctaagcaaaaagaacaaagctggaggcatcatgctacctgacttcaagctatactacaaggctacagtaaccaaaacagcatggtactggtaccaaaacagagatatagaccaatggaacagagcagagccttcagaaataacaccacacatctacaaccatcttatctttgacaaactgacagaaacaagaaatggggaaaggattccctatttaatgaatggtgctgggaaaagtggctagccatatgtagaaagctgaaactggatcccttccttatatcttatacaaaaattaattcaagatggattaaagacttaaatgttagatctaaaaccataaaaacctagaagaaaacctaggcaataccactgaggacttaggcatgactaaaacaccaaaagcaatggcaccgaaaaccaaaatagacaaatgagatctagttaaaataaagagcttctagccgggcgcggtggctcacacctgtaatcccagcactttgggaggctgaggcaggcgaatcacgaggtcaggagattgagaccaacctggctaacatggtgaaatcccgtctccactaaaagatacaaaaaaaaaaaaaaaattagctgggcattgtggtgggcgtctgtattcccagctactcgggaggctgaggcaggagaatggcgtgaacccgggaggcagagcttgcagtgagccaagatggcgccactgcactccagcctggatgacagagcgagactctgtctcaaaaaaaaaccaaaaaacaaaaaacaaaaaaaaacaaagagcttctgcacagcaaaataagctaccatcagagtgaacaggcaacctacagaatgggagaaaatttttgcaatctacctatctgacaaagggctaacatccagaatctacaaagaacttaaacaaacttaccagaaaaaatcaaacaacaccgtcaaaaagtgggcaaaggatatgaacagacacttttcaaaagaagacatttatgcagccaacagacacatgaaaaaaggcccatcatcactggtcatcagagaaatgcaaatcaaaaccacaataagataccatctcacaccagttagaatggcaatcattaaaaagtcaggaaacaacagatgctggagaggatgtggagaaataggaatgcttttacactgttggtgggagtttaaactagtttaaccattgtggaagacagtgtggtgattcctcaaggatctagagctagaaataccatttgacccagcaatcccatcactggatatatacccaaaggatgataaagcatgctactataaagacacatgcacacgtatgtttattgtggcactattcacaatagcaaagacttcaaacccacccaaatgtccatcaatgatagactggattaagaaaatgtggcacatatacaccatggaatactatgcagccataaaaaatgatgagttcatgtcctttggagggacatggatgaagttggaaaccatcattcttagcaaactattgcagggacagaaatccaaacaccacatgttctcactcataggtgggaattgaacaatgagaacacttggacacaggggagggaacatcacacaccagggcctgttgtggagttgggggctggcggagggatagcattaggagaaatacctaatgtaaatgtcgagttaatgggtgcagcaaaccaacatggcacatgtatacctatgtaacaaacatgcacattgtgcacatgtaccctagaacttaaagtatataaaaaaaaataaaaacaactgcatgttgtttcaattaaaagcaatctattacaaacaacagatttctctaaaaagtttaactttaggaaaatattgactctgaaaccattttggaatttgatgggctatttgaaaacatcttgaagattctggtttttatatcattattaattgtctttatgttcccctgttccagtttgtattctggataatatctggttctataggcaaattaatgtttaaaacaaaatgatcatctgagataaatgcttaagctgttcttactaaggggtttatagatacatatttttgaatatacaggtggaaatacatatttttactacaaatagaataatttatcttaatttgtgtatttttaagttattcactaaaaatataaagtagaatttgagagaaaagagagaaatatgttatagtgtgcccactagacagaattaacaggaacaaaatatacttacaaaacatttagaaaataaattattaactgtattagcatgagaagctcactggttcttctcagcttttgctctgcagagattatatttagctatatttttatatactattcattttcagtggctaggcagaaagatagattgatcttttgtggttcatttcaatagttttcaaatttagcttggacatttaattaattagcctttgcataatattaattgcttgtatctagaagaaatattttgtgtatgtgtttggctgataggttaataactgaattgagtaaataactgctgtcactactggctccaaaatgtgacattcatatttccttttttttgagacagtctcgctctgtcatccaggctggagtgcagtggcacgatcttggctcactgtaacctccacctcccgagttcaagcaattctcctgcctcagcctcccgagtagctaggattataggtgcccgccaccatgcctggctaatttttgtatttttagtagagacggggtttcactgtgttgtccaggctggtctcaaactcctgaccttgtgatctgtcgcttcagcctcccaaagtgctgggattacaggtgtgagccactgtgcccggcccgtatttgtataatatataatacttgattttggctaagtcttttcatgaagaaaatgacaacactgacactttgtcattcctcagtatctgtgggggattggtcccaggacccccttctgataccagaatccacatatactgaagtccctgatagaaaatggccatagtatttgcatataacatatacacatcttcccatatcaatcatctccagataacttataatacctaatacaatgtaaatgctacataaatagttgcatactatattgtttaaggaataatggcaaaaaattctgtgcatgttcattgtagacacaaccatccatttcttttctgaatattttccatctctggttgtctggattcacgaatgcagaacccatggatacagaatgccaactgtatagtcatgaggaaataatcaggaaaaaacagtaatattctaagtattacttaaattttggttttgaatccattttaacatttttttcctcctggaaagattttatgactaaatttatctgcaaattgtaatcaccaaaataggagttaaggatgcaaaattgtttgttttcattggtactgccaacattttgttattcctgagttcaaacggatacatttaaaagcctctgcaaccaaatgactgtgacttttagctcagtttctgtgagaaaaaaagacactattttaaatcatttttatttattaaacactagctctctacaaaaagcagctattatgatattacaggactataatgatcaacaaaactgtagtagttgtaatctgggcaataaaactttaagcataaactttggaagcagagcctgggtctaacctgataataccacatgtatgctgtgtgaccttatacaggttacttactctctctgaggtaaagtttcttattcataacatgatagtaattttacataaataaccagattaaatgagcaaatatatgtaaggcattaaatacatggtagctttactatttcatatatgcctcagagattcctggctctcaaggcaggagggagaaaatattagtaacattattactaataccagaaggaaaaaaaaataccaatagcatgaaattgaaacaaaatttcctagcactaaattttaaaagaaaatggtttttatatgagatatataggaatatagtacacatcaaataatgtagtggaaaatacatatttttagtgcaagtaaaataattttatgaaatcataatgaaataactattggaaaacatatgaaaagtactgtgtcctattaaatatgcatacttttgtttacacaagaccacaaatttatagaaaatttatttcaaaagctgagagttcaagaaaatcagacagtatataatatttgacctaagactattccactgataatacaagccgaataggaattattgtacactgaattgcaggatcatagctgaggaagacaaaattattatgtctgaatagaccattaaatgacctctgaattctttgacatataattaaaaataaaagcatatttatgccccaaaactaatgctttgtttaaataaaaaaagatgaataaatttactaaaataaataaacaagctaacagaaaaacaatcaaagatgcaaaaagattgtgttgtggaaatgcaatttgctaagcacttgaaaagatacatgggctgtagttattgtcacatgggcagttttgaactttcatatatgcacctaaacacagacacacacacaacagatattaacactatgttcttttttttcttgagactataaaggagctgtttctaaaagataagagaagaatccatcaaaaagaaatgaacacactgatacggtttggatgtttgactcccctgcatctcatgttgaaatgtaatccctagtattggaggtggggcctggtgggaggtgcttggatcatgggggtggacccctcgtgaatggcttagcaccatctccttggtgatgagagatttctcactctgagttctcaagagatctagatattgaaaagtgtgtggcacctccccctccctcttgctcctgctctggccatataacgcactggctctcccttcactttccaccatgattggaagcttcctgaggccctcatcaagagcagatgccagcaccacacttcctgtacagcctgtagaaccatgaaccaagataaaatatattttctttataaattacccagcctcaggcattcctttgtagcaatgcaagaatggcctaatacacaaaccaaatatggttttccatatttaatgggaggaatggaaggtgcgttactctttcttgaagagtttctctacattagacattttacttccaatatttctttaaaaaccttgcaacaaatccatgaaataggtattttcattctgctttgtagataaagaaactgagactcaaggagattaaagaactagtcaactattatacagaagagccagacttcattcccaggcatggttaaattcatgcccaggtttctctccctagttaaaacaagatttgtaataacagcaaaggtaaattccattagacacttttgctcagcttctagaatacaggcaatcaaatagtagtactgaataaagaattattgaataaaacgatacgtctatttcaaaagacagacaagtacagttgccccttctatatttggatatcaactgaagagttattacaaatgaattaaaggatttataaatgtctatggtattgttgaaggaagagaaaaaaatgcctttcaaacaatgtgctaaattatttaatgctgctcaaataggcgcctctgtcctttaatgcaaatacacaaacacacacacacacacacacacacacacacacacacacacacacacacacacggataccaccatagcttcctattgcttctgtaatagattacggcaaaattagtggtttaaaacaacaccagtgtattactgtatagtttgtaggtccaaatgggtctcactgggctaaaattaagacgtagcaggtctgcatttctttctagagcctctagggctgtatctgtttccttgtcttttctagcttctagaagctgcctgcttgcattccttaagcttagtgtcctttcatcagtcgaatctagcaatggccagtggattcttctgttgcatcagtctgacactgactgtcctgccttctttcacttataaggattcttgtaattgcattgagtccacccagatagtccagaataatcaccctatattaaatccttaatccaattacatctgggaagtcccttatcttatgtaaattaatatcttcccaaatttcagagattagggcatagatgtctcaagagaagggggcatcattctgcctacaagaggcatattattgtgttcttttcaatgtaaaattcgaaggatctactacatttaaaaacagaaatgtgttaggatgttcccaaatgacaaatttaggaaaaacaaaattctgttttaatacaaatatgggagctctcaagctctttttatgtgcaaacaacatcactgacagaaagctttaatggtaatactaatcactgagaagtttctggaccaagtgttttctgtgcattatttcaatttactcctgtaataacattgtacatattattgattgtccacattttatcaatgaagataatgaggcttggagggattaaataacatgtctaaaattactcaactaggagaaggcataaataagattcagactgaacccgtaacaacatatagatgtaactatttcactttatggccttaaatttgagtcattttttaaaaacctgaagtaatccttggatttgtgatttatggggagtggggagcaaggcggtttatttctatagtgaaaaaaataatttatttgtatttaggtattaggtatttaggtatatacttctatgcctaggaccacaagaaaaatgaacatttcactgggaaatttctaaaactttctaagtttttataaatacccaggaagccaagaatatagattgctagaatggggacagggaaagcaaacctacttctaaactgcatcaggaaaataatttaaggaatatgtagataatctggttggaattaaagcctcccagtggaagtatttctatatgccttcatttgaaaatatctctttcgctcacctcataacagcttgaggcaaagtaaaaacagtatggatacaagatgagaaatcccatttctataaagttgaggactttttcatcttgcacaaggcggttgaatacaagggcctgctttctcatgtataaactgtagacaaacaataagattactgtgatgattaaatgtcatcataaacaggtatatgtttataatcaccatacacctataaaacattagaattgtctataaaaagtgaaaagtgttatggcatatattctattttcaaaacatttgcatcttttaataaaaatagtggataaattatgtaaaagtgcatataagtgtatgtatagatactatataagtatatattaggatattacaatataattgaaaaagatatataatttaaaaaaatcaaaatcacgggatgatagattattttaattttcttcttttcgtattttatttttattgtatataatgataagtactgcttttctaatttaaaatagttaatgttaatgttatgatggaagactagaagtagagcggaaacagaagtcataaagcatacgtacacgaaactcttgaactttatctgttcctttctatgccttttctaaaatatctctttcatctaaagaacctgtggagatactatgtgcaaatcttcattttcttttcctccatcaacaagccctggcttacgctagtaaagcatacattttttttcctcctgaaataaaataagaattttcctgcttgtttgcgaaatatttccctaggtatattggatttactcgtgaagattcaaccaagaagcaatgaataaagagagaagtggccttgaaaaacacagtctaattattatttatctatatatctttgctgtgttcattagtcatatggtatacaacatattaaataattcattttttgcacaaattttagaagtaatataagtggaagcaatttaactacaactacttagtgtaatgaacattttaaattgagcttttggaaagtgcttaattaatacttgtaaaataggggttcacagttcttgcaatatgtcattaagtccaagcattatctttaatcttctcccaaacttctgagaggagaaaatagtttttgaagcaacacaaattgataaaccttcaaaagttgaggtaatcagctacttacatttttgagcactagtcacagtataaatggaaattaaaattccattatgacataaagtaaaaatttagcactgtaagtttcaagtaatatgccacccctctacaccaaccttaccaagcacttcattcaaccacatttcagccctaatatgactttttttttatttgcctaaacagtatcacttcctcctttattttggcctcagaagtccattttccctccttggtttactattacctccacattccatgagtccttaatagaaatgccaactattgtactcttcacttcacccctggccaaggatacacagctcaagccaggccaatcagattctctcaccttcagatgtgtgatccttgaactgactgccagttgcttgaaggtcattgacctcagctttcttaatggcactgcccaaaaaggaattgctacttgagtttctaagattgctgaagcctctccatgtttttgtttttccttagaccctattcaatttctctcttgctgtacaagccaccaagtattcttctgatatgattcctttagtataagccagtcagaagtggtttctgctgtttccaacttactaaccatgccaaaaatagtttggaatgaccaatttagttcatagcagagaatggacaccatacctccctatttatggaaaagatactggattttttcctcccaaaagacattatgaaatgtagatttttcattttgtgttgcaaaatttaatcaagtattaaattttagtatattttcttttttataatcatggattttacatcattttaatttttttttgaagaaagttgtctttgtttatgtatatacattatccggttgtcaatcaaggtaggtgtattcaaatctaaagccctcagaagatgcctggctgcttttctaacatgtcacaacctacaatccctggtaatacagagaattcagaggaaaatatgagatatctctctgtacacttatctaaaggagtagatgaagcatatttagtatgtgcttattataattttgtgtggttcgaacatatcacagctagcagtagtaataaaaaatacctttttatagagtatttcttatgttacaataagttaagtacttttctgatatgatagtccttaaaattctcaaatacccttatgaggtgtagacatatttaccctaagagaaagttgaagattataaaggttagagaagtttgtaaagatcagaactgggtatggaattcaggcctgtctgataccaaaatcatggatcttaagtaatttcatatatacaatttttatgtatctactttttctctgcttttctattaaggtaattttaaatgggaacaacttaatggtttaataatctgtgttacatagaattttccctagtatagatttttgataaaatttctcctttactgtttgtcctttaaactcaggcatatctgagcatttatgaaatatcatcaaatagggatcatttagaagcaaaactgaaccactaaactggttaaagtatccaactttcttgtgtattttaataaaacacaaatataggtcaggtgtggtggctcgtgcctgtaatcccagcactttgggaggctgggggtgggtggatcacgaggtcgggagatcgagaccatcctggctaacacggtggaaccccatctctactaaaaatacaaaaaataagccgggcatggtggcgggcacctgtagtcccagctactcaggaggctgaggcaggagaatggtgtgaacgtgggaggtggagtttgcagtgagccaagatcgtgccactgcactctagcctgggtgacagagcaagactccgtctcaaaaaaacaaaacaaaacaaaacaaaacacaaatatagcaatctctattaaacagtcttgatggcaagcatatgctgtaagtaaataactagtaacaggctttcaaaattgaaagtgacagcttttaaaataatgatttcctctaaactgcttgtctgtaattatttttaagatattacataggggactaattaggtacaagataccaaaagggataagaacaggaacaagattgattaattgaacttacgaaagttcctgggaataaaaaatgaattagattgggaagaactgactacgagacttgtgttctgaataatgattaaaaagaatgacaagctaaatttatgtttcttatctctgaatcataaaattctgtttttgcttttgcattgaagcaatgtgtacattaaattgaaatgcatgccttataaaatgtaaacattaacaaaattagggaatatttaagaataaattaaattttaaattgtgaagataaaaccaagaaatcttctacctacttaattcccatgttttcttccacatacaagccctttattatttatttggcactagctatagttattgttggcccaagttaactattatccaacatactttctttagtcataatttttctggagtatctgcaacatttgatgtttcagccatttttgacttttcttgaaaccctcttctcctttggctaacaggtcatcactacataaattgtactcattttttccactggtctcttaaatggctattcttttcctctcattcactaaatggaagagtttttctcaaactcagtctttcatttttctctcttgacagcctcagaaagacaaatgagatggggcctcaagggacaataatttttttttcttttgacagcttaatttggtcattgtgagaggttacagcctgctggcagccctcgcagccctcgcttgatctcagcacctcctcagccttggcgcccactctggccgcgcttgaggagcccttcagcccgcggctgcactgtgggagcccctctctgggctggccaaggccggagccagctccctctgcttgcggggaggtgtggagggagaggcgcaggcgggaaccggggctgcatgtggcgctcgcgagccagcgtgagttccggtgggcatgggcttggtggactccgcactcagagcggccggctggcaccgtgggccccaggcagtgaggggcttagcacccaggccagcagctgcggagggtgcaccgggtcccccagcagtgcaggcctgccagtgctgcactcaaattctcactgggcctcagctgcctccctgcggggcaaggcttgggacctgcagcccgccatgctggagtgtccccccgccgtgggctcctgtgcagcctgagcctccccaacgagcaccaccccctgctctgtggcacctggtcccatcaaccgcccaagggctgaggagtgcgggtgcacagcgccggactggcgggcagctccgcctgcggccccagtgcaggatccactaggtgaagccagctgggctcctgagtctagtggggacttggagaacctttacgtttagctaagggattgtaaatacactaatcagcactctgtatctagctcaaggtttgtaaatgcaccaatcaacactctgtatctacctaatctggtggggacttggagaacctttatgtctagctaagggactgtaaatacaccaaatcagcactctgtgtctagctcaaggtttgtaaacacatcaatcagtaccctgtgtctagctcaaggtttgtaaatgcaccaatcagtgctctggggttttggagaacttttgcgtctagctcagggattgtaaacgcaccaatcagcaccctgtcaaaacagaccaatcagctctctgtaaaacagaccaatcagctctctgtaaaatgtaccaatcagcaggatgtgggtggggccacatgagggaataaaagcagactgccccagctagctgtggcaaccagctggggtcctcttccacactgtggaagcttcattctttcactctttggaataaatcttgctgctgctcactctttggttccacgctgcctttatgaactgtaacactcaccgcgaaggtctgcagcttcactcctgaggccagcgagaccacgaacccactgggtagaatgaacaactcctgatgggaggaacgaataaccccagacatgccaccttaagagctgtaacgcttaccgcgaaggtctgcagtttcactcctgaagccagcgggaccacgaacccaccagaaggaagaaactccgaacacgcccgaacatcagaaggaaagaactccagacgcaccatcttttagaaccctaacactcaccgcgagggtccgcggcttcattcttgaagtcagtgagaccaagaacccaccaattccagacacagttggatctgagttagcagaatggatctaaacagcatttctccctgatacaagcttcactagctcatctcctcttaaagagatcattgcctcgacagggaatctcctatcattacactgccagtggatttttgtttgcctttatttccatatttcctttatatttgtagagtaatagtgtttccagtccctggtttctagtcttgagccctttctatggtgtgttcagatgtgtgcaaattaagtttttttctttgtgcttatgggaggtcaagagatactttttcctttgatgctttctttgcctggttttctcacttaagcctcattattttacatttgtaccacgtgagactagcgacgcttggcataacaattccttgacttaagtactcatgctatatgattttttttcaaaacctacctgtcagtcttgaacacctttggaagtccagttccttgtttcctgcaagtttttatttagatcttattcatgtcacccaagatcaaaagtataaaatcatccttgatttcttcctttctctttataaccagtcatcaagtcctaccaacttctcttttgcagttgtcctatattttcctcctctcactggcccaatcctagttctagtttgggactggcctatttatccaattctttttagcattcattctatctctctccaagctattctacatactgagctaactttctcatgttaattccctgctttaagaaacaaaacaaaacaaaaaactgcaagcagttaatcttcctatcagtatttcaaatagttgtgaagaaacaacaacaacaataaaaacagtaaatattcagatttccattttccatttccagatatcttaattaagtaggtttggaaaagagatcacaaaaatatgtattattaaacgagtatctcaggtaattatcaccaggtagttcaaacagttgctttatgagaaacactattttatgattcttttacttatctacttcctttttctcttcactaacttttgtttaccactagggcaattcactgtcttctgaagccactttcaaccaattgccaattagaagaattttaaatttatacaaccaagctgcacctcaaccaccttgggcacatgttctaggatctgagggctgtgtcaagggccatggtcactcatatttggctcagaataaattgcttcaaatgttttgcagagttcgaggtttttcactgacaaagctactctaatttcaaatcatgcatgtctatgtctcttgtatatcaattagtcatgtacttcatgctactacttattgtttatacctatgttatagcttctccaccaggatagaaacttctttaaagcgctaatctcaccttgtggatacgtatccccttacagcacttagaacaaatatgtgatatatatttgttaatttaacatacttttcattatctctgtagcacaaaaataatgtttcaggggccatgtgacaaaaaaacagaatcatattagatgtgcctcaaaaataaagggaacagagttgttgaaagtgaaataataacttaaaaagtactagtctgtttggaagttttgtttatatgtaaatgcaagtgtgtgtgtgtgtgtgtgtgtgaatgttaacattagtcaaagagtaagaagaattacaaggggacccacaaaacctttaccaatccatgtaatgttgtcaaagataataagtaatatctaatttcaaaatcaaaggagcattgtcccagtcattctttaccacttttaccttttaccttggaatacactaaattccattgtttgcccatgtatctattattttattaccactttatatgtttaactcatcaaatgttcttgcaaatctgatacaattcacaattcactgtgaagaattataaaattatactgttattaattagtccaggtcaaaatcagatccattttggacaaaatcaatcatgaaaatatatggttaattataatgtgatcttttatataaacgataaatatcaaaaaggtggagtagtacaacaatagatattataacagcgtttctttgaaagcattagaacatggcatcaaacataatttactagacaaattctgtattgtgcaggaaaaggagtatttactattttctgaaatacatctttcatcttcatagtgttatctatactattctcttctttgggatctatctcacatttttatcttctctgctatcatccacacagcacctgtgataaaatctgggacaaaataaaattgaataatactacatctttttatttgaggagaactcacaggccagatgtatttgttcttgtatgacagggacaatgaatgattaagcaaagtctcaaaaatgagatgacctttaaactgacccttgtagaataattgagttgatctgaaaaacaatgtagaaaggacattttaaaaagagagacttgtgcaagcaaagacatttaggtatagacattccttgaggttaagtgaaaagaatgcaatgaatatagaaattcagaaaagcagttacataggatatgcccagtagaacttcagagactggtgaagttgagacaatgaaaccttctgaatgttcactcctatgtacatcttttctatatggcacttttccccatatttctttttattatgtaagcataatgctgaatttattttcgtctatttaatgagaagctttttttttcttctttcgatagtcaaccagtaagatcagctacttgttaaagttgggaaaataaatattttactaacagaaaaaattgcattatccataagtgataaaaataaataaaaaccaatctaataactatgctaaatctttagcaagttattactttaagtgcagacctgaccttgattatattacaacagaatggggatagccaatgcctacaaccataatcaataatgaagaattaattctgataatttccctcatatctatcaatgttaaactacattttatgcttatgttattcatgtagttgcatctgttttctatttctgcaaaggttgttatttctgtaacataagtgacttaatagattccagttcttctgtgcatagtttcatttgcatttaatagggcttagtgtgcctctactgaaataggagtttttctaaagcaagaggtttagagtgactgttgtatcactttggggcctcattattaatcagtaattaatactctctggaaagcataagtttgccaaaatatttggcattcaatgaatggcattttgaatcccaatttaaatttggactaaaaaggcttagaaaaaaaatctaaattatttactatattaattataagtacgtttccaagaatgaagaaaactgtatcttctctctttagttccaggcttattcttaggtataagaaggagaactattttatgcattcctagattcttaaatattttaattttgcttgcccatggcagcaatatgtttccgtcatgaaatatatattttttctcatatatgcagaaatgtaatatttttctattttgaaaagtctgattatatatcattgtcatcagttcagcaaaccaatttgggatcaatggaagagcactgcctcaatgcatttggtttcagaaatgtattaataatagtgtataccatgtttcaaatcacatttccaaggaaacctattgtgcacaatgcaattttttcttggacagacaattttatgctatgagtccactggaatacatttttgtttcattgaaaatataattttttcaaccatatatttatataagatgcctaaaatttctgaaagaaaaaatgctgttaatgatattatcgtgttaattttcataaactcctctccatattttaaagtaatacattattaatatagtttctaaaacagtggccatatatttgtactataaatataaggctatgatcattcctgggattttaggactaaaaaataatatgtgacaggctacaatattgttacccaagttatagcagggatacttttgttttaagtcagtcaatcataggtaaagagtcattagcattatttgtcacagaccttctgttagaaaccacaaaagtcagaagaatgaaatgtattacaagcttgtaccctacagctaaaacataaaatgaaatcaatagcatttgagttgttttaccctcagtttaaagtttatcttaattgtcttgtaatttattcctgattgaaagtctagttattgaatcaaaacacaatgacatatttatagaaagctatggctttcttttttcatgtttaaagataattataattttaccataaagcaaaaattgccacttcaattatggagttacataaatcaatctgtgctgtaaacttgcatgttactgcttttgctctacataaaagaatgggaatgactctgtggcacaaatattaacataagcttctatagatgttctgggtacaggcttcttgaagcttctttgggaccaagtaacattatatcctaaaaacccaggagagtttgagtttttctgcaaagaaagagactatggataggaagaaaagatgactcataattttgaaataatgtattagaaatagcaacgcattcggctgggcgcggtggttcacgcctgtaatcccagcactttgggaggccgaggcgggcagatcacgaggtcaggagatcgagatcatcctggctaacatggtgaaacctcgtctctactacaaataaaaaaaattagccaggcgtggtgtcaggcacctgtagttccagctactcgggaggctgaggcaggagaatggcatgaacctgggaggcggagcttgcaacgagctgagaccgtgccactgtactccagcctgggtgacagagtgagactccctctcaaaaaaaaaaaaaaaaaaaaaaaaaaaaagaaatagcaacgcattcacatttgtctttccttttgaaactagtccaacagtcccacagacagttgttttcagataaacacagagattggctcttctgctgctaaagcttaaaacttttatttgttttatctgagctctttcctcagcaaaggaggaccttcaggcctctgaaaaaagtttcagttatttgaaacttaccagatcactgccccagaggcctccttgctcctccccagttcttgttttcttacactcttacgtttcttccctactacataaaccccctagctttagtcaatcagggagatggatttgaaactgaactcccatctcctcagcttcaacacccgattaaagccttcttccttggcaatacttgttttctcagtaattggctttctgtacagcaagcagcaggacctagaccaaactcctggtgtttcattaacactttgtaaaaggaagataattatttgatcaaattagtggtcaatatgggagtaaaggaagaaaatacggatgcttaacagaatgagacaggaagaagagataaaatgtagggagtctagagggccagaaagtttgagtgcaggaagaatgaaaaatcaacacctaatttctaactgaattgaagagagagaaaactccaaagcttttcagattccctgcaatttcaagtactgggaggaagctcctaagcacattcccatgattaaaacagtgtactgtctccatctgtaataatgactaaaccactgttatgaaaaggctgcaaatcaggggtggtgaggtgggagtgggcagaactggagcttagttagcagtcagccatcaggtggattgtatgagtggtatgtatgctacaaatttgcatactgttagcttgatatttaaaacgcttcacaatctggccttaattttccagactcactcatgcattggacaaatctttattgggggtatttatgtgccatgcattttaggctattgggatacatcaataaacaaaacagatacaaacttctgtcgttgcgcagactaaatccattttaacaatatccactaaattctgttctacagtctcactgaaacaatattcttaatatgaaaatatagaattataaaactctattattttctttcatactatctctttaatcctgctaatatgggctaatatctttcctgctgttgaataaaagctcaagaaattttataatttttaaaaaaattgttaatagtactatggtaaaggtaactttaaaaagaatttaaaaatgattctctagttcaatatatgaatctaatactccaaatttcatttaaaggtaaaatgtccttccccagcttagatatgttaatggaagttcctctgcctttggggaagaggctgtaagagatttctttttacttttttctttattaactaccaccacctccttcattcactagcagttgatttttatcactcagacttctattacctgaccttggagattatggagaaaaggcatgtaaggtaggtagcgaagttcctacttcaatattactgttgtgaaatggctgaatactctttgggtcagacctgggtttaaaacagacatggtcaatgagagcatcttcagcactggtatgcttttcttcagcaacttcagtttgccagcatacttcagttaattccagtttgtcattttataggaattctgcggtctatgtccagtttttgccttttgcagtatcatcactccttcaggtaatcctaccgaacaggatttaagaaaactggcattcacctgtgtcccaaatctggtcctttgggttggtttgggtataattatgcaggcaaagaacagtcacaggctctttgcctgcatacttatagaagcacagacctttctagatgtagctgtaatataatgtaatactccagtcattgtaattgcttgttgctctttttctgtctacatttatctgatatgtctcaaacatggatttgctgtgctaggccaacataagggcagcgttttttactgtagttgccaatgttaaacttgagaagggaaagcatatatttccccagccattgtattttggggaaaagtatactgttgaagtgaattcaagtacaactttacaacaaccctcccctataaaggaatactcatacaaagtcacttctaaattttaattcgcgtgaccattttcaattctcctcgagagtaatggtgttcagagtgttaaactctgttactggaacatgatggttttggtctaggttctgctgcttgccacacagatgggcaatcactgagacaatgagtattgctagggaagaaggttttaatccaatcgggtgctgcagctgaggacatgggagatcagtctcatggagacagatccctcatggcttggtgttgtctttgccatagtgagttctcacaagatctggttgttgaaaattgtgtggcaccttcccccaccactctctctctcccttgctactgcttttgccatgggatgtgcctgctctccctttgacttccaccacgattataagcttccggaggtctccatagaaccagagcagatgccagcaccatgcttcctgaagagattacagaaccatgagccaattaaacctcttttctttagaaattacccagtctcaggtatttcttttttttttaaattttattattattatactttaagttttagggtatatgtgcacaacgtgtaggtttgttacacatgtatacatgtgccatgttggtgtgctgcacccattaactcttcaattagcattaggtatatctcctaatgctatccctccccccttcccccaccccacaacagtcccccgtgtgtgatgttccccttctgtgtccatgtgttctcattgttcaattcccacctatgagtgagaacatgtggtgtttggttttttgtccttgtgatagtttgctgagaatgatggtttccagtttcatccatgtccctataaaggacatgaactcatccttttttatggctgtatagtattccatggtgtatatgtgccacattttcttaatccagactatcgttgttggacatttaggttggttccaagtctttgctattgtgaataatgccacaataaacatatgtgtgcatgtgtctttatagcagcatgatttataatcctttgggtatatacccagtaatgggatggctgggtcaaatggtatttctagttctagatccctgaggaatcgccacactgacttccacagtggttgaactagcttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatatcttcttttgagaagtgtctgttcatgtccttcgcccactttttgatggggttgtttgttttttcttgtaaatttgtttgagttcattgtagattctggatattagccctttgtcagatgagtaggttgcaaaaattctttacagtaatgtgctctaatacaaagagatgagcgagaaaatgatgaaaagataagagaagattcaacacttgtatactaggaatctcccagtgagacagaggagggatagaactttgggttcagatcacctctactagagcattatttcatgcagtcacactagtcaccagaccttgcaccactgtaaggtgatggcagcatcacctcactcatgccatccccactgaccacaagactgtgcaagctataagttacctagagaaactaagatgagggacattctaccatacatcttactcaaggaagttggcccccaatacccacatgcacagaaggctaaaaaaatgactgtggtggcaggcgcctgtagtcccagctactcaggaggctgaggcaggagaatggtgtgaacccaggaggcggtgcttgcagtgagcccagatcacgccactgcactccagcttgggcaacagagtgagactctgtctcaaaaaaaaaaaaaaatcacacggagatgtaacatgttaatgagacgtgtgacacatgaagaagcaagtcatcaaactgtgcaaatgctataaattcccatttctacatgctttaatgtcactcctttcatggctaggcctgttaaaattactctcttggctatctccagggaggcagcaagagcactttctcttttccgggctgctttccttgtgctccagcataagttccaataacgcctggagtctgggaaattttcttagccttctgtcagtttctattgcacaagagcataagaacttgtggccagtaacaccagaatagatgccacattaataaaaaaaaaaaagtctagaattaaaaaaaaaatccctaaatgagacttgaacagttatactacatatatagaaaatgacccagaattgccaacatgtagaaatacattgacaaaaatactgaactctaaagaaaaaataaaggcaattatttggaaattcagaaataagaccagtttgtcattacacatttttttacagtaatgcttcaaagaataagaaaatggaatgaaaaatttaatttaaaaaaagaaaatgagtcaagttatccagtcaaattggtcttcaatgttaaagccctaagataagcttttcttaatgcaccaaaacataggaaatagtgtctctataatcctgcatcaaggactttacttgggaatgggttactgataacaaaatgactgaattgtgttattaagagggataaaacaatatcactttcaattagatgtgtgggaaaatataagagatgaagcagaagcattgctcacaacaggaaacatatgagcagtgcaaaaaaaaagtgtaccatgtaatgtaaaagtaagtcgtagaacaaatgtgggcaaactacagccctttggtcaaatccagcccacagacagcctgttttagtaaaatgaattttatgggagcatagccaaaccctttggtttacgtattatctcttcttgcttttaagctacagcagagtagagtagttccgacagagaccatatgacccagaaaactaaacatatttgtcatctcagtattcccattttgagtatgatagtgaatcaactcattattttgaaaatcaataataaaaggaaagaataaagtttttttttcttgtttttcctatagttggtggacctcagggttactgagtatttgctatggagacgtttttctttataaaaatattttggctaatgaatatagaagtaataaaaataaaaaaataatggatttagaaaattactattggtggttgctactatctatatcacaaaaagagaatcaaagagatttaatgtttaaggaaggagtgaatatcacctatgatttatttgtttaaaaacaaaccaaaaataacctggatatgatcaagcctccagatctaactacttatttcctggaaattaaggaagcagaaagaatatgaaatgaccacttggagagacagtcatcaatccaggcttcagaaatgtggtttcttgcacaaataaatatcaaggtgaataaaagagcgtagtggtgaagcctacagattaaaagagacttaacagacctatcaaccaatggcaatgtatagaccttattttgattctgatgtaaataaatgttcaatgtgaactggatatgtttaatatgaactatgtttaataccaactggatatatattgatatcaaataatttgttacttttggcagcagtaatcatgatattttaattgttttaagagtccttaagatatacatatcaaaatatttacagattgaatgttatgactctgacctgcttcaaaataatgcaatagtgggtagttgagagcatagaggaacaactatttcccagggcgtgattatgttgaattagggagttgatacatggaggttcaccgtaatattctctgtaatttttgtatgtttgaaatgttccaagtaaaatgttaaaatatttaaatattcctagtgttaaacttatgaaattagctctaaaattttacattttaattaatttgcatttaaatattaaatctaatcacatcatggttgcacaatttactttgaaaataatttcattaacaaatttttggtaaagaagtcacaataaaatacttctttaatgaattacacttctgatttttattatccttattcaaatgatatgtggtagggcaactaattctgctgcagagatgaatatttagctaactaattaacctcaatttacataatggttgtatttgcataactaatgggctggggattgactataggccattaacagttattaattaatgagattgaattagaaatatatgggtttttatttcaaacttaggaggcaaaggtcaatcataaaaggttaataacaatattcaaagaatcaggcagtaaatattttagcttttagacttcatgcatttctgacaggataattcaggaattggtttcacctctacatgcatactggggcacatggaagtatacacatgtgcattagagaaacttttattagcctcagatttacatgtaaattaaagtaatgggagctagttgtattcacatataagaacttaatgcacctctattcataaaaatcacaggtatcacttgagaaagttctacaacctaaaatttttctttcttaaactgttcatttgtttcaaggaaagagtgcaggtacacttttcaattaatcttcctcatttttgcatttgcaataaaataggttacattatataatttagagttactccaacctttccactcctcatttatccaattcagtttacaattggaagcatcctctatatttttaaaaacataattgcctgtagtttaaagattttagaaactcaaagaattcatctgctatttttaaacaatttaattatgtgagtgatgcataattattgaggacaattcaattcctttaatttcaaagacacctgtataatctgatttttcaaatgatttggttgtatctctacaaggaactgagcagctctctacactgaatcagtaaatgaggttcacgataaatgaaaaggagtgatttctttttatgatcaactgccaaactgatacagaaaattctgtcctgcatcttctgcctgttgctcctgtcttgctttcttttctctcacactgcctgggttcttgctttatgcctctgccctcttctttttccctcttctcccttctaagaacgctcgcttgctgaaatgccttgaaatgatgtccagggatagtccctgggtgaatgtttcagatcctgtttctcatttcacactctgtctgggcctctattctattaatagttaacttaaactggattatcttgagtcttctagattttaaaagggttgctctgattacaaaaagatgattgcttaaatgcaaaagagtattacctcaatagatgggaaaagaatagcatttattgcattattgataacatctttaaatctgtgtcagttcccttcacaaattggcttttatatgcttctctgtgggggtaaactatatgccacagaaatgttgaagttcggagtcacagaacgtgggcttaaatctgtgacgctttgtttactgtcatttaaaaaaataacctttttaattattaacaaaatcttgcctttgtaaaacagggtagtaattctcatttcatagattaaaagtgtaggttaaaaagtgtaaattaaaaatgaaaaatgatgctacatataaattacaataaatgttagtcgctaattttaagatgattttttcttttctcgaagaaaatatgtaaatacaagaagccacacaattcaggcaatttctagaagtcattcattaaaaatatctatttcccaaggtttatccagagcttcacagtgggactaagttttattatttaacatacacagacaatggtggtattttaacaatattggatacacaatttgaaaacggtgttttattatctcgacatttcaggagtatgaaatcactccctgccttgtcatatattagctgtttaaacgaataggcaatcatctcagagtattaatgatctttctatgttgtccactgagaatgatattttagacataggtatttcatttaaaaaattagcagagacaccatacaattctggtaaaagctttaagtagtataacttactttttgaaggaactcggagattggcaaggaccacttccagggaatcagcttggactcgaagtacatagcttgtcctggtctcataatccagaggtccattcacatagataacacctgtgatgttattaattccaaatgtatctagaaattaaaatacaattacctggtcattgtctttacgctataaggaaagaaattctctttaaaaggcactgtgatttcaaaaacactaaaaatgcctatttataactagagtgatgcatgaaagtgacaaaatgctggcttttggaaactgttccagctctttgaatgatcaacatcaatacttcgctaaagtctgccttgaaattgtagggtttttttgtttttgttgttttgagataatcctggaaaacaaagttctatggtcaattacatttgggaaacactgaataatatattctttaccttagattcagatggtcttctgtcacactaaaggctttcagaagttgtttcaaagaaaaccatctaattttgtttaaccaaaattttctgaacttactggattattatactctttgtaatttatgaatattattattttgtagatttagtgttttgctaagaacacttgagagaaaataaaaaaatggataatttaatgttgccctgtgtctgtttatttaaataaatttgaatgaaaatcagggcactttggtaaactttataatatctccccctcttatgctctccatattctctccttactttattttttcatgtaattaataatcccttataatactatatatttctttgtttaataatttttattattaatctccgcttactggaccattaacttccatgagggcaggaatctattttgtacattgttctatctgtagtggctagaagagtagttaatacataatagatgctcagtacatatttgttgaataaataaataaatgtacaacagtcactgtgggggacagacgttaataaatatagccactctgctgtcttcaaagaaaaggacaaatagaatcaaaagagaaagtttcgggacggaacaggttgagaaatcatagctttagtcagatgttcgaagtccaaggaaaaaggaaatttagttatttttagggaggacacatagtagcacagtaataatgtagaaagaaaggcaataaaagtaagatattgaccacttgctacactacacgggcagcaatacctagtaatagtttgtcattaaaaagcttaacagggcctttataatttccttgcaaactcttttacattcactcatttctttaatatttactattgattaacttattacatgtatattaactatttcctgactacctacaatatactaggctatctaacataccaaaagggaaaacagaggagaacttgtggagaacaggtaaaacaaaaattaatgcgaaagattgagctatgaccttattcccagaggcctgcaaattcctatgattcttaaattacaaaaacttatatttttatttttaatcatgaattgtatgtctaatttgactattttgggaatcatataacatgcatagcttttaacatggatgtgactctttttaaaattcacaacttatttacaaccttgaagttccttcaggattagttaaggtatgaccaacatggagtaagggtcatggatggttcagacactggggcggacgaagctactgtaggcaatgatcatggccaaaagctgaaaatttcatgatgcattaattttgaggaaatgtcattaaaatattaccaaatgaggaaaagggcaaggtttcattaattagatacttaatatttcttaaggtacttaatatttcttaagggaaaaaatcactttagctaacatcactggatttttaatcgagttcaggatacatggttaacaattacatttaagatgggcacaattttattagaaaacaatagaatagataataatttcaattcaatctgaaattaggccaaatctaagtttactggttgatggtgagaacacaaactaaaagtctactcaccttcttcatttcctgaaacaatggagtacacaatactttgattaatggcagcagcagaaattacaccaaccatggtccctttggtggcaagttcacttactggaggaggtctgcaggtttagagaagatgatgtatttatttttaaatataatttttgatgtaactttacgttcacagaaaaattgagagaaagataagagatttctgatataccctctgccctcacacattcatggcctcctccatgatcaaatcccccacccaactgctacctttgtgataaatgatgaacctacattgacccattatcactgaaagtccatcatttacatgagggtgcatattgttgttgtacattttatgagtttggacaaatgtgtaatggcatgtatccgctttcatgtagtatcatatagggtattctcactgttctgaaaatcctctgtgccctgtatattcatccctcccctcaactcaacctctggcaaccactgatctttgtagtgtctctatggttttgccttttccagaatgttgtatagctggaatcacacagtatgtaaccttttcagattgccttctttcacttagtaatatgcatttaatgctcctcaacatctatggcttgattgcttatttcatttttagcactacataatatttcgcggtctgaatgtacccacagtttatttccataaataaaaaacatcttggttgcttccaagttttggcaattatgactaaagccactataaacatctgtgtgtaggtttttgtgactctaagatttcaactcttctgggtaaatactaattagcatgattactggattttatagtaagactgtttagtcttttaagcaactgccaaactgtcttccaaactgactgtaccattttgtattctcaccaacaataaatgagagttgctgttgccccatattctaaccagcttttggtgctgtcaatagtctggatttcagacattctaataggtgtgtggtggtatttatttttatttttttatccatatttatgacagagttttgaacttaatagaagaatgtacacggtagttcttccaagctacattatgcaattacattgtgctttcattgaaaccttttacaaaaaatcctgaaatacaaatttagtctgaagtataggctttataaatatctggtccaaattgctttgtttttggtactgctgtccatacacttaattgactaggttatctaaatgtaaagcagtctttctcacagatactctagcacctaatggtggtccatatattcattgcatgagcaataactgcttcttgctgaagaataagaaccaatctgtatcattttaaaatgaagtgtgtaaagtagatatttaatttactagtttatttacttacttattttactgtcctgcattttctttttgctttcttttgataacatccaaatattgttttcaataatcttgcctctttccttctctgtacaagtgctttgggtaaggctttgccaatccccatggtacatgcataagcacattaaccaactctggtcaatgggggcattttatcctttgctcagtgttcatgtgatgtatacgtctcatgtaaattcaatggacatactacataagattatgacttgactagattctcgctagccaactttttgggtatatccctcactggatttgatgaagtaagctgccatatggagcagtcctcgtggcaagaaactcaaggtgatggctgactaacagccagcaaggaatcgaggcccttagtccaacatcccacaagaaactgatttctgccaacaaccacatgtacttggaagtggatctttctgcagttgagcctcagatgagaccgtagccctggatgacaccttgattaaaagattatgtaagtccaaaaaggagaggacacagctaacccatgcctggattcctgacctataggaaattcaaaatgatatatgtgttgttttaacccattaagttcatggtaatattattatgccacaacacaaaactaatatttgaacaatggattgttaatttatgacagatcaagatacatactacttatcaaaagtttaatacaagaaaatatgtcagtcatattaggggataattttcaaaaactgaattcctatttgtggaagtagacattacttaaattgtttacttgtctatcttgttactgcacaagatagaagctaaattttatactttccataattcatctgtttgctattccttatacagtatggaaacaagacgtctgcaacttatgcacctttagctttaacatgagaaaaatgctatgtcgggccgggcgcggtggctcactcctgtaatcccagcacttttggaggctgagccgggtgaatcccctgaggtcaggagttcaagaccagcctcaccaatatctctactaaaaatataaaaattagccggttgtggtggtgtgctcctatagtcccagctactcgggaggatgagacatgagaattgcttgaacctgggaggcggaggttgcaatgagccaagatcacgccactgcactacagtctgggcaacagagcgagtttaaatctcaaaaaaacaaaaacaaacaaacaaacaaaaaaaacaaaacagaaaagaaaaatgctatgtcttctttcaaatattaaaaaatgcacgtgtacatttttgctaaccttaactgcacaattaggatagaaataatactaaaaaaagtaattggcataatttaagaagacatttaaatcctatgcataccactaaaagcatttaaaattctatttgttagtaaatgtttacaacagatttacttctagacaaaatttctcctcattaacctttgtcttaattgttccagtacacttgtttctatcagaactaaaacactatacaaatacaatcttctcccaaaaagaattaaatgaacctccatgataatgagcattagattaaaaatatcaattattttctattttttggcaggattacaatgtacaatattaataaaaataatattattttattattgttttaggttgtggaaagtaccagttacatgatggaggcaaattgcatactctctttggagtcacatatgtcttgaatacaaatgatggagttggtataaatcaggattcattaagccagatggacagagaaggtaggaacataaccaaattgaataaaatgggctgaatataaattaatagggagaggaatggaagttaggaatgagagagtatgtaactactgtacaataattcaagtctggtgtgatttgtaaatcaataaaggaaattgaaaattttgtatatgtttatgaacgatcaatgggaatttatttttttaaagcatcaatgactacatttgatctatgggctgtcagtttacgatttttaaagcagattaactatctctaatgtcttttctagttctaccattctgaacctgatataatgtgagttatcattcactcttctttctgttgagtataatcaaaatctattgctcaatttcagaagcaatgaattatggccaaatgaaacatttctcagaaggttttctaaaaaaatattttctctattaaattcataaatcttcaattcatccatttatgaaaaaaatgcatcactagctctcttccaatttaagcttttcgcacctgatttataacaaataattgtgagtgtctgaaatggaagaatactatctttcaaagctaaatttactgccaatacaactgacaaactgcactcttaaaagaaacacttgaaacagcttcagtaatggaactatacagcttactgatgtagcttgagatagataccaactagatggccattttccaaagatggctaagaggatgctaaaggaaatggttatttagcagatatgaactggaacatgggagaggctagtggtttcatgttttcataatggccttcagtaagggcttcctcaaaggccctttcacaaggcttgacctgaattgggtttgatgtccttgcatatccatgatggcagtgttggttcctatttactccacaacggcaatgcttctaactttcttggccgttttaaacaaaatctacaggctttgactaaaattccaaaatcacctcaactaaaactgaaatagaatccgaaataatatttgttttataaatatatttcctcattgttactatttgcattatccttaccttctaaattttacatgtaaaacagctgtgtattttcaaaattaataatatttttgtttttaataaaaatgttattgagaaataaattaagataaaaatactggcacaatgcctatgcatttcagtatatttatacttcctcccagaaaagttcaatggtctcagaattttttgtattcttatttattttttaattggcaaatagaaattttatatacttatggtgtacaacatgatgttttgaaatacgtatacactgtagaatggctaaattaaactaccatttgactacctcacaagtttattagtggtgagaacatgtaaaatctattcccttagcaatgtacaatattgtacattgttgtcaactatggtcaccatgttgtaaaagaaatctcttcaatttattcttctaacagaaattttgtatcttttgacaaatatctccccaatccttcccttcctacccagccccatgtaaccatttttttacgctctactttcatgagttcagctgttttagattccatatatattagctttattagatcactattagaacatgcagtttttttctctgtgcctgatgcattttagttaacataatgtcctccagatttgagacaaatgaacgtatttgagacaaaatagaatactaaagtctaggttcattcacattgtcccaaataaaagaattcccttcatttttaaggctgagtaatatttcattgtatatatatatatatatatatatatatatatatatatatatatatcacattttctttatccattcattcactgatagatattttgtttgactccatatcctattataaataatgctgcaataatcatgggagtgcagatatctcttccaccaatagcctgatttaaaaatggaccaaggagcagaatagatagttccaaaagaagacatacaaatgaccagtaaatatgtgaaaaaaatgttcaatatgagtaatgatcagaaaaataaaagttaaatctacaatgagatatcacctcacatctattagagtaactattaataaatccacttcatataacttgtgtgtgaatatgtctctcaccaggttcaggcactggtaatactgcagcccagaatgcagtggagggaagcatttgagttcctattccggctggttcacatagtgacactgtgtgctatcttccacacggtgagagttttcccttaggatcagttattagtgaacttccttcacactgacctaaaatgtttctgtttttcgtctactcatctcacttttcacctgaacccctggtaaccaatgatctttttactgcctctatatgtttaacttttctagaatgtcacatggatgaaatcatacagtatgtagtttttttggactggcctctttccttatcaatatgtgcttaagtttcctctatgtctttttgtattgtgatatctcatttcactttattgctgaataatattacaatgtattggatgtatcacaaataactgcacttttgtaagaagaaaactgatcaaaataactccaaaatggtttaaagtaaatatttgcagattaaatgcaaaccgaaaaagttaactgctttggaattcgcatgcacaatacttacaatataacctcatgaagatataaactaattcatacatatcctttttgttttgtttagacggagtctcgctctatcgcccagactggagtgcagtggcgcgatctcggctcactgcaacctgtggctcccacgttcaagcaattctctgcctcagcctcctgagtagctgggattacaggcgcccaccaccacacctggctaattttttgtatttttagtagagatgaggtttcaccaccttggccaggctggtcttgaactcctgacctcatgatccacccatctcggcctctcaaagtgcaggattacaggtgtgaaccaccgcacctggcccatatatatccttttaatatttctaagtgttttttgaaaatatagattacaataaatctttcaactgagtatatattaactaattttctgaataatgactatagtagaataacataatttgcaatgtctaaatgttagacccagtttttaccgtataaatatagatgaaacaattacaatttaaaatctacttttattgttgagttcaagaagtaacaataaaagtaaatgttgtatgtgtcaaataaagcttctaattattttaaaagccaggcaatttaggatataaaagtgtttgtaaatagatgctataaaatttcactaggattcaatctggctctattgctttctttgtactaagagacaaatctaatttattttgacatgtttgagttcaatatatttgcaaatcagtaccaattaagatactgtttttctacctactatgagaggatttaataaaaatgggaagggaagaataaaaaaaaaacacccactagaactccgattatttataatcttggagtaattgcatcagagtgatctaattttacatatttaaataagaaaaacagtttaaaaaagacatgaatcaggagagagatgctagttcttccagaatacttaggatggattttagataagaaaattaatgaagggccaaaagactagacactgctttttacgtatgttccaaagaatgcgtgctttctgtcactaagagttttgcttctattcagttccttaaagaatcttcatctggaggatacaaaaactgaagtataaacaatttatccaaatatttgaaagcaaaaactgcaatctaaggtgtttggtttttcctttgcttaaattattatattgttctcattaaaatagtgtgttctaatctctcatagtcattggctcttaaagcttaaatccataagaatgcgctggagaaattttttaaacttactaaagtacagaagatccctgatttatgatggtttgactttcggttttttactttactatgggtatgaaagtaatatacattcagtatgctcctggacttacaacggggttaggtcctgataaacccatccctgtttgtctactgccctaccttaattattatagagggcccttctcactctcaaaagtgccctgctttggacaataaattatatggtcttacctatgctggaaactatatggatatattaaagtagcaaatttattcctctcgcttgaaaatttacaatttttttttagtgagaccgagtgtacaggtaatcagaattctgttttgaattatacattatttgacattaatatagtaatttctgctttcccttgtttgtaattgccagatatacattttctgttcactctatttttgtgcatgtgattttggtttaagtacattacttaatggcataaaatcatgtgtgaaaagtttaccagaggtaaaaagcattcttagaagattaagtaaatggcacagctattaagcaccggaggagttgggaaatgaatgacttatccattataaattggtgataaaaatgtgatgattttgaatcaagatttaaatagtataaaattctactttccatggagattgtggaagcacaaagtgacttccattaagaggatatgcatatgtcatttgcctgtttaacaccattcaatgtcttcaaatttctctgtgataatgaacaaagtttttagtatgactcagtaagtcccttcacagtccaactctccctacttctccagactcatcaccataggactccatttagtatgctattttgtctcaaatatgtttgcattgattactaataaaataaaattaatgtatcctactgtatgttttacttggatcaaaatttcccatagatacaatacaatgaaataatgggacgtataaaatcactctttgtattgaaaagtttgtgctaaattctaaacagtggatgtaagttgaactgtttggacttgagtcctttgttgaaggaagacttgcttcactctgctacatgagcaaatgccaaaatgtgtataaccttggaaatgtgaaagagaaattaaattccatgtaggtgcacagggaacctatcaaaactgtaatgaaagattgtcagaatcattttgtcaatagttaaatgggcgaaacctattatgtttgaggcaaggttttaatagtgccataaaaagacaggaaaggctatcttcaggtaaagccagctcttacattggacaacaaatctaaattaaaatagaaaacaattttagcaatcgagttatgctctctgcatatgcatttgttttacattattttaatagtcttcagacagctttcattaacttatttgcaatcaagacaaatcattctttccaaactattgttcatcttattaaaatcttttctcaaaatctgtaagtccaaacttggaaggttttataagaatgatagcctgggcaatatagcaagacactgtcactacaaaataattaaaaaaaaaattagctgggcatggtggcatgcacctaaagtcgcagctacttaggaggctgagggctgagatggaagattgcttgcagtgagctatgaccgagccattgcaccacagcctggaagacagaatgagatcttgtctctaaaaagaaaaaaaaaatgatggctatgttcctcaacataaggtaattttaattctctttaataatgaaatgttaactagacctgctcacttgctatttctttggccactgtgataatattacttgcattttcatagtttacaaaaatgaatgccttgattataaattatactttttctgttttgtatatcaagaggtataatgctaatcctttgttaaatatactctaattttattctttaatataaagcttcttgagaaacttattttaagtataaattgtgtaaaactttcaacctgtcatttattacaaaactaattcgtatgaatcaaccaactagcaattttttattttaacagagaaagtggtaagattatcttttgaagaagagttaaagtttttcaaaatttcagaatgttcacatgtataatattctgattttgaatttgatatattaaattttaataataatagaaattgaaaaggacttatagtatattctctgagtttagcaatatatcaacttaagaggttaacaaatataacttagggatatttgcccttattttattatatatataccagtataaattttgaatttaggttgttatggaaattacacttgcaaatatacaaatcttaaaaattaacatgaatgtgacactaaatcatgcaatggttaatattcaagttgatacatttccatttttaaataaaaaacaaaggcctacctatataggtggcatatatctttgaaaattttgcaattaattgtatttggcaaattttttgataaattgtgtaatataatgcatttcccactcaaaatcaatattcacatttagactctatgatctattccagacgtgttgaccttttcatgatatttacttttaaaactgatgacaagtgaatttcagtgtgtataagtcttagtccatcatcctgaaatgaaggtcaaatgtcattctcattcttcagaaggctaacttacttcacctatgggagtcaatgtaatctcaagtagtatgtgtttgaactactattaggattttgctatttctgtagggtttaaatgaaagatatataaaaggaatttaatgactctgacattgtaactaatttctaaaatatataaagagataattgaccgaaaatctcttagtaaatatgaacatgcagtgacaatgagagtatgcctctcagatcttcaactacaggaagcacaattggtcaaggtcccagttactgtggactgaaatctgtttatgtttgtatgaaggacatagttcctaagggctgcttaaggagtcaagtattgaaatgattattaggccaactaaatgatctctatagtctatttcattcattgcataatgtgaatttgagaaaagaatttttatgaataagattaacacatttttctcaatttctaatgaaaaacaaattgtagaaaatgatttaaacaaagatatgcaattgtaaatagatatgaagaaactacctaatcacttgaatggttaaaaaatcaaagtttataattggaatatttctgtgtaatagggatattacccggacttaattcatttccctcccacccccaccaaaaaatgaagctagttggagataattttgagaaagagaggtggaggatgtttcaacaataaagaatgaagaaatgccattagctttttaagaactctttgtttagctctttgttcaaggaaagatagtagagcaagaaggaagaatgatcacatggggcatgcaaattctaagacactaatatcattgttatatctttgtcaaaaatagaaactgaaggaaccaaataaaagagaaacaatgcatgtggaagatttgttacaatttgagatttttggtcgtgtgtatgcttctaaaatatacaaacgtttgtttacagttgtagaaaatgtcacaggatccttgggatgttgcttttccagtaggaagcctctgtggctggtggcacctttacatgaatttttttcaggcctactgggcttgtttcacccactcagcctggcaggcttcacttggcttcttctaccggcccagatcccatgcctgccaagggtgagccaggtgcagagcagcaaggtggggatgagagtgagtgtggggtccaccactgtgcacagccaggcacgctggctgctgtggtgggaagggtggccccaggtgccagcacagatgccagctccatacaagccagtggctggatctggtgcactgcaagcagattccactgaaggcacccatgtctggatgaggagaacgtggtggcacccagtagattggagacaacagaaaccagagtcccaaagacggtgtcatagccctggctcagggagctcctaggtctgggatccctgaagggccacttcgcttctcttctctccttctcattgcccacaatgtggcaagcggggaggcatgtttcagccctgctggtattactgctctttcagtcctgccattcagcaggtcccaagttcttgtcccacatctaggaagaattaggtatatagccatctgaagggtgagcaaggcaaagaggtgcttcattgagcaacagtacatctctcaggagacctgaaataggcagctcctatatgcaggcaggctgtcccgatgtctgcagccctcagtggcgaggagacccagagtgggtagctcctatcctcaagcaggttgtcctgatgtctgcctgagtctggttgagactggggtttttatgggcttcagaagggagaaagtgatattgctgattggtccatgggcagccatgggcagccataggcagcctggagaaagcaccataagttctcactccagtccagggaactggcaggctgggcaccagccttcaggcaatccttggctagaaggtggggtttcaccagacccatccctttccacccaggagcctgtctgccttctgctgccattcatggcacccaggctgtttgtgcccaagaggttcctgcaggcccgctccaggccacccccagccccaccttggcttctctcccatgctcattggtgcccaaagtccagagtgggctgaggtggcaaggggctggtatgtcagcaccacatgagtgtgggaacacacagccaggtggtgacaatgctcggggcttgatgacagctttgctctgaaattggagcaggccctggaagcagggagaggccaggcattgggagaacacactttgagcatgcagcaggaggggggcccaggtccacagtctcagctgggtgattgcacctgcacctgagagctctgggctccagcccctccaactcagaagtgggtggggcccctgcctgttctcagctctcactgactctgcagagtgcatagccccagctgtgtttccctggttgcagccagcgtctttgcagcaaatgctccagacaggtcgctgttgtcatcaaaaggaatagtatacagtatgaagagatatatatttcaaaagttttaagaagaactcattgttttctggatagaacaattgatcattaatgacaaatgaagcacacaatgtcttgatcctccatttcacctaagtgactccataaaagattgatgtgaaaaggtcaagaaattaacaaaatgagtctgtttcaattactataacagccctacaaagcaaagagaatcaagtgtatagtaattcttatctactataactctggccattataaaagtaaacatatgaggcaattttcttgccattatgtgattactcctacccttaatgattattgaaagccagccaccaggaaataacatcagttcacaggatttgaaaaaaaaaatcaaatcttttcccaatacatataaaatatcttaatattataaattataaaccagaaaaacatcattttccttgagaaatgtgtttttaaataatgacaacctaatttattttattgagtatagggttgtctttgtaaaattcttcaataattttcaaacttcattaagggagcattagcagaaagtaaagaagtaatttttttgttctgttttgttttgttttgttttgttctgagacgaagtcttgctctgtcacccaggctggagtgcagtggcgcaatctcagctcactgcaagctcagcctcttgggttcatgccattcttctgcctcagcctcatgagtagctgggactatgggcacccgccaccatgcctggctaatttttttgtatttttagtagagacagggtttcaccgtgttagccaggatggtctcaatctcctgacctcgtgatccgcccatctaggcctcccaaagtgctgggattacaggtgtgagcaactgcgcccggctgtaaagaagtttttaaatatgcaaatgaaacagaggcagagcatgattaactatgtggaagaaggggctggttttttattatgttgttacttttacataagtcagaaagcctactaattatctgtcatcaaaacttcacaggcaaaccagtaggtttttcctttagtaaatattaaagtacttactgtggtgtttattacttgtgtctattattttgctattttacaattttggaagaagacaatgataggtctattgttatattccagcaactaatcaattaccaatagaacaacatagaagtgctttcaattctaaaaaaagaacaatggattttgtttctctgtctagctagaactggtatactgaaaaacgtatgccaaatagtaaatgcgaactctgaaccatttttgatcaaggtcttcacaatgctagttttcagctcataactcaaatttacactttgccattatgctttcatttttattttctttatattttacttctgtgaccaagacactgcaacttctcagaaaactggagaaagtaattcattgtataaaatattcaacctttagcttgaagtccagaaaggtttggcttggaatatgtaatgttaatactcattaaactgaaatcactaaaaatacagatttttaaaacaaccagaaatgttaatctgagatttgctttgaattaagaaaataaatattcattctcttgatattttaagaacaatttacttcactaacgcatatttaaatgtaaaaatgtttctattctatcattagctcatgtaccccatggtgcattctaactaatcagtcattttaaaatcactgtggcaattaaaatctatgaatctgtaaattgtttacaatcacatgtttaatgtgctaggtcttcacctacaccatttcccctttttcctcaacaactgaggttgaactaggacacagttgcctagcaaggaacagcattcctctcccctagttagagctaaatgtagacccgtacctggattctcacaacgtaatgtgagctgaactgaaatgtgcaattctcacctcacttggttaaggaaatctctagatgtggacttctgtctggtttcccctttctgctgactaaaatggtaataatgagttattttgaaatagagtgttgaagatggtgacccctgagttgtcccaggtccctgaactttaaaccattgatatttggtggtttcctattacagtgacctaaactaccctaactcagtctgattaccctgagatttaatgatttaatgactgtctaatagaaataagtcaacggagtcagtgacagaacggggacgtatgggtcaataattcagttaaacattctacgataaataaatactttatctttaaaatctctcttttatacctaatcatttgttaaatgctaatttttcctatggaattcaaacacaagtattggaacgaagacattcctgagatgtaaaagccatgtgtacctcagcttacagtgctagattactgctttccatttgtaacacattaccttcccctacaccctacaaagaacataaatcttgagctatcatttttatatttcccccaaatttgatcacaagaagtagaagttttttcactaggagcaatcccaacacgaaagaccatcctaataatcaaaaattaataatgtcatttagcatctctgggaataatgtgcatccagttgaggcagtaaaatgaatttgaaaaaattagagaagaatgaggcatatgaggttggcagaaaccattctgtgcttcactttttttcattaagaaaggaaagtgtgttggcctctaaagcagcctgaaatggcataggcatattgccaaagctagcaattgaacatattaaaagaaaataccatacagaaataaaaatattctaccatgaatattttcatatttccatatattcatattttgcaatatgaatgagaatgacttttaaatatgattaattaattatgcgattagttgttggaaactaataaaatgttgaacaacttatattagttgaaacaacagtagctaataggactaagcctgctcaggaaatgatgcagaccacttagttccatatttttttggccagaaatcagtcaaacggcagaattcagaattcatccctagttaataaggagaggaaatgtaatccagctatatgcccgtgagaaaaaggatttaggaggcatccagatactgctatgtatttcctcaatggtcttcaaaaagaatgaagagataattgaagatgataatcattagccttaagtttctttatagttcagttaaaattttggttcaaatttagacctatataaacatttatattcaattatttgcatttatccaaaaagtagtgtccttgttcatatttggcataacatttatttttcaaattttctggttatttgataaaaaattaatccttttaagtactcaagtactactaaatgcattatgatcaagatactgattcttagcatctctgggagttatgtgtgtacagttgtgtatattattaatacacagtaggatgcaacaagattaccaaattctctttataactcagaataacaaatgaactgggataatcaagggcaattttgtaattgttagaattctggaagatcaaaattctcccacatgtacccatgtgactgttgttaattttagtaccatataattggctaacttttgctctctaagttaacaacaactttattaagagaatctatttgtagttaatagttctatgcagagacggtatgaaatggtaaattatacgttgaacaacacattcgcatttttaaaacatggcattaagcaaagatacttaataaagaaagttaaatgagcaatgccctgtttcaatttatgaccttggcctcaatgccacaatattttagctaaaagagaagtctagaggcatatttctattgacaaggaaatgagctctaaatgaaaacctagagaaacagtacaccacttaagtttatttaaagaggaagtttaagcaatatatcactttcttctcttggagtttccaaagataattagacttgccgcaaggggctttgaagaacacagatgggaattttaagttaaaactgtgagcgtttttttggatccacttagaagactaagtatattttttgagaacacctgatctagataatttagtgagaaacaaagtgagtttatatccgtcctgttcttgagaactccaaaattaacatgttcagagaagttcttccaaaacagaaaactgtgcataggagtccccctttatttatgggggatatactccaagacctccactagaagcctggaacttcagatgacaccaaagcctatatttactatgtttttttttttttcctgataacccagacagttactaagtgactgatgggcagcctggatacaatggacaaaggaatgattcagctccagggcagagtgacacaggacagcacaagatttcatcatgatactcagaatgccatacaatttaaaacttacgaattgtttatttctggaattttccacttaatattttctgaccacggttgacctcgggcaacaaactgtgaaaaatgatactgtggataaggaggggactactgtattccatagcaaagaattggaatccaatccaaaggattggaagcacaggttactgtgtcagaaaaaaaaggaaaataatagataataatgtacatgtgggtgagaataaccttttaaaacagattaaacaagaattcttatttgttttacatatggtttacatctcgatgatttacatacatgctatggaagattttctggtaattatattacataatttaattttgtgtagattcttctaaacgcagctttgtatgagaggatgaaactgcttggttcagtgggttaagtgcttgcagatgtatccctcacctaccttattcctcagtaccttagctgctgttctagcttaaaattattaattcattctaagaaagtaaaaaacactaaagtcatcctagaacatgatcaagttctccattacctgaaatattcatttttcattatcctcaattattatcatcatccaactttcaatttttctttggatagactaaactactaaaatattctggaatttaatgtagactcccacaccccttatttatatttctgcataggctgaatatttggtgtggaatatccatctatatctttttggattgactaaactctacatttccttcaatctacaacttaaaactgtgttaatcatgttcaaatatagttaagtgtcccttagcctgcttcctcaatactgtgatcttatttctaccattgtgttctcacagtgtattatatttttcatatagttatttgtttccagagataccagagagcttgctttctctctctctctccagataaggacatggcaaaaaggcagctgcctattaagaccagaagagaccctgaacctgaccatgcagacaccctggtcttaaacttggattgtcagctaccagaacaataagaaaataactttctgttgtggccgggcacagtgcctcacgcctgtaatcccagcactttgggaggctgaggcaggtggatcaggaggtcagagatcgagaccatcctggctaatgcagtgaaaccccacctctactgaaaatacaaaaaattagccaggcatggtggtgggcacctgtagtcccagctactcgggaggctgaggcaggagaatggtgcaaacccaggaggtggagcttgtagtgacccgagattacgtcactgcactccagcctgggcaacagagcaagactccatctcaaaaaaaaaaaaaaaaaaaaaaaaaagaacagaattttctgtcgtttaagccacccaatttatggtattttgttatggctgcctcagttgactaaaacagtatatatactaaccataaactataatatataatattggtgtatatgcatatagtgtatatatataaatgtatatgtattatatatgtgtatatatagtgtgtatatatatatacacacagtatatatataaatttatgtatacacacagtatatataaatacacacactacatttatatatatatatacacactatatatatacacatgcactacatatttacacacacaaacgtacacacatacacacatacacactgattagatggaaaatatgattgcagattgcatgccaaaattggaaattgaatgaaatgttccacctggcaataatgagaaactaaagatctatttctcaccattcagatcattaattagaattgaaaccccaaaatataatgttgtattttaataagtttgcactaattttttaaaaagtatccattattcattaaaccattactaaaacatattttatactaaattgtcatattaaccatttaaaaatttaaactatattttatgttaatttagaaacgcctaaaccaaaattggaagtctactcataaattcatattacatcaattttgagagactcctttcaaaaatgccctaaacatttcgtgtatttcaaaatcggacagaaatcaatacctatattcctcctgtgtgaagcgtgggatctcaccaggatgtaagacaagaatcttcactgtggcactgctggacatcacaggctccccatcatcaaaagcaaccaccaccaacttaaaaagcaataaaaattcatgttaaagattataagtaagaacagcgtaacagcacaatttttatatgtatgtttttacttattggattgcctggttccagaaggggaagcaatgatcatttcctcactgcctaccaggtggcagacactatgctagaaaatactacgttctcacttaatctttacaataatccagccagataaatgttattattttcacttgctagatgagaatactcaaagaagtaactaactctatgattaaaaaacaactaccagtaaaacaagtgtattatactatatctctccaattaaagactcatttctataattccactgaagcccacagtaaatacacatgattttatagcaccaatacacttatttaagaagtgttaaattcagacacataaaaagctaattatcttgctcaaaaaagaaattaattttcctagtgaattagttgtttttgagattatagggcagaaatactttactctagaggataaaattggaaatctttatagtttaacactctttggtatactatctcttaaaaacaaattataaggccaagttcatttggtatagcagaaattgttcaaatgatgaaaactaagaaaaagctttagtgttgagatgtgatgtctgacattatttatcactgcaataggatttataattgattattttctttaataacctacattacatcaaagtaattctatgtttactttaagacatgttaaatactttcagaactatgtgcttctttggaatataaattgttttggaagctgcaggttaacaatgtaaactaattcaacctagatcacagaagactgtaaccaaggatcatcctgagagccacaattgacctttgggttaatgctaatttacaaactgatcagctgttccaaacagcggtaaaatcatgagagacatagtgctcactgatccttacgtggttaactgataaagctatttccctactgtagagtcaaagactttattcacagtgacaaaaattattctaagtaactattaaaaatggaaatgttcaaacacttaataaaattgtctacttatggtaatgcaaattattgttttaataccttgccaggtagagacaggcattattttgtcaaatatatttttaaatatgtaaaaaacaaaagagggaatatgttctgtttcattagtatttgaagaaaagtaaaatttgacaaaaaatcaaatagatacagatattttcctagatatatgcaaagattaacataacaacaatcagtattgagtggtattaggaaaatggatactctcaggaaagatgaagaatgcatacaaggggtatttttttcaaattttctaggattgtaatatatcaatcttatcttaaaaaagtgagtaagggaaaaatgatattcatacaagtagttgcatgatagcatttattgtaacaaaaaatggaaagtctaattataaagcaactcagtattatattaaaaagaaaaacaaaatgttatatagtaaaatactatgaaaccactaaaataatagtattaatgtcacttattggcatagacaacatcatattgaatttaaaaaccagtatgtataagactatgtgatttgaaaacatatatttatatatttgtgtttgtatgaaatgtcatcatgaggatagagatcaaaacgcaaattctagctatttccaagatgtgagataccaagtggttttctttttactatttttgtaagtttctaagagaaaaaaaaattgtaatttaaaaaaattaaaaaggagaaaaattgaaagaaaaaaatgtgctgtcatctgttaagccaaattctctatcaaaaattaaacatcaaatagaccacataatgaaaagagacactgaccttaaaaattgttgtaggttcttcattaagattgactcgtgttattactcttccagaatcttcttccacttcaaaaatactggcagggtaaggaaactgtacatcatctactctatacctcacacgacttgcaggtaatccctaaaataaaattattaattattaatttgctgttaccaagttaaaacacagtgcaatgataatattaaatggatctttaaaattcatggtcttttagaagtgaaaatcatatttccatattttcattctttcagagctgaaatgtagccagatcattatttcttcatgataactcaatctgaatcaatgaagtatctctactacaggttattttaaaatgatttatatgagagaaaaattaatggttgctttgggcatcttctctaccactttcctttaattatgtgaattacatcttcctcccaaaacacccaatatctccttttttaaattcagagacagggtcttcctttgttgcccaggctggagtgcagtggcatcaccatagttccccataacctcaaaacttctggtttcaagtgttcctatcccactttagcctcccaagtagctgggaatacaggtgtgtgcaaccatgcttggctaatttgagaggactgtagtaaagtgcaggaatggacatgaaagctaaaaaaacaaaaattatttaccatctacactgtgttgattaccatgctaggtatttctatacatcattaggttaatgctcaatcttttaagatgacattaataatgaagatgatagtaataatggtaagttaatgacgctaacaattgctagatgcttaccacttgccggaaccacattaaagatgatgtatgtgtactctgttacccattttagagctaaggaacttgtggcttacaataagttaaagagtgctgaaatattccagagataggccaagataagttgggacaccaaacaaagtcacttttaaagaaaacaattaaaatttgataagtttttaaaagaatcaaagtgattgtaaaggaacagtcaaaattttgctggctgtcctcacttatattaggtttcagattggtttcctttggaactatgtagggtgacattgaggtgagcactgtaacatttacagtgcttaggccttgtaaatttcttaaaacctagaagtcaaataaatatcttgagcagagaactagtatgtggtaaagttttacttcaaacctaaacactaaattacaacattaacttcttcagagaaagaaacactcctatttggcattattctgatgaagaagaagtaagaacattaccccccacagggtgttgatttggctggacttgacactttggtgtaaaaactgttctgagaacattgctttttatatttccattttcttcaagactgtccttgaaaataatctgttgctcatgttggttcctgaattacagttgggctatgagataaatatgagttttcaggatttgtataattccctattttctgttagttcagtcctttcatatactacacgtcaccactgatgactgtctccttgaatacattctttatttaacctttttccactattctgccttttctccttcccatctggtgctctgtctcagactctgcttgttcccactctttctggctactaaatgttggagttttccaaggctctgtttcaagaacttctacattttctacttctactctcggcccctggaacctctcccagtctgatagcttcaaatatcttctatttgttcataaatatcaaattttaatatctggctaaactctgaacattttaagtccaaactagtacacataattgtccacagatatgctattttcaaataaatgtattcaaaaccagaatgatttcatctcccaaatttataactcttctactatagataatggctctaccttttactaaggtgttctatctgaaagcctaggggtaatcattgatcctttctcttaagccccatagccaaatcatcatcacatcctgccaatacctcaatgagtataggccctaatgtcttctcatatcctctgtgttttctgtagtagactcttaattgactttctgcttccattgtattaaaattatctcatgactcctgcttaaacccttccaatgattttgcatcacacacaaaaaaaataaatacaaagttgttagtaagggcaatctgatcctaaaaacatttcttttttgcctactcatctgatttcatcttgttcatttccctttcacacattttccttgttcctgcctccttggctttgccaaggcaatagtcctttaccaggaaaataaggtggcaatataatacactcatctctcagatttttggctaataaatttaccttcctcttctccaggcgttctctaatactccctttaaattatctttcttcagcaaccctgtctgaaattatagcatatattttatgtatttacttgtttactgtttgtctcccacataagaatacaagctttattagggtagggactgtagctgagtaccttgaatgttacctgacccataatatgtactcaaggagtatttgaataaataattttttatttataaaaaaatttatttataaattttatttattcataaaatttttataaattttatttattcataaaatttttataaaattttatttattcataaaatttttataaatttatttaaaaattatttataaaaattttatttataaattttatttataaaaaatttatttgcataaataagtgaatggataaccacacatcaagggtgcccagacacttcaactgatatctaaagtattcatatatttgaaggtttgggaaatagagaacattgaataaaccttgaaagcatgttagggaactgccagttctgggataatatttttatataaaccactgatttcacctagtggtggatggtcagttcacccactgaagatttatagaaacaaggacacatttttttagaaaaactttggcctatatggacagaatcagacttattataatcatatacaatggcaaaccttgtatatgatttgcttgtgaaagagtgggggtttagcagaagacatcgtaggacttggggcacagtgtcatgcaatgtcagcaactttgcttgcatttgaataataatgataataacaagagttgttagctatcagtttgagtattttactatgtatcagactgcatgtattacatgcattttcatacctacaataagttcagaagttggtattaatagtacctacatttttttttttttttgagacagagtcttgtactcttacccgggctggagtgcagttgcacgatctccgctcactgcaacctccgcctctcaggttcaagtgattctcctgcctcagcctctcaggcagctgggactacacgagcccgccaccatgcccggctaatttttttctatttttagtagagatagggtttcactatgttggccagccaggtcttaaactcctgacctcatgatccgctcgcctttgccttccaaagggctgagattacaggcgtaagccaccgcgcccagccctactacctatatttttaaaataataaaatctaggctttaagaattatcttctgaaattttcttagctggaaaatgccaaagttattaattgaacaaacttggctcacactaaaaccgaagtcttttaataacaaatcaacttaacatttttcagtactatcttaaaggcaatagtcctttaccaggaaaataaggtggcaatacaattgagcaaaagtgcttggcaaagatactatagaatttgataccctagtaaatctcgccttagaacactttctaagaggttatgcagcacataattcaagtcacctccagaacaggaggtcaatgatgaaagaggataattatagcaccaactgcttcaagaacaaatttttagagtttttgctagcatgaggacccattcagtctgtaggacggtgactaaaattacttatgacaatcagattggctctcaaaaacataaaataagttaattatacttagaatcttctttttaataaagccaaaatttttttttgcatatggaattatgcctgtaattgataaaatgaaaaagaaaacatgctggtattatggaatgttatctctcagatgcctaaaatagtttgctatccagaacatcttagaacttcctggatgatttttacagataagattgtatgtatataaatatgaacatatgactaaaatagtttgctatccagaaaatcttagaacttcctagatgatttttacagataagattgtatgtatacaaatatgaacatacatgttacatagtgactacatcaataaactttttattctaagattgcaattattctatagatataccacaccatcatgaaagtgtggccctgagaggactcatttagcctgcaagaaacattttgattcttttatcacccttgttatcaaagcacattttattttatatcacatattatgataactatactaaataactaaaatgatgtagactttcctctcaaaacatttaaaagtttttttctctctctgtcctttcctaaaatcttccttcccttcttcccttctttttgctttcccttcctccctcctttcctttctttacttctttccaaagtctttttaaaatagttgcataaataagctatataataggtaaaggtaataggctttgggaaacagctctaattcctaatattatttctgggaaatttacaaaatgaatcaagtcaaattcattgttttaagaaattataaaaatagctgtggctttaatcttggaaaaaattgtcattttgaaacccagaatttcaagtactctaaaaaagttataaacttgatcacttaaaattatgaattagcatttattaagtatcttttaatactttattccactaaaatataatagatatgatcgaagtattctaatgtataaaactcacccttattagttatgttttaaaaactaaaataatatagtaaatgagtttatgaattatatattttaattattatatatgtgacaattaaatatttaaataatcattcatatatatatgtatatatattttaaagacaggatcttgtgttgtcacccaggctgatgtgcagtggcatgattatagctcactgcagctcacacaatctttctgcctcagcctcccaagaggcttgatatggtttggctttgtctccacccaaatttcatcttgaattgcagttctcataatccccacatgctgttggagggacctggtgggaggtaacttaaacatgggggcagttaccctcatgctgttcttgggacaatgagtggcttctcacgaaatctgatggttttataaagggcttttcccccttttgcttggcactcctccttgctgctgccatgtgaagaaggatgtgtttgcttccgcttccaccatgactgtaagtttcctgaagtctccccatccctctggaactgtgagtcaactaaaactctttcctttattaactacccagtcttggacagttctttatagccatgtgagaatggattaatacatagctggaactacaggtgcatgccatcatgctgaactaattatttttaattatttgtagagataaggatttctttatgttgcccaggttggtccagaactcctggcctcaagtgttcctttcagtttggcctcccaaagtattaggattacaggtgtaaaccactgcacctggcctagacaaacattaaatttccaaatatttgcttttattttaaattgtattaggaatagacagaagtctcttttatatatacccaataagttaatgtttctttcaattaaatacttcaaataatcatattttttaaagtaaactatagaaaacatttaaaatcaatatgaaaattttaaatattaatttctacttcattcatgataatatagtatgtatattctaccgtatctctctatgcatagctgtatatatgtcaagaggaattttttggaccatgaataatgataaaagctatctatttacaagtaaatcaatatttggaggaggttccaagatggccaaataggaacagctccagtctacagctcccagcgtgagtgatgcagaagacaggtgatttctgcatttccaactgaggtaccgggttcatctcactggggcttgttggacagtgggtgcagcccatggagcagggtggggcattgcctcacctgggaagcacaaggggttgtggaatttcctttcctagacaagggaagccatgacagatggtacctggaaaattggtacactcccactctaatactgcgcttttccaacagtcttagcaaacggcccaccaggagattatatcccacgcctggctcagagggtcccacacccatgaagcctcactcactgctagcatagcagtctgagatcgaactgcaaggcagcagtgaggctaggggaggggcatccaccattgctgaggcttgagtaggtaaacaaagtggacaggaagctcgaaccgggtggagcccaccacagctcaaggaggcctgcctgcctctgtagactccacctctgggggcagggcagagctgaacaaaaggcagcagaaacttctgcagacttcaatatccctgtctgacagctttgaagagagtagtgcttcccccagcacagagtttgagatctaagaacggacagactgcctcctcaagtgggtccctgacccccaagtagcctaactgggagacacatcccagtagaggccgactgacacctcatatagccggacgccactctgagacgaagcttccagaggaaggatcaggcagcaacatttgccattctgcaatgtttgctgttctgcagcctccgctagtgatacccaggcaaacacggtctggagtggacctccagcaactccaacagtccagcagctgacggtcctgactgttagaacgaaaactaacaaacagaaaggatatccacaccaaaaccccatctgtacatcaccatcatcaaagaccaaaggtagataaaaccacaaagatggggagaaaccagagcagaaaagttgaaattctaaaaatcagagcacctcttctcctccaaaggaacacagctcctcactagcaatggaacaaagctggatggagaatgactttgaggagttgagagaagaaggcttcagaccatcagtaataacaaacttctccgagctaaaggaggatgtttgaacccaccacaaagaagctaaaaaccttgaaaaaagattagacaaatggctaactagaataaacagtgtagagaagaccttaaatgacctgatggagctgaaaaccatggcacgagaactatctgaggcatgcacaagcttcagtagccgatttgatcaagtggaagaaagggtatcagtgattgaagatcaaatgaatgaaatgaagtaagaagagaagtttagagaaaaaagaataaaaagaaatgaacaaagcctccaagaaatatggaactatgtgaaaagaccaaatctacatctgattagtgtacctgaaagtgacagtgagaatggaaccaagttggaaaacactctgcaggatattatccaggagaacttccccaacctaacaaggcaggccaacattcaaattcaggaaatacagagaacgccacaaagatactcctcaagaagagcaactccaaggcacatgattgtcagattcaccaaagttgaaatgaaggaaaaaatattaagggcagccagagagaaaggtctggttacccacaaagggaagcccatcagactaaaagtggatctctaagcaaaaaatgtacaagtcagaagagagcaggggacaatattcaacattcttaaagaaaagaattttcaacccagaatttcatatccagccaaactaagcttcataagtgaaggagaaataaaatcctttacagacaaacaaatgctgagatattttgtcaccaccaggcatgccttacaagagctcctaaaaggaagcactaaacatggaaaggaacaaccagtaccagccactgcaaaaacatgccaaattgtaaagaccattgatgctaggaagaaactgcatcaactaacgagcaaaataaccagctaagatcataatgacaggatcaaattcacacgtaacaatattaaccttaaatgtaaatgggctgaatgctccaattaaaagacacagactggcaaactggataaagagtcaagacccatcagtgtgctgtattcaagagacctatcttatgtgcagcgatacacataggctcaaaataaagggatgaagatctaccaagcaaatggaaagcaaaaaaaaaatagcaggggttgcaatcctagtctctgataaaacagactttaaaccaacaaagatcagaagagacaaagaaggccattacataatggtaaagggatcaattcaacaagaagagctaactatcctaaatatatatgcacccaatacaggagcacccagattcataaagcaagtccttggagacctacaaagagacttagacttccacacaataataatgggggactttaacaccttcaggtcttcagagcagaactgaaggagacagagaaacaaaaaactcttccaaaaaatcaatgaatccaggagctgtttttttttaaaaaatcaactaaattgatagactgctagcaaggctaataaagaagaaaagagagaagaatcaaatagacacaataaaaaatgataaaggggatattaccactgagcccacagaaatacaaactaccatcagagaatactataaacacctctatgcaaataagctagaaagtctagaagaaatggatgaattcctggacacatacaccctcccaagaataaactaggaagaagttgaatccctgaatagaccaataacaggctctgaaattgaggcaataattaatagcctaccaaccaaaaaaagtccaggaccagatggattcacagccaaattctaccagaggtacaaagtggatctggtactattccttctgaagctattccagtcaatagaaaaagaaggaatcctccctaactcattttatgaagtcagcatcatcctgatactaaagctggcagagacacaacaaaaaaagagaatttaaaccaatatccctgatgaacatcaatgtgaaaatcctaaacaaaatactggaaaaccaaatccagcagcacatcaagaagcttatccaccacaatcaagtgggcctcatccctgggatgcaaggctggttcaacatacgcaaatcaataaacgtaatgcagcatataaacagaaccaaagacaaaaaccacatgattatctcaatagatgcagaaaaggcatttgacaaaattcaacagcccttcctgctaaaaactctcaataaactaggtattgatgtaacctatcttaaaataataagagttatttgtgacaaacccacagccaatatcatactgaatgggcaaaaactggaagcattccctttgaaaactggtacaagacagggatgccctatctcaccactcttattcaacatagtgttggaatttctggctagggcaatcaggcaggagaaagaaataaatgatattcaattaggaaaagaagaagtcaaattgtcccttttttcagatgacatgattgtatatttagacaaccccatcatctcagcccaaaacctccttaagctgataagcaacttcagcaaagtctcaggatacaaaataaatgtgcaaaaatcacaagcattcctatacaccgataacagacaaacagagagctaaatcatgagtgaattcccattcacaattgcttcaaagagaataaaatacctgggaaccctacttacaagggatgtgaaggacctcttcaaggagaactacaaaccacggctcaaggaaataaaagaggacacaaacaaatggaagaacattccatgctcatggatacgaagaatcaataccatgaaaatggtcatactgcccaaggtaatttatagattcaatgccatccccatcaagctaccaatgactttcttcacagaattggaaaaaactactttaaatttcatatggaaccaaaaaagagcccacagccaagacaatcctaagccaaaagaacaaagctggaggtatcacgctacctgacttcaaactatactacaagtctacagtaaccaaaaacagcatgatactggtaccaaaacagagatataggccaatggaacagaacagagccctcagaaataataccacacatttacaaccatctgatctttgacgaatgtgaccaaaacaagaaaaagggaaagcattccctatttaataaatggtgctgggaaaactggctagccatatgtagaaagctgaaactggatcccttccttacaccttatacaaaaattaattcaagatggattaaagacttagatgttagacctaaaaccataaaaactctagaaaaaaacctaggtaataccattcaggacataggcatgtgcaaaggcttcatgactaaaacaccaaaagcaatggcaacaaaagccaaaattgacaaattggatctaattaaactaaagagcttctgcacagcaaaagaaactaccaccagaatgaacaggcaacctacagaatgggagaaaatttttacagtctacccatctgacaaaagggctaatatccagaatctacaaagaacttaaacagatttacaagaaaaaatcaaacaaccccatcaaaaagtgggcaaagcatatgaacagacacttttcaaaagaagacatttatgcagccaacagacacatgaaaaaaatgctcatcatcactggccatcagagaaatgcaaatcaaaaccacaatgagataccatctcacaccagttagaatggtgatcattaaaaagtcaggaaacaacaggttctggagaggatgtggagaaacaggaacacttttacactgttggtgggacagtaaactagttcaaccattgtggaagacagtgtggcgattcctcaaggatctagaactagaaataccatttgacccagccatcgcattactgggcatatatgcaaaggattataaatcatgctgctataaagacacatgcacacctatgtttattgtggtactattcacaatagcaaagactttgaacaaacccaaatgtccatcaatgatagaccggattaagaaaatgtggcacatatacaccatggaatactctgcagccataaaaaaggatgagctcatgtcctttgtagggacatggatgaagctggaaaccatcattctgagcaaagtattgcaaggacagataaccaaacaccacatgttttcactcataggtgggaactcaacaatgagaacacttggacacagggcgaggaacatcacacaccagggcctgtcatggggtggggggaggggggagggatagcattaggagatatacctaatgtaaatctcgagttaatgggtgcagcacaccaacgtggcacatgtatacatatgtaacaaacctgcacgttgtgcacatgtaccctagaacttaaagtatattaaaaaaataaattaaaaaaacaaatcaatatttaaaattgcgttactacggcgatatatttcttttctatatcattttgaaattgtgataaaattgctttaatatgaacactaaaagcagtatacagaattactttcttaaagttcttactgaccagtaaattacttttttggttccgtactctcatcaaccaaatatagtgttctctatttaggtttagaaaaatcttgaggtcattagttatttccctgtattcacacagtattaccactagaccacagcatttaaatagatttttaaaagatttttagaaaaaaaaatcatagccattgctccttcactgctgaagacagaatgagatttggtttcaacaaatacttagatatgaggaagagcctttctaattggtaaagtaacatagtctccttcagaaggatacatgtattttagaaataaaatattcaaaataggagcatgctattacaggaaggttactaaatcaaagtgagctgaaaacgttgccaacatagaataataactgaatttaatgacaattttatatttgtttatttgtttattttaccttatttttcttgagacagagtttcactctgtcgtccgggctggaaggcagtggcgtgatcttggctcactgcaacctccgcctcccaggctcaaatgattctcgttccttagcctaccaagtagctgcgattacagggacgctccatgcctggataatttttgcatttttagaagagacagggtttcaccatgttgcctaggctgctctcaaactcctgagctcaagtgatccacccaccttggcttcccagagtgttgggattacaggcatcaaccaccacatccagccagaaattaaacacaatttaaaacaaatctctaggggctttttgttttccattagataaaatatacttaactttaaagattagtatcatacaactaagtaataatatacttatttatataagatatatttgtaagagaaatttaaaaattgtctaaaatattagaaattaaaaattttataaactactaacctgtcatcatgctcatatgttttatttctatttatttgtgaaatacagcattttttcagtccttgtttatatgaaaactgtctaaaggtttgatagttaatcactctatctttcctggaacactctttatatgggttatagaatatcatattccacactactggctgccttagtgatcactcttcattcttctatttagctgattcgtttacctattcacaactttcaagtgatggcgaccacaggcgcctctgccctttttcttattttttttttaaatttcaacttttattttaggttttggggtacatgtgcaagtctgttacacgatgtttcataatgctgaggtttggggtacaattgatccagtcatcgaggtagtgagcatagtactcaatatgtagtttttcagctcttgctcccctccttcccccacctcctctaatagtctccagtatctattgttcccatctttttgtccaggtgtacccaatgtttagctcccacttataagtgaaaacatgcagtatttggttttctgttcctgcattaattcacttggtataattgtttccagctgcatcaatattgctgcaaagggcgtgctttcattcttttttatgtttgcatagtattccatggtgcatatgtaccacattttctttatccaatacaccactgatggacactcagattgattccatgtcttagctattgtgaaaagtgcagtgatgaacatataagtgcatgtgactttttggtagagcaatttatttttctttggttatatacccagtaatggaattgctaggtcaaatgatgattccattttaggttaattgagaaatctccaaactgctttccacagtggctgaattaatttacattcccaccaacaatgaataagtgttttttttccccccataacctcaccagcatctgttttttgactttttaataatcaatactctgactggtgtgcggtggtattttactgtggttttgatttgtgtttctctgattattagtgatgaacattttttcttatgtttgttagttgcttgtatgttttcttttgagaagtgtctgttcacgtcctctgatttttaatagggtgtttgttttttgcttgtcgaattaggttctttatagatgctggatattagacttttgtcagatgcatagttcataaacactttctcttattctataggttgtctgtttactttgttgatagtctcttcgctggggcaaagctctttagtttaattagttcccactcatcaatttttgtttttgttgtaattgcttttggtgactgagtcaaaacttacgtgccaagagcaatgtctagaatgatatttcttagatttccttctaggatttttatagttttatgtcttaaatataagtaatttattcatatcaaaaaaatttttgtatgtggttgaaggaaaggcctagtttcattcttctgcatatggctagcgagtatactagcaccattcactgaataggcaatttttctctatagtttgtttttgtaagttttgtcacatgtcagatggttgcaggtgtgtgactttatttctgagaactctattctgttccactggtctatgtgtttgtttttgtaccagtaccgtgttgttttgattactgcagtcttgtattaataatatagtttgatgtagggtagtgtgatgcttccacctttattctttttgctttgctcatatgagttatagtaccatgcttaaccctaggtaatgtggggttcattcattcattcattcatttaacacgttcactaaatagaaattactgagttgtgagagtataaaaaatgaaaaagctcacaaggagatggagttgatctcacacccccttctcctgaatgttctttagaaataattcatccatattgaccttatcaaacaccaacctccttcctacctcaagcttttccatttgcttttgtctttgcctgtaagactcttgcatcattatcctcttttaacattctggtctcaaatgacacaaactcctctgcatatactcatccacaaactactctatcactattatttttatagcacatatgcttatgtgaaattatgttacatatttacttgtgtatggttttgcagcctgtctctgtccatcatctgtaagctccattcgagtagattttttttgtgatttgccattatttaagagggcaataataatttgttaaatgaatactacaactgatttaaactgtcccatagaagtgatatttacggtgtcttttaaataaacatagaaattaaccttctcagtcttaaaacttgagagagctacatttgttttatctgagttattttctaaggacaccaaccatcgggcctcccagagagtatcaaggaactgaaacttactagagcactgcatctgggcaacgagatacaagacccttcactgtcatgactggctaactgagtccctgtttactgttaaccaactcatcttctttatctgtccctaattcctgttttcctgcatgtagttacatttcttctctgcaatataaacccctgattttagtcagtctgggagatgtatttgacactaacctcccatctcctgggctgcagcacctgattaaagccaaccctggcaatgctttttgtctcagtgatcggctttctgtgcagtgagcaacaggacctagaccaaggatgtccgatcttttagcttccttgggccacattggaagaagaattatcttgtgccacacatataatacactaacactaatgatagctgaaagctttaaaaaaaatcacaaataaacctcataatgttttaagacagtttatgaatttgtgttgggctgcactgaaagctctccttggctgcatgtggcctatgggccatgagttcgacaagcttgatcctagaccaaacccctgacatttcagtaacacttacgtgtatgtgtatcatgagctgccaagatgtataacacatggggattatgagaaaaacagttcaagataagatttgggtggggacacagccaaaccacatcattccaccctggcccctttcaaatctcatgacctcacatttcaaaacacaatcatgccttcccaacagtccctcaaagtcttaactcatttcagcattaatccaaacgtccaagtacaaaatctcatctgagacacagcaagtaccttctgcttatgagcctgtgaaatcaaaagcattgttacttcctagatacaatgggggtataggcattggtaaatacacccattccaaataagagaaattagctaaaatgaaggggctacaggccccatgcatgtctaaaatccaggggggaagttaaatcttaaagctcccaaatgatcttctttcactccatatcatatccaggtctcactgatgctagaagtgtgctgccatggccttggacagcactacccttatggctttgcagtgtatagccccctcttggctgctttcatggctggcattgaatgcctgtagcttttccaggcacacacagcaaactgtcagtggatttaccattctggggactggaggacagtggctctcttctcacagctccactaggcagtgcaccagtggggactctgtgtgggggctcccaccacacatttctcttctgtacttccctagcagaggttctccatgagaattctgcccctgcagcacacctctgcctggacatccaggcatttccatacatcctctgaaatctaggcagaggttcctaaacttcaattactgtcttctctacacccgctggaccaacaccacatggaagctgcctaggattgagaattgcatcttctgaagcgatggcctgaactgtaccttggcccattttaaccatggctggagtggctaggatgcagggaaccaagtcctgaggctatacacagcaggggggtccctggacccagcccaggaaaccatttttccctcttaggcctctgagtgtgtgatgggaggggatgctgtgaatgtctctgacatgcccagcagacatttcccccattgtcatggtgagtaacatttggctcctcattacttacgcaaatttctgctgccaactggaattcctctccagaaaatgtttttttttttttttttctactgcatcatcaggctgcaaatttttcaagcttttatactctgcttccttttgaacactttgctacttagaaatttcttccaccaggtaccctaagtcatctctctcaagttcaatgttccacagatatctagagcaggggcaaaatgctgcgtctctatgcatagcaagtgtgacctttactccagttcccaacaagttcctcatctccatctgagaccaactcagcctggactttattgtccatatcactttcagcagtttgttcaaagccattcaacaaatctctatgaagttccaaactttcccacatcttcttgtcttcttctgagccctccaaactgttccaacctctgcctgttacccagttccacagtcacttccacattttcagatgcctttacagcagtgccactctacctggtatcaaattactgtattaatccgttctcacactgctatggggacataccagatacttggtaatttataaagtaaataagtttaattaactcatagttctgcagggctggggaggcctcaggaaacttacaatcatggcagaaacatacaagacatccttcttcacagggtgacagcaaagagaagtgcagagtgaagtaagggaaaaatcccttataaaaccatcagattttgtgagaactcactcactatcatgagaagggcatggaagtaacctccccatgattcaattgtctcccactgggtctctcccactacacgtgaagattatgggaactacggttcaagatgagatttgggtgaggacacagcaaaaccatatcaccctctaagaatttatttatctaagaatggggatacattgttggcaagttttcaatctataacctataaatatctgctaattttcgcattgacagcttctcatattcgtctctcaagatggtggacaaggatgagaaacataggtatgcttttgtactcatgggcctcacaattggacaggttggagagacaaaatgtacacataaaaacacaattatttcccaacatttctgattaaaactgtgaaaaggaaacatgtggtgctattaaacggaggtgctacaactagagaacagatcttaagatttatagtaaactagactttaaaactcactgcagacactcacaaatcacaaaatacacaaaatgtattttagttcatagagcgtatagtaattgtgttatatgtacagtctaatttagtatatcatttgagtattaaaatgataaactaggccaggtgcggcggctcacgcctgtaatcccagcacttcgggaggccgaggtgtgtggatcacctgaggtcaagagttcgtgaccagcctggccaacatggtgaaactccgtctctactacaaatacaaaaaaattagtctggcatcgtggcgggcacctgtaatccaagctacttgggaggctgaggtaggagaattgctagaactctggggcaggaggttgcagtgagctgagatcacaccactacactccagcctgggtgacagagtgagactccatctcaaaaaaaaaaaagaaaaaaacttaattttattaggattttgaacaaggggtaaaagtagacatatatcagtaggaagttacataaattaaagctgtcttttaaacaaaaagtcttcctaatttttggtaagaacgttattaaaatatgtatattttaaaaatgtgtgggattctaaaggccctgtcagcatattttcacgaaaactttcttctcgaatattacagtgccatggatgacatcagagttacttcaagagtttaggtattaatatcctaaagtttacagttgatgaggatgtaagcactgtaccaaactagatgcaaagttgtgtttttccatcactctggaagtgaggagaaagaggaggaaaaattaactaacatcaatgtgcttcacatgagctaagtgtgtcattctccatcaagcccaaacaataatccagcaaaatagttcttcttattcctatatgattacaaggtttaaagaggttaattaactgctgtacaatataatttttatgagttaaacaaaaacaacaacactagtgacatcagtcaataattttcatatactctagagtgcccaaacctaacggcactcaggaagaacatgatttatgacatctattataaaggaatcaattttttttggttcatgatttaggtatctttctaaatatgattgggggtagtatgtaacttatttaaatattatgtggtttccaaaatatgtaacaaatgatatcagctttgtgatgtccttttatctgctaaatttgaaatgtgtaaaattcaataattatgagtatggatatttactcatatctgtattaacatgaataacacatggcagacaaatcctgcattggtgatgctcacattagatttttaaaataaaaatgtgatataattctacagagtaataaggcgagaataattaatatagcagaatgaatgtaaatttacaccaagaaaatagaataataagatttcaattattttcttcattattcagcacattttctacttttgatttctattcttacagtgtgtgttaaacacaatatgtttcgacttagttatcatgagaatataattaattactacagaaggtaattgcatacctgtatgaaggatgtttcaaacttgaaaacttagggaatttcagtgaggcatcacgctacctgacttcaaactatactacaaggctacagtaaccaaaacagcatggtactggtaccaaaacagagatatagatcaatggaacagaaaagagccttcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaaggcaaaattgacaaatgggatctaattaaactcaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaaggtggcaaaggatatgaacagacacttttcaaaagaagatatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttacactgttggtgggagtgtaaactagttcaaccactgtggaagtcagtgtggcgattcctcagggatctagaactagaaataccatttgacccagcaatctcattactgggtatatacccaaagaattataaatcattctgctataaagacacatgcacacgtatgtttattgcggcactattcacaatagcaaagacttggaaccaacccaaatgtccaacaatgatagactggattaagaaactgtggcacatatacagcatggaatactatgcagccataaaaaatgatgagttcatgtcctttgtagggacatggatgaagctggaaaccatcattttcagcaaactatcacaaggacaaaaaaccaaacaccgcatgttctcactcataggtgggaattgaacaatgagaacacatggacacaggaaggggaacatcacactctggggactgttgtggggtggggggaggggagagggatagcattaggagatatacctaatgctaaatgacgagttaatgggtgcagcacaccagcatggcacatgtatacatatgtaactaacctgcacattgtgcacatgtaccctaaaacttaaagtataataataataaaaaaatataaaaaaagaaaatataatggactaaaataattaggtccttagtatcaggggaaatcttgatttagtcatttttcttaaacacataattatcaagaaattacttactcaggctcacattgtttccttcataatttcttcatagttatagcaatcacattgtagcagggaataccaaacttattattatcattaaaaacaaatattaagtaatttgttttcaagaacacaaatattttaccccgacatggtttccaaaattctttttcccaaagtctttgaggcaactactctgactgattttgtaacagtgcaattcacaaaatctcccaagtatgatttaacatcaggaattactataaaggaattactataaagtggtttgggtgtgtgtgtgtttgtgtgtgtgtgtgtgtgtatacatatacacacacaaaatatatatatacgttttgcaggcatgtgacttagtcatattttagtgaatttaactggatgtcaaggtatccttaaaggacaaaagagaaagaaaaaaaaaaaaacagcaggcggaactcttcatgtaaccactgagaaagtcctgtgctttttttacttcttcctccctcttccctgtttttaacacctggaatgaccaatatgttttgacaacatgttggcaagttccttatgcagtttgacacttaatataaggtgtttgtatagttcagtttctacagataggatattgacacagctatttaagattgtaaaaaatacttgctttagggctatttaccactaaatgttttgggaaatgtgcttttcaaaggtaaacgtaactcgacccttaaaggtatgaaataacacattccttgtaaaatttatttatttaaacacagttgttaagtttatgaagttgacatttggcacaccgtcagactttcctaatacaaaaaattcatgtagccaaaggaacttagagatgaaccttatctgagctagtaattagtgaccctatattctatgccttaaattcttaacactgtcttcacaatctacaagattaagcaggatccaacttaggtttccctctccatcctcctgaaaaaaaaatggccttggtttttgaaacttactgttcttcctcatacttcagggcctgattcttttgttacgtgactttatcttggcataaccttcagacctccgctcagaatcacttctagaaccttccttgactctctagatacaatcatgctccctcttatctggtttcatagaaccctaaacatttctaagtgcttttctttttttttttttcttttttcttttctttttttttttttttttttgaggcagagtcttgctctgtcctccatgcttgagtgcagtggtgcaatctctgctcactgcaagttccgcctcctgggttcacaccattctcctgcctcagcctcccaagtagctgggactacaggcgcccaccaccatgctcggctaattttttgtatattttagtagagacggagttttaccatgttagccaggatggtctcgatctcctgaccttgtgatctgcccacctcggcctcccaaattgctgggattacaggcgtgagccaccgtgcctggccttacttgattgactttttaacttttatcctttcaagtttgaaataccaaggcttggaaccatgacagttttcccttatgcttaatctagcatctcttatataatagaatctctttaaataatattcaatgcacaaacatatagtaaatcttgaggaatttttattgtgtttggatctcaagggcacagatttgagttaaatattacctatagtttatgaaacattatcattgatggatcttcaaggcatatttgtttattcatttctttctcttcttttattctcatacctgtttttcctatctctctttgccaccaatggcaatctttttaatacatttaaggagtatcttttaactagaccatttatggtacattgtattatagtttagcaaatatcccctcccctttcttctacttcctattctgattttttgggctaggccatgtgacttgctttggtcaacagacatgaagaactgtgacacgggagcagtctttacatgtcatcatgtggttaggcaagttctcttaggattctattctcactatgtgaaaagcaggcctggttagccatgcgtccctgcagaaggagatatgtggaacagacatgagcccagacaaggtcagccaactcctagctgcctcacagacccataaataaaaatattgatctttgctattgcagaacagtgagattttggtgttgtttactaagaattgtttttgtaggaaaaactgtagaagcttctgtgtgcttaaaaaaaaaactttatataatggtattgctttctttttctattttcattgagcactcagttcttacacttcattctttttgctatgtgttaatcaaatcctgctgcaccagaagttcacagggtacttcacactaactaatgatcacagttgtataggaatctctggtatatgttagaaagttcataatatgacatacaatgttcctgacagtggcattgtcttgaatgcttttaaattatttgactctgtagtaaagatggcttgaggttggagagaggatggggtggcaggctctccattaccatggtgagtggaacagccaggtgtgaagccaaacaagctgtagcatttagccacaatggtagtgtagtcaaagggaaacttcaaaacagaatacttgggtccagtccttagattataaacacaccccgagaaaagatcaagcagggaaaaaattgtcatggtcatgtttcagaggcatagcaccttcctgactccctactaccttatgctacccacttcttctctacaacttatgctcaggttcctggacctctgacctttacaggattttccagaatgcaggggaaaagcacaaagagaaggaagcagatcacaaaatataaatatggatgacagatctcatagacttaaaccataaaaaaggtcagagtaaacataaaaaaaagatagttaatatatattatttactatgtagtaggcaccaactgttccacataaatgacatcatttcaacatcacagcaaccctataaagtatttcttttgtttttagaacacatgaaatatattctttaaacaaatttttaagtgtatcacacagtattgttaactacagtcacaattttggaaagcagatccttagaacaataccagaaaaacaaacaacaaataactcaattaagaaatgggtaaaggatttgaataactttttcaaaaaaaaacaacaacatacacactcgacatacaaatggccaacagtacataaaaatgtgctcaacatcattagtcataatggaaataaagtcaaaactacaatcagatatcgcctcatgctttgtaggatggcttttatttaaaacaaatttttttaaagttagcaagaatgtgaagaaattgctacacttgtgcattgttggtggaaatgtaaaatggcactgtcaatatgagaaacagtatggggtttcctcaaaaaaattactaatgtaactaccatatgatccagtagttccacttttgggaatttattcaaaatatttgaaatcaggatctttaagagatatctatctgtactcccatgtgtactgaagcattattcagagtatccaagatgtggaaacagactaaatgttcattgatggatgagtggataaagaaaatgtggtatatgcatacaagtgaacattactcagctttaaaaagaaggaagtactgccatttgtaacaatgtgaacgaatcttgaggacattatggtaagtgaactaagccagtcataggaccaataccgcatgattgcatttacatgagatatctaaaatagtcgtcaaactcaagaagcagaggtggttgtcaggggctaagggaaaggggaaatagggagtagctgttcaagggttataaagttttaattgtgctatttttgttctcattttccagatgccagaactgagggttacagtaaattaagtgacttgaccaaggccacagggctagtcagtgggagtttttgaagttgaaaccagacattcttgctcctgagcccacacttttgaaaccacttaaaattttattgagctgataaactatataaatttgcatatgaggggccatcatacaccagacacaattcatacaaagaaaagaatatctaaatatatactagtaaaaaactttaatataaaaatggagatttttttaagcagataaagctaaaatatctaaaaatgaagaaaaattaatttggcttcacactttataatttattaaataataaaaacatagcgaaacatcatctatatagctttaaagggaaaaacttttgacccaagactctagtagtctttcaagttttctaagtataagcaaaaaaaaagtgtcatataagaacttacaaagtgtatatcctcaataaattgaatacataaataaactaagagatgcagcaaatgcagagcttaagagtggatgggtcagaatataaaaggagtgttgcacgtcatacataggtttaaatatggaaaatataaatggctgtttaaaaatgcctaggaaatataattaaggcaccataaattatttttaaataaaatgtatgtgactaattcttcaaagaaaatataatgaaaataaacttacagagttaaaaacaaaaaggtgagtcataaataaatgtcatgtccccagatgcctcagacacatgaaaattaaaagagtaagaaggcagcatcaggagaccagaggccaatttaccatgaaggccgcccatgggttcctaatcaacagaactatggtccttcatttaaatttcattgtccttaccctgtctgcaaagtttttcaccattcatttccttctctccattgaaaacttcttttcacctgtaccacattactagcaggtttcccttccatcttgtcagtctttaatttctctggctctttccactaatcagtccttgacatatccccaaattctgagagtctatttccaggtttttctcttatctaattatgttttcattcttagagaatggatttactttcagagtttgaacctcaactcaggtaactcctgtgttcacgtttcttttttaagctcttagtctgatattttctgcccgatccatcccaggctctttaaatgcaaccacatcatccccgcgtcagatcaaagcaatcaaagcagctgcggcaactcaatacctatcatctagggtccttctcacggagttgctgatctgtgtgaaggcaaccttagcctcacactgccatctgcctctagcctcccctcagcattaggtttcatgtactccttggtttgataactgggcaacagataaggtttctgccagccccatggtacagctccttcagcctccatcctccacacctgaggccgaggggatgggggagggtgtgggtgccaatttttctcattctatagatagttgcactcagatgttttgaaatcatttaaaatttaatttgtcctaaaagtgacctcaggctgtgacacagtctctaggctatgttaggtctgtgtttgattgtagggctacggtccaaacatagccaccatgcaagaaaatgaacgaattgcaaagaggacaaagataagaccaggaattatgagtggcttaatttagagggtgttaaggccaagaatccaggtcatgagaagccaagataccctttcagagggtctgtttccatttcccctggcaagacactcagaataaagaatatcatttaagccataagggaggtctgtgggccagtcccagagaaagtctattatatttcactcaattttcttggaaatctgtcttgtttaaagtatgttgggacccaggtcctgtgaggtatattcttattccccactcccgaaatatgtgaattattgatactgttaaaagaaaagctttagacaaatttaagagtttaattgagaaaagaaaaaaaacatgatttccaaatcagcccctagaatcaaagaaaattcggagagactttggcactgtcacaaggtcaaacatctatgggaaaaaaatgtgatgtgcaaaaactaaaactgagatacagaaacagctggattggttacagctcagcatttgccttatttaaacaaagtttaaacagttggccgcctatgagtggttaaagtatacctactggaattggctaagactaagctgtcattacagggaaacatactactaaagttaggcttttagtctgtttacctgctaagtatctgagtatggacattttccaggctagattttagttttatttagtaacacattatgggatctgaaggacacttttttaaaggttgaaacaaacaaattttacgcacatttccatttataacaaaagaaaaatgcccctttagctctggtaagtatgacaatttctaaattaaaagagcattatttacatctgaattgttaattctaatattaatttcaagtattattaataatataatcatttttcactaagccttcccttttatacccgtttacactttcaaatctaattatattccactgttgttttaaagatcaagccccaactgtttcatggtgtaccttctttctaattaagtatttgagacaaatgggagtcaggctgggactatagcatgtcaattttcacaagctgacattcacagtaaaagtagttcttgattatttccctaacagctttgatgttaaggggaaaaaaagcaacaacaacactgagctgtgtatattccctcctcatgctcctgggtgagaaatcatagttagtagctgctgatcttaaaaatcagagtctctgctacattgttagcaataatctaaatcaatacagactaacaacacaagccagtatgtggtgagtcatgaaaaataaatcagtagtgatatcaattgaaaatgataccaaaaaactatattatctggaaggaaaaatacaattttataacactcttggtcctgaatagttttgactatggcacacaaagcaagcaagcagcgaattacatgactgttactttctttctactgttagcaccctccgctaatagattgtaacagaatgactgtttggagggttaagcattgggaaatgtccataattacatagcatgtttggtaacatcgtgacattttaataaaacacagatatacattatagaaaagaagatctagccatctttttacactctctagagatcaataaatgtacccttgaatgacagatgggtgttgaaacccctttgcaaataattcctcaggtagctcttctaagctctgaaacgctacaatagttctcaaaatctcaacagagggaaataaaatacttcacagttgtaatgattttctctttatatatatactttctgaaaaagtatagtgagaatactaagtatttgggaactgattttaaagtccataactattaaaaattgcaagaatttttatggagcatatttatttcataaatcagtattaaagcctgaaaaaagaagtcttaaaagtctacataattctcacaatgttatatatatgttatatatatatatgttctatatatgttttatatatgttatatatataaagaacatatttctcacaatgttatatatatatgttatatacatatatataaaagaaagttggtcaaaattgttcatattgagaggtgacaacatgctggtggccctcacttgctctcagcgcctcctcggactcggcgtccactctggccacacttgaggagccccttcagcccaccgctgcactgtgggagcccctctctgggctggctgaggctggagatggctccccctgcttgcagggaggtgtggagggagaggtgcaggtgggaactggggctgtgcatggtgcttgtgggccagcacgagttccaggtgggtgtgggcttggcgggccccacactccgagcggccgtctggcgccaccggccctgggcagtgaggggtttagcacccgggccggcagctgcagagggtgcactgagtcccccagcactgcccgcccgcccacgctgcactcgaattctcgccaggcctcagccacctccccacggggcagggcttgggacctgcagcccgccatggccgaaccccccccacccccgtgggctcccgcgcagcccgagtctccccaacagggtgctgccccctgctccatggcgcccggtcccatcaactgcccaagggctgaggagagcgggcgcgcggtgcgggactggcaggcagctctgcctgcagccccggcgtgggatccactagccaaagccagctgggctcctgagtctggtggggacttggagaacttttatgtctagctggaggattgtacatgcaccaatcagcactctgtgtctagcttggggttcgtggatgcaccaatcagcactctgtatctagttaatctggtggggacttggagaacttttatgtctagctaaaggattgtaaatgcaccagtcagtgctctgtgtctagctcaagtttgtaaatgcaccaatcagcaccctgtgtctagctcaaggtttgtaaacccaccaatcagtgctctgtgtctagctcatctagtggggacttggagaacttttgtgtctagctaaaggactgtaaatgcaccaatcagcactctgtgtatagctcaaggtttgcaaacacaccagtcggcactctgtgtctagctcaaggtttgtaaacgcaccaatcagtgctctgtgtctagttaatctagtggggacttggagaacttttatgtctagctagaggattgtaaataccccaatcagcactctgtgtctagctcagggattataaatgcaccaatcagcaccctgtcaaaacagaccaatcagctctctgtaaaatggaccaatcagctctctgtaaaatgggccaatcagcatgatgtgggtggggtcagataagggaataaaagcaggctgcccaagccagcagccgcaacccgctcgggtccccttccaccctgtggaagcgttgttcttttgctctttgcaataaatcttgctgctgcttactgtttgggtccatactgcctttatgagctgtaacacttgctgcgaaggtctgcagcttcactcctgaggccagcgagaccatgaacccactgggaggaatgagcaactctggacgggaggaaggaacaactccagacgtgctgccttaagagctgtaacactcactgcaaaggtctgcagtttcactgttgaagccagcaagaccacgaacccaccagaaggaagaaactccaaacacgtctgaacatcagaaggaacaaactctggacacaccatctttaagaactgtaacactcagtgcgacagtctgcggcttccttcttgaagtcggtgagaccaagaacccaccagtttcggagacaatattaaacatgttccaattactactctactttaaacaagaaccttataaattcctaaaatatataaaatataaggaatggtacaaataatgcttcacttgttggagatgaagtgaagatgaaacataaaccctatttatttatcccaattattccatgttcacatactcacaaaagactattctgtcacaatttaaccctgttccccaaaatctcctcataaatgcagtttcaaaaagaacaaaactatgcaaataaacattacacctgtagttttgttctgtcaaatttgggaatgaaacgtctctggtgaaaagaaataaacggttagccatttttaatttcaaaaatgatcagtcattcactattcatgtctcatgtgaactacataatgtcaacgctgtcacgaaagcacggtagaaaaaagagatcctctcagcttcaatttagtagagggaaaagttcctggaatatgtttttcctccctctggagcacttcagttttgcaaaacatgtattttataattcttattttgtattcaacaatagtgctctctctggctttcagagtttttccagtttctctgatatttcaaaaagttatggtgttgtcattttatagtttaacatgagtggttctcacttcattcaaaagaaacaggataccttgaaaacgatgtggccaacctctagaaatgaaaattattattgcttaataatagtaatacctaatatatgcaggggcagaagcctggttgagcatgtatatacatcaatcatttaattctcatagcccttacatggccaaactaagtcttggagatattaagaattttttctacagtaatacaaaattaaatttctggaagtctggcacattttgtcaatcctgaagaatacagaataaacgtttatttattcacctattcaattattcaacaaatgtttcctggcagactagtaagtagcaggcttagagttagacatgagaatacaaactgaaataagttttgattcctgtcctcaaggaccttacattctagtttggaagagagactattaaataaacctacagtgttaagatagatacttacagccccaggtagtggtataggatccctgaagagtatgaaattgaaactattttcttctaattaataaacatttataacagtaacagagtagaaaacacttggcaagcctatctgaataataattattctgtctttatggtaccaacataaaataagggtaaaaagcataacatttaaaaaaaagtaattatgtaatatagtaatttcaaaaacgttcatggaattgagcttttacttaggattcgtgtaggtgcaaccaaattgcaactatgctcacttaagggtcccagtttgcaacaatgattcaaaagctcaattctgatcatagctatatcaaaagattgttggtgtttccaggggcaaaactgagtctgataaatatatactcaataactgaaataaatagattcagtatttcaatggaatgactggcatccactttctatctaatgaaaggccaatatcaattattaaacgctaaaaattactactgggagtgcaaaactgaaaacctcttccaaagaaatatgaaatttaaatctggcaattttatttaaaagagcttcaaagtgtaaaaacagagctttctctttacataaatacttacgataagtaatttatcttctttatagaacagacaacagaccaagacaacttttcgcaccttggtggatgcgctctgaatgccaagccaggcaccacagtcattactaccaaaggggaagtaataaatttactgtctatacgaagactttcaggtctgtcccatgtaggtgaaaaatagcgcgacttttaatctctcatcattaacgccattaaactctatattaaattctgtgctgatgaaaattttttttaaatgtatgttagtattgtgtttccttacactcatttattacagagtgttatggtttctatttgcaattctgtcttttctataaaattttcagtttcttgagagcaaaaactggttgccacaatgaccagtatatagttggtgctaaaaacacatatgttgaataaaattgaatacatattcctaatttcaaagtaattgtacatgttacaatgtacttaaaaaacagaaaaattgccagtttcacattcactatctttattgatgggttcaagtctatgaaatttttgcctatcatatatcccaaagcacaataaagcagtttcaaagacattttaacacacttaagaaaaggagcttctgaattaaagcccaccactttcatattaacattaatacattttgattccatatagtcacaatagagtttataagacttgtccaaatcgaagctgaaaaatgttatgatggccattcacttttaattaaatacaagcattaaaagaaatactatttatattagcaatagaaaacagaacttctaaatcacttataagattcaggattttattttcttactcttctaaaatagttcatttaacttttatttgtatttttctaaaatttatcagccaccaacttacagtgtgagcccactcagagaaaaatttaaatcatcaggataataattaatatttataaaacaaggtatttatagaaagcttttttatatgtatactattaattatacatggtattttatcactctcactataataatattttaattaaaaccttgccttgaaagataatttgggatatctcaaaaaagtaaagttctatatgataaaagaatgttaactattttctgtaagcaatcttaagctttttaatttaccaaaataaacacattcaatataagtttcatgtgatatgttgatttggagtttgctaacaaaatagtcatatatgcatacagtggaaaatacataaatttaaaacatatccagattaagtgaagcttacaaatggagacaattcatatatatttatcattgttagataaattagtaattagtacattgtgcattctagaaaaacaaaaagcatattctttgtctaggttcaataatagtcatctgaaatatgctctgtacctgtggatgaaataagtaaaagaacataaaatgtatgaataaatagggtgaaatttacagagactacttttgctgtcttgtgattcggtcatttatgagtgttaaggatttttctcagtacagttcagaatattaatcaatgccttctacttacaggagggtctgcatcttcagcataaactgttgtgataggtgtacccttgactgcatccggagccaccatccctttgtatattcgtttactaaagacaggaggataatcattcatatcctgtaaaacacaattaggagtttagtacttcagttgaaaccaggttagggatacagttactagattgactcccagtcttcatatcacacaacttatttaccactgtcagccttccatcctctcaattccattactctcatttcagactggcacctcagaggaaactgccagagttctcatacaatattaatgtgtggatatcaactgaaggccgttccactggaataaagtctttcaccctcaaaaacatgccttttggagactgaagtgaccctggaatttttttctaacttctaatggtaagaggtaaaattttaacatttgaaaataagaacaagtttctttaaaagctacattctgtgaagcaggcgtaaaagattttttttaaatgctctttatatgtttttatagcaatgtaaattattttatatacttagcataatactgactagaacatttcagatacaaactgtgaaatatcctttgttgccattttacatgataaaaggagattttctctgcagcgcactaaaataatgacacttaagattagatatatttatacacagaaaacaatgttaatttactgaatttttttcagagcaacttatatgtatcttatttttccaatttggcgctatatatgcattgttattcatgcattgtcaagttcattaaataaatagttatcaggtatttcccactttcatcagatatttagcacttcagtgcgaggcactgaagatactgttgtgactcaagaaaaagatgtccctgtctttgtgtcacttaactgccattaggctagtaaaaatactaatctgcagaaaggctagtaactttgactaaattaatctacttatcagggccaaaataataaatcaagtcccctgaaaggaagaccatatttttctgaatcattttatcttttagagataattgtatataatcttttgtcaataaataatgcttattcatatggcagatttatttatttataatattttaataatccttaccctaccgtgttttgggtagtgtgggtcaaacatatttgaactgaaacctaaatttgttaattatctgctcttctcctccaagtcccctttttctcacttgctagtaaaaacaaaatttaaaaaattctacatattctttgatatttgcttagacacaacaattttcctgtacagtattaagctggaaacacataaattaacagatctcaaacttctctttttgcaaagaagtcagaataattatttcttactatcaaacaatgcttccttttatattcgccatagagttgagttctgagtagtcaatatgaataaacctgcatattctaataggagaacttgaactgtacacaaaactgaaaaataaaaaatatcatttcttctgttttgaaatacagtattcaccatctcttctatgaaaaatatttttacaataaattatggactttagaatctgaacaagtaaatgaaccgagaagttttagttctctataatgaggactgtgaagggtattgatcttgaggctccatgcagggagtaaatatataaaacattagcattcacacattttcgtgccctttccaagagtgccaattaacttaataagtggatgtggtaactaagggtgtggaaatcctttagcacccctaaattgtaacttctgaaggttcgaaaggaaggagcccaacactgcaatgtttccatgcatgagtttccaatgagctcattatgttcttaaaaattttattctttattttattctcaggggaaatttaaaaccttaatgtcacaaggtactttttggaaaatttgattcttcagaaacaaaaaaaatgtatatacttttccaattatgtcaacacagctgttcacagtgttgaatatgatgaactttttatttgcttgggaagtattcattggattcaccttctaacttgaatgtacagtgattcacaaactgattagacacacacctaagactgtaaatgactgaagcctatgaaaagattggttctcttccccctttattttctattgacaggatgaagaataaattaatgtagttattgtagtagtatttctttttatggcacgttgtacatactttggggttataatctttcattgtggttacaaaagcagctagttgcatatagtttttccacaatgcattatttcaagaggagaaatgtattgaaatgcaattccaacaagcataatcaatagttcactgtatttatgctcagggacatctgaacaaaaatgtatataaatcggcttctgtgcaaatgttctcttgtgcagtaaattaaggactcgctcagcactccaaaaccatgctcttttctcttgcccattattccactagagggtagtattagcaaaaagaaatatttcctcctctgtagttaagaattgtatcactaaaacccataatatttgtttcttttggtaaaaatttttattggtctcaacaaaaaatagttttaatgcttcaaaagagtattctgaatgttatgatttacaacttgaaaaaccttatggtttttttcttaaggaaaactttaaaaaatggttatactcataaagcctgcaatttgtttccatgtgtcaagcaaataaaattatacctgaaggtgtaggtagctaacaggagaaaactatgttttatttatttatttgctacattagagtctgtaataatcacagaaaccttttctcctttagcagactaccaagaagatgtaaggaatctttttaatgatcatgctaggaagataagaacttgctggtaagtttgtaaatgtaatgacaagttgaagttctacacacacaaaaaaaataaaaataaagagaaaaagatgataaaatttttgattttctggaatcacaggcaaaaacctatagaacagtttttatttagaagataagtagaaagttctaactagttggaacttgatcatctttttaaaaataacgtgtaggctgggcacggtggctcgcatctgtaattccaacactttgggaggctgaggtgggcggatcacccaaggtcaggagttcgagaccagcctggccaacatggcgaaactgtgtctctactaaaaatacaacaataagcctggcatggtggcgggcacctgtaatcccagctactcgagaggctgaggaagggagaattccttgaacccaggaggcggatgttgcagtgagccgagatcgcgccattgcactccagcctgggtgacagagtgatactcagtctcaaaaaaaaaaaaaaaaaaaaagatatgtatatagcaaatgccagtccttaccatactaaagctaattcaggctctatgaggagacacagacagtataagccaatgggcggaatgactttagttgtttctgtcttatggtctagcattagcattatccttgttgagctatatggctgctctataatgccttgaggtttatggagccgatacctacttttacgtgggtgtatggttgattgtttgcctcttaccagttctgttttccactactagacactttctatttgctgtccaagttgctgtttctcatatttctcatattattagcattctgctgggtttttttctctctcaatttctgtattgtctccttgtctttactgacttatttcccttcttttatgcttctgcataaaaagtcataaaaggctacatctgcagctaaagaaaatatttgatatttttactgccaggctaggcatattcaccacaagctgatttaagaggccatgggccataagtgaacattggtggtagcctggcagtactccccaagggtctttgatagtggcacagggtaaggctcctctgcttgtggagaaggactgtttctcataggttgagtgcctgctcagccacagtacacaagaacacaaggtagaattctaaggttttgacttccagacggtaactttgaacctgttcagggcctgggagatttttgccaccctgaagggaaagacacaggtctggctggctttgccacctgctgattatagagacccatggccttgaacaaacttaagtggtagccagggtggttacagcaggtcttggacaagacccagtgctgtgctgggtttaggtctgacccactgcagtcccagcagtggggtccacaggggtgcttgtgtcaccccaaccccagctccaggtggctccaaacagagacactctgtctgggagagagcaagggaaaagaacaggagtttctgcctggtaattaagggaattcttctggatcttatccaagaccattaaggtagtaagagtctgccaagaaccacagtgttactgggcttgtggtgcctcctaaagcagatacagctttagcaacacctacatcctttcaaatacctgaaaagctttccaaataacaaatacgaagaagtccagactgtgaagaatacaataaatacccaacgcttaaatgcccagacacagacaaacatccacaagcatcaatatcatccaggaaaacatgaagtcaccaaatgaactaaacaagccaccagaaaccaatcctggggaaacagagagagtgatctttcagacagagaattcaaaatagttgttttgagaaaactcaaaaaattcaagataacacagagaagaaatttagaattctatcagatacatttaacaaagagattgaaataattttaaaaatcaagaagaaattctggagttgaaaaatgcaactgacaccctgaagaatgcatcagttttttaatagcagaattgaccaagcagaagaaagaattagtgagcttgaagacagcccatttcaaaatacacagtcagaggaggcaagagaaaaaaaagaacaaaatcaatgaaacatgactacaagatctagaaaatggcctcaaaagggcaaatgtaagtgttattggcattaaagaggagacagacaaagagataagggtagaaagtttattaaaaggaataataatgaagaacttcccaaacccagaaaaggatatcaatatccaagtacaaaagattatagaactaccagcagatttaacccaaagaacactagctcaagttatttaataatcaaactcccaaaggtcaaggataaataaaggatcctaaaggagtaagagaaaagaaacaaataacatacaatggagctctaatacatctggcagcagacatttagcagaaaccttacaggccaagagagagtggcatgtcatacttaaagtgctgaaggacaaaaaaaattcctagaagagtatatctggttaaaatatccttcaaacaggaaggagaaataaagactttcccagacaaataaaagctgagggatttcatcaacaccagacctgtcctataagaaattctaaagaaagttcttcaataaaaaaagaaagttcgtgagtaataagaaatcatctgaagatacaaaactcactggtaatagtatgtacacaggaaacacagagtattataacactgtaactgtggtggtgtataaaatattcttatgttaagtagaaagactaaattatgaaacaaaaataactacaatcacttttcaagacatagtaaaataaggtataaatagaaacaataaaaacttaaaaagcatggagatgaagtatagagtttttattagttattttttcttgtctgtttatgcaaacagtgttgttatcagcttaaataaagggttgtatgatagtatttgcaagcttgatgataacctcaaaccaaaaaatgtacaatagatacataaaaaataaaaagtcaacaaaatcaaagcaccagagtatactaccttcacttaaaggaagacaggaaggaaagaaagaaagaagacaaaccataagacaaccagaaagcaaataacaaaatggaagcaataggtccttagttataaaaaataacattgaatgtaaagggattaagctctctaatcaaatgacatagagtggatgaacggattaaagaaaaaaaagacaaaatgatctgttgcctacaagaaacacacttcacctataaagacacacatagactgaaaataaacacatggaaaaatatattccatgctaatggaaaccaataaacagcaggaatatctgcaattacaggaaacaaaacagatttcaagacaaaaactacacagagagacaaagaaggtcactatataatgataaatgtatcaatttatcaggaagatataacaattgtaaatatatatacatatatgtatatatatacatgtatatatatacatatatgtatatatacatgtgtatacatacatatgtattcagtgtgtgtgtgtatatatatatacacatacacacacacatatatattttcaacattggagagctcaaatatataaagcgaatattattaaagctaaagagccagatacatccccaaacaaaaatagctggaaacttcaacatcccactttcagcactggacagatcttccagaaagaaaatcaacaaagaaacatcagacctaatctccactgtagaacaaatggatctaacagttactcatagagcatttcatccaacacctgcagaatacacattctcctcagcacatggatcattctcaaatacaggccataccttaggtcacaaaacaagtcttaacacattaaaaactttgaaataatatcaagtatcttctctgaccacaacagaataaaactaaaaatcaataacaacataaattttggaaattatactaacacatggaaattaaacaatacattactgaataaccaggggtcaatgaggaaattgataagaaaattgaaaacttttttgaccaaatgataatgaaaatacaaagtatcaaaaccaatagtgaggtgtggagttggcaggacttcctgggttgatttggggactttcacaaaagacccctgtgactcagggttttgagttcttaatcaataaagtgaaggattcaaagttaaccactccaagggaggattgaaaaaagagccactctcaatggacaaaaagaaagaaaggggagggggtaacacagggatataagtcctagccaccacagccagcagtggcaacccttccaggtccccttccaccatgtggaagcttccctttcgctttgttcaataaactgtgctgctgctcactctcctggtctgtggactctttttgagttgtaacactcactgtgaaggtccgcagcttcattcttcgaagttagcaagaccacgaatccatcagcaggaaaaactcttgattcaataggatatactgaaatttttactacgtgggaaatttatagctataagtgcctacatcatgaaaggaaaaaaacttcaactaaacaaaacaacctaatgatgcatctttaaaaactagaaaagcaagagcaggctgaagccaaaattagtagaagaaaataaataataaagatcagagcagaaataaatggatttgaaatgaagaaaacaataaaaagatcaatgaaacagaaagtttgtttttttaaaaagttatataaaattgacaaacctttagccagactaactaaaaaagaagagagaagacccaaataaataaagtcagatatgaaaaagaaaacattacaactaatactgcagagattcaagggatcattagtggctactatgaacaaacatatgtcaataaattggaaaatcaagaagaaacaaataaattcctagacacacacaacccatcaagattgaactatgaagaaatccaaaacattgaacaaactagtatcaagtaacaagatatagcaaataacaagtatcaagctgtaatgaaaagtcacctagcaaaggaaaagccagaacctgatggttttgctactgaattctaccaaatatttaaagaagtactaatactaatcttactcaaactattccaaaaaaaaaaaaaaaaaaaaaaaaacaggaggagggaatactttcaaactcattctataaagacaataatactgataccaaagctagacaaagagacatccaaaaaagaaactataggcaatctccttgatgaatattgatgcaaaattcctcaacaaaataataacaaagaaattcaacatcgtatttaaaagatcattaatcatgaccaaataagatttatctcagggatactaggatggttcaatatattcaaatcaatcaatgtgatatatcatcaacagaatgaaagagaaaaaccatatgatcatttcaattgattctgaaaaagcatttaataaaattcaatgctctttcatgataaaaaccctcaaaaactgggtgtagatggaacatacctcaacataataaaagtgatatatgacaaacccgtagctactcccatactgaatgaggaaaaactgaaagcctttcctgtacgatctgggacacaaccaggatgcccactatcaccactgttattcaatatagtactggaagtcttagcaagaacaatcagaaaagaaaacaaaataatgatcatctaaattggaaaggaagaagtcaaattatccttgtttgcaaatgataaaatctaacacttggaaaaacctaaagactacacacacacacacacacacacacacacaccacacaaagtattagaactgataaatttagtaaagttgcaagatacaaaatcaacacagaaaaatcagtagcatttctatatgccaacagtgaacaatccgcaaaagaaatcaataaagtaatcccatgtaaaacagctacaattaaaataaaatacctaggaattaaccaaggaagtgaaagttctctgcaatggaaactataaaacatggattcaagaaaatgaagagaacacaaaagaatgaaaagatatctcatggtcatggattgcaataatcaatattgttaaaatgtccatactactcaaagcgttctacagattcaatgcaatccctgtcaaataccaatgacattcttcaaagaaacagaaaaaaaattctaaactgtgtatggaagtacaaaagacctagatagccaaagctatattaaacaaaaggaaaaaaaaaaacacctggaggaatcacattatctgactttaaataatattacagagctatagtaaacaaaataggatggtactggcataaaaaaaaaaaacacacatatatccatggaacagaattgagaacccagaaataaatttacacaactacagcaaagtcaattttgacaaaagtgccaggaatgtaaccagggaaaggacagtctcttcaataaatgatgccaggaaaactggatatccatatgcaaaagaagaaattaggccccatctcatgccatatacaaaaatcaaatcaaaattgattaaagatatgaatctaagacctcaaactatgaaatgactgaaagaaaacatgcggaaactctccaggagataggactaggcaaagatttcttgagtaatacctcacaagcacaggcaaccaaagaaaaatgaacaaatgggatcacatcaacttaaaaagcttctgcacatcaaaggaaagaatcaacaaagtaaagagacaacccacagggtgagcgcaaatatttgccaactacccatctgacaaggaattaaacagaatatataagcagttcaaacaactttgtaagaaaatatctagtaatctgattttaaaatgggcaaaagttctaaacaaaaatttctcaaaagaagacatacaagtgataaaccggtatataaaaaggtgctcaacatcattgatcatcagagaaatgcaaatcaaacttacaatgagacaccatcttacaccaggtagaatggcttttatctaaaagtcaggcaatggcaaatgctaataaggatgtggagaaaaggaaccctcacacactgatggtgggaatgcaaattagtacaaccactatggagaacagtatggaagttcctataaaactaaaaatagagctatcatacgatccagaaatcccactactagatacatggccaaaagaaaggaaatcagtatatgaaagaaatatctgcactcccatgtttattgcagcactatttaccatggccaagatttggaagcaacctaagtgtccatcaacagaataatggagaaagaaaatgtggtacaggtacacaagggagtactatttaaccataaagaagaatgagatcctataatgtgcaacgacataatcaatgaaggttaaaagtatatgagagaggcactttctggtgtctcccagaaaccagtgggtgatatttatggagccatgggagagattctttactacgtagatatactatttttaatcctggacatgcacattttctttgttttctctggtttggatttttataggaaatatgttatatcttagtcctaaaactctagaatagtagaattaaagatattttctcctgctatcaccaagttcactgacaaatataatataaagaacacaccaataggaatctgaaaatgcggactagaagagagggaaacatttgaaagccatacttcaaagcaaccccaacagaacaattagcaagttgtaaaaaacaatattaaatctgaccatacaccaactagctggttcacagaaattatcatttattcaaattcccacctccagacaatacctcttacctccatacaataggtatgctgtagatgaaatgtccagaatttctgttttgtttgagtctgggacaacctcctggtctctcaagcatcagcttttctgatgaaatcaaaagcaggaccctatcaacactgtcatgatggagcatcagtagcacgtaactgcctctcaggtgtccacggtttcacaaatgctgccttggtactgggcactgagttttcatctagaaaagctatcctttttcttctattctatggggtagcaatatttctttctggagaagaaaactcctctgaaaggtggaaatcttagcttcattttccaagactcactgtgtttaacaacaacctcagcccttgttacaaggtgaacctgatgatacttcatttctcgtcatttcacccctccctgcctactcccacacctgcacactaagacaggcaaacacaaccaagggtcaatctagtctcccgtcttcacagaagcatgtctccctctctcctactcccatgcagccattctatccaaaattataatgagcaaaatgacttgggtcatctgtttatctcagacaagttctttatactccttataatgctgcttagtataatatatccatttacatattcagcttttcagattcatattcagttttcagtttgctgtagaacagcccttttctttctgtgtattttctatattatgttacaacgcagactctaagaccaggtttctattataacttagtttgtaaggctagttatcactctggatcttttaaaattgtttagaattttattttcactttccagagatttgcttatatcatctaatttactatcatcacagattcagttcttctaaatatttagtatatctagaaatatacaagaaaaatatttacaagtaaaatacacaagaaaatatctctaatttactatcatcacagattcagttcttctaaatatttagtatatctagaaatatacaagaaaaatatctacaagtaaaatacacaagtaaatatcttgtatatacaaggaaaaagccttgttacattgatgttctataaaatcttttcaagaaaaaatgtatgttatttgtttgatcatcacaggttttgttttggattcttaaaacttgacactaagaaagctgtgtgcagatgtcttgataaaaatttttatttatactgtggaaatattgtttttccaaataatacttgaattttcccattcttgctccaattttaaacaggtttgatggactaggcattaaacacttcatcttttattttttcctcttgtttacaaaagaaattatgtttctgctcattttgaaagaaagaacttcaagatgttttcctgtggtgactttttgggtccaagtatctcctagcgaataccatacaattatgttatcaacaaaacagcttttcagtactgcgagtaattagaccaagtatagacaatttgaaaagctggtaaagactacatttgtagagaactgagaattgtactccattcttctcttaaaaaaaggataataatattttatgggcctcagtagtatatactagaattttaaagttatatttgtgataatccccaccctgagttatcagaaaagaggaaagcaagtgtcagtctacatttgggagaatttcctacaaattttattatgcttagatgaacttggaataaaaaagtggtattacatatgtctagagttaaatgttaagttttgctttaaatgtataataaataggcaatgactttgcatgagtcaggacgccttgaccaaaggaatggtgtgatttctctaaataagataaagcaattgatacaacacgaattaaaccaacactcttctctatctgaggaataaattatcttccagctgctgatgtagaagcgttaagtaatacccccatattgaaataaagggatgttgaggcaacattaagaacttttttaaagaggtatgaggcccagatacagaatgagggttacttagggcatatcttgctttttgaggtgataattttggacataatttaactcccctaacattttccatcaaaacaagccaagcaaatatatccaaattgaatccagagctgccaagtcagaatctatgagtgtttaccataactgtctgtcatcaaccacaccctcatcagagaaaaggccacaccatttgaggatctatttttcgatctgggaagaaaaggggaaatgtcattaatagcaagtcttttttttctcttctttgtccaaaatcatcaataaatgaattatttttctatttttaatgttttaactgttcaattccaccaagtcatatgagtagacaagagtaaaccaaggcaaatttttcacctggtccagaagatattttgctatttagtctatatagatcactctcaccttagtctttttcatctgcttacatattatggcatcttcataaccaccaatattatattccctaaatatttttgtaacagatttctaaatgttataacacaatagtgtgacaaaatcatatttcaaaatacaatacaatcaaagccctcccttcaggcaatccataattttgtcttgtcccttgatcctttttccagaccactagagcactgataattattgtctcgggaaagagaggtatgaaaagaaaaatcaggttaccccagaaaagattttgacagtttgagttcctatttccaaagaaaatttagtactgaataaagttttaatttcctgaaatagacacatttcttacctcctgaaataaatatcttaggacagagagacacaagaacggaataattaagtatatagacatgtggacccccgagaaataaagaacccagatcctgataaaactctcccaacaggtttagggtgtccgaggatggaaggagcttacgatctccattccaaggtagtttagaggtggaaacagtatccatagaagaaatggcatcaatttgtgtgctagcagataatccaggtcaagtgtaaaaaaagacagcgaaagaggtgggggccaagagaactaactagagggagctggtgtgtgtcaatctcattgagaaaagaaaggctggcgagtggacactagctcatctgaaaaatccaggtggagacacactggaattcatcaggaaacagcataacacatagagaacagaggagagcaagacaagacaactgcccaccctggggtggcacagagtcaggggagtcctcccactgtggagaaacagtgagtaagtgagtccctggggacccaccttctgccatggacttttgcatccctggactcaggagatctcccccatgagctccccaccggtgcctccaggctgacacggagaaccatgtggagtcttggcagagccatactcaggcacacagggagtcccaggagacttgtatccccagacactctggcaccagtggctgtagctcctgcagcagtggaggccagacttgcatgcctccagtaaaggggccaaatccacgaggctgagcagtgaaacattgcaggcctcatctcagctgcaccttgcaggataaggcctactgtccattccagccccacctgagttcctgggtcgggagcagctctgtacttctctgggacggagctcccagagggagaggctggctgccatttttgctgctctgcaaccctccctgtttttgctcttaggcttgggagggacagggattagggactaatgccgacccccaacacagcgcagtttccttacagaaaagcgggtaggctgttttccatgtgggtccacacccttgctacttctcaccgggcagggcttcccaacctaggacctcggcaacccccgacctgggctcttgggccagtagcagctctgtactttcctgggacagagctcccagagggcaaggcaggtcaccattttttgctgctccacagtcctcattcctgttgccctcaggctcaggagggaatgtggtggttggagactgatgcaaacgcccagcacagcacggcagcattacagaaaagcagctagactgctttctatgcaggtctctgcctctgctactctttactgcccagtgcctctggacttgggcccctagcacaaccaccttgtcaatgcctaacacttcagtcagtggtgagaaaaccccagagacaatccacaacctctctgtgactgcagctacccttgggctggggaggaacaaagggcttggccactatgcaggaactccagcacaccacagccacaatatggacagaagcccagtgtctgtttcccgtgagcccccacctctcactctttaccaggcagtgcctaagctcgggagcacggaacagccaccccatctccagctgagcattctcactgctagtggctttgtgtttccttaaggaggggctcctacagtcaactaacagccactctgccactgccacagcagtagttctgcccctgctgcccttggactggagaagaaagaaagggccaaaggttttactcactcttccaggaggacacagtcatcatatagagagaagcccagactgtcctccctgtgaatcctcaacctcccgttctttacccagctcaggccagcagtgcagccaccccactccctggctggacattcccagtaggagcagttttgagtttccctcaggttgagcacccagggacaaccgaaagcccctctaccactgctgctgcagtgatattgcccttgctgccctcagactgtggagggagcaaagaccctgagtgctttagccacacctccagacagctgcatcacccacaagcttggtcctacaatgcagccaccacaccccaggctgactgtactgattagtagtggctctgtatttttctggggtggagcaccaagagacaagtgaaaggccatctgccacagccacagccaaggtcccttcccttgttgtgtctaagctggggaaagaacataaagcctgagcttgccccagagctacaatgtgtagcctgggagtgccaaacagatatacagccagcagtcaagtgcaaaaggagccgacactttcagatcactgagaaggggcacaacaatccttaggaaatagaggagactgacgaagagtctacctactggccattccagttaagtgccatctgctggatcacagcccaaactttactattaaaaatattttgctaatatattcttctgtgaaaccaaggacaagagctcagttacaaataaaggtcatgcacaaaacctcactcctctgaaaacatctaaataaaccaactgactgtactcaaattagacagttgaaagaacatcagcgaacacagatgagaaagaaccagtgcaagaactttggcaactcaaaaaacaagtgtcttctttcctccaaacaactgtactagttccctagccaggattcttaactcagctgaaatagttgaaatgaaagaaatagaattcagaatatgggtaggaatgaaaatcattgagaatcagggaggaagtcaaaatccaaaccaaggaaactaaggattacaataaaacaatacaggagctggtagatgaaatggccattataagaatgaaccaaaatgatctgatagagctgaaaaacacactacaagagttttatattgtgattgcattaacagcagaagagaccaaactaaggaaagaatcagagagcgtgaagactggctctctgaactaactaagaaggacaaaagtaataattaaaaaaagaataaaaaagaatggacaaaacccctgaaacatatgggattatgtgaagagaccagatctacccctcattggcgtcactgagggaaatggggaaaaagcaggcaacttggaaaacatatttcaggatattgtccatgaaaacttcccaacctcactagagaggccaatattaaaatttaaaaactgcagagaactgcaagatactatataagaagacaatccccaaaacacataattatcagattctctttcattctttttaaaatgaaagaaaaaaatataaaggcagctagaaagaaagagcaggaaacctacaaagagaacccatcaggctaacagtggacctttcagcagaaaccctataagccagaagagattgggggcctatgttcagcattcttaaataaaagaatttcaacccaagaatttcatgtccagtgaaactgagcttcataggcaaaaaagaaataaaatacttttcagacaagcaaattctaagggaatttattacaaccaggcctgccttataagagctcctgaaaggagtgctacatgtgaacagccactacaaaaacacacttaaatacacagatctctgacactataaagcaatgacataagtctacataatatccagctaacaatatgatgacaggctcaaattcacacacatcaatattaacactgaatgtaaatgggctaaatgacacaatttaaagctggataaagaagcaaggaccaacgttatgctgtctttaagaggcccatctcacatgcaatgacatccataggcccaaagtaaaggtttggagaaaagtccaccaagaaaacagaaaatagaaaaagctgaagttgctatccaaatttcagacaaaaagagactttaaatcaacaaacatcacaaaagacaaagatgagccttacataatggtaaaggatacaatgcaataagaagatctaaatatcccaaatatatatgcatccaacacaggagcacccagattcataaagcaagttcttacagacctacaaagagacttcgatttccacacaatagtgggacatttcaataccccatggacagtaatagacagatgatggaggtgacaaagtgaaaaagatatttaggacctgaattcaacaattgaacaaatggacataatagacatctatagaactctccacccaaaaacaacagaatatacatacttctcatcaccacatggcacatactttaaaattgaccacacaattggacatcaaaacaatctgtaacaaattgaagaagactaaaatcataccaaccacactctctgaacatggtgcaataaaaacagaaatcaatactaagaaaaacattcaaaaccatacaattacatggaaattaaccacttgttcctcaattatctctgggtaaacaataaaattaaggcagaaataaaatatttcaaactaatgaaaacaaagatccagcataccagaatctctggggcacagctaaagcagtgttaagaaagaagtttatagcactaaatgcccacattaaaaaagtcagaaggatatcaaatgaacaatctagcatcacatctacaggaactagagaaacaagagcaaaccaaactcaaagctagcagaagacaagaaataaccaaaatcagagctcaactgaaggaaattgagatgcaaagaccatataaaagataaatgaatttaggaattatcttagttatttgaaagaattaattagatagatggatgaatagctagacaaataagaaaaaaaaagagaagatccaactaaacacaatcagaaatgactgactgaatgaaaaaagacattaccactgaccccacagaaatataaaagaacactcagagactatgaacacctctgggtacacaagctaagaaacccaagaggaaatggatacattcctggaaccattcaacctcccaagtttgtgttaaaaagaaactgaatccctaaacagaccaataatgaattttgaaattgaatcagtaaataaagagcctaccaactaggaaaagcccaggaccagttagattcacagccaaattctaccacatgtataaagagctggtaccatccctactgaaactattccaaaaaattgaggaggaggcatccctccctcactctatgaggccaaaatcatcttgataccaaaacctggcagagacacaacaacaacaaaaaagaaaacttcaggccaatatctttgatgaacacagatccaaaaatcttcaacaaaatactggcaaaccagcagcacattgaaaagctaatccaccacagtcaagtaggttttatgcctgggatgcaaggttggttcaatataggcaaatcaacagaagtgattcaccacagaaacaggactaaaaacaaaaactacatgatcatctcactagatgcagaaaaggatttcaataaaattccacatactttcatgttaagaacgcttaacaaactaggcattgaaggaacatactttaaaataataaaagccatctatgacaaatgcacagccaacgtcacactgaatgggcaaaagctggaggcattctccttgaaaagagaaacgagataaggatgtcctctcttattgccactcatcatagtaatggaagtcctggctagagcaataaagcaatagaaagaaagaaaacccacccaattaggaagagaggatgtcaaactacccctgtttgcagatgatatgattctacacctagaaaaccccatagtctttgtccaaaactccttgatctaataaacaacttcagcaaagtttcaggataccaaatcaatgtacaaaaatcagtaatagcattcctatgtaccaacaacatccaagctgagggccaaatcaagaatgcaatcccatttgcaatagttacacaaaaaagtacctaggaatacaactaaccaggtggtgaaaaatctctacaatgagaatttaaaatattgctcagtgaaatcaaagatgacagaaacaaattgaaaaacattccatgcttgtggatagaaagaatcaatatcattaaaatggccatactgcccaaaacaaagtacagattcaatgctattcctattaaactaccaaaggcattattcacaagaaaaatgtattctaaaattcatatcaaaccaaaaataagcttgaatagctaagacaatccaaagcaaaaagaaaaaagctgaagatatcacatttcttgacttcaaactatactacaatgctacggtaaccaaaacggcattgtcctggtacaaaagcagacatatagaccaatggaacagaatagagatcccagaaataatgctgcatacttataagcatctgatgtacaacaaaataaataaaaacaagcaatggagaatggactccctattcagcaaatgatgctgggataactggctatacatatgtagaaaaatgaaactggaccccttccttacaccatgtacaaaaatcaactcaagacggattgaagacttcaatgtcaaacctaaaactataaaaacacaaagataacctcggaaatatcattctggacataagccctggcaaagatttcataacagagatgccaaaagcaattttaacaacagcaaaaattgacaagtgtgacttaattaaactaaagagcttctgcatagcaaaaacaaaacaaaacgaaacaaaaaaactatcaacagagtaaacaggccacctacagaatgggtgaaaatgcttacaaactacgcatctgacaaaggtcaaatatccagaatctataaggaacttacaaatcaacaagcaaaaagcaaacctcccacttaaaaagtgggcaaaagatatgaacgcacacttttcagaagaagacatacatatggtgaacaaggatatgaaaaaatgctcatcatcactaatcatgagagcaatgcaaatcaaaaccacaatgagataccatctcacaccaatcagaattgctattaaaaagtaaaaaagaaaaaaaaaaacatgctggtgaggttgaggagaaaatggaacaaagcagtttggtgatttctcaaggacctcaaagcaaaatgaccatttgacccagcaatcccatttttaggtatatacacaaagataaacaaattgttgtaccataaagacacatgcacatgtatcattagtatcatgctattcacagtaataaagacatgaaatcaatcaacctaaatgcccatcaatggtagactaaataaagaaaatgtggcacatatatgccatggaataactatgcagccataaaaaagaatgagatcatgtcctttgcagcaacatggatgcaactagaagccattatcctaactgaactaacataggaacagaaaaccaaatactgcatgttctcacttagaagctgaaggtaaacgttgagtacatagggacacaaagatgggaacaacatacattgggggctgcttgagggtggacagatggaggagagtgaggataaaaaaactacctataaggtactatgttcattacctgagtggcaaaataatctgtacagtcaaaccctgtgacacacaatttacctgtataacaaaccacacatgtatctatgaacctaaattaaaagctttaaagaaagaaaagtgttggaaattactcagaatcatttgaattactcacccgaccattccctaaaccttttgaattaaaataataatatgttttcagttacaagagacaacatatgttaagatataacatttattttattttattttttgagacggagtttcacttttgttgcccgggctggagtacagtgctgtgatctcagctcactgcaacatccgtctcccgggttcaagcgattctcctgcctcagcctcctgagtagctggggttacagttgtgtgccaccatgcccagctaattttttgtatttttaatagaggtggggtttcatcatgttggccaggctaatctcaaactcctgacctcaggtgatccacccaccttggtctcccaaagtgtagggattacaagcatgagccaccatgcccagccaagatataatatgtatttatcaaagttttatgagttacaataacaaagacatggaatcgacctagatgctcatcaacagtgaattagataaatacaagggggtacatatacaccatggaacactatgcagccataaaaaagaataaaaccatgtcctttgcagtaacatagataacagcttgaggccattatcctaaacaaattaattcaggagcataaaaccaaatactgcatgttctcacctctaaatggtaactaaatattgggtactcctggacataaaaatagccactgaaaattaatagacagaaattgggtggggtaggaagtgaagaagcgggggttgagaaactaattattgggtactatattcactatctagttgacaaggtcattcatatcccaaacctcagcatcatgcaatacacttatgtaacaaatgtgaacatgtaatgcctgaatctaaaataaaatatgaaaatgtaaaataagacactaaaaaaagaaaaggtagtggaatacttccgtgtttcactgtgactgaagaattatcttaaaaaaataaaatccataccccaaaattttatggtcaagaacattaacctactggaaaaatacagttatactaattatgtattggtgaaatcttttttcacatcattactttgttgtctaagaaaaccactagcatatggctagctatttagcaggataacaatcatactgcaacctaagaaaagtgatgatttcttcttccatcatttcaaataaaagaaaatcttatttgtagtccctataatatgagaattgtagaaaagttgcctatgaccttcttttccttaggaccctggatacatatagtcttctactaaggtccctcagagacatttgtgttgcacatgcagaatctgaatgatctcacataatagctttgctattgtagtactggccactaaacaaaataaaaataaaaataaagaaaaagggagtaatcctcaggaacttttatttttaggaataaatgtatctgcactttcccacagtcttcaggtaaccaacagaatccaaatgatatggaattgtcagtaattatcataggtaaattctgctaaacaattcaccttaaacacataatggactttaactataatcacttcaaaagaacaaatgaaaaggcattcatgggaacaaaatacaacctgaaaatataatactggcaaagattaagtgaacatagatgcctagagttatctgcatgatctccaggattagataacctaacaaagttggtaagtcatgtaactttgatcccactcagctcttacacattttagcgactatatgaagcatgaatagtatcaccatgtagtagacaatatgtggttgccaatatttcattccaatcctatggtatgatcctgcaactaaacatttattaaaaatgtccacatctttccacatttttctatctaagcccatagatttcattgttttttaacatagaaacttgatatctatagtcacttggtaaaatctgagccataattatcaattatatttttgggggtagaacatagatacaactgtgaataaaatataaatcaaaacatgtatactaaagttaaattgtttattcaactaattactcatattcatctattttattcatggtcattgatatactctataggcttctttgcaagtgcttcatttatcttatagatcttctgtctttttcctccctccactgcccttgctctgtgcaggtatctctattcctttctgaccagccctttttcatcattccaagtctattcaggaagcagaaaaaaacactttaaataagacttttttaagtttctattttcttcccttaccaaaacaaaaatttttacaatgtaccatgatagtgaatgaacttttactttatattgcctaagaaattattgtcatgtaaagtcattttttagtaatatactcatttagtaaagtaacttgaggatttttgtatatgtatctttgtaattgaagtaaatttctcaatatgggattcagatgtcttgtataagaaacatctgtgtacttttctcaaatgctgatgtttatgatggtccccatgggacaggtccttctttggggaaggagtagagaaatctgaaagtttaagatgacgctcagaggatcacggtatgtactactatttgagaactgatcaacttacagtacttcttctcatatctacttttgtctcttaaaaatcactagaaattcaaaaagttaaaaatgccatgctctttcaggcaatcatctggcacatggtattataataaatgggataacaaatccagagaggttaacaaagtccccaaggtcatagagcttaaaaagggttgagccagaatttaacctcaattccatctaacttggaagcttatttcattccagaggtttgggccctaaattaattttagggcctaagaactcttggcccttcagagtcatatataaaatttttttagttgaaggatttgtaccaaataattatgcctgatgctgtggaatttgaactaaaatctagtctagagaggttaggacttgatggaagtcacagagctgatgcagactcaaatttccatggtctttgtacacatatttactgcctctttcaaatttatcttttatagtcaaaaatatagttatttcttatgtattcataaatatttccattggaaaatctatgttatgggtctggtaccactgtgtcattaggaattgttatcaaaacatattataggtataatagaaggaacaaaacctacatgtagagagagcaaagcaggcaaccagaagtcatctctagcccttacctttacaatcactgtgacagtagcaataccaggtggcattgttccataaatatcaaaggcctctaccagaaaagtgatacttgcttcttggtctggaaatgcctcataatctaaactccttaaaagcgatagttctcctgtaaatggatgtagtgcaaaaaagtgcttcacttctgggcttcttatccggtaagacacatttgctccaaggtcgacatctttggcctgtaataagcagaagaatagttttattagtgacgttaccaaaataaagaaatgcaggaaggatggaagtcatgcgttagtgcctaggacagcatcaatttaacgaggacaaaaagacacgttttttgtttttgttttttaaaaaagcacattatttaataatttaccagggaagagaaggagggatgggggagagaaagatggaggcagggaggaaaggagggagacagtgagagggagagtcagagagagagagagagggatctttctataagattttgtcattgttgacgttattactgtatctgtttaacttgaaaaatcactaaatgaactatatcacagtaaaaaaataaatattgtcttaaatgactgtttcttattttctactgatttgataatcatgaacaaatattttaaataaaaataaatactgagtgatttccataaacataatagatggctaaagtactataagaaaactgagaaaatataagtagtaattatttgtcacagggatcctataatacatttctagagatcactctaccatacttcctttgatttaactaggatttgagtagtagttacgcacaaggtgctgtagagagcaccaaaatgaatccagacacaattactgccctacaggttatggtctcagagaagaaacaagacacaaatactaaaatagaaaggaaaaaaatgtgacatgctatctaaaagatgttctaaattgggaacgatatcctttagctgaaaggatgggttttcatgggagtcttgtagaatggctatttcactcagcagtacagactggcaaatgcacctcaggtacagaaaaccgaatggagcaagaatgaaaatggggaagatccagagtatgctataatgtgcatttttaaatgcaaacacctcctatggtgaacctcagccttggtctcctccaatcaattattgacttaacaatcagaaagatgctattaaagcatacattttattatgtggtttttcctgcttaaaatcccctggtttttaattcaattttcaatcaacgccattatccttaacatggtaagagccactacattttctagacctttagcccctcacccctcacactttcccatcttccatgattttgaccaggctttttccccccaactactttgaacaatctttcttccttttctgcttggatagctcttacttgtccctcagttcaccatttagaaataagtttctctagcaaatattctctttgccttaagattaggttaggagctccacctctattacctaggccctttgtactgaggacctacgttttaactactaattttcttgactgatagctaaaccagcctgaaaactcgaagaaagcagtaaatttgttttgttcacctttgtatccccaaagtctttgcatcccctaggacagcatgaatttaacaacaccagcaggagacttggcatactatacatactgaagacatgtttgttaaataaataacttaactaattaattaattgacagatgaatggtggaatagatgaaggaataattgttctctccctggccagtatttgccttatttagatttgttaatgtttattgctgagttcaattatggaagggatacagagtctggaaaagtatgctaaaaacattcaagttgtggactgcaggtggaaaaatggctacttttttttttttccaaaacataccttatagaccaactgagtcagtattaaatgaggtggttgcttaaaaatgcagatttatggatcagcctaatctactgaatcaaaatgttcaggactgtgtaatttatagttaaaaacttaaaaaagaggcttgatacagagatgtcattaaaaaggagagttagattactagaagatggcttttgtgtattgaatgtgaaaacaatacagaataatgggtataaacaatatttgtaaaatagaggggaaaccaatttgtaactctctatattttttctgtgtgtacacatttatgttatatatgtataacccacacaaattcatatatatatatgtattttttgacatttgtgtgaacacaaagataaatgtgaaataaatttaatgctgagtactctggaggcacaatgtgggagattattaacttttgcttcataaactattgtattgtcaactgttggaataaacagaatattacttttgtaaattaaaaaactattaaaaagtatatttttaatttcttacaaatagatctttctgcccttaatttttgggatatctttaaagtaggcttgccacataaaatacaatatgcaatattggagaaataataaaaatttattcattgtttatctgaaattaaaatccaacttggtatgttgtattgttacttgctaattttggcacacaaaccctaatagcaaatctcctaatgtaggattcatgtaataaatgctttttcccacacacctctatttgaaggatggtagtcccagctggcaaattctcttcaacaaggacagtgtatgttgaattggtgaacacaggactgttatcatcaatgtccaaaaccttgatggccaaggttagagttgaatgacgagggtgtactgctccatctgttgccacaacaacaagttcatagtagtccctgacttctctgttaagcttcactgctgtgtaaatgctcccattggatgtgatacgaaaaagattattaaagttacccaaactgtagtgcacttgaccatttattccagcatcagggtctgttgcctattaaataaaacaaaaaaacaaaaaaattcacgtaagttttgacgggctactgtaaatgaaggtaacagttaacaaattatggtatttttctaaccaaaaattatttggccctctaaggaggaaatgacaatgacaatacaatgcaaaatttaaaacatgaaaaatattatactttaatattcttcatttaaaattaacataacaaaaacggataatgtcattagcaataacaatactatgttatgacagaaaactcataaaaatactgaatctttgtcttatgattttaataggttttgaattctaaagtgagaaaaaattttgtttgtaattcatttaacataatctgccgagtgacaatttaagattatgtaggtttttgctcactgtatatattcattttatatttatatatgtttagtaataatgttacacattatgtttgtttataataaataatattttattatgttatgctgttatttatgtgataatgtttattataataaacattaatcatatttaccataaataatatttataagtataacctgacttaatcctcatgatgttgttatgagtaaatattattaatctcattttacaaatgagaacactgtggcttatggaaggttacacaagaaagaaatatctcagtgtcccagttcttaacacaatacttcatatataaaagtacttaacaaatgcttgtggaattaatgaacattagatgaaataaaacagatttgaaactaaatctgttccaaaagtcaaataggattaaaactacagtaactgtaatgtatgtgcaagggactctttttcaacattagaatatacatctctgcataagtaagaatgtttgataccataatatacctatatttactgaaaatttgaagtcatgtaaaatcactttgcatcaaataaaatgagaaaatattgagtaaatattcatcgaatgaaatgtaataagaattaatcttagctaaaactcaattgtgatactaattatgaatctcactatcagctactgtatattttgttttgaaaagttccatgtaaaagaaactgaaataaatcttagaaactgtaaaatattatataattatgccccaaactgtcaacaaggaaaggaaggaaaacaagacacttggctgccttatgagccagggacacaaaaatcactcgaggtccataaagcgtggaatgcaatatgatgtattttaacagcacatatgcagtggtatatccagttttacaggcaatggtaaagcatgcagaatggggatgctgaatatttgcatcttctttgaaacaagaatgtctaagatgtgaaaatcatgtttacaacagtgctcctatatgtcataatgccaagcatttcagcaggatttgtctctttgactcatcaaaacacaactgcccctgggagtttgacatctctgaggtttaattctgagaaaagatagaagaattgcagaaatacctgaagagaaaaaatacggtgacagagtagaatagtttctgttgatatagtttcttttacttttatactttgcctagaatttgtcttacgaattattgacaaatcagtcaagctgatcattctagtgaaaacaaccaacactgccttctccctttttcaccaaaaaaagagggtgatctctttttttggtctgaaattactcatcaagtaaatagataaaattgtaagccaagaacaaaatataaatatgttttgtttcataataataatacccttaaaaatttcagtcactttttctgtctatggaatatcttaagatcaaaaaaactaatcatttatgcaattagaaatttaaatgactcttgttcaagttgtttttattgacccatataattgaatatttattatggtagaatggctcaatttgactgatgtggctgtgtgtccgtgtgttttatacatgtccagctgcttaactatacatccactaggaaacatatctaaacatatctaaattagttttgtttttgctcccatagcaaattatcacaaatttagcagctgacacaaaacaagttcattattttaaagctctataggtcaaaaattcaagatggtctcaccagggctatgtttctttctggagactctaaggagaaacaacttctttgctcattcaagttgttgacagaattcagttgctagagtttgtagaactgagatccccacttccttgatggttgtcatgtgaggaccaatcccggttgctagaggtccccatatcccttggttcatgacacatttccaccatttttttttttttttttgagaccaagccttgctctgttgcccaggctggagtgcagtggtgcgatctcggctcactgcaacctccgccttctgggttcaagcaattctcctgcctcagcctcctgagtagctgggattacaggcacctgtcaccatgcccagctaatttttgcatttttagtagagaccgggtttcaccatgttggtcaggctggtctcaaacccctgaccttgtgatccacccgcctcggcctcccaaagtgctgggattacaggcgtgagccactgcgcctggccatttcttccatttttaaagccagcaatggtggtcaagcccctcacattttttgaatccctccctccatctttttccattttatctttctgacctactcttcaggcatcctccttcacttttaagggcatgtaagattacattatgctcccttggacaatccaggatagtatccccatctcagaatttttaaccttgatatatgtgtgtgcacatgtgtgcaagtgtgtgtatactgccatatataaatatatagcaatctatattttaggatgggatttttttttttttttgaaacaggtcttgctctgtcacccatgctggtgtgcagtggtgtgatctaggctcactgcaaccttcacctcccaggctcaagcaatcctcccacctcagcgtcctgcgcagctggcactacaagcacatgcccccaggcctggctaattttttgtatttttatcagaaacggggtttcctcttgttgcccaggtcagttttgaacttctgggcttgagccatcctccccctttggcttctcaaagtgctgagattacaggcatgagccatctcacctggccggataggagtttttagagaaaatatccaagcagatattcattaagcagactgacagtaaatgctaaatggggcatcctcaccaatagagtttcagaattttaaataatcagtttaaattggtataaattacgatatgtcaagtacacacacattttgactgaatctatgacaacttaattcactgaattcaaagctaccatgacaagaagtatatttgatgcttatggaaaaaaagactacaatatctttggctctgtttatatgctggattacatttactgatttgcgtatattgaaccagctttgcatcccagggatgaagtccacttgacagtagatgcagaaaaagcgtttgacaaaattcaacgacacttcatgctaaaaactctcaataaattaggtattgatgggacttatctcaaaataataagagctatctatgacaaacccacagccagtatcatactgaatgggcaaaaactggaagcattccccttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagaggataaaatacctaggaatccaacttacaagggatgtgaaggacctcttcaaggagaactacaaaccactgctcaaggaaataaaagaggatagaaacaaatggaagaacattccatgctcatggataggaagaatcaatatcgtgaaaatggccatactgcccaaagtaatttacagattcaatgccatccccatcaagctaccaatgcctttcttcacagaattggaaaaaactactttaaagttcatatggaaccaaaatagagccttcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgctgcatatctacaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaacgttagacctaaaaccataaaaaccatagaagaaaacctaggcattaccattcaggacataggcatgggcaaggacttcatgtctaaaacaccaaaagcaatggcaacaaaagacaaaattgacaaatgggatcgaattaaactcaagagcttctgcacagcaaaagaaactaccatcagagtgaacaggcaacccacacaatgggagaaaatttttgcaacctactcatctgacaaagggctaatatccagaatctacaatgaactcaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaactacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactagaaatcatgctgctataaagacacatgcacacatatgtttattgtggcattattcacgatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattgtcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataataaaaaaaagactacaatatcccccagaaagctactctaaaaattttaaggtgactgagacacacatctaatggaaacaaagggaacagaatataaaatgcagagctatttccttatctattcctatgtccccattaaattaaggagcataaataaggtgatgtaagttaagcaacatgagctggctaagcaaggcagttttacttctttactattctagatgaacatgtagatgttaaacaagataaccaaacatagaatcccttattatcagcagtactgtcaagaactttgcattgatgtttaatatttagtcaagcagctcagtgtatgatgctataatgaaaatatatattttcctagaaatcaattaaaagttaattaaatttgttaataagaaaaataacacatctcttttccccttgtactacatcaaagcaatgaacagtaatagctgcaactttataatcatctgtccatggttaacacatttttgtaatatacaccttactatggggcctgatttgtggctactaatttgtgaatgcatattgctgggaaattggctgatagcctgtagtcaaataaagacctcactggacagaactttgaataattgccagaaacaccacttgcaaaccttattcattaacaccaaagttagagtatatgaaagacaaccaagtaattacttaagaaaaaagtcaagggaatttattgaaccaaagttttttgtataatttttgagaagcgattttatagcatgccacttgaaaagggaaaagggaaatatatttcttaaacactaaattcattccccacccctttttttctcattatcttcttagaatggtctgttacacaattctttccatccataaaagtggaagtccattactgggtttgctaccctgggggttaccagtcctgtagagaagaccttaaagcatgcctgtatgggtggaatatactaggataaaacctcaaagaacaggttgatgtttgcactccttccactgagaagtccctgggtaggttacttgtgtaatttacaatgattcatttccatttaaaatatgtcaaatatccattcagattaattatttagatagaaaattttatgacaaaaatcagccccaaggaaataacttgaggacaaaaccaaaatgttatagctattataaaggtgtgaactaccatgtagcacctaattggcccagtgtgaagctgagagagtgctttgctctaccttttgcttgtcctttacagcgatttaagaggtcgtgtacatctttctcactttgaagtgggaaccataaaagctgttgatcagggaggttgggcagtgcatccttcatgacattattagtgaaaatacatttttaaaattattatctattaacttcaaaaagatgtacaatagttgtctttttttttttttttttaaggagctgagctatttcaagggctgtgattattagtgtaaaaggagacaagcaatttaaagactcataatgcaggtaaattttttcactctccacacaaatgcctcataatcattattgaacaatggcaagtagacttactggccagaagataacttgcataacttgaattaaaatcactaaaaacataaccagaatgaatagcttttcattctagtccctagaaatctagtccctagaaaacacatatttaacacaaataatttctcaaggggtcagctattattctaagatacacaataaactacattttatcctagcattcaaggctctacctggtcttgttctaacctatctttatgcatttatatccctcagactaactctctgacacaaactctgtgttttagtcaaaggagtctatttatggtatgaatcaccaccaagaaactctcaagtgtcagtggtttgttaccactgatgtttctttctcgcctatacagcacccactgtgaattccaaatccagctttactctatcttgtctttactcagaagagaagctaaaggagcaggcttcattggaatatgaagctcatgtggtgcaagaagaaaaaaagacatgagatagccaagctgcagcttttaacgcttctgcttggaggtcaacgtatcacctatactcctgcttcatcgttgaaggcaaatcacatgacaaggccgatgtcaaggggtgcagaaattccattccctcacacagtgggacagtgataaatcagaaacacttttacaatgtactaccctggttttccttgaaatgaccatgctctccctcaccttccctgatataggttttttttttgtttgtttttattttcccccaatccaacttaaacgttcaaaacctagcttcagttctacttcatctgggaaacctcttctttccatccagccttctggtccctcttgcacatagcaaaactcactttttattgctatttaagtatgctacgcaattaaataattggcctaaaaatctgtggtgtatccatgtattatgtaataggagacactgttagagaaaagaatctgtaaattgttttgtggagtgtacaatgtatgagaagtggaaagttggagcacagatggaaatatggtagagaaggaaaaaaaaaagatagcaagcaaataaaaataaacaatattcctgtagttgggtgttatttaacgcaaatgaactgaaggtgtcaaattaaataagacagtttaagctgttccaacataacctgcaggcctcttactaagtaagcattaggaagaaactttgcactaaaaacctttacatattcagttctcatgttaatggtaaacacttgaagattatgacatcaatgcttcaggaaaagagttgttgtcatgttcacgctcatacagcaaagaaagaaagtaatgttgtttcatgttcattaaatgtatttacatagtaaggctgtcttttccctttttcaaatattccttatagtgctgaaaacgaagaggaaaacctgggaggactcatttcatatttccccaccattgcttagtatttgataattatgcagtataggttgagtgtgtatatacctctttatgtgatggtaaaaaaaattatatattaaattatatttagttttccaacctcttcttacttctatttctccaacttcttcattctcatctttttctctgtgggcgaacatattcttaccactaaatctaagtgcattttgccatactaaccatgctatttcatgtctgctttatccagtcataaaatcttccccttatttccaaaactgattattcttcagccctagtatcacctctcagaagcatctgagtaagctaaatgcctcatcttcatgctcctgaagctcattgtatgtttctttaccacatgccctattgctttttttctgtcattttttaatagcccacatgaaattaagaattcataaggacaggatggcttatttatatcatacaatgcctgctttatttttctttttgcaatgacataggttagatatgcaataatttctgccaaaatttcttctgaagctatttccatttttcaattacatatcattcccaccccaaccacccaaacacatgaagaaataaaaattgccaattagtatttataattttgtcttaaaagaaggtatgttttctgtttattagaagaaatataagaaaataagacacattttgttctttaaataaaacttaagtgatcacataactacttattaaactttgtccttttgttacattttattgctttcttgttttcaattttgtcactatattagtcagttttcacaatgctataaataacttcccagaaactgggggatttataaatgaaagaggtttaattgactcagtttcacatggctggggaggtctcaggaaacttacaatcatggtggatggtgaaggggaagcaggcaacttctttacctggtgacagaaaagagtgaagaaggaactcccaatcacttataaaaccatcagatctagtaagaactcactcactgtcataagaagagcatgggggaagcctcccccatgatccagtcaccccgctccttggacaagtggggattataggtccctccctcaacacatggggattacaaatcgagatgagatttgggttggtacacacagccaaaccatatcagtcacctagaattctttaaggaaatctatttctaggtcagttttaaagtaagtacaatatatatacctatttttgtataattaaatatattagtttaacttttaacagtctattctagcattgcttaacctttttcattatcaactcctgtcaaaagaggattttaagatttttttctttctaatagaacccttataaatttgtacttccacagatatatttatgtatatatattatccatgctttatacataagaaaagtaaggttttcttgtctcccaaaacctgattttccacattggaaatgatctaccaccgttgagaatgcatgctctagccaaaagagagtcctctgtaacttccttatataccataaacatttccacataagcattgttctttcagcactcattacagtggcatcactttctaaaatgtctgtccatattactatatggggcaactcagggtatctctgagcttgtactcaatactcatcacttcttaagtaatgaaataagggaaaaataccatctccatgaattgcattttatgtgataatctgcttagcccaggccttcctatttatttgattatgcttacattttctgccaagttataacacaaagtattgtggtttgttttctgaataactattttaaatagtcttctctatgcttattgaatatgtgacattttgcttatcaggtgtttttataggtcctatatactaatccaagttttaattttcttttttctagtattctgttgggttcaatataaacatgcccatgcccttctctgaagagtcaagagtaatgtataccttaagcattgtccttctgtcacagggcttttcattatattacattgtctcacaaatcattttcttgtatcatttctagaaaaaaaattcttaactggaaactgaaaagaatgtgacagccagattggattctctgtgaaattctatacaattaaattttctggataacattcaagtaaaggattaacagaattgtaagtaaaacaagagcaataaaaatgcctctggctaatataataactatttaatgagagaaaaatatctcttaatttcccaatactatcaatcatttcatttgctgaatataagctcacgtttttcccaaacaatacccataaaattaaaggtgtttttctctattttacacacattgtcacaatttgacctaccttgataacatcacagggatagagccagatataggttccagttttattttatcatcactcattccttgagctagtttagtaattttcagctgtttcattaccttaatttgggatgtctccaaattggttgatttaaaaatgtatgttaggtattcattttgctgacaacaattcactgaagtaactgaggatcatgttttctaatgtcttgtccaacacagtaatttaaattaggaaaacagaattaattggaagaaacaacttatgtttctctatctactccctgggactgcattcaaagagctaagatgtacacaatgtgaaactgccttttgaattagaagttatgaactcagattctgctgtgtccttccttttccagctgccttccttcagatatactttcctagtaccttcctgtgtgctactatgtaaatagtaggtaactattttagaatcattcctcagcagcaggctttatgaaaagtgctgtcagtttgttttctttaattgtggtgtaaacagtactgctgcttaccttaatattaattatatacacacatttttagaagttacagatatataaaagggccaggtactttattaacatccttttttctttctggtaaaggtaaaataagccagattggagattaaaaagtgtaggaaacttcatttggatgccattcctttgttaattgttagcatgtaggcaataagaggaatatttcaatatcaattggccaagcagaaattttcctgagaataacagaatgttttcaatgacatgttatttatggagtgtaactgttccacaggagcagtctagtcagtagaattaaatgatactgtatactagaactggaatctgagataaaatagaagtggtaagtttacaggcacactctgtttcattgcacgtggctttattgtgcttcacggacgttgcattttttacaaattgaaggcttctgacaaagatgccttaagcaaatatattggcaccatttttccaacagcgtgtgctcatttcatgtctctgaggcacattttggtaattctcagaatatgacaaacttttaaattactactggatctgttatggtgatctatgattagtgatcttttaagttactattgtggttgtgttggggtgccgcagaacacaccatatgagagcaaatttaattaataaaggttctatgtatacatttttttgacacatggtccaagatgagatggtgtatgtgttctgatttctccacccactgaccattcccccatctttctcactttccttgagccttcctattctctgagacacagtgaaattaaaattaggccaattaataaccccactatgtatgggctctaagtgtttaagtgaaagagttgtgtgtctctgatttgaaattaaaagctagaaatgattaagcttagtgagaaaggtaggtcaaaagctgagaaagcttaaaaacttggcctcttgtgccagttagccacattgtgaacgcaatggaaaagatatttcataaattaaaagttctactccagtgcaaacacaaatcataggaaagtaaaacaacctgatgtgaagctgatgtgaagaaagtttgagtggtctggatagaagatcaaactagccacaacattcccgtaagccaaagcctaatctggagcaagaccttaactctcttcctttctctggagcttgagagagggaaggaagctgcagaagaaaagtctgaagctagtagaggtgggttcatgaaatttaagggaaaaataaaaagccatctccataacataaaagtgcaaggtgaagcagcaagtgcagatgcagaaggtgttgcagctagttatccagaaaatccagctaagatatttgtagagggtggctacgctaaaaaaacagatttccaatgtagataaaacagttttctattagaatatgccatctagaacttccgtaacttaaaacagagaggtcaatgcctagattcaaggtttcaaaggatgggctgactttcttgttaggtgctaagagctggtgactttaagttgaagccaatatttattgaccattctgaaaatcctagtgcacttaagaattctgttaaatttactctgtctgtgatcaataaatggaataacaatgcctaataaaagcatatatttatggaagcataaactatgtttacagcatagtttagcaagtattttaagcccatggttgagtcctactgctcaggaaaaaaaaaagacttctttctaaacattactgctcattgagaatgcacctggtcactcaagagttctgatggagatgtaaaaggacatcagtgttgttttcttgcctgttaacacaacttccactctgcagctcatggataaaggagtaaatttgaggttttcatcttattatataagaaataaatttcataagattatagctgtcattgatagttattcctctgatggatctgcgcaaagtgaactaaaaatcttatggaaatgattcaccattctagatgccaatagcaacatttttgattcatggaaggaggtaaaaatatcaacattaatagaagcttggaagaagttgatttcttccttcatgaatgactctgagaggttcaagagaggtttaagacttcagttggatgaaggaattgcagatgtgatagacatggtgagaactagaattagaggtggagcctgaagatgtgagtgaattgctgtaatcttatgataaacttgaacagttgaggagttgctttttatggaagagcaaagaaagtggtttcttgatatgatacctactcctaatgaagatgctgtgaacattgttgaaatagcaacagataatttagaatattttatatactttgcagcaaggattaagaagattgactccaattctgaaaaaaacttatttagctacaatgctatcaaacagcatcactagctacagaaaaaaatttaatgaaagcaagaagtattcaatgcagcacaattcattgttgtcttattttaagaaactgacacagccatcccaacttcagcaaccaccctcctaatcagtgagcagccaccgacagtgagacaagaccctctatctgtataaagattaagacttgctgaaggttcagatgattgacagtatttttttaagccataaaacactttaattaaggtatggacactgtttttcagacacaatgctaattgcagtatggagtatacttaatggagtatagtatagtgtaaaaataatatttatatgcactgggaaacctaaaaccttatgtgactcgctttgttgcaacatttgctgtattactgtggtctggaagagaactctcaatatgtctgaaatatgcttgtattaaaaatgtgtattgctttgagaaacagaaactctacaacctatctaccaagaatctttgcagataataaagaaagaagttattgacttatttcaaacttaaagtctgaggagtctaaatggagactgaagttacgtctaacatgacaagtgtgaaccactttgatttggtttgcccagaggaaacattactcctgctactttcataaagactgattgcttttgacagaaatctgtctgtgcagagttggatgagtatgatactgagaagtcataaaaccattagaaaagactgggctcagaggatctcctcataaaaatgttcacatagaaggaataagacagtgaaaaagaggctgtatttgctatatatccacgttttgaattatgacacacatagggaatatttccagagcttggtttcagaaatcccaatgaactaattcttctgagatatcataaactaaatagtgggaaagcaagccaaagaaatactgtctgatttatttattttgcagactgcacttagattttttaaaaaagagcctctcactttgattcttgtatgacttgaagaaaaagctatactgtataaaggtgtttgcaggtgggttctctggcaagcagacaatgaggcagagattagttgcaagagttttgttggggtatgctttgggggtcaacatttttggagggcaaaggacaagaccagaattggattcagggagaaagtcaaactactgtgcagggtcaactacagccttggccaacccaaggaaggagctgcagaattgcaattgcatgtcacagtttttctgagctggggtaaaatgtccagcattttacactcaggcatcagtcaggatatgggctacactgaaatgggtgtgactatgggcaagggaaccttctgtagataaggtcatctctgaagtggctagcagctgtacatccctctttactccttcatccctacatcactccaaaaagccaagacattcagctctaccttcaagggagatctgcttggcacacagtcttcataacaagcctctatcttggattggtttttttcttagagtataaaatccttgcttaacagaatatagcaaattttatacacatacacacatatattaaattattacaatatcattcattgttttcaaatgaaacagccagctacattattacctcaaaggtgaaaaagtctagggtttgatttttttgatccaaactaatatttgtcattttccacccctgtgcccagagacgtaactcatattttcctgttgaatttgtttcccaagtagaaacagaagtcttaaatatgatgaactttaggttttttcttttagttcttataaacacccagtatggcagttattattgtccatattttacagccaagaatatttcagaaaaacaaaaaataagttcattttcctttagctagcaaataagagtatttggatttgaatttagagtatgaatgtgccatctgtttgtaatttttgtgcaggtaggggatgctgctataactagtgtagcattattaattattctagctgcatgatagattggagtccagagatagaaagatgagctggacataatttagaattcactctgaattattttcatgatggggattaagggccatatcacacaaatacacacttgaaggttatcattacatagcccctcagactttacatatatttcattagaaaaataaaaatctaagttacagagaattgtcagtgggttccctcaatgtctcccttactctgtggcaagctagtctgacatgatatctaacagaaggaaaaacatacttcagataagtcatggaagtcataccatgaagtcatgagaattacagtatatagtgtgcccagagctgtgaattccactaattattttgaaacattgaaatattcatttcaaaataaatctataaaccatccaacatctgtacttatctttatcattctcctgctgctaaaattgaggaaaactccacttcctcctaggttctcaagggaacatatgacacttgagcttttgggactctgttgcctctctttctggcatttctacatccctctttactccatctattgccatcagttttcaaacctgctgaagaatttatcattacaaaataaagagaaatgagaaagaaaatataattgcttcctactatgtctgttttcctacaatctcttcacatcccaagattctatgtgagggcagtgggtgggggaagaaaaggacaacatatatatccattgcactcatttattaatgagttattttgttatttagtcatgcaaatcatgcactatacaaaacatacactatgtttcctaatactgtttacttaattactcttaaaaagtcataattagttctttaaaatgtaaaactaaaatatgacaaatgatgccatctttgctattgagatggtttggctgtgttctcacccaaatctcatcttgaattgtagctcccctaattcccatgtgttgtgggtgggacctggtgggagataactgaatcatgggggcggtttcctccatactgttctcttggtagtgaataagtctcatgaggtctggtctgatggttttataagaggtttcccctttgcttggctctcattctctcttgcctgctgccatgtaagacgtgccttttactttctgccatgattgtgaggcctccccagccatgtggaactgtgagttcaataaacctattttttctttataaattaccctgtctcaggtatgtctttatcagcagcgtgaaaatgggctaatacatctatattcagttactaaatgtgttctgtgaatgaagttggatgttgaatgcagatgctaatgtactgccacatgccagttagacacaattatgtatgtatggagatatatataataaagggtacttgtttaggaatattttacaaaagcatggcctgtcagtgtgcaccatacatttcagagacatgatgaaaaaacattaccactagagtgtcacactacaaatgtgattttttgaattctctataaaaatgtcaatttcccaagcttagcatatatgtgtgtctaaatgtaatggcaagcttcataaatgatgagcatgccaatatacgaagatttggatgcaattatttactctaaaacttcatcaatattatgtggttgcaggtaacttttaaataggcccttttggatctcacatgaattgaaataggaaaaaaatctatttaaagaagtcctgaagtagacgtatatgcttaatattaaacattgtttgaaattgaagagtctggcttaacacactaaattaagaaagaagaaagaaagcaagaaagttggatgttgaatgcagatgccaatgcagtgccacataccagttagatagcatgtggcaagttctaatgggcacaaaatgtgccttgttcacattaatgctttagtgtagcactgaatttgcctctcagtaaatgttaactaaatttaaaaaatagtattattttccccaaatacatcaattcataacattacaaaataattatgctataagtttgatttgacttaaccatacatgttttcatccatcaattcattcatttattcacccacatttattgttgactttaagctgaacaacattttcagggctggggctctaactaaggacaagagtaatgtgttctttgatcttatgtcacttgaaccaaggtgaaaaagtagatattaaaaaataattgccttttaaaaattattacagtgataaacctaagtaataaagtaaatatgcattgcataataagagcatacagcaggacttttaacccggcctcctgaaaattacattctaatgggaaagacaaatgtcaaccaaaatattaagttacgaaaataaacaacttcatattttaatggacattatgaaaaagtaaagtgaactatgagagcacataaatataggtacttaaatccaatattgtgggttcaaaaaggaaatgacattcaacagcatccagaactcttaaactttagttttcacactgtcaggaagtttggaatcccaacggtgactttcacattacttgtattaaataaaagtcatgacaaaatgattacatttttcccattagtttacaatatttgtaaatacaggaaatgacaatagatacagtacctcttgatgttagtaacattcttgagattatttgatattagtaacattcttgagattatttttagtaattaagatagaaaaaaaatgttttctatataatggcataatgacttagattcagggatgactgaagaatcattctcaagttgaatgtcaaactggggaggctctgatggcacgaagcagctttctataacaatttcccatggatgaaatattgccagacatttttgtaacgtcttgggtgatggtaaattctctcttttaagttttagggaatcctattaattaggactactctctccatttcatagctaaggaaactgagtttcatatggattagatcatttgcccaagtcaatagttactaagtgatgcagctagaatttgaatgcagacaacctaaataggaatatgctatatttgcaggcagtcaaaaatgctgtaaagaaaatttaatgttggtaaagggaaagggggtatacttgtttctggaggacagggagagtgctattgaaatggggtactcagtgaagtcatccttgcaaaagatgtctttttgaatgaaagagtgaatcacacagagagttagagaaagagtgctccaggcagaggtaacaacaagtacaaaatccatttgaaggtttggtaagcgtagctgtgttcaagaacagcaagaagcccagtgtggctggagtggagtgatgcaaatgatgttggagagagcaggaggagccaagtcatgtggagatatgaaggctatgaaaaaggagtttggattctgttctaacacaatgagcatccactgaaatgtctgagtggcaaaatggtgtcatctaatttgcatttttaaaatatcactcttgctgtagtgcagaaattgactgtaagaggggtagcacaggtcaaaaagtaagatactatttacataatctaggggaaaaatgattgtggtttagaataggtgaggagtacttgcctttggaatatgtttcagacagatttactgataatgcaagaatcagaagtggtcctaggaagcagatacttaagatgagattttggaatttgctaatttgctagccaaatggcatgcttactgtacaggagttcagagtaagtcatgattcatttgaagccttcacctgagatgaactgatatggtatatgggggaatggggagcctggtttaatgccatatctgtataatttcagatttatcggtgaacattaattcataaaacttacagagttgattggttgctaaatataacaaaggtgttgaaaaagaataaatgaagctcagaaccagcaatatcaattcagaggtaaagagtaaaaaccaatgacctccattagcacgtttaaagaagctccatatccacagacaatgacagactttactcaaaatcatgctcaagatgtaattacaacctgctctctctctctctctttctctttctttcttttttttcgagacagggtctcactcccatttcccaggctggagtgcagtggcacaaccacagctcactgcagctttgactttcctagctcaggtgatcctctcacctcctgaatagctgggactacaggtatgcaccaacatgcctggctaatttttgtatttttttgtacagacagagatttgccatgttgctcaggctggtctcaaactcttaggctcaagcaatccacctgcctcagcctcccaaagtggtgggattacaggtgagccactacccctggtctcaagacataattacaaggaaagatgcaatcaactccctgacaagtcttccacaccagtattggtagggaaggagagctggtctgggcacatgtggctacaaacacttcaaaaaaacatactgattctctggaacttctagactgaaaacttcactttcttttcatttttagatgagaacagtatccctcgcctggagatcaggtaatgacttcatctgaattagataccttaccatcttgtaagcaagatgatagatgtcctctgtacctatgtccctgcattgcttttgcaccaataactaaagtcaagttgcagcatgttctaactgtccctgctatgagtagaaaaggattattcccaaaaagaacagcaggatatgccttatagtattggcagcaccaggaggacatgactgaggatagatcttgattatgttggaaggggttgaagggagaaaagtacatcttaccaagagtttagtggtatggagatactttgtcataattgtggccaggacacctggagttgattctaaggtactgctggattattccccaaaggttgtgaaaaacagtggcctataataaacaaggtgtaggtagtgaaagtgcctggacagggatttgaagttaaaggtatatagaagtgggcattttagcatggatttcttatgtatgaccagagaaaccatctattagttttgttcctcaggagagcctaggtagcactcccaattctgaagcaatatagaaaggtgcaacaagaggtgctctggtatcattgaaaagttcagtgatggctctcctcaccaggccagagtagagggtagtgaatgttgctatgaaacttgtgttccttagtgtcaatgtgagtggaagaattctggattcagaatccaggtggaaatactccaatatcagaggcagatggatgaaatgtatcatagcaatcagcaaaaaacaacgtcaaataagctgctacgaagtgcaaagatctataaggatggctatccaaccacggtgttcccaaagcaaatacagaaaggcagccaagaaggctattgctggatttatataatctaaaaacatcaaaatcaggtaaactaaagccgcatcattgtgttctttcctgtgattaatacacatttgaagtatgagttgcttttttattgctgcagtgatttggccaatattaatagctgaggacactgactattctgactttgtccagaaaattgcacataacatcaattccaaccaagaagttcatctcatggcaaagttaggtgcaatcatatgcataggaccactggatctgttggcactaatatacagtaccacccagcagtgctgacctagtagaatactggaaaagcctcttaaagatagagctaaggatgaatttgggaatgaaatttttcagggccacagaaggaatgaccattgtatggtacatttttcttgataagaagactagatggaaatgacaaatcaagggttcagggtgggaatggcctctctcatcatcatcttgactaacccatttgggaaaggcatactttcgtccttgcaaagctaggctctgctgcactagagatcctggttttctgaagaccggggtgatgttttcactgagatgacatagtaagggtcccattaaaccaatatttatggttagtcagtagaaattattggctctttatgccaacaaatcacaaagtacagaaagaaatcactacacctatgaaaatagctaaaatttgatgaaaaagatgagagagcttgctctgctaggtatcaagactgtatgtaaaatcactataattgagacagtgtgctattgctgcaagactagactaataaaccaacacaatagaatagagagcccagaaacaaaccctcatacacatgtatatgggatttatgataatatgtattgcgagtcagtgggaaatatatatatttatatagaagaaaacaaattatactcccacctcactccacacacaaaaatcatttcagatgataaacctattacgaataacaagacaataaatctttaaaaagcaggtccttcatgacctgaggaagtaggctattttttaagcaaggtcaaaagaatagtaacacttacaaaatgatggataaatttgataatcttaaaatttaaatctgtgtgtcaaaagatatcttgcaggaagtgaaatggaagctcgagaatgggagaaatgtttgaaacatatataacaaaggaggggctcatttctataataatcaaagaactcccacagataaaaaagaacattcaagaagaaaacacatttactccaacagataaataagaaactcaaataggcatttcggaaaagacgaaattcaaaatagtaagtaaatatatgaaaagattctcaatgccattagcaaaatgctaatcacgatcataatgcgatatcactgaaaccgtaacaaggtggctcaaattagaaagactgacataccaagcacacagacaggaaccatgaccaactctcatatacaactcttggcatagttactatggaaaacaatttcgcatttccaacaaaattgaatagacacatgttcataacatagagaaactcaggcacatgagcgccaggagaaatgatataaacatattcacagcagcactgaagataacatcctcaaactggagagctctcaaacactcatcaacatgagaatgtgaaaataaattgtggcatagccacaaacagcaaataaatgaatgaacaggtagaaatgtggctgaatagtaaaaagttaaatatgaatgaaagaagacagatactaatgcacacacactctaaaattctgtttacaggcttcgaaaaaagacaaaactaaactataatgtttataaatgcttacttagatggtaaatgtgcaacaaaaaaacccaggaaattaacatagtggttaactctaggtggaggaaagcaattgcgcctgagaaggagcatgaagaaagattttctggtgatgcattctatacctgatttggacttacatttatgtttactgtataataatatactaaactgtacatttatctttaaatcacttttgtgtattacattttttttcttaaagtttaaaggacaagagttggtcttaataaaaatctccggatatagctggaattctttctgtaaaaccaagttggttgccaagcttattcctcaggtaggcaataaagtccacgtaagtaattgtagtgagttataatatttgtagagaaggaaaactgaactgaactaaagtgaataggtcatgaattttcatcagtctataaaacagaagtgcaatttgtataaagtaggatctcataaataagtaatgtagcattaaaatatatagctagatagatgtagcaggggtttgtgaggcaaaattacttggtattgcttcttggatatacattaaataatttaaatggggaaatggaaaacacaatttcaaatacatgaccaaataggctgatagcatgtctgttatacttttcttccatgtagtttttacgcctgggaaatgccttcattatctttgcctgtcccatgagtgggtaaagagatgtgctattttttccagtaccaactataaatttcaattgttctttgcattcacactgctgtgtgtggtggggggtgggggtgataatcacttttttttttttatttcaacttttatttagattcatgcatggatggtacatgtgtaggtttcatagaagggcatatcatgtaatgctgatatctggggtactaataattctattgcccatgtagtgagcatagtacccaatggttgtttttttcagttttcaacccttgtgcccctcccccagtctcttctctagtagtccctagtgtttattgttcccaactttatgtccatgtgtacccagtgtttcagtcccacttacatctgagaataggtggtattcggttttctgtccctgcattaatgtacttaaaataatggtctccagctgtattcatgttgctgcaaatgacatgatttcattttttatgactgtttagtactccatgctatatatgtaccatattttctttatcaaatccaccattgttgggcatctaggttaattccataagtttgcgattgtaggtagtgctgtcatgaaaatacaagtgcatgtgtctttttggtagaatgatgtattttcctttgggtatatacccagctataagaatgttggttcaagtggtagttctgtttttagttcagccactgcagaaagcagtttggagatatccacatttacatttccaccaacagtgtatatgcattcccttttttccacacctttgcaaacatctgttatcttttgactttttaataatagtcattttgactggtgtgagatggtatctcattctggttttgatatgcatttcttgatgatttatgatgtggatcattttttcatttgtttgttggctgcttgtatgtcttgagaagtgtctgctcatatcttttgccaaatttttaatggccttatttcttttttgtttgttgaattattttaagttctttatagaatcaggatattagacatctaaaagctgcatagttagcaaatattttctcccattctgtaggttgtttactctgttgatattttattttgctttgcagaagctccttagtttaattacgtcccacttatcaatttttgtttttgtggcaattgtttccaagacttagtcataacttctttgccaaggctgatgtccagaatgatatttcctaggttttcttccaggatttttatagttttgcatcttacataagtgattagtgcatcttgacatactttttatacatactgaaagggaggagtgcagttttattcttttgcatatggatagccagttatcccaacatttattgaataggaagtccttttctgattgcttatttttgttgactttataatcaaatggtttaattctggggtctccattctgttccgttaacctatgtgtctgtctatgtgtagcctatactactgtaggcttgtagtatagtttgaagtaggataatgtgatgcctttggttttgttctttctgcttaagatcgctttggctattcaggttcttttttgtttccatgtaagtttcagaacagttttttttttttctaattcagttaaatggtactggtagtttgataggagtagcattgcatctacagattgctgtgggcagtatggtcattttaatgatattaactcttccaatccatgagcatagaatgcttttccatttgtttgtgccatctatgatttctttcagcagtgttttgtaggtctccttgtagcaatcttccacttccaaatttagatgcattcctaggtattttattttcacttgtgactattgtaaatgtaattgcacacttgatttggctctcagcttgactgttatttgtgcataaaaatgccactgattttttttaccttgatttttgtatcctaaaactttactgaagttaccagtttcagtagccttttaatggagtctttagggttttctaggtatagaataataatttcagtgaggagagatattttgacttcttctgttcctacttggatgtcttttatttctttctttgcctgatttctctaactaagatttctggtaatatgttaaataggaggggttagagtaggcatccttctcttgttccagttctcaaggtgaatgctttcagcattttcatgttcagtatgatgttggctgtggatctgccatagatggatctgattattttgaagtattttctttcaatgcctagtttcttgtgggtttttatcatgaggaaatattggattttatcaaaagctttttctgcatctattgtgatgattttttttttttttgagacggagtctcgctctgtcacccaggctggcatgcaatggcgcaaccttggctcactgcagtctctgcctcctgggttcaaacaattctcctgcctcagcctcccaagtagcttgcactacaagcacccgccaccaagcctggctaatttttgtctttttagtagagatagggtttcaccatatttaccaggctggtctcaaactcctgaccttgtgatccaccctcctcggcctcccaaagtgctgggattacaggtgtgagccatggtgcccagctttgtcattttgagatactttttagtatgctgtgaaattcagttaggtagtattttgttgaagatttttatgtctctgttcctcagtggtatgggcctgtagttttccattttaactgtgcatttaccagattttagtatcagaatgctggcctcacagagtgcgttagggtggagtccctcctactcgaagttttggaatagtttcagtaggactggtgccagctcttctctgtatgtctggtagaatttggctgtgaatccatcctttcaagggcattttttgatcggtagatttttcattactaatttaatttcaaaactcattatttttctgttcaagcttttgatttcttcttgattcaatcatgggagcttgtgtgtttccaggaatttatccatttcatctacattttctagtttgtgtgcatagatgtgttcataatagcatctgaggatcttttgtatttctgtgaggttaattgtaatgtcatcttttgtcatttctgcttgttcttaattggatttcctctctttttatttgttaatctagctataggtctataaatcttgttcatcttttcgaagaaccaacttttggtttcattgatcctttatatagattttggggcctcaatttaattcagttctttctgattctagttatttgttctcttttgctagacataaggggttttgtttgtttgtttgtttgtttttccctagatcttccaggcatgatgatagagtattaatgtgagttatttctatatttttgatgtatgtatttagcactatagactttcctcttaatgctacttttgctgcatcgctgagattctggtgttgtaacactgttttttaaatcaactgtattgatatggtttggctgtgtccccaccaaaatctcatcttgattgtagttcccataatccctacatgtcatgggagggacctggttggaggtaattgaatcatgggagcagttacttctatactgttctcgtgatagtaattgagttctcaaaagatctgatgttttacaagcattttttctctcccttcactctgcatttctctgctcctgctatcatgtgaagaaggatgtgtgtgcttccccttccaccatgatcgtaagtttcctgaggcttccccagacatgctgaactgtgagtcaattaaacctctttcctttgtaagtatccccgtctcgagtatgtctttattagcaatgtgagaacagactagtacagtacattggtaccacagaaagtagggttgctgtaaagatgcctgaaaatgtggaggcaaatttggaagtgggtaacaggcagaggctggaacagtttggggggctcagaagaagatctaaaaatgtgagaaagtttggaacttcctaaacacttggaaggctaggaagacagaaagaagtgggaaactttggaactctctagagacttgttgaacggctttgaccaaaatgctggtagtgatttgtacaatgaagtccagctgatgtggtctcagctgaagatggggaactcgttgggaaatagagtaaatgtcgctcctgctatgcaaagagactagaagcattttgcccctaccccagatacctgtggaactttaaacttgagagagattatttaaggtatcttgtggaaatttctaagtgccaaagggttcaagagaaaacagagcattaaagtctggaaaatttgcagcctgatgatgtgatagaaaataaaaactcattttctggggagaaattcaagcctgctgcagaaatttgcatagataacaaggaaccaaatgctaatcaccaagacattggggaaaatgtctccagggcatatcagagacctgcacagcatcctttcccatcataggcccagaggactaggagagaaatggttttatgggtcaggtccagggcccactatgcagcctcagtacatagttccccatgttctgcctgcttcagctccagccgtggctaaaaggggccaatgtataggtccaggtgttgcttcagagggcacaagccctaagccttggccgcttacatgtggtgttggtcctgtgggtgcacagaagtcaagaattgaggtttggaaacctctgcctagatttcagaggaaatatggaaatgcctggatgtccaggcaggagtttgctatagaagtggtgccctcatggagaacctctgctacggtagtgcagaaaggaaacatgtggtcagagcccccacacagagtccccactggggcactgcctagtgaagctgttagaagagggccaccatcctccagactccagaatggtggatccaccaacaccttgtaccatgtgcctagaaaagccgcaggcactcaatggcagcccatgaaagcagttaggaggggggctgtacccgccaaaaccaaagggttgaagcttcccacggctatgggagtgtcactcttgcatcagcatgacttgtatgtgagacatggaatcaaaggaggtcattttgaaactttaaggtttaatgactgccctcttggattttggacttgcattgggcctttagcccctttgtcttggccaatttctctcatttagaatgcatgtgtttatcctacgcctgtaccctcattgtatctaggaagtagtaacttttaattctacaggctattaggtggaagaaacttgccttgtctcagatgagacttaggacttggacttttgggttaatgctgcaatgacttaagactttgggggactgttggaagggcataattgtgttttgaaatgtgaggacatgaggtttgggaggggtcaggggcagaatgatatggtttagctgtgtccccacccaaatctcaccttgaattttagttcccataatccgcatgtgttgtgggaggaacccagtgggaggtaattgaatcatgagggcaattacctccatgctgttctcatgatactacgttttcacaagattgatggttttctaaggagcttttccccgcttcgctctgaacctctcctgcccccatgtgaagaaggacacatttgcttcctcttccaccataattgcaagattcttgaggccttccaaactatgtggaactgtgagttaattaaacctctttcctttataaattccccagtctaaggtgtgtctttattagcagtgtgagaacagactagtacatgtaagtatactcttacacatactgaaattctaaaagtggacatatatccaatatcaaagctttttatttatttgtcaagagaacttatttatgtgtttgtatgcttgtgaggtaagacaaatatgtatgtttagatgctgacatatactttaccggttctctttttacatttaggaatcttcattacaaaactttacttttagataattttatgtcattaaatttagtttcatttcatgtatgtacatacattatgcaagggctaagccaagcgttgggctatgtagtgaaatttctaacatcaatctctactttcaagatgtttagataaatagacaacataaatatactctagcaattactatcaaaatttgtacacagtattacatgagaccatgaatagaaaacaccgagggtataggaaagttcacaaaagattttctggaaaagattatagtggctaaattttcaagtatctgagttatctttaaaaaatggagaaaaagaaaatcaaggtgggggtataaacagatgcaaagagacatatattagcaattgtgagcaagtgagtatggctagagataaagttgtcaaagtaatagtgtgaggtgggtactgtgttttgtttgttctgtgggtaataataaccatattgtgtacttaagttatttgttagttagagacataattccagaatttacatcacagataattataaagtgtcaagaccagtatcaggataactaactcacaggctgtagcaatagttcaagtgagaaataataagagcctgattatggttgttatgagagagagaatgtgagaaaaatttgtaacatgtaaaatgatcaatattggtgattacttggatatggagagtgagagagaaagaggagacttagatggctccttagcatttggcttggggaatagttaattgaggtacagaattcagaaggagccctttctggggaagacgaaaataagacttcaatcttaaaaatgttgaaatttagatgctttctggaaattcaagtggatattttacagatatatgtctatttgaggctgtagcttaaaggagtagaaggaaaataagcatctcaatgtaagtaaagctgtcggctttaatgtaattgcaattgataaaaaaggaatacatagagtcaaaagggcaacttagatgatactttcaaaatccaaagtttaaggagcaaacagataaggggaagacagaattagatgtgcttaaacatgaaaactagcagcaagcaggtagtagaatcttaagaaaaaagagagacagagagagatcctatagcaatagagcagtaaagtgacttagataaagataacatttaaaagcacagtggtcatttgtgaccataaagtggacacagatatcattcattgtatagctgggatttcacaactataaatatttacacatacacacacacacaataatgtgtatttttctaatagctgatattaagcctaaacattgctaaaggggtaggccctaaataaatattgtaaaaatatattcttaaaattttctaatctatttatgagctgctaattgaatatctgaaacatgaccacatttcaaaaatagtcacagacattaggtagatttctattgtaaatattattatgtagcacatttatattgacataaccaatttttcaaattgtgtgggcttttttctttatcagaatgagttacagggtttgcattatatagtttggcttaaaaagagaactcataaaattccccacttgcagcccacttaaaaaagaattattacagttttaggcactgttgagtgtcatactgagctacaaaaaataagaaatcaccataatgctctccaccttcattttagttttagaaccccacacagggagacaactatagtaatcagagttaggccactgaggttcagatttattttgtttaatattaaattgtatagttgaaggaaacatcatttttttaatgactgtatcactacccttccaaacactgtagtttactaatgattttaaaacttctttaagtgcttaagacagaaacattcctacaatatcttagctaagatttagcatgcaggtctcatactgggaatacatttgtgttttaagttaaataaattcagcctcttatttagaactggaagaacatgttgtagacttatggttctatttttgttacctagacctcaaagaagtcagttcagtagaaaaatttatacaaggtattacatggaagtttactgggaatcagcttactctatattatacaatgctgagaacattgtttaatctttgtttaaacattgtttaacaggcagtatagtttccaagtgtgccttctctaatgcatttgtgcaagcatttatgcccagggttgctatgaaaaacagagataaataatttagtccttaaacttgagaattctgaccttagcagactcctcaatgagatactcctacaaaggccagacacctctgatattagctgaaagccttcctacctccacttccctcccccctcaacctccatccacccatgtctcacatacagaaatgcactaaagcatatagtgtgataagtgtgctgaagtaaaaggccacctctttttcttttatgctgaattatgttaataagtacaaagaagtttttctcatgatcatgtatcttagacagaatttactgaaatagatctttatcttctcactttctaacccagactgatgattgaattcacagaacattagttgagaaaacaaatgaaaatgacagaaaccatgttgaactatgcatcatgttctcctacttctgatgacatcaggtttataatgagaccagattcatctgtctgactgttacacattagcataaattattcccaggaaatccttcaattctcttttaggaataaataagattctgagaggcacatccaagtccattgttgggattatgccatttttaattgatatataatatatgtacatatttatggggtacatgtgatattttgctggaatgtgtaaaaatcaaatcagggaatttggggtgtccatcacttagagtatttaccatttctgtgtgtggacattccaagttctctcttcaagccacttgaaaatatacaacacattgctgctaaccacagttgctgtattagtctgtcctaatgttgctaaaaaaggcatacctgagactggataatttataaaagaaagaggtttaattgactcacagttccacatggctggggaagcctcgcaatcatggcagaaggtgaatgaggagcaaagtcacaccttacatgatggcaggcaggagagagcttgtgcaggggatctcccatttataaaaccatcagatcttgagagacttattcactaccatgagaacagtgtggggaaaactgcccccatgattcaattatcttcacctggcccctcccttgacacatggggattataattcaaggtgagattttcgatgaggacacagccaaaccatatcatcccatccccagcccctcccaaatcccatgtcctcacatttcaaaaccaatcatgccttccaaaagccacccaaaatcttaactcatttcagcattaactcaacagttgaagtccgaagtcttatctcagacacagctagttccttccgtctatgagcctgtaaaatcaaaagtgagttagttacttcctagatacactggggatacaggcattgggtaaatatacccattccaaatgagagaaattggccaaaacaaaagggctacaggccccacgcaagtccaaaatccaatggggaagtcaaatcatgaagctccaaaatgatctcctttgactccatgtgtcacatccaggtcatgctgatgctaaagatgggcttccacagctttgggcagctccacccctgtgactttgaagggtaaagctcccactcctggttgttttcatgggctcatgggctggtgttgagtgtctgcgacttgccaggcccaaagtgcaagctgtcagtggattactattcttggggctggaggacagtgaccctcttttcacagctccactaggcagtgtcccagtggggactctgtgtgggggctcccacccacatttcccttctgcactaccctggcagaggttctccatgagggctctgcccctgcagcataactctgcctggacatccaggcatttccatacatcctctgaaatctaggcagaggttcccaaaccttaattattgacttctgtgcacctgcacgatcaacaccatgtggaagccgccaagacttggggcttgtaacctctgaagccctggcctgagctataccttggccccttttagccatggctagagtggctgggatacagggcactaagtcatgaggatacacacagcagaggggtcctggacccagcccaggaaaccattttttcctcctaggcctctgggcctgtgattggagggcctgccatgaatgtctctgagataccctggagacatttcccccattgtcttggtgattagcatttggctcctccttacttatgcaaatttccactgctagtttgaatttctcctcagaaaatgaggttttctttactactgcctcatcaggctgcaaatttctccaacttttatgctctgtttcctcttgagcactttgccacttagaagtttcttctgctagatatcctgaatcatctctttcaagttcaaagttacacagattcctagggcaggggcaaaatgccaccagtctcttgcatagcaagagtgaccttaactccagttcccaacaagtttctcatctccatctaagatcacctcagcctagactttattgtccatatcactatcagcattttggtcaaagtcatttaataattctctatgaagttccaaacattccctcatcttcctgccttttgagccctccaagtctctaggaagtaccaaactttcccacattttcctattttcttctgagccctccaaactgttccaacccaggcctgttacccagttccaaagttgcttccatatttttgggtctctttccagcagcaccacactctactggtacccattcactgtattagactgttttcatgctgctaataaacacatacctgagactgggtaatttatcaaggaaagaagtctaattgactcacagtttcacatggctcaggaggcctgctttcatggcagaaggcaaatgaggagcaaagtcctggcttacatggtggtaggaaagacagcgtatgcaggggaactcccatttataaaaccatcacatcttgtgagacttactcactatcccaagaacagcatgagaaagacctgccctgatgattcagtcacctcccacctggtcctttccacgacgtgtgggaattatgggagctacagttcgagatttgggtggggatacaaccaaaccatatcggtcatatccccaaaccatatggttggggatacaaccaaaccatatctgctatctaacattagaacatatttctttctttctttctttctttttttttttttagaccaagttttgctcttgttgcccaggctggagtgcagtggtgcaatctcaactcactgcaacctctgcctcctgggttcaagctattctcctgcctcagccttcctgggtagctgggattacagagatgtgccaccatgcccagctaattttatattttcagtagagacaggatttctccatgttggtcaggctagtctcaaactcccgacctcagatgatccacccgcctcggcctcccaaaatgctgggattacaggcatgagccaccacacctggccagaacttatttcttctaacagtatgtttgtaacaactttcttcatcagccccatcctccaccaccaccactcttctcagcctctggtatctatcagtctactctctatttccatgagaacaactttttcagctccagcctatgagtgaggacatgtgatatttgtctttctattcttgatttattttacttaacataataacctccatttccattcatattgctacaaatgaaaatgattttcattatgccacttttaaacatgaacatttgacaagaaattgacttatttattattgttatgtaaagtaactagtttaggctaaattgggtctactgttgggagtatgcacaataacagtaatacaataataattatgcataaccccaacaacagacccagctttaccctatttatcttatataacaataagtaaatacataatacataaaagaattttatatttttcctctaacacataatatttctttatctcccttttcctttttctctctttcttacatatacacatgcgcttgtgcatggcacaggttagtataaaccagaatcaatggcagagctcactaaaacacagatttctggccccaacactagggtttctgattcaatctctgtggtatagagtatagcagtctgcatttctaaggtgtttctattggtgctgatgctgatgctgatgctgcttttccaggaacaacactttgatagccacctaacgcatgtttgtattttttcagttcagatacgcatgagcaagtcacaggaagcatggtcattggagaatcctgtatagtagagtggttaagaccaaacatttgaaagtaattcaaatatgtacaatggaaagcatttagaatagttcgtggcacattgtaagaattcaaaaattgatagtcattattactgattttttactagagctgtcagtctatccaatatgcttctttcaatgcaagctccacatatcccactagctggacttattttaagatgaataaacaaaaatacaaaaatcaggatcgcaaccatgagctctattttgataataacaaatatctttcatttcctttaaatttctaaaatatcctacaaatgtgactatatgcatatatatgttcatgtactaaatgttgatttgtacatttgttattatcaaagaccaagctttggctaacacacttaaaaaggataaacgctgtttataatctgactgactatgattgtttgtagtgatgcagtagaagaaaatcatttatcaacttaagattttatagtttcttaagaacagtacttccattaaaatgttctctaaatatggtaatattaggcaaatgcaagagtgcaactaccgtatttcgaaaaatcataaacaattgtttgcatttagttcatagtgttgtaaaaaatattactttctataatatacgtagccatactttataaattatttagtatttaacataattataataaaaattaagtgcatattagcttcattccttattttaaacctgtacatatattatgtgtatgtattaatccttcaaatcactacttgagatgaattctattattatctccattttgcgatagcgaaatccagtcccagagaagctaaattagttatccaagattgcattagttattttggcaagtcaaatttgaactcaggtagttttattccatggcccatattttaagctgttcattaagttctccatcttgttgggatgctgggtctggattcatggagtcacgtgatctagtgacaggatgaaccaagtgaccagggagtggtcgtctcattaaagtatgtaaggagcataagaggtgagggttgttaggtaagatgagaagtccgggatccctgtgtggtgagtctagaagtcacagtccagtataaaacaggcttttaaaggtaagtggctggaaagctggacactgatttagtagactggcttagagtcagtctatctaaaggctgaatggaccttcacagaagttatatcatgctctgctgttgtatattcccaaatgcctattcctttgagacttgaggggtccaggaccaggcctgcagatttgatcagaatatgactgcatttgggggcttctactggcatctgctcccccaaagacttgggatcatctgagagttctgcagttgagtatgaggcctctagtaagaggcctctcatatctgagacccattctaaagatcaattatttgcatgcttgtggtccacagtcaagatatgcatacaaatcctctagattctatctcctgtgaaatactctcaaggatactaggcaaaatattacactaagtcttcatatcattcactatttcattaggccccatctgaactcaatgtatttttaatcatttttccagaactcctttaaacagctcttccattattgtcagaatactgacttagagtcctcaaattgcttcttcagctggattatatttcatattacatttttttggctggtatttttatttccttttttttttaaatttccaacaaagatttcactaatacattgaaaagaaccaagaataatctgcttttctcatgaaccctaacctggccacctcagtctattataatgtctctttttccttgcagtaaagaatttatagcacccatttgacacttgacacagagtatatacttactgtatttactaggttttgagtatatcttttcatacatattgttacagttttcaattctaaatgcacaaggtataatatgataccttgtgaataaaaagataaacattaaaaattgttgattggtaggttattttttaatatgctggataaaactttttgctatgtataatccataaatttgcttcaaaagtattccttagttattatttgttactacaacactacctttaaaaactaaatgaggccgggtgtggtggctcaggcctgtaatcccagcactttgggaggccaaggcgggcagatcacctgaggtcagaagttcaagatcagcctggccaacatggcacaaacctgtctctactaaaagtacaaaaatttgctgggcatggtggaggttgcctgtaatcccagcgactcaggaggctgaagcaggtgaagtttgaacctgggcggcagaggttgcagtgagccgaggtcactccattgcactccatccagcctgggtgacaagagtgagattctgtctcaaaaaaaaaaaaaaaaaaaaaaaaacaaaaaacaactaaatgaaaactcccttcagcattttaattcaaatattggattattcatattaaaatatcaatagaatataaacacaaagttgataactcaaattcagtatagtaattaacaatatgtatcttggttttaagtcttaatagtttttgatgacaattaaaattaaattttacaagcagagcatgagtaatttagtgaaattaatatatgatataattatcattaggtagcaaccattatgagcatcaaaattccatcctataaacattacactgtgcagaatcagttagatgcagcctgccttggatgtcttcctcttcctttttgctttcaacatcgttttagtttttatgaaaacaagttattgcctaaagaccaggctaaggtccatatttcaattttaaaaactgaaataaattatagaggccatttcttatcaaatttaagaaccaggagacaacaacaaggttaacacaataattcaagaacaaagaatcactaggaaaagcgggaaaaaaaaaataagaaaaaaaggaaaagaaatttaactaaaaactaatcatcatgttgatgtctacttgtgtgtttttagttatatattccatctgggctttatctctccaagctaaataaattaagaaaatgggaaagatcatttttgtaaataatttcaatgcttgtttgtttttaactgaatagttaatatatatatggctaagtgaagtttttcagttttcagcaatgtggcattttaaactgacaactgtaatataacttaattatcattaataaagacgattacattagttcaagcctcatatgcctggtttattacaattgcctcctacttctgccttctggatttagaatctcccatttcaatatatcaggagtaatttttataaaatacaaatcagatgttgccatacctcagaccctttagtggctcccccgtcaccttctacaacatggtatagaaaagtgtttatgacatggtacgtcttattcattgtaactatgctatgtcacactctgatttctctgtgcctttacttatacaactaactttccctaacagattccaacttctctcaacttctctcttacctgtgttcttccttcttgagtcaacttcagcatttctcctttgatgataatttttgcacatgcccctgttatagactttattaccttgttttcttggtgtagccaaacttgtcagtgtcctatgcatgtccctcagagcatttggtatgctttggccaacttccacctcctggtattgtcactggatcctaagggtgttgcttttccagccagaaacctctgcgggtggtggcgcctttgcccaagttttgctcggactagctgtgtttgtatcacccactccacctggcaggctgtgcttggctcatgctactgggctaaatccgacactttgccagggcaagccaggttcagagcagcgatgggtgcatgagcgagcaagtgcagggtcttgtcactgtgcatagccacgcacgctagctgctttggcgggacgggtagctccagccgccctctcccagcaaaccttagattgaatcagatacagggcaagagccttctgctgtgagcacccgcgtctggatgaggggctccctgaagagccgcaactcttctctcctttttgttgctcgccacatggtgaggggggtggcagctaaacaaggttttagccctgtttgtgttaccgctctttcattcctgccatttggtgggtcccgagtttttggcccacatccaggaagaatgaggtacgcgcacagctggagagttaaggtggagaggaactttacaaagctacagaacagctctcaagagaccgaagtgtgtagctcctatccataggcaggttatccccataagtgtccagctctcagcagagagaagacccggaataggtagttcctttctgcagaaggtggtcccaggagacacgaagaggaaatctcctccctgcagctggtattcttgatgtctgtgtgaggctggctggctccagggtttttttgggctcagaaaggaggaagtacatgttgattggtccacgggtggccatgggcaggcccggtaaaagcaccgtaagttttcactctgggccacggactccactggaactgatgggctggtccccaggcttcaggccatccctggcttgaaggtggggcttcaccagggacaccccactttccacccaggagcctgtcttctgctgccatcaatcatgttgttcatggtgcccaggctgtttatgaggagaagtgcctgcaggcccacagtgagcagccctctgtcccctcttggcctccctcctatgttcattggcgcccaaagttcacaggaggctgaggtggcagggggctggcatgtcagcaccaacccaagcacgcacacacccagcctggttgtgacagcacctgggctcggcctgaactttgcttcaaaattggaaggggtgccaggagctggaagaggtcaggcagggggaacaggcacttccgactctgtgggggcaggggagcttcctggatccctgagagcacagagatgcctaggtctgcagccacagctgggcagctggagctacacccaggatggcagggctcccaccctgccaacttggaagggggttaggttcctgcctgctccttgctcccaccggctccctggagcatttagcccaggtcatacctcctctgctgtagctggtgtctttgcagtggctgctccagatgggccactgctgccatcagtatctacagcctgactcagtgcccttctatcagattatgctgagggaatttgactacttgcttctactggaggcaagaaaatccaaaaacttggcagcccattggccaacattgcagctaattactctcaggatttagtgtatatgttttccagttccataacctctcaggaactggacaattaaaactatcaggacagataactctgatgcatgagtttgcatctttttctagagtttgcccttggagtgaagtttcagttctccttatgattgctggtttaatagcaatcttgttactggctaccttctcttctttgcctcactttctcacttccttatcactgttatctacacttctcaaaaaatatttatacatgaatattttgtgtccagattttctgttggagaatccacagtaagccattggacaccagaggtactacagtgtggggagcagagccttcagatgggatgctggagttgaatcgcttgttggccagttggtatcaagaccagttggcattttataacatcacaatgaccaagattatcccctatgtgaattgggatggcataaacatataaggttatgtatgccttatgcagtatttccagaatttgagatagtgacaatgataatgataatgactgtggagttggtagttgcaagtattgtcagtgatctaaaggaaaaaatgacttttaaaaaagcttcaactggtcaatcaaaatctcaggacatggtgtgaacatcacaagatctctataacaccatttaaagcaaccctctccttttgcagtttaaaggagattgagctaaaaatcagatcttgtgcctggttataagaatagcagaacagtagagaagcctcacttgaaagcaccagcacgccttctgtggaaaagtcagaaccttcacagggaaggagtaggaccctgaactctgggtttggaacatctgggtggctcacacctcactaaaccaagattctttcctcccctgaagaccacataaacacctcatctgaggttgatacttcaaattgtgcacatcttcctccaatttttttcttctttgtgacttctagaccaattattatgttcaagaccaagaatggcccaaatgaggaagtactgtctctgttttaacaataaaggaattattcatcaaatgaaccacagacaccggctaatatgtccaggtagatccagaagcacttagaagaacactaagagtaagtttactacgagtaaatcttctgagtgctggaaaaggtgtgtgtgcaaaatattagaaacacacggtagactctaaagatagtatttacctaatgtaatgaattcaaatctaaatatatatattttgaggtctaaatgtccacatccatacctagtagtatacctaattacatgtttctgtaaaatgttttaatttcagaaactaaaaatatatattaaattagcatactatcacattaatcaatgtttaaattatacaataattataaaatgtaaatctgtatccttgaaagttaattaaaatatataggatatgattcattttttaaagtcttgaagaatatccagcacagtcatttaacagattacattagctgagtttcttttgagaattaaaatgtaataaacttacactctttgaaaaactacatataagatctatataaatattccacttacttttacttgacccacaaaggcattggcttcttcttccaccacagataaatttcttggcagataaggatcaaacactggagcattgtcattgacatctgtcaccactatgtttactgtggcagttgaggtcttaaagaaaaacacaagcattaaatgtgagaggagctatttttacttagaattcatttaagtagtcattctggcatttgtctatctgaaaagcatctcatttttctttctaatccttagctttccaaaaaataaaaataaaaaaataaaaaaattaaaaaaaagaagcttgcaaagaagcttcccacctcaaaaaacagatgggaaaagcaaatgatgatattaaagggcaaacatctttttggaaatgtcaagtatttcctggaggaaaacggttttacctttatcttgttcacattttatgggtggcaagcttttgtttatacacacgtacactgctttatctctgaaatgtgccatttctgtagtttttgctgcttgtatgtttgactgtttaaaaataaaaccagtacattataaaatagcatggtacatcaaatgagcattttctggaaagctcatgctatcgaaaaatgctaccttaataattttctaggtgtacatttaaaccaagagtttgagtaccatatactaggcatgaaatgattatcttataagcatacagcttacggaaatggtatgcaggtaaacctaccagtagtgtgtgctacctagttaaaagttaaatccctggcctgctgcagtcaatattatgtaggtcaatgacttctgcacaatcaatgactatcttcataagtgattcaagctggaaactgctctctctaatcaaagcctgagtacagcacagaacctctacctagctctgtcacagtgtggggctgatcacaaaaggctgagagcaaaggtacagagagaaagaatattaacctggaaagtaagaaacctggtatgctatggtattaaatatttagtaactataaataaaaaggaggaggaaaaagcaaggtgatactgtcatgagagaattatccaccttttgtttaaaaaaatgcaagttccattaattagtaagtgatttgtagtgagaggctaaaatcctgagcactaagaagtgacttgagtgaagctgaaaaggttttgcagcagtcatggggctaaggagtcaagtgattttttttattttttatttttttttatttttttagctattaaagaggacagatcttggtaaatacccaatgctttctgttggggtcacagaagttctataccatgcaagtcatggtgcttgggaaaaagaccaaacctccctcaaatgtaaacccagtattgaaactctgattggatttaggtgatctgcccttattttaacagaagcaaaagcaaatactttttttagtaatgtaactttatcccaagcctctataaattttttcatgcacagtgttcagtagtcacttaataattaccatgcatagcagggaattcctgggtattagtgatggcttatttctttatttgtatgttggcttaccctttgaaaatttatgttgctattcatatgtgatttgcacacatttttgtatttaaagttaaataaaatttttatttaaagacacgtacaaagatggtcagaacatcattatatagtcaaaatctggaaacaacccaaatgtccatcgatagtagatggttatacaggattgtgttttatatatgcaatggaatcatatgaagtactgagaatgtacgaactactgctataagtaataacatggattaatttcatgaacctaagtttctagaacataaataacacatactatatgattccatttatataaacttcaaaaacaggcataatccctacatggtgataaaaattagaatacgggtcactttgaagaagaagatcgaatagcgacagaaatgatcacaaagctgagcttctggagtgctgattaatttctgttttttgttatgagtagtggttacataggtgtgttctctatgtaaaaattcattaagctgtagaattattgtttgtgcattagtctgtgtgttatattttcttaagattatttactttaaaagatgcacacacacaaacatacacatgtgtgtcgatatatgtaagtatgtttaaagaaattcaagtgctacttgactagatggaatccagatcatttcattttcctcgttacttttatatattttctaaatgttctcccaaaaggctaccatgctttcatgacaaaaagtattttaacaaatattatttctttaaaatttgccttagaattgaaagcagtaaagaagatgtgttttttacagttgcggtagttcccaatttgcctgagggttaacaagacattgaaatttacagcctggatccaaaatctaagaatggtgaccctggagtttgctggcttttcttcaaattgcctgaccccctttacaccagcctgtctttacctgtcaatccactgtttttctcatcctattctttaaaatttatattcatgttttcagagtattctgtatcctcagtttaagactgtaactcttaagtggataatgaagaatacaaccagatcactaagtaaactaagaagtcaaataacaattccataattttgtgctaataggggatgatatttatgggacatgcaggcattttcttcatttcttactgaattttatatgacatgaaaaaaatccatgtcttacagaaatgtacagtcacatctatacatagaataatttccagtttatatatttcttgaagttttttaataccacttgcttcagaaatacttatgtaaaaatgaggatttcagggctatccattaggtctattgactattgttctgaacctatggaaatatttataaattagttaggtgtaaatcatatttatttaatttttcttgattggttcagaaggatggcaacaatatgcttcaatgtggatctgtgccatagagaatgtttatgtcttattaaggaaagacttcttttcattgttcaagcttaaaaattagcaaatgaaaacagatcactttaattaattgttaggaccatatgtcattaacacatgttcacaattaattttaaatatgaatatatatataatgccagttaaattaaaaagatctcaaactaataaacctaataaataaaaagttacgtattttccatcaacggagtttgctcactgattatttcctcaaaagttgtattaacttataattccactagctggaaatacttgcatgttagtactaaatactgtaattgaacactttcatgttcattatttaatttaaatgtgtcttagaatttccttttgtaatatcatagaagaattttcaaaatatatgtctcattctcaacaatgcaagatatttctgtttttgtttgtttgtttgttttgagacaaggtatcactctgtcattcaggctggagtgcagtggcatgatctctgctcactgcaacctccgcctcccaggtttaaacaattctcctgcctcagcctcctgagtagctgggattacagacatgtgccaccatgcctggctaatttttgtatttttagtacagatggggtttcactatgatggccaggctgatcttgaactcctgacctcaaacaatctgtccgccttggcctatcaaagtgctgggattacaggcgtgagccatcgcacccagcttactgttgtaatttgaatacacatttatttttataaactagtatggctctgaaagaaggatattaatatagcatctttttttattttcattgttgttgttttttttgagacatgtctcattctgttgcccaggctggagtgcagtatgtgatcatagctcacagcagctttgaactcctaggctcaagtgattctctcacctcagtctcctaagtaggtgggactacaggtgcacgccactatgcccagctaatttttatttctttattttatttttgtagagacagagtctcagtatgttgcctaggtggtctcaaacttctcatctcaatcccaccttggcctctcaaagtgctggggttataggtctgagccgcgatatccagctcatcttttgttttttgttgttgttgttgttttttaatagtataaaaaaagtgagttataaagccatagtcaaagaaagtagtgtaaattcatctatcaatacacaatgcattatttgaaattcgtgagaacatacattaagagtatcttatttattctcttctagtatttcctatctcaggaaatgacatggcaaaataattaactaattttctaagtcactttatctcatacatgcaatttattagtcaccaagtcctgttaatttgaccttgtaaatgcgccttgtattatacagttttgagcaatggataaataatacaattttcatttcctgagtaaatagctggaagtcagataactgggttttctgattagcatatgtttagctatgtaagaaaaccagaaatgtgttttgctcaataatttaatgaataatttttaatacattttcttgttaatcaacttaatgaacacttttaagggcagtgtgtaatactacgaatttaataagcaattttggctttaatcctagagaggataagagaagggatgtttgttttttatttaatcacaaaaaaatgcatttttttatcatttaatttttacatcttttgacacaaaatttgttaaacatttcatggctagaaaactatttctttatattttgtgtgcatctcatagcacagccatttgttttgtgctattacatttatattagatgattgaaattcaatgacattcaatacatggtttaagaaacatgtatgcttagaatttatctgagcagagactcatggtatgtataggaatcagtcaggaatatttcaatttgttcattaagaaagcagaaaacattatcagaggtaaggtaacactataattatggagcacttatcatttatctatttcttaaataaaaacatgagtgtttaatttcaaaggtgcaatttcttttctatagtcaacaagattcactatatattctcagaaataataaagacattattttattaagaaatgtgtctaacgtgtttactaatagaacacacaatgtcagctcaatgaatatttttagatactttaaatatctatttttattataatttgtactacatgctgaaataaattaccttataacttattttatttaaatgtctgaaaaaagaagagctagaaagaatattgaaaatttccatctgtgagaaaacacaagaaatgttatttatagaacacaaagttttcctatctgaataaaaatcttcactactatatctaaaattcttttcaataacaatgggacaatgaggatttatagtttagaattcaatcattttttgtttaggccaataaaacaagaaaaatacatattcaataataagtatagtatttagagaatattaatttaaaacattttcatccttaagcgcaagtcatcttgttgctacacagttcagagccaagccaacttcattcagattgtagagtttcattcatgatgtagagtggaggtccttcctaccattaaagattagccaggaggctttctttccttctgaaggaaaaaaatatacataaaatctagaatttctttgagaaagagaaaagggaagttccttctattatgaattacgggaaggagaaagggagacacagaagagacatgaaggcaggaggcagaggtcctcctcctcatcccctactgccactttggacccctccttaagtgaagaggcactggagaaacattttggaagaagggggaaatgatgactgggaaactaagagaaatttgggtgaaataatcacagtagttttcaggagtatgtaagcctccagaaaatttccacaggttccatgggaggtcccatctaataggttatggcactgaatatacagcaatggcagagagaggtgtcaagagagagaagccatactaccagcataaaggactggtaaatacatgttacatctagaccacaattttagaatgaagtcagggaggagaggtttggttggcagcttaactagtgagtatttatattgtcttaaacagataatgctgaaatactgttctaagaaacttaagtgtgacccagattacatctattccctacctgtccaaacacatatttatacattattgtctaagtaggaagattgcatcaggtataaaaaataaagaagcttttttttctctgtgcacatctgagtgtagtgtgtaaagattatatatgtatgtgtgtatgtatgtatacacattttatgcaatcgtgcatgtttttatataaatatatattttcaaaaatatcagaaagtatttatagtatacctgtatactatagtatatataatatagaactatagatataaatatttatatatttgtacataaacattttgcatgttacatatattgtaaagattcacatatatgacttaaatgtttaaagttttactattctataaccatacgtattgtgttctaaaatattaaatcaactattttgaaattcaaagttactttaacttcacacattttctcacgcatgtatttttgcttttgttaaagtttcctatttgattatgaagttaaatgctcaacttttaaatgttaattgttcatttatattgccatgtttcaaagaaatttaggaaataatattgcttcaagacaaaaacaaagatgctaagtcttctagcaatctgaaattgtgaaatattacaagtgttcagactgaaagccataactgagtaattcaatccagtaattcaagagcattttacagaaatcaaaccatgatggaatcaagttacctattgtatcaattaaggaggaaaataatattgctgaacacacggaatctggtcagaaatatctaggctacagaataacttcacattttaaatgaaaaaaattactgatcactgttcgcatatttatttatatctttcactgtgttattggttgattaacacagctgcaatccataagccctacttcctagctatttttctacccactgttgctacttacagataagaatatctaaaaggaaatctgctagatggggtttctgaaaaaactttggtgctttgttaaaataaagcaggggtgcagactcttctggcattcatctttatactttgtctggtatagagaattgacgtctagagttgcagaagatgggaatgaaagtagacaataaaaatggcaaagcagaaaatagccagcaggcatcctcaatggcactgatgtgcacctgcaccatctcttcactgtccacctctagattttttttctgtatttgtttgtactatctcaatttttaaatgtaaaatgttgtggtattaagtatattcatattcttgtgcaaccatcatcactatccatctctaaaactcttttaatctagcaaaacaaaagctctataacattaaacaataactccccatttctcttttctttatcctctggcaaccatcattctactttgagtctttgtgatttttgaccattctaagtaccaaaatataagtggaatcatatggaatttaacattttgtgactggctaatctcacttagcataatgttctcaagatttatctgtgatatagtgtatgtcatactttcttccatcttaaggccgaatgatatttcattatatgtatataccacattttgtttatatattactctacataaacatggaaaactgggttgcttttacatcttagctattgtgaataatgctgctatgaacatgggaatacaaatatctcttggagactctgctttcaatttttttgatatataaatgaaagtgtgattgggggctcatatagtaattctatttttaattttttgagaaactaccactgttttccacagtggttgtaccattttacattctcaccaatagtgcacaagggttccaatttttccacatcctcatcaacatgttatgttgttgttgttgttttgttttgttttctgtttgttttttataatagcgtctctactgggtgtgaggtggcacctcattgtggccttgatttgcatttccataatatttagcaatgctaagtgttttttcatatgtttactggtcatttatatatctcctttggaaaagtgtctattcaagtactttgccaattttgaatcagtttgtttatttttgttttctttaaaaaattctcgggctgggcgtggtggctcacacctgtaatcccagcactttgggaggctgaggcaggcagatcacgaggtcaggagattgagaccatcctggctaacacagtgaaaccccatctctcctaaaactccaaaaaaatagccaggcatggtggcaggtgcctgtagtcccagttactcgggaggctgaggcaggagaatggcctgaacccgggaggcggagtttgcagtgagccgagatcgcgccactgcactccagcctgggtgacagagcaaaaatccatctcaaaaaataaaaaaaaagatctatatattttgaatattaatgacttatcatatatatgatttgcaaatattttctcccatttttatgttgcttttttattctgtgtctttgacacccctttacaaaatcacaaattccaacttgtctattttttgttgttgttgtctgtgtctttggggtcatagccaataaatccctgacaaatgcaatgaaatgatgcttttgccctatgttttcttctaagagttctatagactcagttttcattttaggtcatgaatcacttttgagtttgtttttgcatatgatgttagataaggtccaacttcattcgtttgcatgtagaatgatcatagcacccatcttaaaaattatctgaccaattaagtgaaagtttatttttggattttctattaaattacattggcctgtatttctgtttttatgctagtactactctgttttgagtattgtagctttgtagttagtttgaaatcaagaagtataagttctccagctttgttatttatttttctttttggctatctggggtcccttgaaattttaaagataagttttagaataagtttgtttttttaaaaaaattatttctacaaataacatcattgggattttaatagaaattgcagtaaatctgtagattgcttgggagagtattaacattttaacaatattaagtcttcccatccatgaacatgggatatttttcaatttagttatgttttatttaatttctttccaaaatgttttgtagttttcattatacaagtcttttatctccctggttaagttaattcctgagtattttattcttttggatactattgcaaattgaattgttttcttaattaactcattcattttcaatctatgaaaatgcaaatgattttgtgtgctgattttgtactctgatactttgcaaaatttcttagttccaacatttgtgtatgtgtgtgcaaacatgaaacatgtgtatggaatcattaaagttttctatatgcaaactcatatcacctctaaacagagataactttacttcttccttttcaaattggatctttctctctttctctctctctcttttctttctttttttgcctaatagctctggtgaggacctctgatactatgttgaacacaaatggtaaaagtagacacccttgttctgaatcttcaaaaaaaaattagaatcgaaaaagtatagttttatctgtacccccgatagctaaaaaaaaaataaattacatgacacatgcaacttatacagatttttcaacaatcattaacaaagaaaatttagaaaaggacagtcaaatcaaacttcctccatactgtctacaaataaactcacaatgaccaatagaatgtgacctcttatctccatcatccccattttgagatggtagaaaacgtgtattctcatgatcaaattttcaaactcatcctggcaatttgtttcacacaaattgcttgttaacattttcatttcaataaattccatccatctgtctgtgtttattaaatatctgttttaaaccacatgattcttaagtttaaaaggttaattttactgtaattactaaatatttagataagaaaagtgctattaagacgtgagaatattattgttatataatcactttttttcttcaggaacccactgtgtatgcctacatataagtatatccgtaaaattatataaatgatggaattaactgaataaacttttgtttgaaatctaaatgctttctactctactgatattctcattacaaactttacaaatgaacacaaaatttactcagaaaatcagaattttaaagcaaaatgaaacctgagtgattatatgaggaaacgaggacctagaaatgctaagtgtcctgtccaaggagaattaaaatatacaaataaattactgaacaatgaactagaaagaacaaaactactgattttagcccagaacttattttggttttaagtagtcaaaagtattattagtagattgtgactattttccttccatctgtttccttgtctaagaaactttaaggacagacttaaaatgttctagctaatattactgccattagtttctgatttataatgtggcatatttcaaagctatgtattatcctttctttttttcctattttattggttgacctgaatgctttcttaatttcacttcactgtaattatacctcttaatctatgctaaataatttctccttctcctccttagaatattttctctcacttattgcctagccgagttaccctctaaactttcatcataagtcaagttcttcaattacttcctccagaaactctcactgacttctttacatacatctaacacagacatactgtaataatttagggcaggctgggcgcagtggctcacgcctgtaaccccagcactttgggaggccaaggagggtggatcatctgaggtcaggagttcgagtccagcctggccaacacggtgaaaccctgtctctactaaaaatacaaaaattagccaggcgtggtatcatatgcctgtaattccagctacttgggaggctgaggcaggagaatcacttgaacccgggaggctgagtttgcagtgagccgagatgtttccattgctctccagcctgggcaacaagagcgaaactccatctcaaaaaataataataataattaggtggattgcttatataaaaattagccataggttttatttacttttctatcatctaagtacctattatcctcactgtttactacaactgttctgtatattttattatatgtataagtatgtttatttatgtaatgtctgaaaaatgttaaatagcttactatggacagactgcaattaccaaatttaattatttctatttatctcacttttagttaagatgagaaaactattcaggtatcaattttatatttttattataataaaatctcagaaatcctcctaaaataaatgtgaagatacatttattttacatttattattacaataataaatacattattattgtatactttcagccaatgtagtatatagattaaatagatcatttcaaggagccaggagatatgttgatatttaaattgagtgagccttgcttatcaatctgtaatgggtttgaaattatttctagacaatagcactgagttgacacataagcacctgattgaaaaaaaaaagagaatcacctaacacatggcatagaaatggtgaaaataattattaacaatggtaatattacaatacatagaaagcgggatgctggcagttgtgaatgagatcgttcaaataacacagacaagtgattttaaagcagttcagaatgtctaacaattttttttttttaaagtgagttttaggtccaaaggaaatagaatttatcttctttggaattataagcccatttaaattatttagataaccaagaattacttatgattcttactgctacttacaaatgcctgtggaaacaagcaaatcactttcctaagtgcttaaagatatttatccacaaaatccactcttcctccctgacccttaaaaaaatgacgctaagtgtaacaggttccaacataataaactgccagaacacatttcatggtgcagtgcaaatgacagacacaatggaatacctgttagaataaagtagatttcattttccctacaagttaggtgagaatgctgatctcaagtatctgttctgtcaagtcaaaggttgcagcacaatagcaaattcagagtataggtgcatgtattaatagcctgttgaagaaaagagcaacacttctagtaattataagaagttgctccagatgaaaaacattaattcatgtctgtgatacattgtttaagactctctcagttgccttaatactatttttaaaaccccttcacagggagcatactcaccccatctggcctgccatctgaagctgtgatgatcagaatgtagcgatcagtgctttccctgtccagtgctttccctaaggttagaatccccgtgctagtgacaaaacaaacaaacaaataagacaaaaagagatattatgtcacaaggagagtcttcttagtatagtgaattacttttgatagctttttttcccctctcagtaatcacagcttgagtattttagatgtataatactaagattcattctgaaaattgaaaacagcttttaaggctgtcaaatttcttagcagtatccatgaaactgacactgagctgatttcctaccttccaggaaacaaaacataacaaaactgtgcttaattcattccaagaagaacagtatctatcttgttttcgattatttcaagagaaaagacttcattattccttagcagtctcagaattctttgaaacaaggaatggtttcctataactaatgtatatcacctcccaatttatgtcatatgtatgtccattatgaaaatgcaaaaacccatctaaatgttatctctgacaaactctatggataaaagtttttcttttttcttacttttaaaataacagagacccattgtacaaaattagaaaatagaattttttcaaattacagaaattatgttttttgtaatgtttctttttgtactttattataaccacatttaaatatatgattgtttcagaagaggaatcattctgcatattttacattttttaagaaaatataattgtattagaattcatgttctcattttataatttgtttaaaaccccttttgtggctacactaacaattttagtattttgttattctttggaaatttagctgtttcttaatttaactgatgtataatgggagattaacagcacttgggaaaattattgcacttacaatatttttaatacctactccttatcttttcactgctcagaataaatgtttccaaatatttaagactttattcacccatgtaatttattttataacagtttggcttgctctctaatgtaggttctacatttatttcttaaattttacatctgatattgtacacattttaatcgagcctaacaagtatccactgtgtagaagagtttatctgaatataataacacattaaaatatatgtaccaagtccaaaacataaattgtttctaatggataaaatgctttcattttaaggtaagtgcttttattgtaaagaaaatttaaacaattcatatcacatatggtagttgagtacagagagtcaaagccgatgaatcaaaataagaatcacagttactcaatttgcttattatgttgtaatggttgacgtggactttttaaaaagttctgaacatatggcatgcccatgaaaaactgactttgcttcctgtacattttaaaaatgttttgtcaaaataattgaaaaccagttcccagagcatgttcacaacaattaagtttggaccagcttcctacagtacagaaggtccagataatcccattttaaaattacattaaatgagaaaagtaagacatgtatttcttctgaggcttattcacaagtatcttaagaaacaggaaagctgaaaacctagccatggtataataagagaaagaaagaaaattgagttaccattttcattttgtttcttccctcagttaattatctatattcctccttgtacattaaattagaaaattactaaaaagtatattgtatatttacgatgaattacaaaactcacgtgataactgagttgatttcctaccttccaggaaacaaaacataacaaaacttcgcttaattcattccaggaagaaaaatatctatcttgtttttgattatttcaagagaaaagatccattattcctcagcatgttcagaattctttgagacaaggaatggtttcttataaataatctatatcgcctcccaactgtatatagtatttggaatatatatgtatactctatatatactatttaggatatataatactatatgtattattccaaaaatactatatgccgtgaacaatatagtatacagtatattcatacttagggccattttaaacacaaacagctaattgtctatggtctggtgattattatagaggtagtttttatgtaatacgcgggccttgcgactcagtgttgtaggcagttgtgtggtatatttgggcaatgcagaaggggagaaacacaggcagtgtattttgggattcatagctgaaagactagtttatgggtttacctgtgcatccttttattaaatccgagaaatagctcacaaaaagtcttattaccagctagatggaggctatcaggccaggatacattggggtacacttagtaatgcaatacaccttataagttcacatattaaaaatacataagcttcttcaattgataaagcatcaataacactgctacttatacaggattgaaaatacatttcccaggagtgatgtcagtggaaatggagaagacagccccaagagatggtctcgccacaaaacgtcaaaaaatcacaattaagcagggaccttcaacagcaaatttgatgaaactctggaaaacagtcacaggtttatagcaaccagatgaaggcagaatttgttttaaaaaaaggtaaatcaaatctggtagaagaactctgtggcattttgacttgtctttatcctaccatctcactggctcagagtggccttgaaaacatcagtgaacattcccagtgtgacactatggtctttgtttctggagggagcgagctatccttattcataaagaactgtgggggtctattctagtctgtctggagactgcctgaaggagtgattcatggcacttatctttgtttcatcaaacttggaaatcactcaaagcagaaaagcagtgggcattcctcagaaatattgtaaggcaggggatagcccacaaacacttgaggcgtataatagagtgccaaaaacttgccaggaaagtctgggtaaatagtttcatggaaaattcaggcactcaaaagtgtactggggaatacagaataataaatataattgagaattcataaatatacccacacatctacagtcatctgattttcaacaagaatgccaagaccattcaaaaggaaagaatagtcttgtcaacaaacggcactggaacaaatggaaatctatacgtaaaagaattaagttagactacttcacttcatacacagctattacctcaaaatggatcaacaatttttctaaacacaagaattgaaacctgtaaacaactcttagataaaaactagaggtaaatattcataatcttggatttggccatggattcttagatatgacaccagatgcacgggaagcaaaggaaaaaatagatatactgaacttcgtcaaaataaaaaaaaaaaaaccttttgtgcatcaagggacattatcgagaaagtaaaaaaaacaacgcatataactggagaaaatacttacaaatcacatatctggtaagagtcttatttccagaatatataaaggattacataacttaacatcaaaaagaaatcccaatttaaaaataggcaaaagactcaaatacacattttttccaaagaagatatacaggatatacaaataatcaaaaagcatatgaaaatatgtcattagtcatcaggcaaatgcaaatcaaaacccacaaccaagtatcacttcacactcactatgataattatatttaaaaaaagaaacaaccaccattactaacaacaacaacaaaaaataattgttggcaaaaatgggaataaatcagaatcctcatatatttctggtgggaatataaaatgcttcaatcactgtggaaaatatttgacagttcctcaaatggttaaaaacacataattacactattccctagcaaatctattcagtatatacttaaaaaagccaaacacaggtacttaaatacacgtacatatatgttcacagcagcggtatttgtaataccgaaaggtagaaaaacagcttaaacgtctatcaatttatgaataggtaaacaaattgttgtatatgcatgtaatggaatattacgtagccatgaaaagtagggacctacttgcacatgttgcaagacagacgaatcttggaaacattaggctacaaaaaagaagctagacacaaatagtcacacattgcatgattccatttctgtagaatattcaaagtaggtaacttgatgaagccagtacgcagattggtgtttgccaggggctaagggaaataaggaatagggagcaattgctaaatgggttcaggtttctatttggagtgatgaagctattttagaactagacagagttggtaggtgcatgagttctgaatctcctaaacaacactgaattgttcactttaaaatggttaattttgtgctatgtgaattttgcctcaattatataaattatattgcagagtattttccatcaccaagcttttgggctacgttcctgaaacatattatgcttggcatactcaattattatagaaaatagggtttgcctaactataaaaatggtgttcaaacataatttaaaaatttggccaggcgcggtggctcacgcctgtaattccagtactttgggtggctgaggcaagaggatcacaaggtcaggagatggagaccatccatcctggctaacacagtgaaacactgtctctctctttttttttaatgtgcacttttttttttttatttttttgagacagagtctctctctgttgcccaggctagagagcaatggcatgatctccgctcactgcaacctccacttcccaggttcaagcgattctcctgcctcagcctcctgagtagctgggattacaggttccctgggagcttatttaaaagctctgtgccatcagttttcccttctgtcaaatgggaaagtgaaaccccatctctactaaaaatacaaaaaattagccgggtgtggtggtgggtgcctgtagtcccagctacttgagaggctgagggaggagaatcccttgaacccaggaggcggaggttgcagtaagccgagaccataccacagctctccagtctgggagacagaacaagactccatctcaaaaaataaaaaaaataaaaaaataaaaattatcacctgtagtcccagctacttgggaggctgaggtgggaggatcacgtaagcctagacttttgagactagcctgggcaacagagtaatacccagtcttaagaaaattcaatgatgtaaatagaaagtagcagaggatatctacttccaaacaaaacaagctaccgaatttaaaacctgcttctataagtaactgtttttcaaaattccgttattaggaaataccgatgcagcatcattataaactattatctcacatatttcatgatgtataggctttgcttatttaaaattttgttaaaaattctacagcttgtgactgaacatttacacttggaggtgtctgagcctttgacagatttatcacattgcttttgggcactgagtttcaggctttacaatgatatttaaagagattagagtatactttaaaatgtacagttgcttcaagtttgacatggcatttcatattaaatagcaattagcaattaacaaaaacctactaataaagggagctaggtattgacagcagtttggggaaaagatgatggtggcatgaactaaggtagtagagtgaagtgtgagaaatagtttgatttgggtttaatattttgaaagtagagctgagctgtcagggaataaaataaatatctttcttatatattatttaattttcaatataatcataaaattcaaactgatatgaaaaatataattgagcattacatgtaatgtcaaaacaaattaatcaccaaagaaaaaattaaaatgcaagtgaagaaaaaaaattttaatagaatttggaccagagatggagataatttttgaaattctcttatttagcactgattttaagtgttggcatcacagaccccatgcttcagtgataacaatccataaatatttgagagatggcatttcctcaacctcccttaataaataactataccattaggccatcatatttataagggaagttgccatatatcttatttaaatgtgtacttatttgtggatgattgctgagtgaatatttgctaaatcatatgccactatcaagacagacactatgaaaagatactagaaaaatgcattatattagaatcatacagatatggccacttaatacatgacactgaatgatttgtattaccaatgtttgtgatttttaaaaaaccaaggctttttctttaaagacccagtttctttcttggctgtgtgactaagccaatttattaaaataataattcagtactttgtaaaaccctactgacattaagatgattattcattactactaattttttaaaagaaatacaagaaaattttggcatacttttatttcattaaaggaaagtaatggtattataatgatgcgtattgagagaatttgcattatagcataaaataatatggtatttaaagtatacaatagacatgtaaatattttttcattttgctttaagatataaaatataacccaaatagcatatattgaagtgtctgatgaggtagaacattgtttatttttttagcgtacctgtcttagtccatttgtgttgctataaaggaatacttatggctgggtaatttataaagaaaataagtttatttgtctcacagttctacaggctgtataagaagcatactgccagcatctgcttctggtgaggggctgagagtacttccactcatggccaaaggtgaaggggtgctggtgtgtgcagagatcacatggtgagaaaggaagcaagaaaggaggggtggtgccaggctccttttttacaaccatttgttgtgggaactaataaagcaagaactcattcattacctctggtaacaagccattcataagcggtctgcctccatgacccaaacaaatcccattaggccccatctccaacatgagggatcgaatttcaaaatgaggtttggagtgtcaaatatccaaactatagcagtacctggattgttcatatccttgaaagttatagagaagtggtagtgcaaagttttgaacatgaatctcagaagtttcaaagaaggtggcagttgaaatgtcagttattgttctccatttcaaatgcattgaaatgtattgctagtggttcaggctactctataaatatcaatgagaacaacagcattgaggtggtggaaacaaagtgaccataggatagaaggcaaagggcccagtgtacaggaccctgaatcaagaatgatcatcaaaagggatcacacaaccattatagggacatgttctgctttagctttcctggaagcagtttgtgtcttaaggagatgtctgtccaggttgacctaagagctttaacattaagaatcatggtcaatttagactaaaaggattttgcattgacataatttacacctttaagaacctctgtgacccagccattatctttttcattccaaatgcagagatgagaggagcactagagatataggaaagcagtgcatttagataatttatttggcaaaactagtagctcactggatttcacaatcagcaattgaaaaatctcttggcatcaagggaaaaacaggaatagaaattcttaagagacctgggcttcctgcttaccagagcaggtgaaaacttcattgttgtctttttcttttgttgacagctttgttaacattttaattcagatatcataaaatccaccaatttaaagggtacaattcaatggtttttagcataatcgcagagttgttcaatcatcactgtaatcaattttagaacattttcaacaccatatctattaacagtcactccccattctctcccactcctcattttcaggcaatcattgatcaactttttatcttatagatgtgcctattatgaaaattttatagaaatgaaataatataatacgtgctctttttgcaactgacttatttcacttagcataatattttcaaggttcatacatgttgtagcatgtttcagtacctcattaccttttattgatgagtaatattatattattacagacaggcaacattttgtttattccttcctctgtagatggatatttgacttgtttccacttttgtaccattgtaaataattcttttatgaactttctttgtgcaaactattatgtagatgcacgtcttcatttctcttgcatatgagcagaatgctggcttatgcggtaattctgtttaccatttggagaaaaggccagttctccaaagtgtagtcatagtttgaatccatgtccttgcccaaatctcctgtcaaattgtcaccaatgtaggagataggacctgctggaaggtgattggctcatgggggcagtttctcatgaatggttgagcaccaccctccttggtcctgctctcttgatagagttcaggagatctgcctgtttaaaagtgcgtggcacttcccctccctctctcttcctcctgctcaggccatgtgaagcgctgactccccgctttgccttcagtcatgacttttaagtttcctgaggcttccccagaagcagagcaggtgccagcatcatgcttcctgtatagcctgcagaaccgtgaggcaattcaacctcttttcattacaaaatactcagtctcaagcacttctttatagcagtgcaaaaacgaactcacacatgcacattttacatggccacataaatttacgcagatttcagtatctccacattcttagtcatacctggttttgcctttctttatcactacagacacaaagtatgtatgaagtcaaatctctttacagttttaaattgcatttctctaatgacaaatgaacagtgatcgtgatcatatttccatgtgcttgttggccattcacatatccttttttaaagaaatatctattcaaatattttgcccattttaattagattatttctctttattaagttgtaacagttctttatgtattcttgagacatgtttcacaccatatacattattttaaaatattttctctgattgtaggttgtttctcactttaggatggtgctccttgaaatacatttttaaaaattgacgagacccaatttatcaattttatcgttaatctttgtgcattttgtgtcatatctcaaaatgtactgactaatccaaataatgaagatttacttctgtattttcttctatgtggaatgcagttttatctcatatattgcaatttatgatccactttgagttcatttttgtgaatgatgtgagataaaaattgaaattcattctcttgcatattgtcccagcttcatttgttgaaacaaagttctttcctgattggattatcttgacccctttttgaaaatcaattgaccataaatactagagttatttctggattcttaagtctgtccaggtgcttatatatctatctttatgctaatactacacagccttgcttaaagtttttaacatttttattttctttaatgatgattgtaaattgtagctaatttttgatttctacatccctatgagataaaaatgaaaacagttaaggctttttatttttcaaatagaagtttacttatctgtggaaaacactgttcttgtctatagtttcccaggcattactaactcatgtttgtaaaattctatttaacgtgaaatttcaggtatttctgggaagactaattgaccagcacatggttctcttgttttggcattatgccccacatgttcctgagtctgatgtggcaatgtattcatttgtcaaagttttaactttataatcattggccaagtttacatttctattccttctgaaagtaaaactattcacaggtacacaggaaatatcagggaagagccaagctctttagaaaccagccacatgtgacagcagaacagctaccttgctattgcaaaagggaagcatacagtctctctgaagccctaaatgcctccttttaatgcctgctcccagttttctcaatagttatcattagcaatatctcagatgtattcagagagataagtagaatgacactgatctagacctcaaagaagtttggcatgaacacgtattttatttcattgtgctttttttcttaaatatacctatgttaatctgaaattgaaggatgtgtttgtaacacatcttgcctacaagcctccctttgaatacacagtttggtgctaagtaaccctttgtagtaatgtccttgtcattatcagtagctgacaacattaaaaggatctaattaatcccagttgtgccttccaatgaaatgtttccacctcagtagattttacctagtaaaaatgttaaaaataaacagtctcctgggtaatatttctgggctcagaattatcctcccagctaccattagcattcatagaaaacagaaagggaagtacaactacaaacagctgaaagcctctgattagaagtctgctttcttactaacagtacgttgctgtacatttttttaaagtaggaaatcatttttaacttacgtttctgaaagattaaaaactctctgaggatctccattctcaatggcatatgttattgagtctccctctcgatcagttgccttcagagagaaaacataattcaattatcaagtaattgatatggcgcccactcattacagagtaatataaaagcttgaaactaatagcacagaatgtccatgacactgttaaagaataaagattaaagcatggcctaatggcaaggtgtaaaatcaaacatttcgtatctgatccatttctgaatatgtaatcctacctgatgtggaaataatcattttcccaaggtttacttatttaattaacttaattaatgaatttaatttcaatgtctgtttataatttaaataaaagctgctggctgggcacagtggctcaagcctgtaatcctagcactttgggaggccaaggtgggcggattacctgagatcaggagttcaagactagcctggccaacatggtgaaatcctgtctctaccaaaaacacaagaagttacccgggtgcagtggtgcacacctgtaaccccagctacttgggaggctgaggcaggagaattgcttgaacccgggaggcagatgtttcaatgagctgagatcatgccactgcactccagcctgggcaacagagcaagatcttgtctcaaaaaaaaaaaaaaaaaaagtgctaaactatgtttacagtgtcgataaagtgtttaatgtatattcttttctttttctgttcagaatatatcaagacaataattcaaatcagtctaactttctggttaaaaatcctgaatttatagccacaaagcatgacttcaaaaccgggctccaattgtcctatgtgattatttctgtgtatccatttctaaaacgaggactatacaacaatacaaatgttaatagatgttgagaggtttaattgaaataatatatatcaaggcacatagactaatatctggtacattgtaagctttcaataaatattaacctttttgttggtttttcttcccttcaacacccaagtcggagaagaaaacatatagtttgactttgagttccgagtttctcttgaccaaaataaagatgctcttgttttatggcactgaggtctggagttttaccttaaaaaacatcaaatcagttctttttccagtgagtcattcgatcctcttataaaagacatggataaagaaagaaatttggatgctatcagagagttgacagaatgatctgcctaagcatgatgctacagggggggatatatctgataaaggttcagatgtattttatttttaggtgactagcctggcagaaacaccagcctctccacagacaggaactgccctggagtcagcaggattctgagagaggaataagtatgtgagtttctgtcagtgactacataataactgtcccagccataagaggctgagtgtgaaattccctgtccagacaggcaggaacgtattgttcttagtggtagatcagttggctttgacatggattacacagtcctgctcacagaacgtccttatcagctaccacaatggattgatggccagaagcctctcttggaccacaaaaactacagaatcaagggaaactgaaaataatatttcagtcagtaataaactactgaatattgactatgtgctaggttctgtaagaaaatctttgcaagattatttaatctgtctctcataaaagtgatatacttccttcgcatggctcctatgacatcatattgtcctgctttcaatcctcacattatcaatggtagttcctcattttcctttgctgatttctcctcattttataagacttattttatattggattgttccaaaggttggtccttgaacttcacttatttagtcaactcattcaacagtgtagctataaatactgtctatctgctgaagacggtcatatctctaggctagccctttcctctggatttcagatgtgtatccaattgcctacatggatccacattagatgaataataataagcctccccaatttaaaaggttaaaagccccaaatctagatctcctttccatcttgacgtacctcaaaaaataaaagaaattcaaacaataatctattgttttcactgcttcatcatctcagtaagtacctgcaactccatcctcctactttctcagggctcatagctacactttgagggctcactcttacattccaatgcaacccatcagcagatcccaccagatttacctaaaatatctgctgtatctggctgtgtctgaatttcttctctgccaccaccttcctcatggattatggtagtaactattttactaacgtgttgcttcttcccttgtatcctcacaatagtcaattttcaattcagcagacaaaagtacttgtttttccaggccaattcttttatttctttggggtaaagtctattgctttctcccccagctccccaccctccccatgccatacacactaaaataaaatggaatcaaaaaaagtaaatgaagaagaaagtaataaattagccagggtaaaatatttttgaaacatcccatgttagtcaaaatccaaaattttatatttcattgagttagtcataatggaagcctaggagtagaaaaaaaagaagcaaacaaatttctaagaatacactcaataaaatggatagtagacgcttgatatttttcccttgcattctgttctttgctagataggaaccacaaataatgatactcagctaacattttgaagaatcagagaattatatctggagactatatcttaaccccaaaaagcttacagtgaactttttctgttgtttttctctcggtcaataaatttttcttattatgttgttatagatatgatcatgttcttttggtttgtttattgatatgtggttgctgttttaatttttttcttgagaaacattttataatcttgtgtttcataaaagccagaagaaatgcattctgaaacaagatagcttcatgtaaacaattttaagaccagattaatatcgaatcttttattatatcagatctactctaatatttaatatcctttatgtaagatgagaacactgtatttatatttattatttttatgttaattcctttcaatcccagaggtagcttgaaatatttcttcagttttatttgaccactcaaatacctcagtcttttaaggattgtgaatgtcaacaatttgcctacttcattcttatgtgaggttatgcccatattggaaactttgaagacttaggatttaaaagaaaattcttatttgattcctttcttcatttttatcttttcacacaatcctttattggtgttccagggtcgagggtggtataataattaggaagtatttatagtttttcagccaagaaagcaaaaggaaatggtgtaatctgtatcaaagttctgcaatctatgcattacatgagttagcacttgtatagacaatatcatctttctttgtcaatgtccaaaggtgagaaataatccataaaaagaaaaattggaaatatcaacagaagcatttacccttcaagtattaggatttgattatgtgtgtatatgtgccctaaacatatttctatcagcaatatttaaatgttttctatatataaatctaaccagccatctcaaaataattgcttataatgtgtcagaaactatattaaaattttgcatgtcttgtctcatttaaacctaatagtaactttactggtaaatagaaaatgcatatgacttcaattatattactatttctgccatcattccaaccagatttctctgtactttaattaattgaaagatgcatcttttttatctagagatagtaataactgtatcatcttgaaaatgggagcatagtgttattcagtattttccataatataagagatataaattgcttctttttagtgaaaaaacattttatgtgcttatttttgataaatcaagtcatatccgagtcccttcttcaaagcctgagaaaagtatgacagcagttatctttctggggcttattttgagtttaacgggggagattctggagccagctacctggattcagcctcagctatactatctcttctcagacaatgcactcaagtacaaaatgagaatactactactactacttaatcactcattaattcaacaaatatttattgagcatctacgctgtgttaggcactgaggctgcagcagtaaaccacacagacaaaaatcctgcccttatacaatttacatggtagtggaggaaaatgaagttaaaaattaattagaatattttgttttcagatctttatacgcgttgctcaactacaaaatatttcacaaaggacatatatggagagcagggtgaggatttacacttatagaagtgatcatgacagacttactgaaaatgtgaaattttggcaaatgcttgtaaaaggtgaaagagtaagtcacgtggggaagaacattccaggaagagggcagagcaagtgataaaggccgtgaggtgaaaacaggcctggtgagtttcaagaacaacaacgaggttgtcaggtctggaggcaagcagcatgtggaagaggagctcctcagtgtacttcgaccactttaatacctcaggttaaacgaataaatgatgtgtattttggatagctggcaagtaatgcactttagccactggtttgctaatatatggttaataacatggttaagattaaagccaatctttcctttaatttttatttaatttaatataattttaattttgcctgaagaacaaatgattcctttaaaaatcaaagcaattactctttccagtccactcaaccagattacttgcagcatctgacttagagtccctgatttttcagaagcaccaatagggaaacaaaagtatttatccaaggaagcagtgttcttagacactggcaaatggaaaatttggaaaagaaaacaaattttctctaaactaatcttctgttcatgttaaagatgaatacagccatcaaataccgtctgatagagtgcattttatgtgcaaggaatgattctacacatttcacaggacattaagacaaagtaactgcccttagggattctaaaatagataaaaatcaatggatttggatgattttctcacttaggcaaacaagttctgatttatgttattaaaccacttgagagcaacaaataaagctttcaattcagtacagcagtgtttcaaaaaatgtatacattcattcctggtattacattttttggcctttaacaaaatgttataatatttaaataaaaattaatgaatatattttattcatgtcaagtactgttattttgtcattcataatgataatataaaatgttattttgaagtaagtgtaagtaaaaggtcagttcattaaatattccaaacaatataaaatgaataatattatatagaatatacatataacatatatgaaacttggaaatgtagctaaatctacaatgacaaaaatataaatatgctcaaaaataaaagaatgttggaaaactgcacacaggagagccataaaacagctctttttcttacaatattggtatggattaatgatcttttgcccaggaagcaaaataaaatgccttatgctaagaaggcatagcagaatcactgctggtagtgttgaaaataaatggcatttggaagtgagcataaatttatttgtcacatccagagaagtgtctgtaaattaagaagtccttaataggaaaaatacctagacttccgttagatttagggatactctatgaaggcttagtcttaaaaaaattttgttgtacaaaatgggtaaccttggaatacaaagagatttaatcaattctaaaataagcctgcaattctaattttgtctagggctcaaggaacaatcaacaaaataaacttagaactaatgtaaatattcaaaatgacgcatccaaataatggttaccattatgtattaagcacttttaatatcccatctcatttaatcctcaaaacaatcttctctggagagcactacaatccctattttacacataataaaatcttaagcttaaaaattaaataatttgccaaagtttacaaactatagaatcataattcatattctatgccttttgaaactcattttctatcactagcaaagtcccctatgtcctaaacttatctcgagtttcccttcacctgcttgcttgaaccaacaccaagttcttcttaagaaccctaatttcccagtatcccttttgattggtgagcctcagagtagccttcttgtttctcaatgtcactgccagattattcttctggaaatgcatcagctttaattcttataccataagcattatactgcattaactgctactcttcattgttaaagtcatactctacactatttatcatacttcctgttttttgctcattgtcagtctctctctttgcctgtcattgctgtcattgtcaacttaatccaatatcaaagtttcaaataatatgtaaaatgctaatgacttcaaaattgtatttcagttctggggctgagagattcaagatcatggcactagcagatcccatgcaccttttgtggtctgcagacagctgtcttctcattctacacttacatagtagaaacagagagctctggtttcttcattccccataagggcactgaatgccattcatgaggactccactctcatagcctaagtatctctaactaccaaatgtcctacttctaaataccatcacgttggggattttggcttcaatatgtgaattttgggggaacacaaacattcagtccatagcagatgtcaaaaagtcttttcaaatacagtatggccaatattgaattactctttctctaacagtcttttaattttggctaatgacaaatcaatgtttccagttactcaagctgtatcttaatacctattcttaacttctatctccccttctatatccaattcattaacaaatcatgtagtttttaaccaccaaaatataaccagattgaaatgacttctcattatttctggaaagatcactccaggcctagaatgtgctgacagagcatatcaacaactctccataatttttcccaggcttcttccacagaccattttcaatgcagcatccaggattatcctttgttaaatttggttgattatgtcactgctatactcaaatttttaactgtacctaatttcgtgcagagtaattatatctatccctctcctattactgaatgatttcatctctactactgtctgtttcttttactttactctgtaaggaggagtatttttcttcttccttaaacatatcaggtgtgtctaaacttcggggtcttacctttgcacctgaaatacttttcctcagatacaaccatggctcatcctctcaccttattcaactatttgctgtaaggtcactttctttgtgaaataatcactatcaaattgtattttcccatgcacttcctctctagctttccttctttcattttccccataacatcttctaaaattccacataactcacatatattttgttaattttcttctctattagaatggaaccttcataaaagcagaaattttgtcttttttatttactattatatcctagcatttttagttgtgacaccataagaagttaatatttacttgtcatttggtccttgcaaagttataagccttaatgattacattataatgagaaaaatgaatgaaagaattttggaaaaatgaaaaaggaaggtattaagtggacacaggtctctccctgctcctgttttcactgggaggcaggaaaatgcacacctcaggaggggagggcatgggacattctggcttctccctgatttattagactgcaaggataaactaagtccaggaaactcagtcagagctctgttctgtatatgcacattcttcctcagtatcataaagggccttcctttgtacttcctatgactgggagcctaactttaatatactgaaggaagtacagcatttcaattgtatctggtacttgaagcaactgaatttacagtaaaacaaaacaaaacaaacaaaaaaagaaaccccacatgctttttacctattgtatatactctgtgtgtctctattaattgcttccaaacttgacagagaaaataaagttgtgtgtgtgtgtgtgtgtgtgtgtgtgtgtgtgtgtgtgtgtcctattctacattttcagaatacctgtcctaggttaaacacattccaaaagactgttagggaacagtttgttctgggcacactgatataaatatttcagttatctttatttataattattaaaaaatttgctatcaccttcatgaatattggacatgaatattcattgctaacatgaatggctcaagataaaggaggttatatgaataaactatatgaaaccaggaaggcttttgtcatctggaatgatgctgaaaagatgattccataagtatgaatttagcccaattattcttagtttttattgcccaatactaactgtaacattaccctgagagctgtctctagaatagtgtttggtttgcctaaattgaacttaaagaaaaatgttgtcaggcctctgaaaggacaaatcttacttgctaataaatatactgtgcatagtagtatttggcctgagacaaacttttccaacctttctatgaaggttgtgacagagaatcctagccctcttttactactacttattcgtggctattgatacttagaatctaattattgtggaaagacaattggctttggtcagtttacagccctcaacatttaatgacaaaccaaatagaaaaaaatcagaatcaacatttctgtcattaaaaaaatttcttcatgatacagctcttgtccagatttatataaatagaagtttatttgttctttgttttagaactatgaaaaactggacacctacgaagcaatttacttaaactcttagaatttagttcaaggttttctcaaagctttcctcagagcctactcacttttctaactagttagatttctcagccttcactagataaaaaccagatatgtaaaataataaagttatccggacacaggcaaacagtgaatgaaatcagtacacagtgaatggcttgacagctgtgagagaagtagacagaaagtgcaccttaaaaacaatagacacaggctgggcgcagtggctcacgcctgtaatgccagcactttgggaggccaaggcaggcagatcacgaggtcgggagatcgagaccatcctggctaacatggtgaaaccccatctctactaaaaatacaaaaaattagctaggcatggtggtgggcgcctgtagtcccagctactcgggaggctgaggcaggagaatgtatgaacccaggaggaggagcttgcagtgagccaagatcactccactgcactccaacctcagcgacagagcgagactccatctcaaaaaaaaaaaaaaaatatatatatatatatataaaacaaaaaacaaaaaaacagataaaacaagcatagttatcaaagatcaattgtccattaagccccacacatcacagcactacttatagataaaaatatgtaatccaatttaggaactattaatcacacaatattctgaattaaatagacaaaaacaaagcattaatttgatgcccattataaacaatatatgtactgctagaaatgagaaataatataaaactattcaatatagcccctaccttgagaaaatattaatctttgtgaaataaacattgagaaatagtgttcactatatgctggttaactgtgcatttgtaaaagtaatccaggtctagtatctacaagattaagaacctagtcttaattctctcacttttagccacctagggtctagggaactagcatgtatccctagacatctattctaaatcataaaatgaaataaaaaatacttcaagcatctactttatgtagtagatatagaatcagatgaggtaatagatatttaatacacttcagaattccattcaaatagaaggtattgctcagtggtcgggcatggtggctcatgactgtaatcccagcactttgggagcccaaggcgggcagatcacgatgtcaggagtttgagaccagcctgaccaacatggtgaaacctgtcactactaaaaacacaaaaatttgccgggcgtagtggtgtgcatttgtaatcccagctactcaggaggctgaggcaggagaatcgcttgaacccgggaggcagaggttacagtcagccaagatcacatcattgcactccagcctgagtgacagagcaagactccgtctcaaaaaaaaaaaaaagtattgctcaataaattaatttaatagttaaaatcttaggctttggagtgaaaagaaataggaatgaaatgggactctttcacttataagccacatcctctttgagcaagatttaaggtatttatatctcagtgacatcattctgatactcagataaaatggcacaaggctgtcatgatgatagaatgaaagagttcatatctagaattcagcatagtgcttagcatgcatttactaaactcttactattgatgttaatatttagaaagaagaatgcacaatagaattcaggcaaaaaaaatcgatttgtaaagcagtgtttcttaaagagactacaactctgttatcaataaaactctcacttctggaatactcagcaacatatagtaagtgatatgataccatattagcagagatagtacatcaaattcccggcaaccacttaaggtggggggggatttttttttttcctattcttagatacaaaaattttcatctgcaaggttacatgtatactttaagcactgcttgctcttcatgtccactttatatactgataaacagaaagaaagatctccagttaaggtctgaaaatgtgtctaagataggtagatattggttgatatggcttgtctgtgtccccacccaaatctcgtctttaattcccacgtgttgtgggagagacctggtaggagacaattgaatcctgggggcaggtcattcccatggctattcttgtgatagcaaataagtctcatgaaatctgatggtttgaaaaatggtagtttccctgccccagttctctccacttctctgccgccatgtgagacatgcctttcaccttccaccatgattgtgaagcctccccagctacatgaactgtaagtccaattgaacctctttcttttgtaaattgcccagtctctggtatgtctttatcagcagcttgaaaatggactaatacattggtcaactatattggcagtggatggtggggaggggaacataaataaatgtttataaacctggccatcaacactttgagctaaaaaaatgacaaatgagtgaaatacacaattcacaactaatacttagcatgtattattttgagcaaattaatagatcaaacactaacataaccccttagtatattttcagttgatacatatatcaaaaagtaaaaataagcaggattggagcatacagcagagacacttctccaatgacaaagtgaggagctacactgaccatctcccagtaaaacaatcacaactgctaaaaaagaaaccttaaaaattaaagtctcagctaggcgcagtggctcatgcctgttatcccagagttttgggagactgagaccagaagattatatgtggataggagtttaaaaacagcgtgggcaacatggtgaaactcatctataccaagaaaaaaaaagataagaaaattagctgtgtgtggtgttgtgcaactgtagtctcagctacttgggaggctgaggtgggaggataacttgagccctggaggtggaggctgcagtgagccatgaccacaccactacactccagcctgggcaacagagtgagaccttgtctcaaaataatattaataatcataatagtaatataaataaagttttaaaatagtctctaaatactgttctaaagacatatggcaagtggaaaaaatatttattcaataaaacctactaaatctcactaagaattgtgaaaactgttcttagtgagttcactaagaacagcctgtctttctccctttccaaaaacctattcagcacagcataatgcaggcatagtcaagaacatgggaattcttcctcacagcttcagtctgaaactaggctatctgcccatgaaggcaggccacacaatttcttatcacccccagcaatgtgctgcagtggctgagaagtctgatgtttccggtgggccttatggacaggaatggagaaaaaggcatttgccaagtcaatggctgtatatcaggtaccaggagatgtgttaatttgctcaagcaatgaaaccacatctggtacggaagctgcaattggagtcaccacttcattaagcttacaatagtccactgtcattctccaagatccatctgttttatgctcaggccaaataggagagttgaacagggatgtggtgattaccacccctgtagctttcaagtccttcatagtggcattaatctctgcaaaccatccagggatgtgatactgtttttgatttactatttttctaggtagaagaagctctaatggcttccatttggcctttcctaccataagagccctccagtcagggagccaatgtgggggttctgccagcttctaagtatgcctatgccaattattcattccagcactggggaaatgaccacagcatgagtccaaggacccactggataaccactataagacagatccgagctgaaaccccattaattatctgacctctataagcccctactttaactagaggaccacagttttgggtccccaagaatcaacgtcagctcagagccagtgtccagcagtccccaaaatgactgataatttccctttccccagtgcacagtgaccttggtaaaaggcccgaggcctccttggagaaggatggaagaaagattaacagcataaattggtgggtagtgtaatgggattcttcctcaaggggacctggcctccccttcattcaaggagttctgggtctgtaaactggctcaactctggaaattgactgaggggtcatgattctctgtttttataattcaaattagtcttttgtccattctacatagaagttttctgcttaaattaagtaggaatgcagtaggcttcctattaatttcacttctaggaacaccctgattaattagccaatgtcagagccttacatgagtcagactactctgatgctgctttgcctctgctgtccattatggtaactacacccaccttgcctttgatggttgagcgccaccacttggcccatgccaccttgggatccaattactcctattgtatttaaattttgtagttgagtgactgtggttcacactgtttgatctgacatacagagaagagcaattatagggctcttcaaagatgcaggtgctgccctcataaatctcttttgcaaagcactggtcaagggtatatcttcaggacccacccagcagggatgagtaggtctaaagtgactagtccactccaccatcccaaactccctaagcctttagatccctttctctgcattaaaccaagagagatccggcatttccagcaagctcagagttggctctcttttaatccatattttagctaaccagacaaataaattattataacctttttttaactcctgaagctgcaacattaaatgcagaatccctacttggtgggcccagatcaataaattcagcctgattgaactctatgtttcttccaccattatcccatacccataatatccattcccatgcctgttctccagatttctgcttatataaattaaaaaaacataacaaaacaaaataaactcgagcagttcttttcaagtgtagcacacttcctcatgggtcacactctgaacttacctctaggggcccacaaggactttagtctagttatagattcagaagcaaacaggagtgttggggctggctcctgaggagaatcaacattatttttcctggcaactgccttaggggaggccatcactgttgcttcaggcagtgcaaggtttctctcctcagacaaaagtggaaaggctgatggcagcatggattagagagaggaggtttccacgactaggaatggagaagccatttcttctgacaaaaaagtttcatcagagtttacaagctcagtgtccccagccttatcagggtcctcccacacatccccattccaagttgcagggtcccattcttttccaatcaatgccctcactttaacaggggacacctggcgaggctgtgattacacctgttgttgcaggtcagccactagcatgataagagtttgtgtctgattttccacaattttagctctttctctacaggagctaagactctcactcgggaaaatcttagcagatttgaggctcagtatctgcttctgaagccaggagttagaatccctgagttcagccgggcgcggtagctcacgcctgtaatcccaacactttgggaggccaaggcaggcagattacgaggtcaggagatcgagaccatcctggttgatacagtgaaaccccgtctctactaaaaatacaaaaaattagctgggcgtggtggcgggcgcctgtagtcccagctactcaggaggctgaggcaggagaacggcatgaacccaggaggtggagcttgcagagagccaagatcgcgccactgcactccagcctggctgagagagtgagactctgcctcaacaacaacaaaaaaaaaaaaaaaaaaaaaaaagaatccctgagttcatccttttctttcatcactttgtccagtaaacttaggagcaaccaaccaacttcatagtcaaaggtattatgtatagagtcactaaactctttgcctctcacaagtggtgaatcaggagtgtcaaatgcatttattttgcataactgtctaaataattcagagcaaggactatcattgttcaccatactattagaagtaaagtacttagcattttttgatctaatcatattaaacagccaactccagaaaccccaaaaccaatgaaagaactccatccttaatattcagttcctctagaaccactcctggcaccaaaatctgtattagtcagagttctctagagggacagaactaacaagagatatagatatagatatagacatatagatggagatatatatatatatatatatatatatatatatatatatatacacacacacatacatatatatacacacacacacacacatacacaaaactaataggatatatttaggagtttattaagtagtattaactcacacaatcatgaggtttcacaataggctgtctgcaagctgaggagcaaggaattcagtctgagtcccaaagctgaagaacttagagtccaatgttcaagggcaggaagcatccagcacaggagaaagatgtaggctgtaaggctaagccagtctagtcttttcacatttttctgcctgctttattttctgattagatggtgcccacccagattaagggtgggtctgcctttcctagcccactaactcaaatgttaatcacctttggaaacaccctcacagacacacccaggatcaatactttgcatctttcaatccaattaagttgacactcagtattaaccatcacagtatcatataacacagcaattccattcttaggtttctgctcaagagaaatgaaaacttatgttcacacacaaaaatatatgtaaatattaatagcagtattattcataatagtcaaaaattagagacaatccccatgaccgtcagctgatgaatgtataaagtgtagtatatgcagacaattgcacattattgagaaataaaaaataatgaaatatcaatatatgctagaccatgggcattaaaacgttaaactaagcaaaagtaaccagatacaatagatcacacattgcatgattacatctaaacaacatgtcagaatagacaaatttaaagacacagaaagcagactggtagttgcctaggactggtgactctggagtaaatgaggagtataggctttttttatggtgtgatacaaatattctaaaattgactgtggtgatggttgaacaactacgtgaatatatactaaaaacattaaattgtgtactttaaattggtagattttagggtaaatgaattatatcttaatatagctgctaataacaagcaagaattattccacagagatgatggagttagcacagcttccttgctgtccacactcagtagcaatctatttgttttcctggagctaatgagcttcttgtggcttacagacagggaccagagagaaacacagaaagtgtcaggtcatgggatgtcttaacacacaggtatcttcctaagggaaatgttaacataggtggatcctataggagtgagtctggtctttataaagcccaaaatcaagaaacagctaaatagaatggatatggaaagcattcctcctgttactgaagccacaaaagtataacgagcataaaaaacagacttgcttcaagtggtataggattagacaattaggttcgtacaatatgaagtgtggatccacacacataagaaaatttcacacacaaaaaagagagttgacagtacaactagttaggaaaaagcaaagtccttcatatatgatgctgtttggtgtttattcagacagaagaaattgaaattgatttcaaatttcattatatacacaaaaatacatgttatatagcttgaaggcttaagtgtaaaaaataaacagttaaaacattggaagattattttgtcaaatacacatataatccaggtcaagagatcagtttattcaagaaatattgaatctggtgatatgaagatatatttgactctatgaacttggataccttgcctatcttccttccttcttccttctttctcatctatctcagctgtctatctcctagaaccagtaaccaaatgtttatacatggtattaattttcacgtattaatattttattaatagaatcaatagcattgatagaattttctattttgttatgttctgttctcttatatactacttgatttcattaacaagagataatattaacaccaaaaattgattttgtgatccaaagtatggcttgaaaatctgctgtagagactttgaatgtttgcatctctttagtgtcataaatatatgtatgcttcctgacttcttccttcctgattttcttcttgaataagtaatttcataaaccattacaacgcttagtatgataaccgtttgctcctattgcgggtatgggctgtggtctggtagagagaatcagaaccccagagggggaggaacatgcagtagtatttgtggcagcaacgtgcacagcaggaagtattagagccttagtcaaatgagaaaggcatctgagagggtgggaggcaaatgtggccatgtttggaagatgaaatgttttggggagccaaatggactggcagtgaagggccagcaagaattgttaagagtctaatgagggtgagtagggcatgcccatgaagtgggggacagcagcagtgtaatttggggtgtcctagactgagtgatatcaggctatctgggctgggtggggtgttgtggaagtgatcaatgtaaagaatcagagcctgggtggggtttcagaaagtaaacggtgtcaaaaccttggaaaagggttgccacagcagcctggcatggggtcatcaaacccaagagaggaaaaggaggtcattcaagatgtctggaatgggaggtcagaacccaaagcaggtaagcagaatgtttaggactgggtcagaatgggaatgatgatttggtgtgatttcaaagcccaaagatggttacaagggcatttgtgtagactctcatatgtgttgagttagggaataatgagggtaatcatggtgtctgcatgggaagggtgtcagtaggacagcagtctacagtgggatgtcaaagcaagagtggagagagtggagcaagatggtcccccagtaatcatcccctgaaacaaacaactttcataacaagaaaatgtcaggtgagcactcacagtacctggctgtaaatacatatcactgaaagagtcactgatgaggataggaaagaaagtcttgaattgctgatgccacccctcccccatcccctggcagaagacacatggcaagaagagaggatctgtgcacttgagagagggagagtgcagcaattgtgaggctttgcattgaactcagcactgttctgtcacagcagaaagcaaaaccagaatgaattcagctgatgccggctcacagaaggagtatataaaccaatcctatccagaggagaataacccaaaccagcagttgaaacttaagttccagccagccttcccaccacaggctaaagggctctggggttctaggtaaacttgaaatgcagtctaggccacaaagactgcaactcctatgcaagtactagtgctgagctgggcttagacccactggactaggatggcatgtgacctacggtgacaatggctggagcagctaagggagtgcttgtgcaacccctccctcaaccccaggcagcacaactcacaggtcagggggatactctttacttctgctgaggagagaagagggaattgtaaagggaacattgtcttacatcttgaataccaggtaagccacagtaggataggacactagtcagtcatgaggctcccatttcaggttctacctcatggctgacatttctagacacatcctgggcaaaaatagaaacctctgccttgaagagaagaacccagtcctggtaggacccatcaactgacgcaacaaacaaacaaacaaacaaataaacaaaaaaccttggtccctgaataaccagcagtgatacccaggtagtacactgtggtgagatttatgagacttgctggcttcagatgagactcagtccagctgtggtggctatgggagagactccttctgcttgagaaaactcttgcatgctgttcgtataaatgtaaatcagtacaactactattggcaacagtatttgaaattcctcacaaaactataaatagaagcatcatatgatccagaaatctcacttctaggtataaacacagaaggatgaaaatcaaaatatggcagagctatctgcactccgtgtttattgcagcactattcacaatggccaatatttggaagcaaaataagctcaataaatggtcctgggaaaactggatatccatacactgaagaataaaactagacacttatctcccagtatataaaagaaaatcaaaggcatcaaactctgaatctgtcatggtaaattgtgtatgcatccacaatggagcattattcagccataaaaagtgacattctgtcattttcaaaaacatgattgatctggacatcatcaaattaagggaaataagaaaattaagggaaataagccaggcacagaaagacaaactttgcatgatctcatttattcatgtgagctgaaaaataaaactattgaattcatgaagatagagagtagagggatggttcccaaaggcagggaagcgtaatgcaggtttatgggggaagtggggatagttaatgggtacaaaacatagttaaaaagaatgaataagacttagtatttgttaggacaacaaagtgactacagtaaaaagcaatttaattgtatgtgttaaataacaaaaatagtataatcagtttttttgtaacataaaggatagatgcttgaggtgatggataccccattatcctgatgtgactattatgcactgcattcctgtatcaaaatatctcaatatcaccccaaaatatatgtacccacaaaaattaaaaatgaaagaaaatttaaaaatacaagtacaagtggaatgaagaaggcaatagtttggggtatggtatttgtggcatgtagtgtgaagtgttggactttgaacttggtaataagtttgtctgcgtggttgtcggtggggtgagggctgcatctgtgctgcgccagtggcagccaggcgtgtggtgtcaaagcatgagtggagtgaggagaccatttgtatggggtcataggcaggagattggtttaacccagtgacatttacttagtacataaatacaatgaaggtaagaagcaggtttcctatcagagaatagagacaaaagtgtggaaagattaaaaaaaaaaaaaaaactagagtaaatggtatgggatcagattggaattgaagttttagtgtgaactcataggtatatatataagtaaacaaaggaaaaataagtataaacaggtctttttagcctgctatttggggcattacactgtgaatttttcatctttactcatgaagacagcttctgattccaaatcactcagcacacagtggttaaattaggacaactgtagcagcaatcaagttttgctgtgctttctaaccatttatttatcaaaatccgaatgaactacctttattttggaggagggaggtaaggaatggctcagtccacttctattgctagataattgtgtctttgtgtctgaaatttatgttttttaacctggagctttctttaaaaaaagctttgttcttatgtgtgggtgagacaagtgtatgactgggaaaatcagagacgaagatgacattttttcccttattttcttttaaaaactggttttggatttaatgaatctatggtttttaaaaaagtatttgaaaccacgagacatataattgaatttttcagttttcttaataactcttccaatgtaaatattctttacttttcaatttaaaatacattgttttcttagctccaaatcaactaattcttggtagttaagtatagaaacaccatagggactttgcaggatcagttgagtctcccattgttctcactagacaactgatacttattagcagtttattgagtatacttcactaacatggtttttgttcctttctatttatcaaaatctcagaaaaattacagcctttatatacttacactttaatcaacaatagctgacagcatgtgaagcaataaatagcttcaagacatgcaataaactctgaggtttatttacaaaacaacacagtgagaatcatttattgccaagttactaaaggtaatagtgattactgctattaaaataccagaagctattaaatagttgcccaagcaaatagtctacattcaaacccagaattcaaattagtcttttttcatttaactttagaaaaacagaatagtttaactctgttcaattagaaaggaaaaaaaaaataaccaagaaacaacaaaaattctccaattcaaacaggtttagaaattgtaagcttttctttgggtcatacaatgggcttttggcctgaagcaaatggaagttttcactttctactatagtcataaacttttgctgataggtcatttataagaaggaatgaataaaagtaggtctctaccatttccataaagatagactaacagagaacatgcagtatcagttgattatcacttaggaaactggaaagagtgtttcttggctttaaaagagacatgatagaaatctaaaagcacagcagataatagggaataaaggtctatttgaagtgtctcttccccagaactccaaaatacacctttattatgacatataattccctagtgattgcctataaaattctattaaagataaagatcttggccaggcgtggtggctcacgcctgtagtcccagcagtttgggaggccaaggcaggtagatcacttgaggtcaggagttcaagaccatcctgcccaacatagtgaaaccccatctctaccaaaaatacaaaaaaaaaaaaaaacaaaacttagcttagcgtggtggtgggcgcctgtaatcccagctactcgggaggctgaagcaggagaatcacttgaacccaggaggtggaggttgcagtgagtcgagatcatggctactgcactccactgagtgacagagtgagactctgtctcaaaataaataaataaataaataaaataaagatcttctattctacctcattcctctggcgaccatattcctctaagtcggggttcctcagtttggtaccaatgacatttttgaactggaaaattctttgttggagaggggatttcctgtgcatttagggtgttcagtagcatctctgacctctatcccttagttgtcagtatgatctagtccccagtcatgataaacaaaaatgtctgcagatattgccagttgtctccaggtggggggtgggggcaaaattgtatctgacagagatccattgcttttatcaatctcaaaatgcattatctgtcatagagtccaattaaaacaacacatagtttttgaaattgagactatctcataaaagctgagacatatgcttcctgaagtcagagttattgtaaccaaccacttgttactcatctcaaaacacattcactgatttctacagtcctcccctgctctgaggatttggttttcaggcaggtggagacataaatactatttaatttctaatgcatcatttcccatgtctctcaaaatgttcccaatagaggtcacacatttttacatataagaaaaaaattcagagtgaaaatccacacaattttaaataataatatatttaaagctaatctaaactcacaataatcttggggatatgaaacctggggtaacagttcattacagttcaagaagtctcatggatgtttgaaacttcaaaggagagcactattgctgattagttacgtagactgaagttttcagtctcttgagaaaagtttggtatttcaaatctgaaaatgatttaagcttactggggaatgaaataaactgcaaaacctttctagcactctaaatcctgatatcacagagattacatctgatattagcatattttgtggtgcctaaagcagttttaggagctgacaattgccagggaaaaagagaatttccgggaagtttggtcctaggaactggacatgtgtaggcatttctccaaattcaaattcaaatatgtataacaataacaataggcatttgtataatagtgtacatataaaacaaatttatagttgaggggatatattttattatatttgtagtacagaggcagatactatattaccgaagatgttttgtttactccagataaacaataactaattcagcacgtttaagcattcatcttgactctcctcactttccaactctacatcattctctgaggcagcaaaacatgtacactcagtggcctcactacagcagtctctccatcttagaacagtgtgaatgtgctctgggcaatatctgtagtgtgaagaaatgtggcttgagtttgttaatttgtaccgtgtcctcatatgcacactttctcaaagggagagtcccagagtccccataacagtcttttaaataaatcttgttctttatactgtgttctgcacttctctaccggtccttctcccaacacagacacacacacacacacacacgcacatcttaatttagaaagaatagcaatcattatttgtaaagacaactgttgggacagcaacaattctctggagaaaagtctaaaacatatcttcttaaaatgtattcctttactattaattatatttgtattagtttttttcacactgctattaaagaccccaaactgtgtaatttataaagaaaaaaaggcctccacatggctatggaggcctcacaatcatggtggaaggcagaggaggagaaaggcatgtcttacacagtggcaggcaagagagagagcatgtgcaggggaatttccctttataaaaccatcagatcttgtgagatttattcactatcatgagaatggcataggaaaatctcgcccacatgattccattacctgccacctggtccctcccacaacacgtggggattattacaattcaaggtgagatttgggtggggacacaaaaccaaaccatatcaatattctgtctgctttttaaatatttttttattttttgaatttctatagtgtatttattatacttcatcacttgggtttctttttattttagaaaaccctgaatccgccatttcctagatgtcatctcaaggctacataacactaagtcctcattacagagttagtaaaaaacaagatggttatcataactgtcttcattacagaggctgcttgaaaatgaagtctacacagagctaaccaataagaagacagtagaaagcaacacaccaaggcaccatttgaaacctcagttgcagcctttcttaaaatcagatccacatgatagtcaacaattttttattgattacatagtatattccaggcactgttgtagttactagggatataatagcaaataaaacaaactctcggtgattatggacctaatataatacttggcatgacaatataacacaaaataagcacaagtgcatataggattacagcaaagaggataaagttaacagaaagcacagcatgttggaatattattattttttataaggtgggtaggtaagaccacttcactccaaggaaatgtaagcaaagtctgcaggaagggaaaaactaagtcatgagaatatctgaacaaggagcctttcaggtagtggaaatagcaagtgaacggttccagaggtaggaatcactcagtgttccaggaggtcagtaaggctagagtggaatcagtgaaaggatgagaagtaggagatgaggtcaggtagctatcagtacaacatttgtttttatcttaggtaatctgagaagccatgtcaggaatttaacaaaaatgtgaagtcattttaggtaatttttttaaaaagtattattctgttgcctgcaactgaccacaaaagggcagggcggtgggctggagcagtccagtagggaagctattgcaataatctaagtaggaggtaggtgatggtggctaggattagggtgaaagcagtgggaatggtgagaaattgtagaatcatgtaaatatctttggaccaaccaaatttattgattcattggtgacaagggggcctgtggataaagagaaaggtcagggttcacttaaagggttttggcccaagaatttggaaggataaagttgccatttactgggtagggaaaatgcagaaggaccacctgttttcattaagataatggaaagtaagtgtcaagcattgagcatgggaaatactaattttgagatgctctgataaaaaacaccatgatatgcttcacacatcctccttcaaggaatgacgggattattcccttatacattagaaatgttgcacactgaaaggcttcagctatcagtcctattcagagaatgcctcatctgaggaaagcccaaggtcaagcagctttctgaggcaacctgcgtctaatgaatattgatgcagacatataaacagcctatctccttgtcacagccttacaaccctgaaggaccatatcacatccataattttccctgtaggcagctgaaagctttacttggactgcactgaagtttaacttctccatacatacaatactgctttcttcccctcccttcaataggagttgataccccaaacactccctaataaagatcctgtaattgaatcttaatttcaaagtctgcttcccagaaaacccaacctacaaaagatgtttctttagtaaccaaagggaaatactgttgttacagattgacatggatctatagttttgagacagagagctaaactagacatttgaattagaagttatgagcatataccacttaaactcattagatctgttgaaataatctttggagtgaatggaaataggaaaagaagaggttaaagttgaaagaagggtgtttcaatttttaaaagtcagggaagttaaggggaagaagtatcaaagaaaacaaaaatagagcagcctgggagtatggaaaaagtcccaggagattggggtacactgtaggtcaactaattaaatttttaaataaagaagaaactatcaattctgtcacatcatgaggatgggttgagtaagatgagaaattaagttgtcaatggaatgggcactgaaaatgcaaaaaaaaaaaaaaaaagccatttgagtggattaatgtgactgaaatcctggttacaatggagtcaacagataatcctggaaaggagaataaccacaactttcttcaggccagtataaacaatatatttgagaagtttccacagtgaagggaagcacagaaatggataaattgctagaaggtttacgggaccaagagaaattttgttgttgttgctttgtgttcaattgcaagatataatggcagtattgcatgctgatggaaatgatcaggtagagcaatggatgcttatgatgtaagaagcacatagggaaattatgaagcaacatccttcagagtagacatacatggaatcagtagaattcaatcagatcagagtcagagtaaagagcccacaattagaaggtgtgtgttttagatttgcattgggccttgccaattacatttccagtcctaagtgctagtgaggtccaataaccagtgtcattctgcaaagtgattatggatcatgatgagacattaaatactgagttgtgtttagaaaattttaaagtgatttgacagtaattttatatatgttgaatctaacagttaaaatggctttcattttacatcttttgtatttcatttttctagtaattcatttaaatgcaccctttataacagaaactttaagaagcactgatctagcatgcaagtgaaagaaatggtttatacagaaatgaggagtgcttatttttaattactgaagtacaagtatcacaggagctttggtgttgcttcgccagctggaaacttctgcggccaatggcaccttctacctgaggattgcctgtgactgctgggcttgttccacctatgcagcctgacaagctgtgctcggtttgtgctactggcccagatcccacatctgccaagtgtgagccaaaagcagagtggcaaaggggtgtgaaggtgagtgaatgtggggtccagtcactgagcacagccaggcacactggctgctacaagagggcaggcagctccaggtgccagtataggaggaaggtccatgtaagcctgtggttggaccagatgcaggcacctgcatctggatgaggggaatatggtggcttgtggaagcttggagatgccaggaactgcagaaccccaaggagggtgtcacagccctggtttggggagcccttagatctgggttccataaagggccacagctcttctctccttcctgttgtctgcattgtggtgtcggggatggggtgcctgtttccgtcctgtttgtgttacagctcttcttttagtcctgcccaaccagcaggtcctgagtttttttcctacatctaggaagaatgaggtacatagacaaatggagggtgagcaaggcagagaggagtttcactgagtggcagaacagttctcaggagacccaaagtgtgtagctcctttcctcaggcaggtagtcccaggtccagcttgtcagtggagaggagatccacagtgggtggctcccttctgcaggaaggtcatctcattgtctgtgaagccctcgtggagaggagacccagggtgggtagctcctatctgcaggcaagttgttatgtcatttgctggagtctggctgagtctgggggttttaatgggcctcataggggaggaagtacatgctgattggtccatgggcagccaggggcaggcccaaaagcagcaccctaaattctcattctgatctgccgaactgacagctgggcccccaggctattactataaagctaccaatgtcattattcatagaactagaaaatactattccaaacttaagtggcagtgaaaaagagcccaaatagtcaaagcaatcttaagccaaagaacaaagctgaagccatcacactacctgcattcaaattatactacaagtctacagtaaccaaaacaacatgctactggtagaaaaacaaacccatatactaatggaatatattggagaacacataaataaagccacacatctgcagccatctgatcattgacaaagtacacaaaaataggcaatgaggaaaaactccctattaaatcagctggctagccatacatagaagaatgaaactggattcctagttttcatcatataaaaaaaagtaacccggctgggtgtggtggctcacgcctgtaatcccagcactttgagaggccaaggagggcggatcacgaggtcaggagatggagaccgtcctggctaacacagtgaaaccccgtctctactaaaaatacaaaaaattagccaggcgtggtggcaggtgcctgtagttccagctacttgggaggctgagtcaggagaatggcatgaacccaggaggcagaactggcagtgagtcgagattgtgccactgcactctagcctgggcaacagagtgagactctgtgtcaaaaataaataaataaataaatattaaaaaaaataaattaacccaagatacattaaatacttaaactaaaaactaaaactataattcctagaagaaaacctaggaaagttttatttttatttttttttgtcaaaatgatgaattagagactttggtgcgcctcagccacttgaaaatagcaaaataaatcataaaaatgaactctgtgaactttaagaagaaaaacgggaatccaatggaattatgaagaataccccagatcctggagaggaaaacaccagcaaacagctcccacgatggtgtccagttgataaaaagaaagaaagaacaaagaaaatatcccacctgcatgaaaaagttacagaaattaaaaatcctagtgtctccagataagaaaacatcagtgcaagaattctggcatcatgaaaatctgaatgtagtgataccaccaaaggattccactagattttaagcaatggtccctaaccaaaatggaaactcagaaatgacagataaataatataaaacatggattgcaaaaaaattcaataagatccaaaacaaacttgaaaattaacacacaaaaaaattctaaagcaattcaggaattaaagaaaaagataaacgtcttaaaaagtaatcaattacagcttctggaatcaaaaaaactcttgaaaaatgttaaaatatatcaaaagctttattaatagactggatctatcagataaaagaatttaagagcttgaagataagccttctgaagtaacccagtcagacaaaaataaagaaaaaagaattttttaaaatgtacaatgtcttcaagaaataaaggattatgtaaaacaatcaaacctattaattattggcatttctgagagagaaagagaaaaagaaaacaacctggaaattacatttgagggaaaaattcaagaaaatttccctgatcttgccagaaaggtagacatccagaaacaagaaatcaagagaacatctgtgagatactatataaaatgacttcactagggcatacagccacgtgactgtccaacatcaatacttaagaaaatttttttttttagcagtaagctcaaaatagcgaatttcattgtttttttaaattattattattatactttaagttctgggatacatgtgcagaacatgcaggtttgttacataggtatacatgtgccatggtggtttgctgcactcatccacccgcgatctacattaggtatatctcctaatgttatccctcccctagctccccactccctgacaggccctggtgtgtgatgttcccctccctgtgtccatgtgttatcattgttcaactcctacttaaaggcagatagagaaaaaggaaagatcacctacaaaggtaaccccatcaggctgaagcagacttctgatcagaagacttacaagccaggggagcctggggatctattttcagcatgcttaaagaaagcaaattccaaccaagaatttcatattccatcaaattaagcatcttaagcaaatgagaagtaaaatattttcctgacaagcacgtactaagaatatttgttaccactagaaagccttcaaagaaatcctaaagtagttctaaacatgggaaccaagaaccatatctgctaccacaaaaacatacttaagtacatagcccacagaccctataaagcaacaacaaaatagaaactacaaagttaccagctaacaacttaatgatagaatcaaaatttcacatatcaatattaacctggtacataaatggcctaaatgccacccttaaaaggcacagagtggcaagttggattaaaaacaaaacaaaaccaagatccatatggctgctgtctccaagagacccaccttatatgtaatgatacatgaagtaaagtaatgatgctcaaagtaaagagatggagtaagatctactatgcaaacagaaaaggaaaagaacagggattactattctcatatcagataaaacagagattaaactaacaacactaaaaacaaaaaagaagaaagaaagaaaggaactacataatgataaagggttcaattcaaaaagaagatttaactatctagaacataaacacaccccacattgtagagtctagattcacaaaaccagtactctagacctatacaaagacttagccacacaataacagtgagggagatcaagaccccactgacagcattaaacagattgtcaaggcagaaaactaacaaagaaattctggacttaaactcaacacttgagcaactggatccaatatgcatctacagaatactccacccatgcaccacagaatatacattcttctcaactgcacagggaatatactccaagatttaccacacgctgagtcataaagcaagtctcagcaaatgaaaaaaaaaaaagaaatcacagcacccatattcttggaccccagtggaatgaaaatagaaagcaataccaataatatttctcaaaaccccatgattacatggaaattaaacagcttgctcctgagtgacttttaagtaaacaacaatatcaagccagaaacataaaaaattatttgaaataaatcaaaacagaaacacaacataaaaaatctctgggatgttgcaaaatcagtgttaagaagaacatttatagtgataaatgcctacctcaaaaagttagaaagatctcaaattaatgatctaacattatactagaggaagtagataaacaagaacaaactaatcccaaagctagaaggaaaataagacaactctaattagagttgaaccaaatgaaattgagacccaaaattccacacaaaggataaatgaaaccatagtttcatagttggttctttgacaggataaacaagatcaatagactgttagttagattaataaagagaagaaaagaaaaattcaagtaggcacaatcagaaatgacaaaagtggtgtaatgtcacagccgatcacacagaaatacaaaactccctcatagacaactatgaacatttctatgcacacatactagaaaatctagaggaaatggaaaaattcctggaaacacacaacctctcaagattgaatcgggaagaaattgaaacactgatgaaaccaatattgagttcaaaaagtgaatcagtaataagaaacctaacaaccaaaaaacagtaataataagccccagtccagatagattaacagctgagttctaccagaggtccaaagaagagctgatagtaattctattaaaactattccaaaaaatcaaggaggggtgattcctaactgattctatgaagccagcatcacctaatatctaaaccgggcaaagacacatacacacacacacacacacacacacacacacagagacagacacacacacacacacaatgaaactactggcccatgcctctgaagaacacagacacaaaaattctcaacaaaatacttacacgtcaaattcaacaacacatcaaatatttaatttacgatgatcaggtagggttaattcctgagattcaaggttgtttcatcatatttcaacatatacaaatcagtaaatgtgatccgatcacatgaacacaatttaaactaaaaccatatgatcacctcgagagacgcggaaaaagctttcaacataattcaacatcccttcatggtaaaatccctcaagaaactaggcatcagaggtacatatctcaaaataataaaagctatctacaacaaacccatagccagcatcatattgaatgatcagaactgcaagcattcctcttggaagtggatcaagacagagagatcttgtctcaccactcctattcaggacaacactggaagtgctagccagatgttaaactttttttttcatatatttgctggaggcaagaggaagaaacaaaagcatccaaatagcaaaaaaaaaagaaaaaaaaatcagactatctgccttcactggtgatatgattttatacctagaaaaccctaaagactctctcaataagttattagaactgatcaacaattttagcaaggtactaggatacaatcaatgaacaaaaatctgtaggagttctatacaccaataactaagagccaaatcaagaacacaattcaatttacaacagccacaaaagaagtaaaatacctaggcataaatctaaccaaggaggtaaaagatctctgcaggaagaactacaaaacactgctaaaaaaaaaaaaaagggaacccttgacaaaaataagcactgtggaaaggactccctattcaataaatggagcttggatagctggtgagctatatgcagaagaatgaaactggatacctaccttttactacatacaaaaattaactcaagatggcttaaatattttaatgtaagaactaaaactataagaatcctagaagaaaacctaggaaacactattctggacatcacctttggcaaaggatttatgattaagtcctcgaaagcaattgcaacaaaaatgatcattgataagttggacctaattaaactaaagagcttctgcacagcaaaagaaaccatcgacagagtgaacagataacctacagaacaggagagaatattcccaaaatacgcatccaacaaatgtcttatattcacaatctacaagtagcttaaagaattaaacaagcaaaaacaaaaaattccatcaaaaaatgagtaaaagacattaataggcacttctcaacagaaagggatacaagtagccaagaaatatatgaaaaaaatgcttaatatcactaatcatcagagaaatgcaagtcaaaaccactatgagatacctactcacaccagtcagggtggctattatttaaaagtaaaacaacaacagatgatgggaggctgcagagaaaatagaatacttatatactcttggtgggaatgtagattagttcagccacagtggaaatcagtttggagatttctcaaagaactaaaaatagaactaccatctgacccagcaatgccacccaaaagaaaataaattgactgaaaagacacaggcacttgtatgctcacagcagtactcttcatgatagcaaggacatggaatcaacctaggtgcccatcggtggtggagcatataaagaaaatgtggcacatatacactacggaatactacatagccctaaaaaaggaaattgtgtccttcttagcaacctggatacagctggaggccatcatcctaattgaattaacacagaaatagaacaacaaatattacatattctcacttataagtgagaactaaatggtgcatacatgtagacataaacttgggaacaaaagacactggggagtactagagggggctggctgagagggagcgtagcaaggctggaaaaaccaactgttgggtgctgtgctaactaccttggtgacaggattaattgtaccccaaacatcagcatcatgtgacatacccatataataaacgtgtacatgtaccctttgaatctaaataaaaacggaaaaataaagaatggcaaaattaaaagaaaaacaaacaatacattttgctaaatgaaataagtcagacacaaaaggacacatgctatatgattccacttatataaggtagctataacagtcaaattaatagagacagaaagttacatggtgggtgccaggagctgtgggctggtgtttggggagttagtgtttactgagtacggagtttcagtttgggaggatgagaaagttctggaaacagacggtgatgatgttgcacaaaaatgtgaatgtacttaatgccaaagatggttataatggtaagtatcgtgttccatatttttattacaactacaataataaaagatatgtaggaatttgccagatgaacaagatgaaaaagggcattgccatgaaataaacataatgaatctgaaaaaaataaaagcatctttgattgcaaaagagcaaattgcaaatatccaaagtaatccttgtaatacacgtgacattataaattttacgatgcagtgcctatgattcacgcacactgtacctgaaccagctgtgaaacattcatgaatcataaactcctgtatcatcttcagagcaaaaatgcatcctattttacaagaaatattcatcaaaaaagggaaagagaagtaaaaaccctgaaatttctagaacctttcaaagatatcagaaaaacaaatcaatacctctgacaggacctgttaattcagagggtcatgctgtaagacagcttgcatttaattcaaactgttttggaacaagatcaattctgtagtgagatcaaggcagcagaaatttttcctcagggctaaaaataataattccttgaggcccagacattaaattccatggcttcttgaaactattcaaaaatgagaagaatggataaagattaaaagaaaacacatgctgcaagctgacaaaacacctttttagacttacacccaattcgttcattagtcaaatgtgtggttttttttttcccttcaggtaactggaggtgtcaacattcaacttcttggtctgtttctcgtcattttctattttctcctgctatttgtctctgagctgttatacctgttattgcagtttccaacaagaaaaagccaggaaaaggaaagagaatcaaagcatcagagcgagtcacctcactgggaggtggaaccagaagttttaaagcagtagcaaaatttgtatgttctgggtgtcagtggacactttctgtataataattttattttacttttgttaagaatcatgaagcaaccacaaaaaattaaatcaaggcttatcaagtagatgtttgaaagagaaacaatgattcaccttataggtagatgtactttgctattgaagggattgtgggcaagtctaagcaaagctgaagggaataaggaaatttcattccttagagaagacagcatagaataatagtacagagagtgtagggtagaacagcttgcattctaatcccacatctgcaacaggattctctttgacataggaaaagttacttctgctttgttgggagtattaaaaatggagaagttttcaagtgcttagtgtagttcctggcttatgatagcatcaattaaaattaggtattgatgctattattattaatattgatctcttagccatctatatcttcagcatccaaagtgtcagtttgttctttaaattgcaattgacccttttttctcaatagaatagctagtaaaataataaagtggaatttcttggaatgtatccattctcctcttttacatttcatttttttattcattatttcaaatgcccagtaccttcttgttcaccctaaaatcttttatgagtttatgagttaacaggaaaacagattccttttagaaaattggaataaaaagaattaccattttttttttttttttgagaccgaatctcgctctgtggcccaggctggtgtgcagtggcatgatctcagctcactgcaagctccgcctcccaggtgcaactgattctcctgcctttgcctcccaagtatctgggattacaagcatgcaccaacacacccaggtaatttttgtatttttagtagagacagggattcaccatattggccagatgggtctgaaactcctgacctaaggtaatccaacccctcagcctctcaaacacttttttctacatttcaaactctttgcaatttacctgctatctcatttaatctcctcttccctacactgaagacaatcaacctccctcctattaaccaaccacttatcctgcctccttatgtaccttaaatacgaaagataagatagtccccattattttaataaatatttattgaatatattcttgacaagtaatcctgcttgtatttttagctagctaatgtgagatacatctttgacatggttaaatgtatgatcccttaattaatttaatataataaactaatgctacattataggggtataaacacttttaaaaatatattttctattttaaagttggctttatacttaacataaatataatggacactttgtttatttttgaatgattatcaatcattcaaaggtcagtacatctgacctttcacaaaaaaagtaaaaggtcaaatgtaaaaattgtaggttttgtggttcacatatagactctgcatattattctttaatttttgtttttggttccatatttttgtttgtttatatgtttcttacaaaccttttaaaatacaaaaaatattctatcttacttgtctctcaaaacataggccatttaacccaggaactgtatttggtcaatctgtgcttcactgtaaatgttctttgttattttaaaagcaatacggacatatttcaagtaaattattgttttcactaccactcattttcagatgtaagtccacaggttaacataaataagaaagtagcagccaaaaacaaaaaaaagagagaacagtaagaaaaacattttaagtcaaaggaaaattgccagcttttatcttctcctaaatcccaatccttcactcctaaaggaacacattaagtgcaaagggggtcatacttttattccattgcaaaaagggtcatacttttattccattccccatgtatacatttgttatccatttggcaaattgtggttgaatttctcttgggatgacctcgccagcagtaggtgaatggatcatttgattcaacactagttcgtaagtgattgttcttttcaatcaggcacacactcactgctgataactgcatattttgactatttgtagaagtgttaaaggaactaagaattttatcgtaaataagccatgttggaacaaatatcaaggccttgagaataatatactttatacctttgctcaacatataatgtaggaaaatatccaattaagagtctagaaatggagtgaggaagggccagctgagtattttgtttaatttttaattgttaactcttatagtaccttcataaagtttccaaatcttttcctttttcttgcttttgctgtaaatacaaaagtccaagcctgcattatattatactcagtttgaataaggaatatcagctccttaagaataaaatgaaacagttttattcttcccaagatcttttcaggcttttatattgatcatcttcatttctgctgtgtagctggcttcatcaatgatgtctcaatttatgtctataattgttattttgcaaaactgtctcattttaattaatatgatgccttactcattatttttaaattattttcttcattattttaaaactaattttatttctaaggactgggaacagggtgggtggatgtgataatctcacacatgttcttgtcttttttccttttattttccctctggtgctgggatagagaggatgaagaaagaaaaatgtattcgttagatgaattatctgtattgaggttgttctaggattactgtgctagaggaaggacccccaataaattccaccattaagaggctcaatatcaagcaacaatcctgtgatctagtggcactgtatggaattctaacgtatcttttagctaatgtccaggtggtagtctgtgttacatcttgatatgcatacctctcttcttcacatgcttcagtatcctttattttatttataattagaagcacaaactctgagatttacggatccaggcaggactgatctcacctacaatactgggcaagatcttcaaggggacagttgatgctttcttgccaactgcccactccaccaccacatttctctccaatgttctctcccttgttttagttgtactgactcaaatctaagcagctatttgattagagtattgaatggtgatcttccctgttttgtgtgaatttctttgggattttcttctctcaatccttgccagactttttttgtaataacactggactagcaacaatttcaacctcacctatttataaaataatgttatctagtactatttgagacctctcttacttggattttttggagtattgtactcagaatcaggaactttttgagataaaatctgagaaatgaataacttttgctcaattgtgctttattcaggttcttatctgtattctattctataatctccaagtgaggaaaatagtcaattcatatttctctaaagtgtttcttcataagagccttaaaataaattgtatatattttaaacattagtacatttaccccaatataacatcacaaaattaacctttggaaaatacagaactaatgtaatacaaaacattcccatccctccaaaaacagataaaataaaatataatagttctctacagcctaatctaaaagaatgtgatgtaatggatagagcactgatttattaatcaaagggagaaaaactaatgtggctcataaacctttccatttctgagtctcattcttttcattttcccgataataatgataataagatcgacctgtttgttagggtcaggttaatgaccaagtgaaatgatgcgttatacatatgtcaaagaaatatagcctcttaaaagaaagttaacgcagctgacattcagtaacatatctcggtttgtaagtaaaaaattagaaataaactcaaataaacgatcaatacatattatagtaaaaagtaataatttgaattaagataacttgttgaacactgatttatcaaactctattgaactaacccattttttaaatttatacttttgtttgtttgttattagaaaaacatttccctagatagaagctgctccactattctgaagggaagtagaaacgatgaaaagcagaactggagatgatccatgatggacatatagtgtgagtaagaaatatatattatttgttttaaatcactgagattttgagtttgtgtatgtgtccataatatgagctaactatccttaatgataccataagtaaagaatttaaagtaaataagatgtgcctgaccgcatattaagtgccacactaagtgttaattatagctccctggcggtaaacaggggactggttccagacttctgagtatataaaaaatccacacatactgaagtcccacagtgggtcttatggaaccctttgtatacaaaaggttggctctccaaataggcaggatttatattatatctctcaaaaaatctgcatataaatggatctgtgcatttcaaacttgggttgtgcaagggtcaactgtgttactattttatgggatgagacggcagagatgatacatggaaattttgtgtttaaaaaaggagaaatatgcaaatggtggtggggtgggccaaatggaatgtgagttacatgaaagggtaatttggaaggaaacaacgcttttgtgaagaaaagaaatacttgaatatttgagtataaaacatagttttatttagtacccttgcctcatctttagtatgataaaaatagataaaaaattcagacagacaaagagggaggaagctgcttgagtgaacatactctgttgatgtaaatactcgaggaaattagctctatattgggtggtgtgctgatgaatgcttaacaaaaaaactttgaagtgaaaggcactgatttgttgtatttgatgatttctgtggcataaatatgcccaccatagcaatgtttagctggtaacatgacatagctgcacagagtcaggaagagatgcacatgactggctctcacgatttcggcgcggtctggctccagcatttgactgtgacaagtttcactggccggtgagaacgctggaggaaaaaaatctacctataactgacccttattagcataacaggtttgagaaagcagagccctattttcctcaagtgaatgccatcaatacagccgtcaggcaaaactgcattcatgcactgaggaaaatcactgcttctcaaacaacttttggataccataaaaggcccgttcttaaaaggggaagtgggaggaggggaaacaagaattgttgcctgaaaagaaacgactttgatctccatcaaaacagattagtttgaagccaatttgctgctatcttcaaaactatatttcccctcaaattctgtcttccaaattgagcagtgcgtcagctgtaggtagtgctagagtgtgaaaaggatgaggatggaggcagccagggtacctccaatgcatcttgttattagaagacttttgaagagtaatttgacgggagcttttcaacttttaggtcactagtttaaatgtagtctcagttgatcatgaacaaaagtgggtggttagtggcctatgaaaagtaccttcatggtattacccttgttctttctaatagagactgccactacagttggcatcctttcttttccttctaccagaagcacaaagggtgaatagaaatgtcatttcaagtattttttcagcctttgtaccagagaaatttgaaatatgaaaaaggccaacttcttttcatctttaactcacaggtagaattattgaactataatatgtttcctagatcttcctggattttattaaaatgaaacctgagccactttacaagtaaaattatgtcttacttcatagaaagttaaattacataaaggcacatacttgacaaatatttaaatataaaatgtataatttcttgacctgaatcttacacatgtaaaatttattttgttttccttttctttctcttatttttttcttgcttcaataaatgagttcccatgaatgtaaagacaaagatcttattactccattaaatgaactatcttaatatttgattttttctattctttatcattacaatactttgacttttttttcctcctaaagagactgtaggttttattccctttcttttaattatttcatgaaaatcctccaaatttccatattactaatatctctaccttcatataattttgtttcaatattaaatgatcaattaaagcaaactttctctaagtacctggagaaaagcaacagaataaatattagagtagagacacaaagtagtacttggtaatgccaagaaaatttcagcagctatcagtaatcagtaggatataacagaaatagccctgttttagaagtgatgaaaactcaatcaactgattttaagcagcagttactttctatggggttagctttccacatctcaaaaataagattgatgtgttatttttgcatcattttcaatacaaacattctatgaaatcttcacttttatatcatccgaatttaagtgacagggtgttaatattcgaatgggatttaagcgagatgtagctgtgccttatgtcacgtcagctgatggtaaagattgatgctgggattttcctgggttagtcatgttaaaatctcccctaggctttaaggccagcttcatgaattctcatatcagcaacttctgcaattaccacataacaccagaagataaactctgttctctgaacattcatatagaaaatagtacgtcatcttatgattcttatgattggcatagcaaagtgaaaatatatcaacaccgtatttagcccaacttgaagctgcatattcagtcaaagatagagcttttcctggccaaagatactttggtcagaaatatataaacagtgaacaccaagctatcatcttgcaagtaacacatatgctcatgaatctctagctacaaataaaaatatcagctaaaactacccccttcttctaaaggaataaaaaccacagcaattacaagatttgcctatggccataaaatgaagtggggtttgtctcagaattagaatgcctaccatcagcctttgagtacaaagttaattcccctacacaagactgcatcaaaaataaatccagctggacaaaaggcatacaagacagaaaataatagtcagctgcagactctttggatccaaagtataaaatattcaagtatgtgtttccaatcccttcattctctcctgtaatgattgcagctaatccctgcctgccaaacgttagttcttcaattgtggcgatcaatagaatagattagctgtggaaaccctccatccatattacccttgctttcctttccagatggaattttcattcactagagtggaggcaagcatgtgaggtttctccctccatacacaaatataaactcattaaatgccaagcttgtcactttagaatttatacacacacacacacacacacaccaaggaacatacctgtagatttaataaaacagcaccaaccctcatggcttcactaatttcaaggctatacatcagctgtgggaagcgaggagggctttgattatttggtggaagcacttcaatatacacagtgcagatggagttcctgcagagaaagagaggaaaagaagatggttacgaatctgcatcacatttaatgttagactgcattgtttattcagttgttgggtttacaggagaaaaaatttccaaattttatgaaaaataatacaatcaaaatgaaaggatagaaaaaactaccaccaaagtataatggttttatgaaattatcttagtaaaagtaattgactccagtatctgtttttcctacttagattaatagtatgaattaaaatggaatagctatacaaataaagctaataaattaacttgccttgacttctgactttgtttttaatgcttctctaatagcaaaatcattctataaacatctggtaataaaagctgtccttggggcttttttgctgttaaaccagcagagggagtattgattacaataactcacaaaacaaattatgggctgcgttttatcagttctgttgctgacatcaatggcttaatgtaagtgcatgtgaggagtcaggatcataaagaatcctacgtaaaatagttgcaaacaaaactaaatacgttttaaaatcttctctaaaaagcaatatatgataagctaggaattagatttaataaagcccttataatgacaggagcttttcttgaaggacaagataccttatcattacaaggaaaaaaaattagcattgacatagtcaacttctttgatatctctgaactttgaatttgttttataaaacaaaaactgaagaagcatgttagtcaaggtttgtaaggtggaaacattagctgaaatatatcaatgagatctgaaaatacataaggttagccctctatcgtgaaaaaacatatatatgtatacatacacacacacacacacacatatatacacatatatacacacacatatacacacacacatacatataacattttgtacaaacataccaccactgcctaagatgtatgctttgaatttaacaaagtcatgatttagttcaaaacacatttgttataatttctatttggggatgagaatctttatttatttatttatttatttatttgagacggagagttgctctccagcccaggctggagtgcagtggcatgatctttgctcattgcaacccccacctcccgggttcaagtgattctcctgcctcagcctcccaagtagctgggattacaggcctgtgtcaaaatatctggctaatttttgtattttcagtggagatgggttgtgccatgttggccaggctggtctcgaactcctgacctcaggtgatccaccctcctcaacctcccaaagtgctgggataacaggtatgagcaccacacctggcctagaatctccttaaagtagtcccaaactctttataagatgcttcaattaaaagacatggtcaccaaaaatatttgtctgagtttattaactacaacattctacttttcaaaaccttttgaaagaaattcaggctgggcacggtggctcacacctgtaatcccagcactttgggaggccgaggcaggtggatcatgcggtcaggagatcgagaccatcctggctaacatggtgaaagccggtctctactaaaaatacaaaaaattagcttggcgtggttgcgggcgcctggggtcccagctacttgggaggctgaggcaggagaatggtgtgaacccaggaggccgagcttgcagtgagccaagattgcgccactgcactccagcctgggcaacagagcaagactccgtctcaaaaaaagaaaaaaaaaaaaaagaaattcagatcataggcactaaaatttcgttttatagcttgtcactttataatatacctaaattcaagttgtttctgagcatatcatcagtagatagataccaatagaatagtaagcataaaagctacagtgacttttaaaaatttcatggttgggtgcggtggctcatgcctgtaatcttagcacttttggaggccaaggtgagcgatcacaaggtcaggagttcaagaccagcatgaccaacatggagaaaccccatctcgactaaaaaacacaaaaattagccaggcatggtggcctgtaatcccagctactcaggagtctgaggcagaagggagaattgcttgaacccgggagacggaggttgtagtgacccgagatcgtgccattgcactccagcctgggtgacagggcgagactctgtctcaaaaaaaaaaaaaaatttcatgcttacatttatcatgatattgttctaaagtaatctcactttaaattaaaatattttaaactttcatagttaaaatatctgtattcatttctgcctctgattttatctatttagtatcaaaatttgccaatacagttaatcagattatatttcttaaatgggttcaaactgatgatgaaatgttgcttatatacttataattattaatgtaaacatgaaacaatgggaagttacaaaatgtattgtatactgcaaagattcccacttccgtgttgtgagaacaaaagaatcgtcattctgaggtagacctaacatccttccaggtggtgatctgactccagaagcagccccaagatgtaaaacattttccctgatattacccttgaagatcttggcttcttttagggtctgttgttgatcaagtttttaaaacattttatgaatctccttcttttctctgatagcacattctctatgcataacaagtcctacaacgttattggtaataaaagtaggtgagtgatgttgaacacagaatttgtaaccagatattcctgagttagaattttgacgctgccctcaatgatctagagcaaattatttctttcagcttcattatttccacataataagtgggaataataataacatctaaggtcagcataaagatgaaataagtttatatatttgtatatgtaagtacatgtatacatatatatgaaacatacttttataacttattttaataaattactcaaaataaggcttaaggtttcttattccactctatgaatagtgcaaacgatcttgcattttccttagctacatcctttataatactgtagatattttaattgaatcctttcacttggctaaattcctacaaaggcttgatactccttcacccctcctgagcatggggtatgttggtgttagaatttgagcatgttgtatcataatctttagggtaggatacaagaatctacaattttcacaaatttccaaagttctacttatagaaactagactttgaagaccactgcttcagaatctcatgaaaagtacaatatgtagactcacctgttttttttaaattacctcaggagaaaaactctacaaagtcacttaacgtcttcaataaccctggatccaagagacttcctcactgtttaacatttttttttttttgacctggaacatatctgtactgcagattcgaagctttctttcaaaagctaggccctttctgcttcgatattctttagatcttcagtttactggtcaagaatactttataaaggttttacaagaatatcagtgtcttaaagcttgtgaaagtatagttaaactacacttattatactttttgtatttctttattcctttccctttcattatcttcccattgtagagggttaaagtgagacaatgctacaataaggaccttaaactcgtatgagttacttggatacttgtcacagagtcgaaaactttaaaatgctgaaacaaagaggactctagtctcagacaaaacacagagacaaattttagcccaacatgaccgtctccttgatccgtccttactcctttgcttcctctgttcctttccacaataattcaaaagctagaattgctaattgtgttcccccacccccttggtcttgaatgttagttatttggaggagatcatatattaaggtcttgtatttttcatcttcaacatcctggcatgtccctataatgtgtttaaataaccaccaggcttcttgagggttactgccttttaaaatgctatctcctttttatccctgatgtcagcacagtgtcagagttagcttttctaaaattaaatacccatagtattaacaataaaataatagtatttatgctgtaataaatagtagtatttcaacagcatcatttaagcacttaataaaatagggcagtcactatataaataacactttacgcaagcattttgtattcatattttatcgctaaatgcataaaactgagcatctatataagaaaaattttatttttgtaatatagccagtatgatgcagataaatctccatttctaaaaacgaatctcataaagctttattatatttcacctggtaataaaggtcaaagtagcacaaaagaggtaatatatttcttatatactcttgaaacctacccaatagttccataaatataaatacatatatacttttttttgataaacatagaaattgacccttctggtcttaaagcttgaaacttaacatttgttttatctgagctccttcctcaggaaacaaccttcaggcctcccaaaaaaggtatcaaagaactgaaactcaccagatcaccacatccgatgagatgccagacccgtcattcattatgattgcttcctagcccctccctagttcctgttttcttacatattgttacatttcttccctgctatgtaaacactaactgtagtcagtcagtgagttggatttgagattgtcaccaatttccttagctgcagcaccagattaaaatcttcttctttgacaattgttgttcagtgattggctttttgtatgaccagctgcagaatctaaactgaacccctggtgttcctgtgacagattttcgttacctgaccaagaacacattgcttgtgtcttggctgccttgagccaagagtcttagaaggcctcctaagcagttgctcacccaattttcactggaggtgttttggtttttttctggccccacagcagctacccccaactacattcctgattgtctagtcagaacagcatttgaaatttgacatctgcacccggataggtgagtgtcaggttctttgtgggcctggacagcatgatcccctcctctcagtttgagaattttttaaagaaatttttatttgtcagttgaacaagcccaaatgactgaaagtgggaagcatcctgtgttagtatggacactttttgggggtttcagtatgaacactcttgggggcttgtttgtaattgtgaggtgtgtgtgtgtgtgagcaagtgtgtatcttttgtgggactagacagtgggattggctcctctcaatttgagaaattcctaaggaatttttctttgtgggttggtcaagcccaaccagtagaaagaagaagcaccccgactgtttcagtttggatgctcttagggctcgtttattgtttcagcagtaggattgtgttggcgattgtgtgtgtttgatatagtcatagcaaagtagaattcagtaagctaatattttctgaaacactgtttggctccaatattctttggaatctggagtttgctattgaatgggaaagcatgacagagttccatgtatccagacttttgtgctactgctctaaccatggtcaggcctggtcagtatgtgatgttctcttgtgatgctgtttggttccagtgttctttggagtctggggaggtttagcctttaaaaagcaaattgccatgaaaactattctacccaaaattttgattcacagccttcaatggattacctactgaggtcaagaaagtgtggctatgtaaaccagtgagtttctattgctatatcatggctataattttgaggtaaaatagattggatctttatgtgtgtttatatgcgtcttaatggtttatgtatgttcatgtattacgtttttttttgtctaccaaattggtttataaataaaagaatacacataagtaagcccaaagtatttttcaagttcaaatgagttaagtcaaccacaataagcaagctggctttaacatttttgataaaataaaaataaaaatgcctttagaattgtcagcatacatttttgctgagttttatatatgtctctgctagatatgattgaggtgtcatggtttggcatagaaggttatagaactataaacccagctaacataaaatgatcttggtttgtgtaccttctttgacaaatgagactaatgtaatgttgttagttgattcttgtgagttaatggcaaaaatacccatatctttaattttaagatttagttgaggacctgacattcatcagctattaaaaaaaaaagtaatgaacaaggaaaaagctaactttaaatgatggtgtctaatatttcagttttcagaagaaatctggataaactattaaaatgaaataatcaagtacttgtaaattgaataaatgttgtaggtacactttttgtgtaatataaaatttttaaattgtttttggtgctcattgggtgtctgggtcatttccaattaagaaaaagttatggggaaacatatttctaaaaattgtggaatggttctcatctgtaaaatgctaatatctgatagtcagctcagaatttcttgcttctcagatgttcactaaagttttgttcactaaaatttaaggctactaagaattctaaagaagatgtgtttttattgagaaaacgaatctgtttgtctagttcagaagttatctaaaggctaattaaaattatgggcttgaaatggttagttatgaaacaaggcagaagaaaaccaataagtagaagaaagagatgtgtaaaaagttatagatacgaaaatatattttaggaaggtgataatgaaaaaaataacaatttttataagaaaagattttgtatggtgaatgtttgtccaaaattaaaataactggttattaaaaaaagaacagaaagaaaatctaagacaaaacaaaagtccaagcatgtcatggatggtctgtgtaagtcatatgccatttttcctgtttctctgtgtgtctatcttcatgcctgtacaaagaaaatacaaagttgaaaaagcttagataataaaatatcctttaaaacttgataaaataggaatgctttggctaattagcattgttcatagttaaagctcatatcttaatgaatgtaaaatataaattattgtaaagaaatacattagcagtttggcaattttttaaatatagttaagcccaaagctggatgtaacatggagccaaatttcatagtatatttgctattctgcatcacatacctaaagtgaatttcttagttacagaaaatgtatagtggtactgctggacttaaagacagtaaatatcaaaaaactgaatcaggaataaaatatccatcaggttaattttttttggctctgggtaacactgtaaagccaaagttaattgagtagaagataaattgagggttggactactgtttatttctgcttttttttttttcttgagacagggtcttgctctgttgccaggatggagtgcagtggagtgatctcagctcactgcaacccctgcctcccgggttcaagtgattccccttcctcagcctcagtcctcagctgggactacaggtgctgccacctcacctggctaattttttgtattttagtagagatggggcttcaccatgttggtcatgatggtctcaatctcctgacctcgtgatccactctccgttgtcaccaggctggagtacagtggcacaatcttggctcactgcaacctccacctcccaggttcaagcaattcccctgcctcagcctcagtcctcagctgggactacaggcatgtgccacaacacctggctaattttttgtattttagtagagattgagtttcaccatgttggccatgatagtctcaatctcctgaactcgtgatcccctctcctctgcctccccaactgttgggattacaggcatgagccaccatgcctgacctatttttgcttctaattttcatttatttgctatttgttctacttaaatatacaaatatatacacatacacatatttatatgtatacatatacacataggtatacatatatgtatatatatttgtatacatatatataatatataaaactattgatgctttttagtttctaatggaaagcttttatttggttctatgaatagtcattttgttttctatgtatttccaacaattcaccatttgttctgtttattgaaagttcctaaactacctttgtcaagcttcaaaacattgatgaaggacagcagccatttaaatttgattggtttttcttacctctgagtatattgatagctatgataattttaaggttcttggcaaaaatcttataaaagacttatttttatgagttctaaacacaaatagtacattatatattttgtaatttggaaaagtagatgagaatagaagtgtttaaatgatgtttatttccaatgtaattcaattcaatcaataatttcagttggttcagatcctttcctttagtgaagaaaaactgtgatatgggttaaaagttttaatgttcaggaaagactgggctgtttttttaagaaaaattttattgattgggatttctctgaaactactttcattgtgtttaccactattaacattaagtgacactcaattgaattaggtagtaattgctttaaaaattgtgacactttgttgtaatttttgatccaaatccatttatctctgatgggcattcatgtggtacttgaaaacaaaatatgcacaagtgttgcactggtttgaagagtttggtgtgaaagttacttaatcagttgtaagtactgtatctagaagtaaatcttagaaatgtgtgatgatgctcttttaagtagctgaagagagattattatgtggttttcactttgtccttgctttgttgtatagtatttaagtgaaatgagattgcttatccttattctgaatttccaaagctgatatttgcatttgccatttttcaataatggaaaaaaaaacaacattagttgtcttgctttcaaaagtttgtcaaaggacctatcaaaactttgatgcttttggtcacagttctgtcactaaaatgctagcaattagacatatggaatgagtaacctaactactttaacaccgtggtcagaagtgctataagtagtatctgctaagctccaagccactgtgttttaatttgtgacattttagaataataggctttctgtagtataaatatcctattaactaatccttgtgctgttaagttacaggtctttgaatcctcagtctgaagaaagcactgacttctgttaaattttgagcattgataccagtcaaagcctcatcttcagacacaggagaaggtgacaatcaaaatgaactgctttcatgagacacagggccagaaattaaaactattcaatccctctagacccaggaactattgtggaaactgtaggtgtgtgagatggtgagggacaattttgagggacaaactcagttcagagtttctgtaaattaaacgttaatgtcaaaagcacaatgatgcaaggtcagtgtctgggcctatgtgtcagaataacagggttttcttggtgcattgatctgctctttaatagataatcgtaaaaggctataagaactttgtcaaactgattaaaattagatagatttgtttataaggttttattaaaattagatttaacattaataatataccatacaaagatacaattttgttttctcttttgaacaaaaatttcatgtaagaggaaactgcagggaaaaaaaggagaggggagagacagaataagttggcctcatgctatcttaagtattaggtcttattgcttaagaaacagagtctcctctctatcaaaaggtaaatgtttttgttttattattttggctaaataaatgaatattttatagtgacctgtgatcctattttgtgatatcgagtgtcttaaacctttgatactcgacagaatttccaacagcaaaatttcaagttctaaattcagtctttgtgaactcaaaccaacctttttggatattagttgccctgaagttcaagagagacatgtaaggcttattaggcttagttgttatgttagaattatgcaggagatattgtcaaatctgaggtggtgctaagtttcctttgggtgatatttatatggatgggttgttaaaatgtgtttgaggattatatgagattcctgtaattctgatatgtcttaatataagttgtcagtaataattatgattattatgttacattgttgtatgccacagaaataaccaaatttctttatctactgtgcctttaactatgactctcttaagacttttgtcatctacaattattgttttgctttgatccttctcaaaaagtgacttataatcagctacagtctagggattgcttctttggtgttcgtgaaaagaacttttcaatgcaggttactgataactttggagattgtgccattaggttagagaggaaaattccagggcactaattgaaaggctgatgtgttcataaagattgttaacccaacatgaagcagagcaataattgattgcatggactaaactaatgaaggactgaaataatttttgtggcttttatctttggaatattgctgatttttttgttttgtttttcagagtctggataattttttagatctacttataagctttaagttatgctttaagtatattaagtagagtatacttttgtaaacagaacttgaggcatattttttctctgcctattttctccggaattatattcttaattcatgtgtgttagtttgcatacatttaatgacaacttgttttcttgtataatgggacacaattggaggaagtggttattttcttagggctttgaactgaaatgggcttgggaaaggttccagaaaagccagtgtaggtcctatataaacaatgaaccttgttgcactttgggtggttaatcaggctaagtatatgggcctgaagcttcttttgcaagtagatttgtcctgctatgacttgcctttgttggaagttggggggctgaagagaaaatgctgtgtttcagaagaaaatgatactattagattagcctttgatttctgggtggccgtgaaatcacctgtagtatgacgctgcccacgatgcccctcctcagtattaagcagccagaaagactgacaaccagtttccccatgattgaaaattgataaatagaaaggggggactgaaaccgaccaaacagtcccatagatcactttttcgataaacatagaaattgacccttctggtcttaaagcttgaaacttttgtgaattgttttctgttttatgtgagttccttcctcagaaaaccacttgcagcctctcaaaaaagtattaaagaaatgaaacgcaccagatcaccatattcagataatgagatgctagacccctcattcatcatgattgctttcttgcccctccctagttcttgtttttttacacattgttacatttttttccctgctatatattcccataattttagttggtcgggaggatggacttgagactgatctcccatcgcctcagcggcagcacccaattaaagccttcttccttgcctataattgctgtgtcagtgattggctttctgcatggttagcagcaggacctagaccgaaaccttggtgttttcgtaataatcttataattgaaaaagatccttaaaacaatgtaatttaagtctcattttacaaaagaggattttaaaaatggaaaagatttgctgactgaatcaagattataacattaattagcaacagcagataaactaaaatacaaggcttctgaattcaaaatctgctttccatttctccctacgtcctacaagaacaaatatgtaaaataaactggagaatttttacttatctatgtgtgaatataaaacatttttggtttgtaataaaggatgttaccttacaggaagccataaattatttcaagtctgaggttcagactatgaagtcacaattttaaattattaatactgtgaatcaaacttcatctataacacttattgtaagaataacataaaatatgaataaagaagagggttggaaaatagacttaagatactttaagtttgggaatgatataattataaaaagacaactttttcatatgacaatagtaattagtagtaatgagataatgttgctagcttatagaggattgtattatcttattattattttctattatatatgtcaatatgtgctacaaggagtctatttgtaattctgcatttctagcttatttctaagatgaaggttacagatatttatattgctttttctggtagatttcagacagattaattactgtttttgttttcctttgtcttctaccaatattgtgctagaaaagctatgtttacagtttgatgttcacagattgtattctattatttttgaaatacatatagaaatctacaagagcaaaaacttcacattgaaaaccaatataggaggacagagaaaacttttctggagaagttacagggcagagttttaagatagaagatgtatttatatataaataccacagaacattaatagacagaggaaaactcacatgtcaatttacagaagattaaagaaaagaaatgtatgttttgtggaactaaagagaagggtgtaagtaaagcagtagtaagagttaaggtacagaggtgggactcatgggctatatctgttgatataaacttcatcttgacaatgaggctcagctggtaaagtttaagcagattagtgattataaccaaaagtgccaagtcattcacagttctttaacacactactttgttttgtttcttttgatcttcttgtttcctctgctgggatattccattatcattcttgcccaggtaaaactgcacttgtatttatctactgctatctgtctagatttacctgtgcctgcatctgaatcccatgtgggcagagatctcattttacttgttttatatttctagtacctccccaagagactaatatttgtgggaacttagacaatttttataaaaataaatgaataaataaatagcctcatcattttttactaatgataaacttagcatgtacatttgtcactagtaaaatgatcttttaaagagaaaattgtattttaaaaagaatgtataatcacaatgggaaaataattgtatttcaaagtaaattatttcatctcatattaattaaacatagccttgcattttatgaaaagaatgggaatttaaaacgtatgttagcccatgcatcagtcatttttatcgtaattttattagaagctatttggggagagagagtgtctcttattatctaattatcaaacagtagtgctttattcatgttaggatgaagtaaatatttacttaatttaattggataacgtaagtataagttaaccaatatacacgactaaagaatatcccaaaataacttaagtgttttttaaaagcttttggtttttatttcttctgtatgcttatcaaagtctcaaaaaaaagtaaaacaaaacactaaactatgtactattccttctctcactctctgaatctttagctggtttactaaattagaataacacagacatacgtatttcattcatattggacttattttcagtcaatattactacatttatggatgaaagctgtcaattttaaaataataatatagaaaactgtctaaattctgaagcctgctgtcattttttgatgttattatttagttagcttacatgccatggttgctggctgggtcgatctgtaaaaaaaatcactatatatatagtgtgtgtatacatatatatatagtgtatatatatagtgtatatatatataatgtatatatatagtgtatatatatataatgtatatatatagtgtatatatatataatgtatatatatagtgtatatataatgtgtatatatacaaatatataatatatatatttgttcataatctttaaatataatcttccttataaaagaagtctgaaagcaaagcctcataacttttcagttcattcatcaattcaatttgaaggattaactcctctccagaaaatagcaaatatgattatcctacagtgaacatgacattatctcagcaggtagaatggaagtatatggattttattctctgcaggtcccacttgatatttcaccaaacattctaaggtgagtttttagtatccaagacattatttaatgaaaataaatgtgaagctaggtcaactaaatttctgatgtcacagaaaagacgtgtatactcagaatctgaagatggcactttgttttctggcgtggaatacaattttacttaagtaaaaaacatttattgtattgataattatagacaatatattatccaggaaaatcaatgatatgtcttacaaatagaaactgagcaaaaagaggaatataagatctcattcattaaataatcaataaagtgatttaaaacacttcaaatgtaatatattggccacatatagatcagaccagatttatttagcacaacacaatcttcaatgaaaaatatgtatatataataccaacttgtggttggttttattttaatattcaagactaataaattaaaagtcttgaatattaaaagactttaataaaatcaaaataaaaaaacaaaaggtgactttgttcttataaatagcattattatcattgctactaaacaattatagttttcctccacaacagtaactacaaagattatagatatgaaacagtggaggaaaaagctttaaatctaacaactctgagttcaagttatggtcctactacttgtttactaggggagtggaagtgggaaaggggactgctgagccaagtcaattatcctatttcagcctcagatttctggtgtgcaaaactaaattatgcaaaagtcatgatgctattgttaatattagaaattatatatataaaggagctagcaaggtatctggtcctagtgtatgctcaataagtattatcaatcatctttaattcctcttcagaataacctagcacagatgaagctattatttaaaacgcactcaaaccttacttggctcttattgtagattctgtaactactcaatgtataaaagtattctatatatttcttctaagaaggagcccttagctgtttatcaggttcaggcatacagagtcctccctcagcatccatgtgggattggttccagagcccataaggatactaaaatctgcagataatcaaggccctgatagaaaatgagacagtatttgtatataatctatgcatattgtctcatacactttaaatcatctcgagattacttgtaatacatataaaatattaatgctaatagttgttatactgtagtttagagaataatgacaaaaaaagtctgcgcatgttcagtacagatgtaatgttctccccaaatattttcaattgttgcacttagttgaatctactgatgtggaagccgtggatatggagggccaagtgtatatttgctttttggatatattaagtttggccacatccaactaaatgtgtccaaaattaaattgatgtcctcacccaagccatgtgcacccctattgacatcaacatgacgtcaccttaagcaaaaccctgggaaatattttatcttatttttgacaaatctatttctctattcttcctaacatacccagttcaaaacattagcagtatttcctgtagactcttgtgcctctgctcccctaaaatctgcctcccacagagacaatcagatggattttacaaaaacatgttttctcacttgactttctaatttaaaagtctttccaagaattcctcctattgactagataagtctaagtttcttataaaagaaaattaaattttctgtggcatggccttttaattttccagccccaccttgaatcagtttatgccccagtaacactgactaataattatctataaacaagaagctatttcagacctttgaggctgtgcaaatagggtcacatacttctttttcatttggtcaacctcatcctcttattgtgggatgacttcttggtactccttcattatcgtaagttccccatcaataaccccagaaagcccagaatttaccttaatctcaaaattgctatgctaaactcaatttaatttatattctttatatactttactgtattttgggggctttcaaatgatggtactgtagttatctttgttttccagaatgtagtaaatggtagtatgtaataaatggtttgttgggctgaaaggaaacttttcctatcacagacacctgaaggaaatgaggccattgagaaatctgagaaaagatccatccaggctgagagaagatgaaaatcaagctcaaaagcatataggtagctatgatcctcagagatagagaggagactggtgccacaactggaatggactaagaaaagcagagttgagtaggagatgaaatgtataaactgttgacatgagggagtgtcctacctgtagtgatagctgacaaatttcactgagcccttttgaatttattttaatgatttgccttttactcagagtgaggtgtgaaagcactggaaagcttgagtaatggattgagatgttttccatgttaccaggatcacccaggctattgtgttgagaagagattgaagagagcacaggaagacttgtaattggaagaagttttcaacactctagactagagattgcagtggcttggactggaatgctaataaccaaagtggcagcagttgttgctttctgaatacatttttagagtagaacacagaggagttgctccaggttatgtgtggagttggggaggaagaggggcattgaggatgactctaagggtgtttggtcagagtgactgcaagatgggagacgccttaaacctcttattggatataaagtcaccaataagtttgacaggagtactgttgaaatgaatgtcaggcatgtaggaagtaaactcttccaagtgtgacttccagtatgtagatgacaataggatatgaggttagaaagaagaaaatttattgggaagagacctatcatctgtcgatgacagcaaggaggggtaatgggcgttataattattttttgacacgagattcaaaggaaaacaaactattgaggaggaggaaatctagtttaaaaatgtaaatgagaatctaatactccaccaaccgtatctctgtgattaatgatgatcacacaccctgcaaagtttagttacagtccatcaagtttcctacacctggtgtagtattgagttatctgacaagtttgatctcgtaagattcttgagacttccttttttttttgaactaatattagtaaactgtatcttttagaagaatcatccatttctgttttcaaattttgcatacatttaagcaaagttgtctctgaatcctactttttttctatttatatgtagtttcttcattagattttattgtatacagttttacttgttctttttttcttgattaggttagatagtattttatccaattaattatgtctttatttttgttgtttctttccagagaaccaaattcagtctcatttatttgttttatatatgtttataatacattcatgtctgatattatagttattaattattttgggggatttcttgtgtttttatttgtttcttttatgaagtattatgacaactatacataatcttgataggatttctcaaaaagaaaagtacagactaattttattaaataaaataacagcaagcatataatatcagcttatttcaagagaaaaaaattatgtcctaatagaatctacaccatggatgcaaaatagatccatctaagccatggatgcaaaataggagctatagtaagatcagtcattatatcatcaactcaagaagaaaagtcattactgtcctcatatatggtagctatttatttgatctgagaaaagcaccattactattttaaaaagtcaataaaatagaaatagatgagtatttttttaacatattaatagtttttaaaaccatagaccaatctaatggggaaacactgaggcagtctcattcaagtcacaaacgagacaagcatttttattggaagtataataggaaatgaaagtaaagaaagaaaatggaggccaggcgtcgtggctgatgccagtaatcccagcactttgggaggctgaagtgggaggatcagtagaggccaagagcttgagacgagcctgggcaacatagcaaaattctgattctacaaatttgtttttaattagctaggattggtggcctgaacctgtagtccccactactagtgaggctgaggtgggcagattgcatgagcccagagtttgaggcttccattagccgggattgtgccgctacactctagactgggagacagagttagacctgggctagggggaaaaaatgtaaaagaaaaaaagcctatttacaataaaaacaaaagatgtagaaatagatcaagtaagaaatgtacagaacttacataaaaagaaaaacaaaaagcctgctaaaaaacacaaaaaaatgcatggacaaatgcaaatgcaaaatgttcttggatagaaagattcaacatcaaacatatataatatattcctaagtaattaatatataaatctcttgtgttcctaataaaaacacagttaacaacaaaaacactgaactagcttatttaaagtcaaagagaaaacttaacagaaggagagggaacattttggagggaaaacagcattgaggtaagttagtagcaccagaggatagagcatactatgtaagcttaatcattaaaattgtgtggtaataggttataaaatataaataatagaattgaatagaacatttagatcaaaatcaaaacacataagaaaatatatgatataataaatgcaacatctcaaatttgttcatcattggatgaatatcacaatgtattgtgtggggaccacagagtatttgactggaaagaactatggctgcattaatacctcctactgtgtactaagatacatctcaaatacaataaagatttaaatatacaatatgaatccacataaacactagtagaaaacgtagaataactgtaatctgggcttaacataccaatataaaaaactgatatacttgcacatattcaaactgatgcatgttgagtgttaaatatttctccattgtcaataaaagaggataaatcgaaaagtttatcaataatagacttcttctacagttttatacttattaaggaatatgtttatcaataatagacttcttccatagttttatacttattaaggaatattacataactgtgaaaaaaataatctgaaggatttatctagtatctacatggagaggactccaggatacattcattgtgaatggaaaaaaaccccagcaaagtgaaggaatatattaatatttattcatattttcttggaatgatactgaaaatctggaaataaacaataaattaacaaaagggatttctcaggtgggagactagaaagatgcaattgtaatagcaggaaatcttttagcttgctgtgtgtgtgtgtgtgtgtgtctgtgtgcgagtctgtgtgtgtatacacatatttaaatacatgtattattttacataactattttaattacctatacactcagaagtgactttgaaaccctgagacattacatgccactgacacatctgttaatttctttgaagaaaagagcctttctctgtctgcagccttacttttccataataaatttgaaatatgcctctgatattgtcctcttcccaaaatttaaccaaatcagaatatgcatgcagttcctgagaatctggtctctctgattttctgatctaatttagatgtttataggataaaagaatacttgccgcgcttcttaaatttaattacagggttaaacgggcccgatgaaaagactgcattggttctaatataaattaccttcgctctgcaggaggagcattatccgctgcttggaccgtgagtgcgtaagtccgcccgactatcatttccacccctggagcgatggtgataagccctgttgttttattgatgatgaagtctccctgagccccaacaaggatttcatatgtgatctccccatttgacccttcgtctgcgtcgactgcagtgagctggaattgaaaatcacaacataaatcctcttgggtctcaacttttcaccaccatgtcgttttttcccccaacaaaagaagcttgctttcaaagaaaaaaacacaggaaagtttccttgacatatatactgttttttgttttttgtttttttaactgaggctactgtgtcctgttacaatactaaagcaatcacaaaaataagagtgattttgttttttgtgagagtgattaagaaataaactttggatcttgaaggcttatctttattttaatttaataaagggaaaaagaggaaagccctaacagaaaatctaatatccctataggaaatttatttttcctgtcttgccttgcattcttgacacataaactcatattaaaacagactgaacctggaaaaaatgaaataggcatagtcggcctttgttactcccaaccttccttttactctcatttttccttccataatgttctcctccctgtctcccagacactctcatctttgtgtcctttttgtttacaattgctctaggaaaggttattaacttgcacaccctgatttataaaggactgataagtcgtagagtattaatgtgtcaacaatcaaacaaatgcatctcccattgtagaatatcaagggtaacatagcccaagaaatgtttctttggggaaagaaaatctattcggagcccttgaaattaagcatgtaaacatctgtatagccaatttacatatatctataatcattttgaaggaactggtatctaaaagactttatttgggatattatatgaaaagataacaatgattaacttcatcaagcaacattaaagcaacagtgatttattatattaaaagtggctccttgacttgctgataaatataaattaaaggggaaaaagaatataaagggattctagcagaaatcttatagtaagcattttacatacatcaatagtattttctgtattcatcatacaaaaagtgaagaatgaaagaaagtggtctcaatttacacatgagggaatataattaaaagttttctgtggaataaagaaaacacatgtaattgtagtaaattaacctacctgtagaaatgttttatttacttatatttatattttcaatacattacttctaaaaatagtagtttttatagtttgcagactcctttgaaaatacagtaaagatgctggtataccttccttgatcaaatgtaaacatacacatttaccttgaaacttgaattcaatttcagaaacatcatattaactaatttcccattcaaaagttcatgtttaatatcctcaataaatgtaaacaaagtactttatacactgtactgtgctgaaggggttatattatgcatattctattttttattatatgtcatgcttagagtgataatgtccatagacatagcagcaaaaaataattgagaatgaaaaaggaaatgacattaatgcaactaagtcctgagactggctatttgggggtggacagatgtggttgctggaaggaaaggcattttatgacatgattctgcgacttgtataagcctgacagacatattcctaaaggcaaaggagaaacatttgcagaaacagtcaaaatgaatggcatatatttatagagagctattcaagccagacaaactaattctgttttgtgtatggataaaattagaaaattagaggatggggataacagaggagatatcaattttgattatacttaaatcacttaaaatgtctcaggaaatcttaattaaaatttagcacaaattggattcaatattaacattcttcctgggacttaaattggctaaaggaatgtaatgataaatggcaatgcatcaagttaagaaaaggtgttaaggagtgtgcttcagggatgtcagcattatagctggtcttatttaacattttcataaatgatgttggaagggaggataagctggatgataattacattgaagaaggtacccacctgggagatgctagaaataccaaatagtactgcaaaacacaggagacagaaacacccactaaattgcagagatagtcaaccacagttgagctaaggtattcagggaacacaattagctctgcagaaattattaggaggtagaaagcttaacaagtacacaaaataaggattctatgtttaagttacctagataacactatttttcagtcttttactactaaataataaaataatgggttatgagtcaatataatttgtttgcatgtatgctaacaaagatattttaaggaaattaatcgtagtccaccgtcagaaaaataagctgagacactgattctgaatacccaaatcataatagtgtcttccatgtaagatcccgaaaactcaagacctttttttttttaaacctcaacattagcaggagaattgcttgaacctgagaggcagaggttgcagtgacctgagatcatgccactgcactccagcctggcaacagagtgagactcttaaaaaaaaaaaaaaaaaaaatccaaaacctcaacgacattacacagtagatgtccccttctgaagtctattagatgatgttgaatggagttgtagttgctaattttggagctaacctatggcaagaatttaattcaattatagttcaatgactctgtgaccagtagatagtgtctatgagatggaaatatatgaagctcatttctaatttagcagggaaatctgcttcctaaatgaaaagggcatttatttacatggggaggccaatattttgcttacaagtttcagatgaaagtaaaaacaatactataactttaaagtgtttattgaaacattgtgatatctaaaaggtaagaaattgtgagctatttgttttttttatttcttttcgatgatgttttatagttctattcaggaactttagccctaccctttcataattccttcctctcagtgtttcaacatgtgcatattccaaatgtccccatctgtattagtctgttttcatgctgcttataaagacatacctgagactgggtaatttacaaagggaaggtttattggaatgccacgtggaattccacgtgggtagggaagcctcataatcatggcagaaggtgaaaggtgcatcttatgtggcggcagacaagagaagagagcttgtgcagggaagctcccctttttaaaaccatcagatctcatgagacttgctcactatcacaagaacagcacaggaaagacttgccccaatgattcaattacctcccactgggtcctcccacaacacgtgggaattcaagatgagatctgagtgggaatacatccaaaccatatcattccaaccctggcccctcccaaatctaatgttctcacatttcaaaaccaatcatgctttctcaacagtcttccaaagtcttaactcatttcagcattaactcaaaagtccacagtcaaaagtcccttccacctacgagcctgtcaaatcaaaagcaagttagttacttcctacatacaatggagatacaggcattgggtaaatacagcctttccaaatgggaggaactggccaaaacaaaggggctacaggccccaagcaagtccgaaatccagtggggcagtcaaatattaaagctccaaaatgatctcttttgacttcatgtctcacatccaggtcatgctgatgtaagaggtgggtttccatgctcataggcagctctgtccctttggctttgcaggggacagcctcccccccaactttgtttatgggctggcattgagtgtctgtagcttttgcaggtgcatagtacaagctgtaggtggatctaccattctgggctctggaggacagtggcactcttctcacagctccactggtcagtgccccagtagggactctgtgtgagggctctgactctgcatttcccttctgcactgccctagcagaggttctccaggagggccctgcccctcagcaaacttttgtctgggcaaccaggtgtttccatacatcctctgaaatctaggcagaggttcccaaacctcaattcttgacttctgtgcacctgcaggctcaacaccatgtggaaactgctgaggcttggagcttgaaacctctgaagccacagcctgagctctatgttggaccctttcagccatggctggagtggctgggacacaggacaccaagtccctaggctgcacacagaacagggaccctgggcctgcccatgaaacaattttttcctcataggcctctgggcctgtgatgagagaggctgctgtgaagacctctgacatgccctggagatattttccccattgtcttggggattaacattcagcttcttgttacttatgcaaatttttgcaggtggctttaacttctccttagaaaatgggattttcttttatattgtgttgtcaggctgcaaattttccaaacttttatgttctgtttccattataaaactgaatgcacttaacagcacccaagacacctcatgaatgttttgctgctaagaaatttattccgccaggtatcccaaatcatctctctcaagttcaaagttccacaaatctctagagcaggggcaaaatgccaccagtgtctttgctaaaacataacaagattcacctttgctccagttcccaagaagttcctcatctccctctgagaccacctcaggctggactttattgtccacatcactatcagcattttggacaaagccatttgacaagtctctaggaagttccaaattttcccacatcttcctgtctttttctaacactccagactgctccaacctctgcctgttactcagttctaaaattgcttccacattttcaggtatgttttcagcatcaccccactctactggtatcaatttactgtattagttaattttcacattgctgatatagacatacccgagactgggcaatttacaaaagaaaacaggtattgaaattacagttctatatggcggggaggtctcacaatcatggcagaaggtggtagcagataagagaggagagcttgcgcagggaaacttccatttttaaagctatcagattgtgggagacttattcactatcatgagaacagcaagggaaaatcttgcccccatgattcaattacctcccaccagatccctcccacaatacttgggaattcaaaatgagatttgggtggggacatagccaaaccatatcaccatcaatcacccatgtgaccacaaaataatctaagttgctcctaatgtttccttttaaattttggctgcagtttactactctctttaattgctctttcctggttctgataaaaaaaatacagcttgatataaaaggacaaatataaagatgattgaattgtgcataagctgaacaaaaacattcaaattggagtctcaaaaatgacacagaaagccacagttgatataaaccatatgcaagaatataaattgtaatgcaagagtgtaaacacggtattttatatgaataaatatattttttattagaagtgaattatgggccggaagctgtggctcacgcttgtaattccagcactttgggaggctgaggtgggcagatcacgaggtcaggagtttgaaatcatcctggctaacacggtgaaaccccatctctactaaaaatacaaaaatattagccaggcgtggtggcgagcacatgtagtcccagtgtttttgggaggctgaggcaggagaatggcatgaacccaggatgtgaagcttgcagtgagccgagattgtgccactgcactccagcctgggtgacagagtgagagtctgtctcaaaaaaaaaaaaaaagtgaattatggcttaattgataatgcatgaatgtgttgatcatttgatgtttttgcctcttgggcatccttggctcttgcttccagtaaaagtcccttattttcctttggggagcaattggcaaaaaaacatgtcaagttattcaagttggtatagtcaaggtgactcctagaactactgtaaaagagtgtttttttcttcctctagggctaaactggtaaatttatatctggtgtttctgctggctttccagtcttcattggatgtacctaagactgagacccatacagaagaagacatgtcaagaaataagcagaaaatatcgctcatgacatggtttctgcttatgcctgaaaccaaattcaccactttctgatagattaaaaattacatattttaaatgctaatttattttgaaattatgtctttcaaccgtaagaaccctaaatatataaaatagttttgatgcttaactactcttcttggtttgctttttgattatttttctaggattattgtgcttcgagattttggtttgagataccatgtaatcattaatacaataatgtaatatataattattcattacaataggcaaagatattgcttgaaagtggtagaattgtccctgtatagaaataatattgaattactcaataagtaaaaaaatacagataaattagctggtaaatatttccatcaagagaggacagactcgatttcagggaaatatttaaatgagtattgctttgttttttcttcttcataatttcatggatagaggattcattcttacatagatatgagcaacctcagcatacaatttttttcattattaagatgagaactttcacattttaacttaaaggaagcactttcatagcttctctttgatatatatgaattgccagaatcactactcctgtgctttgggaccattgttatgtaaaataagggtaccaccacaggtaatctaataacagagatagcttctaagtgactcatgggcagggagcatagatgtcctggagatgctggacaaaaggatgattcatgccccccccaacaagctggggacagagtaggacacctcaagatttcatcacactactgaaaatggcacaaaatttaaaactttggaattgttgatttctagaattttccatttaatgttctcagaatatagttgaccaaaagtaatagaaaccatggaaagcaaaactgaggacaagggaagaatactgtaaaaataaacatgaactgagagatttacctcacagcatatgtaaaattaactcaaaatgcatcacagacctaaaggtgaaagctacactatgaatactaggagaagataatataggagaaaatctttgtgaatttggttggcaaattttcttaaatatgacagtaaaagtatgatacaataaaaaataaacttcctaaaaattaaaagctttttctctaccaaaaacataagaacatgatacataaaatacagattatgtatttgcaaaatatttgcagatcatatatctgataaaggacttgtatttataatttatagagaatacttaccagtcagtactaagaaaacaaacacaaattttttaaatgagtgaaagatttgaatagatatttcaccaaagaagatcaataaatggctaataagcacatggaagtatctcaaattaatttgtcattaagggaacacaaaatcacaatgagatactaataagcatctgtataatggctttaacaaatgaactgacaatactatcagagaggatgtagtgggtggtaaaatggtacaagccactgttattaaaaagcagtttgacagtttatttaaaaagtatatatttaccatgtaatctagcacttttcgtaagatatctatatataacaaacagaaaaataaacatatatgtgtatatatatgtgtgtgtatatatatttacatttccaaaaagtgacttatatagaatattcacagtcacattaaactggaaacaactgaaatgcccatcaactggtaaacagataagcagaatgtgttttcacaagatggattctattaagtaactcaaagaaacagatatatagcattgattcatgccacagcatagatgagctacataaacattatgctatttaaaaagccaggtaaaataaaagtaaaagatacatactatgggactccatattttttaattcctagacaaggaaaacttttagaggcagaaaccaaaacagggggtgtctacagctgaaaatgggagtgagcattgactacaagtggtcatgagtaaagttttggggtgatggaaattttgggggtgaaagaaatgtatagaactagattgtggtcattgttgcacaactgtctaaatttactaaaaccagcccaactctttcatggaactgatgtttactggtctttgaataaacacagaaattgaccccccacccccaccccaccataccctgtcttgaagcttgaaacttacatttgtctcatgggagtttcttcctcaggacactaaccctcaaccctcctagaaaccaaggaactgaaactcaccagataactgtatccagaaaatgagatgccagacctctcatccatggattatgattccagtttaccaattcctcttccttaccctaccctaatatttgtttttgcacaagtattttttccctgctatataaacccctaattttaatcatttggggagatggatttgagactttatctcccattctcctcagctgcagcacctgattaaagttttcttctctggcaatatttgttgtctcactgattggcattttgtgaagcaagcagcaggacctagatgaaacccttgatgttttggtaatatacatacatgaggacatgtaaattataccttaataaagttatcgaaaataacaaagataattccacccacacatctgacctttttaatgatatttatccatttttttctgctacattatagaatgcccttcaggctacttgttcatgtattgtttcatcatttgagtaactttcttccttcttcctgccttcttatgcacctcacaaagtttagatcttgattatttgtttctttctttctcttttaaaccactgtatgttcctctgccttcagagactttactatcaactccatgaactccatgctacctttgtaaaactacttcttcctcctatgaatggacaggtatgaaagctctggcaagcaaagaaaagccagacccatggaagaaaagcagaatgtaatcagctaatccaactatgaaaggctgtctgtgttgagaaaagtaatcagtagaagagaaggtgaaattgtggaatatagaatggagagcacacaaacaaagatttcaagataagataccttcatattttcctctgagagaacattttatagcaagagtataatcttcttagcagctcccttcagatgtggtaatgattaatggccaatgctggagaattgcacagatttggcagaaatcaaggtacaagatatacttgagaactctactgggatcatttggggttaatgtctccttatgacatgccagaatatgagataggattgtatcacttgggcctttttcgttggttatatttatcctaattttacatttgaagccttgagttaaattctaactttgaccttatctgatatgcagtggctggcagccatagcttatacatgtatagatatgtataaaaatgacatcacttaaggcattcttcggtggtttcctagtatgacagagtcgatttttcttttttgcctcaccagatgtgtttaagtgtgggatgaaatataaacaaacgtttatggaatcagtattgtaaacaagaaggtgaacagtaaagttatatggtgaccccatatcctgatgatttgttcctagaaattctcaagggcaattataaggatccttttgcacactcaggttgaacttcacctagaagtagaatatgcctaatctacaagcttctgggagaaacaatacttctgtatgcacacaatatacttgaatcgtattcatatcatatatacttagaggaaatgtatcagtctattttcacactgctataaggaactaactcagactgggtaatttatgaagaaacgagttttaattgactcacagttccacaggcttaacaggaagcatgactgggaggcctcaggaaacttacaatcattacagaaggcaaaggagaaggaagcaccttgttcacatggcagcaggagagagagagagagcgagaggagaagtgccatatacttttaaaccatcagctctcatgagaagtcactcactatcatgagaatagcatgggagaaatttgcctccataatccaattaccttccactaggcccctactccaatactaaggttcacaactcaaggtgagatttgggtggggacacagagccaaaccaaaccgaggaacaatccttgagtcaccttaatcaacactggacataaagaactaagagggatttgaagttcaataaattagtttactgaatcaagtagagatggcttttaggcaaacatattaacctaaataagcagagtagggaacattctttttcaataacttggcattactcaggaatgattacagagtaatcaatgattactgaaataacaattataataaattctgatgtatttaaatggttctagttggctatactagaagatcaagtcaggagggacatatctctgggaactacggacaatctaaactataccaagatgtcatttgtaagtatgggcattatcaatcttctattacagtcatatttctatgaactaggaaacaaacatcttcttcatggtacctttggcgaagtttggacagactaagaatcaatgcattgctttattaaagaaaagtgactggtgtgctgcattcatatgcagaagctttcgctagtgaaagtttattcctaggggatggtttatagttatgctatcagaccagatgcagaattgtcggagaaagagtatctaatgactactctggtaatgtaaaatgtatgatatgtaggaaaagtctattttttgctaggaaagttgagaaaataatttggaaatattaaagtgtattgtgttaaatatttcatctctctgcctcagctctatcgtgtgataagggatttttaaattcatttatgtagttagataaaaataaaatctgagtgcatactgatctctaggacagaaagattatttggatgggcaacataaaacttacaactaggtaatccttatgtagaaggatttgccagagaaagaattgaatttacgtgtgtaaactaatatacccagttgaatgtatcaacacttataaaaaggcagaagtaatagaggataagggggaaaaattgtctttcaaatgttaaagaaatatcagaacagttaagtgaatctatctatggttgttaatttgctttgtagagggaattccaacttcttagtgtatgaaatatgctctggtgatagccagtgttttaacatctatttttaatgcactagatattatagaagttagtgtaacaaaaattttaagaagattcctcagaaatgtgtagcaagtgggtaacacataatgagtgcagatgacttagaagtcataagatattatatctaaagttacaagacttctactatgctattgccatagaagctatattgttgcctgcctggtatccttaattaaagctaaatcaacttggagctgtgtaaggtctactgggtctctccaggttggcattcagtctgaacctaaggctgctgctcattaaactatcactggaaattcactattcagtgtgatttctgatggaaaaatgatataatgggtttgcttttatgtttgttgatttcttcatgtgtcaataacattcaggaagttcttcaataactcctgctggccaagcaaattggggattgcaaatgtatttattttcagatttattctctgtggccttaatgtgaacaagtgatgctttaaagccaaaaagcataacaggctcccagttttcccccttctcttacgcatatcctagaataatccaagatgatgggcacctcagtagggtaggtggctggcaaatttatcactttggttgtataatttggaaaaagatattgataacattaataataacatgatcattaaatacttatatgaataattgtcaccgaagatgaatctcccatctatgcatttttcttcccaaaaaaaggcaagaaataaaacaacaagaagatgactttaaagcatttcttttcacagcctgactatttaaagggcttgtttcttttctgcagcaacttcatgatccttttgtaaaggttcattggttctaattactcaaactctgagactggaaactggaaccttaagtgctctaatgctatcaaattctctcatgcccaacttacactctcaaaaaaagatttcctcaaagttggcttccattaatttccatctcattagctttaacccatcgatttaaggacccagtctttcatacttcttcaagaaatctcacgttgtatacaatgccaaatctaaactactctacatgcaaggtagccatcttaaattaatttataaataattggatccatttattcagaccttaatttgtaccaaatgtctgactccgaaaaatgaagagtggaaaagaaacagaaacaataacttctgtcaaacagaaggtgctctaggaaaggagatgagagagaaacctatctttaaatgaaatgctgttacagaaacataaaaatactttacaaaagtacagaaaagcctgtcatgacaaaggggctgggagaataaaccaacatatatttgacttagtaaaagaaaagcaaatctttgagcattcagttcctcttctctccaatgccagttaaatttgtatctttaatgcctcatgaaattactatgcctttggccgtatcatttcatcttcaacatcatattatcttcacttgcctatctgagtactctaacagatcatcatccccactcacttttgatgaattctcgttagtgctcttagtctttctcatcaaatttaacaactcaataattgtgatgttttctgattatttcactgtgaagaaggattatttcttgcaaaatatagtcaactccttgaggattagggctgtgccttactcgttctacgtatttttcagagcacttagtttagtacgaatcacctaaaaatctgtgtagattaaattataatctagccaagaaagtaatacaacatgtagcatacatatattaggacttgcacaatagtgcttttgtttgtttgtttgtttcctttgccaaactggatgagcaagtttactagggttttaagaaatccctactgctctatttaaatgtttgttttttcccctaagatctcctgtatttgaaatatctcaatacccaactatttttattttactcagatgactatgcttggacattataactgtcaggcctctgagcccaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgacattaccttgtgaaagtccttttcctcgctcatcctggctcaaaaagcacctccactgagcaccttgcgaaccccactcctgcccgccagagaacaaaccccctttgactgtaattttcctttacctatccaaatcctataaaacggcctcacccttatctcccttcgctgactctcttttcggactcagcccgcctgcacctgggtgaaataaacagccatgttgctcacacaaagcctgtttgatggtctcttcacatggacgcgcatgaaatttggtgccgtgactcggatcgggggacctcccttgggagatcaatcccctgtcctcctgttctttgctccctgagaaagatccacctatgacctcaggtcctcagaccgaccagcccaaggaacatctcaccaatttcaaatcaggtaagcggcctcttcttactctcttctccaacctctctcactgtccctcaaccactttctcctttccactcttcaatctctcccttctcttaatttcaattcctttcattttctgggagagacaaaggagacacattttatccgtggacccaaaactccggcgccggtcacggacagggaaggcagccttcccttggtgtttaatcattgcagggacgcctgattatacacccacgtttcaagggtgtcagaccacacagggacgcctgccttggtccttcacccttagcggcaagtcctgcttttctggggaaggggcaagtacctcaaccccttctctccttgtctctaacccttctctgcttttctgggagaggggcaagtacccctcaacccctcctctttcacccttagcagcaagtcccgcttttctacagggcaagaacccccaatctcttatttccgcaccccaacctcttatctctgcgccccaatcccttatttccgcaccccaacctcgtatctctgtgccccaatcccttatttccatgccccaaccccttatttccgtgccccgaccccttatttctgtgccccatcccttatttctgtgccccgacctcttatctctgtgccccaaccccttttcccacttttctggaaggtaagaacccccgaaccccttccctctgtttccctactctctcttttctctaggcttgcttccttgactataggcaaccttccaccctccattcctccttctactcccttggcctgtgttctcaaaaacttaaaacctcttcaactcacacctgacctaaaacctaaatgccttattttcttctgcaatgccgcttgaccccaatacaaactcgacagtagttccaaatagccagaaaatggcactttgaatttttccatcctgcaagatctaaataattcttgtcgtaaaataggcaaacggtctgaggtgcctgacgtccaggcattcttttacacatcagtcccttcctagtctctgtgcccaatgcaactcgtcccaaatcttccttctttccctcccgcctgtcccctcagtaccaaccccaagcatcgctgagtctttctaatcttccttttctacagacccatctgacctctcccttcctccccaggctgctcctcgccaggccgagctaggtcccaattcttcctcagcctctgctcctccaccctataatctttttatcgcctcccctcctcacacctggtcgggcttacagtttcgttccgtgactagccctcccccacctgcccagcaatttactcttaaaaaggtggctggagccaaaggcatagtcaaggttaatgctcctttttctttatcccaaatcagatagcgtttaggctctttttcatcaaatataaaaatccagcccagttcatgacgtgtttggcagcaaccctgagacactttacagccctagaccctaaaaggtcaaaaggccgtcttattctcaaaatacattttattacccaatctgctcctgacattaaataaaactccaaaaattaaattccggccctcaaaccccacaacaggatttaattaacctcgccttcaaggtgtacaataatagaaaaatgttgcaattccttgcctccactgtgagacaaaccccagccacatctccagcacaaaagaacttccaaatgcctgaaccgcagcggccaggcgttcctccagaacctcctcccacaggagcttgctacacatgcaggaaatctggccactgggccaaggaatgcctgcagcccgggattcctcctaagccgcgtcccatctgtgtgggaccccactgaaaatcggactgttcaactcacctggcagccactcccagagcccctggaactctggcccaaggctgactgactccttcccagatcttctcggcttagcggctgaagactgacactgcttgatcgcctcggaagccccctagacaatcacggacgccgagcttcgggtaactctcacagtggaaggtaagcccgtccccttcttaatcaatacggaggctacccactccacattaccttcttttcaagggcctgtttcccttgcctccataactgttgtgggtattgacggccaggcttctaaacctctgaaaactccccaactctgttgccaacttagaccatactcttttaagcactcctttttagttatccccacctgcccagttcccttattaggctgtgacactttaactaaattatctgcttccctgactattcctggactacagctatatctcattgccgcccttcttcccaatccaaagcctcctttgcatactcctcttgtatccccccaccttaacctacaagtataagatacctctactccctccttggcgaccaatcatgcaccccttaccatctcattaaaacctaatcacccttaccccactcaacgccgacatcccatcccgcagcacgctttaaaaagattaaagcctgttatcacttgcctgctacagcatggccttttaaagcctataaactctccttacaattcccccatttcacctgtcctaaaaccagataagccttacaagttagttcagaatctgcgccttatcaaccaaattgttttgcctatccaccccgtgctgccaaacccatatactctcctatcctcagtacctgcctctataacccattattctgttctagatctcaaacatgctttctttactattcctttgcacccttaatcccagcctctcttcgctttcacttggactgaccctgacacccatcaagctcagcaaattacctaggctgtactgccacaaagcttcacaggcagcccccattacttcaatcaagcccaaatttcttcctcatctgttacctatctcagcataattctcataaaaacacacgtgctctccctgccaatcgtgtccgactgatctctcaaaccacagcaacttctacaaaacaacaactcctttctttcctaggcatggttagtgtggtcagaattcttacacaagagccaggaccacaccctgtagcctttctgcccaaacaacttgaccttactgttttagtctagccctcatgtctgcgtgcagtggctgccactgcattaatacttttagaggccctcaaaatcacaaactatgctcaactcactctctacagttctcataacttccaaaacctattttcttcctcatacctgatgcatatactttctgcttcccagctccttcagctatactcactctttgttgagtctcccacaattaccgtcgttcttgacccagacttcaatccggcctcccacattattcctgataccacacctgacccccatgactgtatccctctgatccacctgacattcaccccatttccccaaatttccttctttcctgttcctcaccctgatcacgcttgatttattgatggcggttccaccaggcctaatccccacacaccagcaaaggcaggttatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagttcgaggatttgccccacccaggactggcaaattagctttactcaacatgccctgagtcagataactaaaatacctcttagtctaggtagatactttcactggataggtagaggcctttcctacagggtctgagaaggccaccgcaggcatttcttcccttctgtcagacataattcctcagtttagccttcccacctcaatacagtctgataacggacgagcctttattagtcaaatcagccaagcagtttttcaggctcttaatattcagtgaaacctttatatcccttacggtcctccgtcttcaagaaaagtagaatggactaaaggtcttttaaaaatacacctcaccaagctcagccaccaacttaaaaaggactggacaatacttttaccactttcccttctcagaattcaggcctgtcctcagaatgctacaggggtacagcccatttgagcggtatagatgctcctttttattaagccccagtctcattccagacaccagagcaacttaagactgtgccccccaaaaaacttgtcatccctactatcttctgtctagtcatactcctattcaccgttctcaactactcgtacatgccctgctcttgtttacactgccggtttacactgtttttccaagccatcacagctgatatctcctggtgctatccccaaactgccactcttaactcttgaagtaaataaataatctttgctggcaggactatgctgaatctccttaggcactctctaatcagatatcctgagttgtcccaattcttagaccttttatacctgtttttctccttctgttattccatttagtttctcaattcatccaaaaccgtatccaggccatcaccaatcattctatatgacaaatgtttcttctaacatccccacaatatcaccccttaccacaaggcctcccttcagcttaatctctcccagtctaggttcccacgccgcccctaatcctgcttgaagcagccctgagaaacatcgcccattctctctccataccaccccccaaaaattttcgccgccccaacacttcaacactattttgttttatttttcttattaatataagaagccaggaatgtcaggcctctgagctcaagccaagccatcgcatcccctgtgacttgcacttatacgcccagatggcctgaagtaactgaagaatcacaaaagaagtgaatatgccctgccccaccttaactgatgacattccaccacaaaagaagtgtaaatggccagtccttgccttaagtgatgactttaccttgtgaaagtccttttcctggctcatcctggctcagaaacacccccactgagcaccttgcgacccccgactcctgcccgccagagaacaaaccccctttgaatgtaattttcctttacctacccaaatcctataaaacggccccacccttatctcccttagctgactctcttttcggactcagcccgcctgcacccgggtgaaataaacagccatgttgctcacacaaagcctgtttggtggtctcttcacgcgcatgaaaataacaaaatttactaccagtgaaagctgaaaagaaaatgagctcttttttggaaacaataggtgaataaaagctaaaattgatcaaagaaatgtttcatttattggacatatactaaagaaaatagtataaaatatattgtacattttgtttcttctagagcaatatcatatttcaagtcaaatatctagtaaaccagcaatatatagaaccataagtatgagcgtgaatatagtcaaaattaaaaatacacaatttacatgattgtaaaaacaatcacatacaaataagcagaagcttcataaaaaatgcaagcacctaagcattaattattgaaaccggaccatgaaattggacaactttcactatgacaaccaaaaaacatgatacagaaatataaaagtaaataattgtgtttacaaatgagttttctttaaaaagctacactgttaagtatatcaaggaaaggggataacgtctgaaaaataatataaaatctaaatattctgttttcagttacacaaattcaaaatgcaaggaattgtgattactataatgctagcattagtatttcttcaaatttatcaaatgggaaacctcagcctaaactacataagccctaaggttttaagagatactgaaatatgtgctaaacacttaataatgtttaatttgatgatctaagtcatatttgtcatgtattataaaaccaaaatataatttgcctttcttcattagtagtctagtaattacttaaggtcataaactatatgttgatagtttctttatttcttatgatttggcatcgtgcgcaatactttaaatgctctacacaataaatcattttcaaataaatgtgttaattattcaactttgcctctttaacagcatatatgattgacttatgttttcagtcagtttagcatctcaagagtctttttgaagtgattcttctgaataatcaagtttggaagtactacgttatagggatactaatataactgtagtttaaaatattttactttgtaaaaaatttaaaaatgaattaacctgaaatataagttatttcccatgactcataaataaattcctaatacatattttacctacatctattagttctttttatccatttattcatttaacaaataatatttattaaaggtcaatgtgctgggactgtgtaaggtgttaggcatacagtagtgatagaaaaagaagaaaagtatgcaaaaaaattgacaataattttattccatttgagcctataattaagtgagagaaacagatagtttaaccatataattataaatttttaaatgtgctgtgaaggagaaatcaggatgctccaagataataaaggggtaacattgagaagaggaaatcatggaagtcttctttgaggaagcggcatttaaattaagacctaaaagacggaaagcatatgaatgaaagttatctcatcactgtgggagcatcataacaaataagagaaagataaaatgctaagtgaagaaattgaacgctaatccagtaatacaggatatcgattatgggcttcatttttatagcagtagaaaaccattgaaggggtcaagcatgctaattatttgagtgatttcaaatgtaatatagcccactggctaatgaatgaagaagagggaaagaggagacataaataatactcatagaaggacatttcacaggtttaggtgaaagttgatggtggcagtgaaagaaaaattaaggccgggcgtggtggctcacacctgtaatcccagcactttgggaggccgaggcaggcagatcacgaggtcaggagaaccagaccatcctggctaacacggtgaaaccccgtctctaataaaaatacaaaaaaaaaattgccgggcatggtggtgggctcctgtagtcccagctactcaggaggctgagacaggagaatggcgtgaactcgggaggcggagcttgcagtgagctgagatcgcaccactgcactccaacctgggcgacagagcaaaaaaaagaaaaaaagaaaaacaggtagatgcattaaataagtatatgagaaaaaattggtaggaggtggtaatagattggagatgggagtaaatgagtatgtttcaagaataactttttccaatcaaatggaaggtgttgctattttcttttccttctttcttttttctttttcttttctttttttttttttttttttttgagacagagtctcgttccgtcacccagccgggagtgcaatggcgcgatcttggctcactgcaacctccaagagattctcccgcttcagcctcctgaggtgttgctagtttcttagattggggaatatcatccatttgaaaaaatgctgatagtgtaatcaaacttggaattcaattaaagtcctaagcatgagtgaataacctgtataagttcagaattacatgttggtgtatatatttcaattctaatacaaataggtttagccaagaaatggagtggtctttagaaaaaaataaaatgcttcaaatatcaaaaataaattaaaattgtgtactaatgtaaaaataggtccacatttttgtaagctttgctcatgaagactttatccggtatttgctgaaatactgaaccccctcaagaccttaagtaaatataaccctcaaactttaatcatgacattatacacacaaaccaaagaaaacaaaatcattatttgaaagaaattgtcgtctatggccataccactctgaaccctcccaatcttgtgtgaaataaattgtcaagagacattaaaatacgatgtagttttatcttaaacttgaatatttgaaattacaaaaacagaatttaatatgtaattttatatgttatgtacgtgtcctccacagagcactaaataacacaggacactcagaagtatatacagataaggtagcaacaaatattaataatcataagtgctttacataatttatgagaatggtacagtaataatagcaagttaccacatgcagcatttgctaagcatgcatgtgatagtagtttatatagttagtttaataatcacaacactcttttgaggttggtactattattatcaccattttaaagattggaaaactgaggtacaaaaggttatgtcatgtaatggtacaaagtggcagaaagaaatgcaactagctagcctgcctcccaattctattgtctttaaattggattctacttcatctctgtcacttaaaaccctcgttaatttggaacaatcatctgtcattatattaactcacatttttctataaaattaggctataaaaataattatgttcaaagttttttcctatgatatattacctatgatatagaataactacctatgatataggtatgataattacctatgatataggtatacctatgatatagaataactacctatgaataattacctatgatatagaataactaagaaattaaaatatttccaatttaagagcaggaaggggtagcttggctaaagctgtgaagttagagatcatctcgggaaaggactatgtgaggtgatacttagtgtgtgatagaattcttacgccaaatagaacatatatctaaaattaggtgttttctaaactcattgagggtacattagtcgagggaattaaattctatggacattaactgaattcctactgtgtgtaagtcattatactgaccactcgtggttagatcattaaaagtttttgtcttaaaggaacttacagatcagtaggggagacagacacgtaaaagttagccttaacgcaagccacaataaaacatgtgggagatacagttgatagctggtacgtggaagcaattaattttgacttgctaggaaaatatagcctttattaaagaggtaacaattgtactgtgtgttaaagattttcttttttaaagatacaacttggatcaaaccttcaacctgagagagctctcaatagttacagaataagaagaatattccatgctaaaaacaagtaaaacaaaaccctatatattattctcggattcataacatgaagggatgtagcaggagatgaaacaaatatatttaagagtattacatagatgtccttgactgtatgtgtggagctttcttccttccattggtaggttttccaggagggtgaggatctgttctgactcagtttcagaataatcatctgaaacagtgtggtaggaaatccattgaaatagccagattgcccaacatagtttactgtagtagcctaaattatggcagcacataggcatggaaaaggaattggtggtggaaatgggaatgcaaattggtacagtcaccttagaagacagcttctcagtttctaacaaagatatccatattcattctatatgatccagcaatcccactccttggtatttaccaaaaggatttgaaaatttatgtccatgtaaaaaaaaaaacttagcatggatgattatagcagctttattaataatggccaaaacttgaaagcaaccaaaatattatttcatggaagaatgaataaataaactgtgttacatctagataatggaatattatacagccctgaaaagatatgggctattatgtcatgaaaagacatggaggaattttaaatacgtattactaagtgaaataagccagtctgacaaggctacatactatatgattctaaacacatgctattctggaaaaggcaaaatcatggagactgtagaaagatcaatgattgtcaggggaaggaagcaagcaagggggagggaagcataggcagagcacaggatttttagagcagtgaaactcttctgtgtggttctataatggtggatatatgtcattagtacaaaaccataaaatgaagcaccgagagtgaatcctaatgcaaactacagactttggatgataacaatgtgcgaatgtaagttcattaattgtggcaaatgtatcactttggtatggggtgttaatattggggcaggtatgcatctgtggggacagtgagtatatgggaaatcactgtatcttcctctcaattttggtgtgtacctaaaactgctcaaaaaaaatctttaacaaaaaagatgaaatgatgatctacaaatacattctaaaatagaaattgcctaaactgaacaataatttggatgtatgcaggtaaagcagagggaaaacaaacaagactgcaaggtgcctatcctgctgcctgtggaacctaaagattaatggtgtgcatcatgatatagctgcctccaacacgactagatgcatgtttttgagtgtctgtgtttgtttattaaaataaagataattgattagttaatgtatttttggatatgtgcaatttgaagtgcttgtaaaagatctactttgtcatgtccagctgatatctggaatgtcagcttgctgcttgggaaagaggtcattacagggcatttaactttgggagacaagtatatatagaggtgatgattgaaaacttgagaacagatgaaaaagagaagaagtatatatacgtatttgaagaacgttaatttttaaagggtgataattgaacaaggggccagtaacatctctcagccaacagagaagtaggatgggaaccagggaagtttttcataaaagggtatagttgagagtttcaaaaagattaaggacttttgactttgacatgtagaaatagactgatgggatatctaattttatatgattttagtggtgtgatgtgagtgaaacccagagtatattctatacaagatagataaatacagatagaaatatagagatagatatagatcaatatatgtatgcaggcacttagattgatacatttttgtcgataaggaaaataatcagagtgggatagaagcatgaagaattatatctgggagtagggattagaccagaacctggggatgttaataatgttaattgggcaaagggaagggattagtcactggagagagattattgcatcaaaaaaatagaataattggtggagcacagaaattggaaggagtgcagtctaagacaggaaagaagagtaagaagcatcacagaagaagggaaggagaactaaaaaacaaaagaacaatgaaaagaagtggggtgaggatcagaggactcaactttatgtgggattccatcttaatgacttaagaagtaccagaatctacaatgaactcaaacaaatttacaagaaaaaaacaaccccatcaaaaagtgggcaaagaacatgaacagacacttctcaaaagaagacatttatgcagccaaaaaacatgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggattgtaaactagttcaaccattgtggaagtcagtgtggtgattcctcagggatctagaactagaaataccatttgacccagccatcccattactggatatatacccaaaggactataaatcaggctgctataaagacacatacacacgtatgtttattgcggcactattcaccatagcaaagacttggaaccaacccaaatgtccaacaacgatagactggattaagaaaatgtggcacatatacaccatggaatactatgcagccataaaaaaaggataagttcatgtcctttgtagggacatagatgaaattgggaatcatcattctcagtaaactatcacaaggacaaaaaaccaaacaccgcatgttctcactcataggtgggaattgaacaatgagaacacatggacacaggaaggggaacatcacactctggggactgttgtggggtggggggagggggcagggatagcattaggagatatacctaatgctaaatgacgagttattgggtgcagcacaccagcatggcacatgtatacatatgtaactaacctgcacattgtgcacatgtaccctaaaacttaaagtataataataataaaataaaatttaaaaaaaaagaagtacaattattcagtggtacttttaaaatattgttgtttaaaactgtaactctcaaaattggctgcatattagaactgtttcaatttcttaaataaaatctgtctaagtgagtccgttatgggtggccaaatcatttaaatacaaacatcttagaatgaagtgctggcatcaatactttaaaagttcctcaggcagaatgctaatagtcaattatcattgagaatcacagtttaagagaattgcagatgtttgcgaatagtgtttatggagcattaattggatagctagctactagtatttaaattgacatcttcaaaatattaaaatctgtatcctgtatagggagtaattgtcttttcaagaaaactagcaatgtgtggattggtattagtggagcatagtatttattagtttcaacctatacgattgcattgacatctgataaaacggtctgcatggaatgaaaaatgaaattatctcatgcagtaattttcccttaaacaaaatatgtgctaataatgtgattatacttcagctccggttacggaagatgatgttggtgctttaaggcatcactcctctaagtgttgttcatgacccatgtgcatgagaatcactccaggctttttgaaaaaatcaagtgtaagagacatatataaagtcagaagctcaatttataactgagaacttataacaaggatctggttaaaactttataaccaactcatttgctccttgcagacagggtagatacttaataagaaaaatatactgtacttaaaaaattgagtatgcactcacatcaggctaaaagagtctcatggctacattgaaaatgacaataattaaaacctgttgcccaagtgtctctttcctttaaagtgctcattgtcacttttgtttctgacactttcagtctttgacatcagtttactaaccacaaagtaaactgatgtatcctgtgtcaggtcaatggggaaaggcagggttgtgatgaggtgtagcatagggacctatgtcatgactcttaaagggtatatgtagatcagagttctgtatcaagtttctttgttttaaaaatattctctcaatgagaactagtttatgtctaggttcttggaggatgttttatagcgagaccattcttctaccacataccagaaataacattaaaatactaattataaagcttaatttgttgacttaaataatttttaaaattgtgggcatgctgacacaaacaacagtctatcttcataatctgcatagttcaggaaaatatataaaagtcttgaaaggcaaggaaatatctgttttacaaagagatacataagggaaattaacttttgtagacttcaaatgaggaaataagcctttgatcccctaaggcaaacatttttgagatacagtttctccatataattgctatgattttcttacttacactttgtagttccctgctggctgtttttctgtgtaaacttactttcatttccaattatgtcattatagagatgaaaatcagctctaattaaataagaacatgacaataattgtcattcatttatttatgtaaactatgatttttctacctgtgaaaaggtgatttagcaaagaaaaatgtagctctcatggtccatcaattgactggaactaatagtcatgtatctacagcttcccattctctcatatctttattcattcaatattacttgtctaagggtcttcctttctttcatcttcaaataagcatttattaagtagctacactatatttattttattttataattttaacttttatttcagattcagggggtacatacgcaagtttattacctgggtatattgcatgatgttgaggtttggggtatgattgattctgtcacccagatactgagtatagtacacaatagttaatttttcaattgtctcttctccctctctccctccatagtagtccccagtgtcttttgttgccatcagcagctaccgtattaaacatctactatatgccatgaactatagatacagatgccacagatacagaaataaactagttacagttttgccctgaaatcaaatgctttaaaacacattcattttattaatgtgacaagtaccataccaatatattaaaaaatttaccatagcagtttgaaacgttttttctctctttaccaaatacacagcagaagctatttacacatagaataaacattccggtgaattcccagtccccaggctatcatgtcaccccttctatagaactcaagaaagcatatcttaattcataaataaaaaataatagcattgaatgatttcttttttctttcacattttgcttgtttgtttgttttttgtgtttttctttttaagacggagtctctctctgtccccaggctggagtgcagtggcgccatcttggttcactgcaatctccacctcctgggttcaagcaattctcctgcctcagcctcccgagtagctgggactacaggcgcatgccgccacgtccggctaatttttttaaaaatttttattttagtagaggtggggtttcaccatattgcccaggctggtctcgagctccttagctcaggcaatccgctcgcctcggcctcccaaagtgctaggattacaggtgtgagccgccatgcccagctgcattgaatgatttctaattttaattaacaattaatgcaaagttggtgatgatttatccttggaataaatatttactgcatggctaatatgtctgccatgtgctggcattacagtggcaaacaagacagccaaagttgctaacctcctgagttttccatttggagtaagggaaagaagaaaataggttaatttcagatatgggctatgaccttgatgagagaggaaaagagagaaaaaaagtgtgtgtgtgtgtgtgtgtgtgtgtgtgtgtttgaaataacttatttaagtgtaataagcacagataatggtaaaaataagataaatcaggaataaagatgttgcctgacttacatgttttcaaagttaccatttactatctaacttaaattttctctgctgtaatgattatattttatctaggtaaccaatatctagtgggattatgcatcaatttactaaggcagttttttgtatttatctccaagtgaaatttaatcaatttctacagtagtgaaaagtaatttgaagatttaatatattcagtattttaataaaatataaactggtcaaatagctatgcttttttttttaaagtaacaaccaagcatttattcacttactacaaatagctatgtttacctctaataaccagttaagtctcctttagagtccatatagatatgcttttatttgtttttggttttttgtttttgtttttgtttttttttgagatggagttttgctcttgttgcccaggctggagtgtgatggcatgatctcagctcaccgcaaccttggcctcccaggttcaagcgattctcctgcctcagcctcctgagtagctgggattacaggcatgcgccaccatacccggctaattttgtatttttagtagagacagcgttggtcaggctggtctcgaactcccgacctcaggtgatccacttgccttggcttcccaaagtgctgggattacaggcgtgagccaccatgcctggcggatatgcttttatttgaaaagtaacagaaatttaaagctatttaaactaattatgctatacaataagtgtgaaatcaatttctgtttcttaagtaatttcttcatgagcatatcgtataatgcacatgtaaataacagctttgagtgtacacttatattatgtgagtagttacctgtatgacactgtccccaggtctcatgtctgtataaacatacacatcataggatatttcagggaaggttggcgtgttatcatttgcatccatcacttgaatattgacgatgactggctcactttcttgtacaccatcaaatgctgttatctttgggaggagaaaaatacacttagtagagatgttctgcaaatataagtagtacagagtttgctcttacagtttaacaagtttcttacaggtaatcttacaatttgaaagggtgcaaaaatattttgttgataaaaggacgtaatagagacgtaatattacatatattaaaagtgttctaatatggtaagaagcaagtattgaagattttgttttaaggtattcaactccaggcatattttaaataatcagatatgcaaaatatcatttaaagtgggccaataacattgctgactcttagggttaactacaatttaatccttaaaaacttaattggaaaatattatttgcatttacatattttgtatacaatagttccttgtacagtcaatgtgtttataccatcaggaaggtagacttcctagatgtactttgtatcacagtaattcacccaatggcaattttcaaaggactaagtggtatcatttaattgtgatattttatactttatcaatgttgataatgtatgttatactttatcaatgttgataatgtacattatcaagattttaacaattcctgccaaatcagtgctacagcaccaccatctttgtctaaatccactttgtatctaacttttaacaatcacataaactttcctggaagttctgatctttttctatgtaggcttctccagaaataatttctacatatcttgtttaacttgtgctttctcttagctcatctttctcctgtgactgattcaaaaattgggatataattagaagttacattttttctttatccaactgtcaaccctactatacttgttatttacgtgtttgtgtgcatgtgtgtgtatgtttatgtgtgtgtgtgtatttccctatctcatgataaatatttacaatcacaactttaataacctttactttttttcccccttgattagcctaacccatgatttatctacctcagtgctattgacaccttgggacagataactctttattgtgaggggctgttctctgtattacaattagcagcatcctttatgtctacctactagatgcctatagtaactaccccttcacaattgtgacaaacaaaaatgcctccagatgttgctaaatgttcactggagggaaaatttattccctcttgagaatcactggctcaaccttatgactaaataaaaaatgcaagaacaacaacaaaaaaggttaggaaataattctttatacctcaatttaagacaattatgactgtttagtaaagactgaaattctcactttcttttttttttgaaaagttttttcttctgtgaggaagaatgttaatatagctacacaaattacaaaaaaagagcaatacatgtaaataatttttcattgatcttctctctggtattgaaaataatgtatttttcccccaagtcattgattttttcagttttaaccagacatctctttcagttccatacaaacatacatacatacattcatacatacatatgtatatttacacaaaagctctttaccgaaaaggtgtaagtttgctgttcttccctgtccactggttgaagtaaggtgaggtagcgagtaataccagtctgtgtgacggtgaagactgaggtgtagtcattcagaaaaaggtgaagctctgggtcttttgtctttgaaaaaaaatgacatcgtttcaaacgttgaataaataatgtagctattagttcattacctagaagttaatgtttgaaatttatagcaaaaatccacgtgaaagtattaagaatttctaacgataaaagatatttaactagatatttactcaaatgatctaaactattcaaaagatggtgacctatatcgtggaatacaaaatactgaaatacaaacaggtataatcaatgtgggaaaaaaggaaaaataatagaaaaacagaaagaatataaaaactcccaattaaatatattcttactgattatttgttatcaatattttccaaaatagcattggactggagaaataagaaataaaagcaagaaaagaaaattgcatttcaaaattttagcaataagactttataattacttcatttatagtaataaactgcatatatacatattactatcttgttcttacttataatgcaaaatagaaataaaattggttatgtattattcattacctataaatatcatgcttactctttcttattttaatgctgtaaaattttccaaatggaaacatgtttactttaattaaaatatttcagataatttgatttaaaatatgcataaatttagcaaatgtgtctgatagaaaagtctagaaaaaatgatatatacttaaaaaggaagggatttcaaaattcaagtctgagagacaatcaacttagcattgaagaccctttgcaatttcattgccacccctgaaacagaagacaacatactctaatttagagaaagaacagcaatataaagtaagaaggctagcactgatgtctgcatagtaggaaagaaaggcaggtggagcgaagaaaaaaggaatattcagagagtggactattatgaaggctttgaaaaagagagaaaggagtgatacagggaggtaaggtgttgttctagattatactatcttttaaagtatgcatagcatgatatgaaatggatttaatatcataaaacacttctttaagtctgatgtcaaggactgaggcaagagcaaagaatagaaaattgttaaatgtgtttaatttgaaaataatagaactcataatttcaaaatttctatgtaaaatacaaaagttgtaatgcacactactataataaaatgtgaacatgatttgatccacaatatacttgaatctgcccatcttttaaacattgtgatatgtgtagatttcaaataaccttgaaataaatggtttcatttgaacctaaaacaagttatgtattcataatatctcattctgtagtagcttctatgttcaggattttgacttaaggtcactgtgctacatttatcctggaacaataagaaagtaatactacacataataattccaactggcgtatttattataaaatgatcaaaaatattgagaaaaagttcaagaggcttcacactctgatattttcaaacaggcacttcagttgtttccatttcagtgtcatgaacccaattactcagataactagaaagcgggatattctaaaaaatctaacatgttagttttaaaaataaattatgtatttttaaaagtcaattagaaaatgcatatgtctattctgaatgatattttaagcattcttattttacactttagagtgaattgtgattaaattcaattattagagttgataaaaaagttttagttaacatgcagtttcagtcaaagaaactctaagtatgaatgtctgccatttgttttgtgttcatcctggatttacctaatcactgggcttttaagcacatatacacttctctaaatgcaccaacaatggtgccatctggcatgccttaatttattcggacctttaaaccctaaatgcaagctgaggaagttttgctatgtaccttgtttaccaaatatttactttgttccttttgttcaaatctcatcattctctacttcctttataccttaattctctcaatttattttcttcctttcaaccgtaacctctgttaataaatttgttaggtatattcactcatatcttcacatttttaagcatttttgtgtgtcaagtatttcgataatgcaatatttcaataagtattgagttgtcaactagtgtgtccaaatgtgactgtagtataatatgtttgtgtcacaaagagcacttactttttaccactttcaagaaaacctctaggttttgtttgtcaaatgcttttcgtttgaagataatgcacacatcaatactccataaatagacttccttatattggataaacagaaacattaaagatcttttgttaatttaactgtctcagtttcttgagtgcttttataataactagctggagaaagataacatttcccagaactacagtgtatttgctttttgtgaagaagataatctatcacagaaagctagcactatacatggcatattatagctcattctgttttgtttagttaatctctgatcaaaatataacatttacatttatgtatatttaaaataataatcttgtacataaatgctactggtaaatatcctcgtattaatttaagtaaaaaaatttaggaagccagatttggaaatgttcaacaaattgtcactcaatgtttaataatttatattcatttttaaagatagtgcaagtttcaaatgttgtgtatatatttatgttccaaatattacagcatatcattttatgagttttatgaaaattttaagtaatatcaacataaaatgttaatagatacatatcagtaccaactaacctattgttttgattgacaatatttacagttcaaggttttgctacccttcacaagaaaggtgtatcaaaggtttggtaagaaacaatgtgcatttgaagtcaaatatccttctctaaatctctttataaacttaaattccttcttgtcaagctgcattccgatacagtttgaatttcacaaatatatttgaattttgcaattcctaaagagtaacttgagtcaacacttgtatatttgcaactcttttaatcatgttagagttaatagcttataagtttcatagactaggatgtacatggacaaataatgctctggcttaatattccaataggggtagcagactttaggtagctgttgtgtctataagtttatttaaaatgaatttaagtgttaaatcaataggtacacagagagttgattaaaaaccgttaattttcctctgacattaggtaatatttattttaccctaaaatatccagtcagtatataccaaaagtatgatatattaattcacttatctgcatattatattttgagatggtaaaataagctctgacatgcacacataaaaacagaaaaaaatgcaaaagtaaatgcatatgaaaacacacaggtaaacaaacatatgaatataaaataaacaagcattctatcatataaaactatgttcaaagatgagagtctactgtttaaacaccaacttggggtttctaatgggaataaatataggatatcacaaacacacaagaccatatgcatgcacatatataggcacatacaacacagacatgtatagacatatgtgcacatatatatgtatgcatatacaagagcatacatataaatgacaaagcataagagaaaaatgacaaaaaaatgttatctcctcagccagttttaattacttggtagtagttgcctgagtatttagttcaaaaaaattcaatttcaaacttacaatgttttagaaaaaatgccatgataaattaccaatgtttgttgtggactgagaaaacattaataattaagcagtctttgcctcagttgacaattaaatttggattttacaaaatttcatagtactataaacaatagattatgtaaatatttttaccttttttaactttaaaatatttttaaattttaaaccaatgaagtaagtatatttaaatttatataaagtatttgtagatatccttataagggataatgaagtaatacctacgtgttttagtgaagaaaaaaaagaacaaggaaataaaccacagcaattaacaaaagaacaatcacaagcttaacacctagtacctacaggaactccactgggtggaacctatacgcaaattaaacatgaaataaatattgtaaatgtaaatgatcacaaccgcacatatgaagaaaaagcaaaccacttccagcacactagactgacaatttttttcagagtatacaatttttttattagcattgtgacccacatataatggaataacgatatttatgaagcatataaatacttaactgctttatgagtatattgaattaaatatcaaagatacctcttcatagtaaaataacgttaagcagagaaacaaatttacatgaagttataaataagtatctttttacaagccaaatgagtaatctttattgattattattctttgtcattttttatgatcagcattcaataatcaatttttagcatctctgacactgaaaacctggtggtctcagacatgcctcttaacaccttgtgccttacctattctacttatattatgggttattttgaaattatgatgtggtacaagtactctaaaaggcataatgtataaactgatatggttcatatatgtatacatgcatgtgtatgtgtgtgtgtgtgtgtgtgtgtgtgtgtgtgtgtgtatgggtatatgtctacatctatatagcaataaaaagaacactggtgcaaatatttcttttcctttcttttcagtattactgtggcccttggaattctttctgacttaaaatctacactgtgaatactatcacaactcacattcctggctattgtttcttaaaatgtggcttcactttccactaaattaaagggagaaacacaacttaaattttacgcaaatggatccaaacttgtccccttcttggcatttaccatctggaatagctatgcttgaagcaactcttgagagccaagccctgcaatgacaacttccacttttatgcttgaggcttaatctctaatactatgctgatattgtatgaggtggcacactgtctctctcaaagagtttatccctataatgatgattgtcactaattctgacactcaaaagcaacaggattttgtttcattttgttgaattagggtcccaatttgtcatctagcctgcagtgcagtggtgcaatcatggctcactgcagcctcgaaccagtgggctcaagggatccttctgcctcagcctttcaattagtgagactacaagcatgaaccaccatgcctggctaagttttttgtttatttttgtagagactgcatctccatatgtagccaaggctggtctggaactcctggcctcaagccatcctccagcctcactctcccaaaatgctgagattatgagtgagccaccacacccagccaagagtggcatgatttaccttgaagtaaaattcatgcccataaactaaaatggctttaaagttttcttttcataatacagatcttttgaaaatcccagaaatgaactaatttactttataaaaataaatggtgctcggtctataaaaaacagatgtatcagaaggacataaatccatcttctaatatatgaatgactatttcatagatttattttgtgtgctggcaaatggaagatttaaggaataatagatgaattaaaagaaaactggtttcaactcagtatgaaaaacagctttctaagaattagagttgttcaaacatgggataggccatcttgtgaaatacttaatgcaacatcattagcatctttgaagcatctgttagataacctaattcattcaatagtgactgaatttatgagtttattgaagagttcccaaaccctattaagtgctggaaactgtgttagttcttcagcatacaaaagttgctaagatataggacctattctcaacagatgtaaactcatgagggagaaagacattattttcaagttggaagtatagaattagagaaatgcactgagggaggcatgcaactaaaattggataatgaataccgtggaaagattctcgaatgaaggaatgcctgaggtgagctctaaacactgagtataagttatccaagccagcctgtgcaacagatgaaagatttcaaagcctagaacatgtaatgagcaaacattagacaagatgtagcttggcacatgaaagaaacgacaagcagttgccaaatgttataggtgaattaggaagtttccaaaactcaggccacaaaaatgttcaggtatcaagatacagaaaattgtgtgagcttaaattttcttctctagaggaataggtgtcataaaagtatatcaaatagaaatgtgggccagacgcagtggctcatgcctgtaaacccgagcaaggtgggtgtatcacttgaggtcaggagttccagaccaacctggccaacatggtgaaacactgtctctacaaaaaatgcaaaaaaaaaaaaaaaaaaaattagctaggcatggtggtacaagcctgtaatcccagctacttaggaggctgttgtgggagaatcacttgagccagggaggcagaggttgcagtgagcctggattgtgacgctgcactccagcctgggtgacagagagaaactctctcaaaagaaagaaaagcaagggaaagaaaaaaaagaaaagaaagaaggagaaggaggggaaggaagggacggggggaaggaaaggaagggagagagaaagaaaaaaataatgaacggagagaaggaaggaaggcaggaaggcaggcaggcagaaggaaagaagaaagaaacaaaggaaggaaggaagaaagaaaaaaaaaaaagaaagaaagaaagagaaagagaaagaaagaaagaaaaagaaagaaagaaagaaaaagaaagagaaagaaagaaaggaaagaaggaaggaaggaaaaagagaaagaaaggagagggagagagggagagaggaaggaaggatgtagttagatgttagatttgagcttttgaataaatcactctaatggccctgcagaagatagacttgagtaagaaatcaagagaccaagaacatcaggaagtaattctaataacagaccaatagggtggtggttataaggatagagagaagaaaagagattaaataaataattaggggacaaaataggaagatctggaagatttcttagttgtggcgaataaagaaaacataaaaatcaagcaagacttctaggattctaggttgcatagcacaataaaacatctatcaatttctgggaaatgggttttaggagaggatttcatacagtactggaagtttaaactatttctaatattctatgagcttatttatattttatatatagaaactacatatgatatttttaaaaattttattactagaagactaggcatacttgttcactctctggacacctaatgacagtcactcaccatagattattttagaaagggggtgagtctaagtaataaacaaatgatcagttttgctgattaattacttgacacttttataaaagttatgaagcatgccaccctccatgtacatggcatcatctcagggaaattttctctccatgccctttcctaccagtcccaactaaagacacataccaaggcagcaatgattgctaccatatagatgactggacaagagggggcacctgatgagtatgaaactcacaatgttatacagctattacatgacagaaccaggagtcaagccaagatctgtctaaatccaaagcccaaactgccaaaaacacttcagagcatttcatagactaactggtactgtacatctccaagagttgaattataagtagtgtttctcaaaggttttagacccctgagctctctccactttatttcatcaatgccctgtgagtactactgtcttttacaaagttccttggaacacaattttaacatttgtaatttaaaagtgaacagacaatccagacaagtacggggtcacataggcaagcatagggcttagtgtgtaaccaatagataatatgaacacactgagaaggtataaatacataaattttgctattgtgtaaacttaaaactacctaactttagatttagatttttctaaccaccagttctattaaggtatgacctaagctatcatacactttcaaattgattagtcactacttaaaatatgagtatgtattcaattgaaaagcaaaatccgcactaaaatttgtgggacattagtagatctacaaaatacatttgctcagcctggattgaagttattaaggtgactctaggtgttttctagtggggattcagtagagacttttttcctgtgactcatgaaacccactatacatcagagaatccctaaattctcttgactggcatatgaaactgtgtatagattaatgtgttcacttttctaggaaaagaacctagagcattcttcagctatcattatagtcagactatgatcaaagtatataaaatatagagtgcttaaaattgagaactttgttttccataaaccttggcttaaggtccatttctactgtttactaacactgtgatcatggtaaggcatttaaactagctttaatatccctttctgaaatagggataattgcatctatcatgtttgttgtgagatttaagggaattaatgcaagaagaatttactgtattgtttgacatgtactgagaactcaatgacagatattgttaaaacttgtggtttaagaagacactaaatgtgagagaccaggaaagattgaaaaaaaaaaaaaagctagaatggaaaaagaaaacaaagcaaagagaaacaaaagaataaaataaagcatctggtgggaagaggtggagtgccaacaagaattgtcatagcctctgtggagtgttacaaaatttatttagaaagagaaaaaaaatctgaaagtgccttcctaatttcctgaagtgattataaagctatgtgtaatgagatattagggaacattctagagctctgctgccttatgagtgacatgtatttatatttaatttcattaatattaagcaaaatttaaaagttatgtttttagtccagttaaattttaagtactcaatagctgtataagactagtggctactatgttggacagtacagttacacagtaattccatcatcacaaaaaaatccatctatctgagagcaagcactgttaagggagaaatgaatgaatcaagaattatataacagcaagtaagaaatccaactatcttttacatatagttatgcttataatccaaacacagttgtatttacttgctgttttatatatatgtgtgtgtgtgtgtgtgtatgtatacctgtgtatatatctctatctatctatctatctatctatctatctatctatctatatctgtatgtgtatgtatacctgtgtatatgtctatctatctatctatctatatatatacacaaaacatatgtatacatatttatgcagtgaggatactgtggtagttcacaaactcaaaggaaaatctttgggaattagaatacctctggggaacttaaaacttaaaagacaggcactcaatgggactctcttttctgtgtgtatctctcaggcttcattctctcccactgataattggctttctcatgatgtcagcaaatgtggctacaaaggtttcagattcatttccacttctctaatacatgataccaaagtctttcagcccttctgttctccattgtaaattcctgggaggattctggctagcctggtatagattttctgtccctttataacattcactctggctaaggaggtaaagtgttctgatttgctcagcctggaccatttcccactcatgtagatagtgtgagtacaagaaaaacaaaagacaatgatttgtggagtgaagcgtaagcatccacatagtcactggcagaagtatgaatgggtcagctgcctcaaatatattttaataacgatgccctcagacttgaagaaaagtctctgagaatcacaatctaggggtgctttcatgattttttactcatgtagtaacaccattatttttgctttatcaataattatataaaacagttctcaacatatgttaataaaaatattgccctcgtcattaaataaacatcaagtaaaacattcattttcttacatatactgaatatctgcaagctgaaaaggaatagttattgaattcaaagatactttttaaaatatccttgttttggaattaaattataacactaaaactcacttacagtgacttaattctctcttctctagcttatgtagccatatctttgtcatatttcccattaatggaaatatgagatttgttacacaaacaagagcaaaatatgtatttaacttacatcttctatgtccttgtccagagctactattcttaaaggtgaagtcaaattgagactgtccgaaatggttgctcccactggggcagattccaggatatagccttgataactgggcattgtaaaatatggactttgattgttttcatccagtatttcaatgtgtagaccggcaaaggcaggaagaggatgaccattgtcttgttcagcctaaaattgaaaagaaaagaaaatatttagaaagtatatgtcgtgctatctttttggagtttcacttttcatgcaatatatagggttctctttttaactaatatcatcacataaggaaaaaatacgttaaagggccatttgaaaatataaatgaggaaatgaaaatccagtgaggcttaattgcttcagtcttctgttttaaaactcagtgtatattttaaaaattcactgtaataaattattattattttattttatgtttttattttttgagacagagtcttgctctgtcgcccaggctggagtgcagtggagtgaactcggctcactgccagctcttcctcctgagttcacgccattctcctgcctcagcctcccaagtagctgggactacaggcgcccaccaccacgcatggctaatgttttgtatttttagtagagacagggtttcaccgtgttagccaggatgctctcgatctcctgacctcgtgatccgcccgcctcagcctcccaaagtgctgggattacaggcgtgagccaccgcgcccagccaaattattgtaatttttattgaatgcagtaggagaggtaattgtgtttaaatacatttagtcagaaaattcaaatggagatacttgagtgtaccgctgataaaatatttaaataaaagaaaaaaagtaacacaaataaagaactatcgtatcgactttgtctcttctgtgtcttctcattttacactaatgtttaaatctctgctatggtctctgctgttgtaccccccaaattcgtaagttgaaattttaaccccaaaggtgatggtattaagaggtgtggcatttggaaggtgataaggtggtgagggcagagccctcattaatggggtgaatgcccttatagaaaagggtctagagggctccttttccccgcctcccaccacgtgagaacaagtaagaaggtggaaccaccctctgtgaggaagtgggccctcactagaaaccaaatttacaagagtcgaatgtccagcctccacgactgtgagaaataaatgttccttgtttataagccatccagtttatggtgttttgttattgcagctcaaagaaacgtagacaattcccaaataattcgtaattctatataaaattaataaagttatatttattgcccactgaccgtccccaaaagcttcttaaaaaggacagaaataataaatttcattgtaatgttgtagaaactgtgaattgcaatattatttaactagaaatgtttttcaagtaaaattaatattcttatgtataaattttcttttttttctcccattaagtttaagaagttgataaaaatttctgtttctaacacattttcatacaaaatctctacatggtcatgctgcacataggaaaatactaaccatagattttctgttttttaaaaaatatatattttattatatgtgtattggaaggtttaatttaaaggaagatttcatcacaattgacttctggaaaatctcctccaacttttatgagaaaacatggatataatttaatagcatatacatttattaaaatgaattcaaattctatctttaatttttgttatgttttccccattgggagaaaagttgtatttttaaatcaattaaaatgaaaataaaatatttgatattaaactctggtgtgattttctagatagatagtgacagtactttgtaagtagctcagctagagatctctaactgttaaaacgtgaggaaagaaatttggtctccagaagacaatttttcacttccttctaatagtaatttaacattttcatctgttaaaaaggtaggtaacaaactacagtgatattggtagggattgctgacttttcaccaagaaatattacaatatattttccttcatattatttatattgaagatttgttgaaatattatttatgtcaattactaatgtgaaattatgctaattaataaacccatagggaggtaatgtcatataatgcattgattaaaaaacttatatttgatttttaatatattgatatctctatttagataatatgctagattttcttagtaatattacatagtttaccttatgcatttaacttttcatttggcagcagaatgtcaaattagcccatggcacaaaacgctttaagatcctgctcagcactaagaagaacagtactggaataatgtttggtcctgtctgggattatgtatccatctcacataaccaggcatgctgctaataccatcagtatggatgaggtctttctgcatccagcagttgtgattaatttgtgccgagcgatggatgttcttttaggagttacccctgtgacacacatcaggctttctggagacagctgaccagggcaagaggtagagtctacgcctggaaaacattgttttttcactgtttaaaactaattggtccatatgggcttccaacccaatgaccttgaaatgatttaagcaggaatcctctgcttcactcttacaggctcagagcagttcatacatgcaaggcattttgaacagatttttttctctctttcttgtatctctccatctttctttaatatctaattattcttttttttttttttttttttttttgagacaaagtctcgctctgtcgcccaggctggagtgcagtggcgggatctcggctcactgcaagctccgcctcccgggttcacgccattctcctgcctcagcctcccaagtagttgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaataaccagcatgtcatatccaggacataaaaatgctatgaaaagtcataaattctacaacttttcctctttccccgatgaacacacccaaacacacacaatatataggtggtgaggaggatgaaaaaagcaaaattgtataataatgaaataagcttacattttacattcagatcatatatcattagtttttaccagcagctgtgaagccagtaaaaatatgtattatttgcatgatgaaaacaaagtgattcaatgaaaagagaaataaaattcaaatcagatctatgaagataatctaattcttaacttcctcatatctataaaaattacatataaaggctctgcccatttttactctaatattaatttagagttaataatgattaatatttttggattgctactatgtattttgttctatttgaggtgtttcaatttgctgaccagatatctgtctccaaagcccactttctttatgccatttatctgtccagatgtgaaaatgtgtatttttgaactgatggaaaaaaagaaaggttagttttatattcaaggccacataggctgtaagttacatacagaacatgggcccagactcaggtctcctgatttttaagaggctacacaggaagattcatcatatgtttctcaaatttacagaatgcaaatgaatatcgaaaagcaagagagatgggacaaattaacagtaggaaaaaatattgagataaatacttctgttaagtaagagttaaaatgttgaatttaaacaacaacaacaacaataataataataataataataataatatactttgctcgttagtgggcccatgcatcaaaactctgatacaattatcttttcttccatacaatataaataagggttctcaaaaatctgaattattctgttcccctgaaatccgtggtggatgaaatgagaaatattttaaaaacacctcagttggaataaggtggtattttaaaaatcatttactttcataaggtaaccttatttatatttacagagtctatagttacgagttaaacattatatttaagtgctaggttttgtttgaaaagcgtctgggcatgagtctcactttcagtaacgagaccaaagtaaaactgaagccaaaaaaaatgaagtataaaaagcacaccattttgttactttggaaggcaaaacattgaaaaagacaaaccactccatcttcaatattgaaaaaaggaaatactgataatttctgagcaccttgtaacggaggactgagactacagaataactttgttcttcctaactggtggcaaacaatttaacaatttcataatctctaatatgaaacctttcaagtagattcaacaatttaaaaaagacaatggtaaagcttatcaaattatttatcatttaaataaattctaggatagaagaaagaaatcatgttttccaggaattatttattgtgcatctacagagcccactttttttttttttttttttttgtattttaaattctgggatacatgtgcagaatgtgcaggtttgttacgtacgcatacacgtcccatggtggtttgctgtgcccatcaaccagtcatctacattaggtatttctcctaatgctatccctccctaggcccccaccctcgacaggccccggtgtgtgatgttcccctccctgtgtccatatgttcttattgctcaactcccacttcttagatcgcaagtgctcaccttcatctgtattcaccctcccaagttttcttaaacccacttcaatcatacttttgcctcagccactcaaagccagctgcttttgtcaaaatcaccggtgccttttacattgctaaaagcaatatttattttcagtccttatcttacttgacctatcttcagcattattcactatcctttcacggcaacagcttctcggttctcttcctattttactacccattttttctcattctcgtttggtggtttccccttttctcccctacttaattttggagtggcccagaagtgaggagttattcatcttttctttatactcactcccttgctcaatctagtctaatctcacaccttaaaaatgtcagtactattatgactcctaatttcaatctccaacctggatttctcctttgaattccacagtccatatccaactgtgtacttcgtaacactgcgtaagtatctaacagacgtttcagatataaatacctgcaacaatgaaattctgattaccctgcacgaacctcctccactcatggtcttttccacttctttaatggcagctacatagttacaggtaccgaaaacaagaaacttggaggcacctcttgcttcagtggatagatatggaaaaagtgaaaaccacttttttgaaaattgaatttgaagttccatcttctcatttcacaatacagtattagcagattatatatgccaagaaatattctatgttagtaaacttgagatgaaaaaatactcttatgtcaatgtagtgaattatggtcttatcctactgaagcattaaaggtaaatattgcaattttcaaagttaaggtaataccacattttaatttggataatattataaatttatgaaatatttttctatatttataatatgtaaaaatagaaatataatcatattgcttgtatagtaaattccactgttctatgctattgtaaacctaaacctttcttgtaattagtctgaatctcatttttcattagatttttaaattccatgagcataaacactgtaaatgtatcagtttcattcactgctaaaatttcggacaatccctggtatatggaagaaggtcaaatatatatttatttttacttttctgtatctttaattttaataggctttaaatatttttttaaaaattaagtgattgtgacatcattctaattcccattcgatagatatttatggatgtttttccagtgtgtgtgtgtgaacgtacacgaagtggaaattaattaatgtgaatgtacaacatgaacaccttagattatagaatgtctttattcacacattttaaaggtttgtgatatctgcaagtttacctatgggtaattaatactgatgcacattcttgccagtcttatgaatgggcctcacccagccccctcaatcatcaattatgattctatatctatagggatggtgctgtgaacagaataacgtataatcttctagaaggtttatgcatttacatgtaatatttatgcaaaaaggcctatttatatgcatttttgaatggacagtggcttaaagaatgagatgttagttgtgactttgctcttaacacatggcttagatacattttattgtcagaatggtgcaaattgaggactttagcatgattttgactgtgtgtactcttccagtccactcaacacattttaatttattaatttaatttacttgctttacttactgaactatagcttttaatacctagttcttagaacctgcttggccaattttcgcaaacattagatatcttaggaagagaaaaaaaaaagagggagggaggaagaaaaagagggaataaaggatggatagagggagtgggtaaggaaaacaaatggcattctcctttcaccagaggtaagggacagataaatgttaaaaatcatggcaaccacacaaggcaatcattctcaaactctgatgtacctaagaatagaatggaaggcctaataaaaagcagattccctgggccaggcgcagtgtctcacgcctgtaatcctaacactttgggaggctgaggcaggtggatcaccagaggtcgggagttcgagaccagcctgaccaatgtagagaaaccctgtgtctactaaaaatacacaattagccgggcatggcgctgcatgcctgtaatgccagctactcgggaggctgaggcagaagaatcgcttgaacccgggaggcagaggttgcagtgagccaagattgcgccactacattccagcctgagcaacaagagcgaaaccccacctcaaaaaaaaaaaaaaaaaaagtagtttcccacaccctatccacaaagattctcgttcatatgttgatgttagaggcaaggaatctccatttttatcaaactgtctgtggtggttataatgtgagcagaatgtactttcacagacattattctgggtgtggctactcaaactccaatttttagagaatctttctttttagccctattggttagggctattggttagccctattggttagtggaccagtctttactaatggatagtccttataatctggagcaaaaactccagataatacagtgcatccaagagccaatgttgtcacgccagaagatttggagtctagtaactgaaactgcatgcaattatacaattatcaactgtgtaggttcaacaccactaaaattgtcatgtgactctagcattaccaaagattgctcgtgtgtcagtgggaatactctacaagtaataagctcagtcttagctagtattcataggtcatggtcaaatcctcttgacattccattattcataattaattagaatttaggtatgttggtgtatgtgtgcacgtatgcctgtgtatacacagtatcaatatagttttgggtgtaagccaccacttttactttatcatttttaaataaaggaacctcagattgagaaaaaaagcagagagaaggtaatttgacatacagaaagtttttggtttctagtcagagtcagagaaagacaaacgcatatagaatgtacccggaaggcagataatgacaacattctgagtaatagtatattcctgttgctagtgactaaacataggatataaggctactatgtaattcaaaattttcttcttcctgtgttcccttcctggacaccacacctcttgctaaacagctcttcagtaaagccttcaatatacaagggtgtaatttttccaagtttcttcacccagcaaggtgcaggctgcatattgatctttatatgaggatgattctgaaaaacgggcaaattgaccgaactaccaatgattcacgcatatccctttattcctttattttcaattttaaattcaactctcaagtagacaaagaagattgtttgctttggttaattttgctggagggctaaattatatatcctgtctttctttatggatagaaattgcatttgcttaacattttaaaaatcactttagacagttaaaatatgtttacttaagctttcaaccaatttattttttggcaataacaatattattagtgtataaccttcaaatagcctgacatttggacatgtttgtcttgggattcaaacgtgaattacttgtacttttattttgaaatcaaaatgttaataaaagtctcagatttttctttagcagacaattcattgccattgaattttttcacaggtggaaagtatatggttgtggaacatatacatcctgagttggttacagtacagaaaaatagaaggaatcataaaactcttaagaatctgattaaaaacatcaacatttaatccaattataaagtgttgcaaaaaaaaaaagagaaaagtaatctatgctgttagaatcctatagtggaagtttgtggttgtgtcaggtggaggtaaggtgattagtgactaggaggaggtgtaggaggcgtatgggatgtttgtagcatctttttttaacaaaaatctggttgttagttacatgattaacttcactctgtgaaaattcatcaagatatacactttcctgtatgtcagcagcatgtcagcatttcaataaaaatgttactaaaaaaataagctatgaacttgctccccaaaaaagtgtacatagactatcccttcctctcctatcacagtaaactaggatacgggcgctcaagtccaagtggtaatttaatagcagctgccctaggaagtgacatggaaaaccaacattatgaagatacgtgaaaattaaagatgctcccctcttcaaccatctgtgttcattaaagatggaccccaaaagtaaacttggccttttgcactttcccactaagtgtttcccaaatactgtggtttccaaagccctgcttcttatctgctgccttaaaataatctaaggtaattgttaaagcaaattcccaggggctcaaccaaaatatctgacatgtatctgctgtattgcttatttgttttctttattagtttaattttatcatatcttcctaagttttcaagtaattttaatatatgacttgctctcaaaatttagcatccgaaaatcacatgtaaatcttgattctgtagggagagccctgaagtctgcctttccaaaacagccacatcccctggtcctggatatgtagaatcagtagtcgtttgggatcagttggatcaggcattttagcttctctcacacaggcttataggtagctgttacactaaaaaagcctagggtgagcagctgaggccaactctgttctagccttttatgtaagtcattatcactcttcttcactttcagcaaagtctcttaatttggacttagttggaaactgaatggaaggaattcatttatgtaagggaattctctgtaggatcctgcagctcactgaagctctacaaaagctataggtccaaagcaacagtaattggtaacaggttatcaggttatatttcctttgtgtgtgtgtgtgtgtgtgtgtgtgtgtgtgtgtaaaatgtcttagggagggatgactgtgaataacctgtgctccatgaatcaatgaacatattatcaactgactaaaaattattaggtttttgccattaaaagtaatggcaaacaccacaattatgtttgcatcatcctaataaaaataagaatatcccattgattcttgaccctacttataaaattaactgccttaaaacctacaggagcctccttttattcaaaatttaatactctaaaaattaaaggatgcatatacagtttgactttaagccaatttattactattactaaacatactcaaaaacttataaataaattcaaaaacctataaaattcatgagataaaatacaaataactgttgtatgctgtaaagtttgtttgcaaggctatacagcaaaagagtatattcttggttggaaacaaatacctttttttgtatgacaaaaaggaaaagaaacttcactagatagaatataggcagcacatattttataaagccttgtaatataacgacgaaataatactgacacatttcacacctagggaatatttttaataaaacgaaatactttctatcttcacttcaagtaagaatatgcccattctgtttataacttgttacaacgaacacatgaatcctcaaagctcttgtatacctttcaatgataaaaatctttctttttgcttagagcatgagatacaaatcgacactggaatgactaaaaggattttgaatgatttaaagaaaaaataaccttgccactctggggaagaccacagattctgaaaactctcacttatcaccgacatgttgaactatttagctggtgtttggaacgtgagaatcatcttgggtataaacagcaaggtcagccagatataaaattctgatagtgataaaggggtaactttttttctgtgaatcttccaacttatgttttatttttattattttatcctgccttttgccttccaaccagcaaagccatcttatcctacactgaggtctgatcccattcccagttttttgtcaaccaagagaaaaccacactaaagtaccttctatgaattagccaaccagaataatgtattttgtaataagcaaattttaaaaaatcattaacataaaaattatatctaaatcgtttatttttcagagcctagaaggtattgagggtgagaggtcaatatttctcctccacctactggaccgttcttgagacaaaaaataacaaagagttttagcctacaagtttttcaatatgctctttcattgttatatttctatggaaccaagaaacctatgaagaacgattactcgggaacatatgtgatagagtgctaaggatgtttatgtgtgtggggattgcagagtggggagacgtgacaagggttcagaaagtgcctttcctttgaacattttacaatgtttggtcttgctcttgtactcttacaatgacctttgcagacaagaaggccttggcaaaaagcaaggtactctgatgagaatggataaattgcctttcttcttcccaagcagttacaggtcaccttgtgaggaagaaaaaaggccaaataaaatgtcacctctgtgtgtcttttgtcagtttgtgctttttgacagccactatattcaactgctacattctatttctgttctaacactgctgcatgaataacgatatgagacaagaggacatcatacttcctttccttttattagcttccataattggcataatagttaattaatttaggccagtacttagaattgttagagacaaaccagtggaaaataaaaacacacggtgttctttctgaagaaacacaaatactgttttgttttgtgtgtgtgtgtatgtgtgtgtgtgtgtgtgtgtgtgtgtgtgttttggtattatttattatttcctagtaatggtagtgttgctcttcggcaatatttttgctttgattaaacttaactcattaaaacaaaagttgtaaaaggtaaagtttttagactgacttctttttgagcttctacatcctctgtgatgtatctcagtatgttatctgagtcaaattgttgctgttctcatgatgtgttgttggatatggtatcaggcaccctgtggaggaactctctggtgggaggtggtgtacaacgtcacactgtagcagaaaacctgaaggatactcttagctgccttctctggcatttgatcccttagttctatccaagtgtatcactttatccttaggcagattaaatttcatattatacctctgagctcatttacttactctgttacacttaaggtaaaacagatatagtcatttgtcttaaccattccctcttatttagtgatatgttcaaatttcctaacataaaggcttttcttcatcattaattagaagcattagtgatcttatatagagagtctcgtggaatatagttttctcccaaattcttcttggccctccatttttaagccagttgataacatccccttttgttagttggatgctatgacatatcatgacaaaaattatgctttgtgtggcaatctgctaagtttaaaaaaaaggagaacacaaaattaaaatacgaacacttagtgtatcaaaggtcaattgatttcagaaattgtaatatttgttggaaattcatggaaagattgctatttcattactaataacaagtaatgcctgaaatttctgtggggtgattttctctaaaatgtgtaagagatatttactttgccttaccttagagacctggctattggggtagaaaagataaacttattatattatttagtaacctactgaactgaggtgtggtgtgcaatggacttaatatttgtatctctccaaattcatatgttgaaatcctaatccacaatgtaatgcaattaggagaggtaattaagtcatgagaatagaggtctcataaaagtagttagtgtccttacaaaaggtaccccagaaagctctctcaccctctcaccctctcatcctctcatcctctttccaccaagtgaagatacaaacagaatttggcaatctgcaacccagaaaaggaacctaactagaacccgaccatattgagtatgaaattccagcctccggaagagtgagaaatatatttctgttgtttataatccacccagtcttttgtactttgttagagtggcctgaactgactagtacgtgtctgtgtgtgtgtgcgtgtgcgtgtgcatgtgtgtttgtgtgtgtttcattcttgccataagaataagagtaggaatatattgctagaatatttccagatatagaagatatgtcatttgtagcatttgtcttccttcttgtagcttggcaatagcagccctgatgttttttctcttgtcctaactctgggtcactatggaccctgttcaacctcaccttaaaggagtgccaatcgtttccatctcttgtctttttttttcctctctctctctcttttgtttgaaaactgatgatatacacattagagtagaaagaatataacttatatttcacatctccataacagatttaattaattttattagctttttcattttcacggtaggttccatctttttcattttgagaagtgatgactgatgatctttgacttgctactctgcctgacttagacacctgtgatctttcaacttgacaacatctctgtgggaaattcaggtagggggcaaattgtaaattggcttgaaggcaacatgcagcagcatgatctattttttgttgttttagcgatactctgttggcagtgtgaaaagatggacaagatgcacagaaatgaagcatgattttagagactgcttgtgtaagatcatgggccaagagaatgcgaaataaagaattgcagtagatgagcagagttgagatattcaagaggatttcaaaggtatcaggaagggattctatgagtgactgagtgggaacatacgagagaagagacctttgaggaagtggaagtgtctagcttgagtgggtgaccaactaaaatatgattaactgaaaaagggaatagaaaatagaaggtttggaatttttaaaggatgtatatagtttgctatatttttaatttgtcacaattaaataatactaggagtagttatccaaccaataattgaaaagatgtccgtaggcatcagaagtaaaatatgtctcctcagaccaagaaaaatgccaggcacctgagaagcattcaacaaggattagggaaattgaaaactagcaaatgtcatatgctttaaaatcattgaatcagggtgttctcttaaatttctatgaagtaaaatatgatttttatcattactcaaatagtgactaaacattttctagagttatgacattagtgattcatgtagggacaggggttgtagtagctgtcctcctcttagccctcaatcatttctcaaatgctgttttcctgtaactctcaaattactgaaggatgacaccttgccagggcatcaggcacatcagcactaagaatcaagctcactagttttaattccctggctaattttctatggcaaatatgtaatttttctttagaagaaacacattttttgacgcagtcataagtagctttagttgtgccataacaaaggtgtgacattttttctaggcattgaatttatgtggaaatctatttgctacatttgcatcttttttttttctggacagagatgcaagatcaaattgtatcaaatgcacacacattcacatgtaagtatttagatagagtgaagacgtaggtacacagattcagcagtctgaaaagatttactgtgccagggagaaaataattacaacaaatgtttattaagcagcttctatgtgctgtatataggtaggtgtaggggcatgggatgcagtgtaaataaatgttttgcaatctgccctcctgtaaaagttgggagaaaataaacaggtacattcaatagagtaattggggccactttaggggccaaaaggctgcaaaaaagcagcttcctaacagtggctatgcctttcgagggcaaatgtcttcttagttaaaaactgaaacatcagtttgaattagactgttgacaagaagagggaggaatgattcaggaagagggagagtatctctaaatgcttagatgtcagaaagagcatggtcagttgagggcactggaagcggtttagtatgtttggaacagagggtgtgcaagttaactagtgagagctcagggttagtgagctcatgagttggaaggaaaagaagttaaaaggcagcatgctagatagaataagtaggtcagtgagtaacaacatgaaaatcagaggaaacatgaaacaattatgcttctaatttcattgtgatctttgctcttcgttgttaattaaagggatttagattaaaacatgcaattgttatttgaagaactgagagacagtaaattattcaaaatttatccatttaattggccttaataattaatgactagtagctttgtattagatgcctgaagtataaatatatcaactaataatacttgaaaatatttcacttacaatactgaaagtgattttatggactttgtaatagatggtccacacgtgaactaattcactcttaccagagttcttaaatgtgctttcatatttttacatcacaggtggtttttattttatgagtgtagtgatcaaataacttatccaaactgggacatttaaaagagcaacagaggtattatgaataattacacaaagacaatggacataaacatgtactgccctgggtaaaccaaatctatgattcttgttcacagtgtatatcacattttaaagtatgcttaaatgattacaattatataaaatttaggatagtgttttggaatggaacaaactttttcaactgcatgttttaatcttttcatagtctaaagtttgtgaactattccattttgtcttccaagttacacctttacatttttatttgtcagcatgctgaataaatcactgggagaaaaagagaaaaaaatgaacatgagaaatctctaatttgtggcactcaccagctgttaaatacacacatagctttttaaagcagaattcttcttcaaaatgtaggagaagagacttcattttattttttctccgcttttgaaacataaattgggatctagtccaacaaaaacttttagggccaatgaaaaaatgaagtattattaaagtaaaaagagagagagagagaagaaattgaaagatttactatagaggagaactgccagattgtagcatttcaatggtcccctgaacaatgccacaatactcagttattattcaagcaggtggcacattattattacagttagatacctttgcttattatgcccttgacttcacacaaaacatagtaatttgaatctaatattgtctgttaaaacttccattaataaaagaaagtgctattaaaacaaaaaaaaaatctgtggcctattgtaattgattttttttctgtaattgatggactgagttacactgtacccaggtacaccaggacagctgaattcgataataaaggaaaataattgatttttggtttcacatgtgacagtttggaaacagtgctttgtcaaatttcttaattcccatagaaagcagcaccacaagagtcaggtagatccacaatagaaaatcagtacacattgtggagttttatatactctcataataattaacataaaatagtcaatgtaagaaggtgaatctcatgcatggccatttaatacaactggttaaagtggtgttttttgttgaataactcccaaacccttaataaatgaaatcccaggaaactgtagtcatccttcaggctctctccgtggtctgacgctatacctcatttccctgttaactgcttgtagcctgtgcattatgtctccaagcgtttacttctgtgcctccttatgttcaaacatcatttcccacttttattcattgaccatactctttcaatccagcaacatttagcttggggtgatctccagaaaatcttccctgagtttccagattaatttaaatgtccctattctgtgtgtcgttaccgctttttacacgtcttcctcttagcatttgatgcattttatctgatttatttgattatatgactgtttccctttctagactataagttttttcaaggacaaagatcgctgaataaacacaggttctgtgctaaggacatatctattaattgttaaactagacaaccatttctaagtatctgcatatttgtgaagtgaaaagagcatggctttagcgtatataaaactaaatttgaatctcaactctgccccttattagtaatgtaactctaaggtaatcacttaccttatccgaactttagtttccccattttgtgcaaatgagaatattactaaaattgcggcaacagttcaatgaaaaatgcacacaaagcagcttaaacaatgttcattctcagtaagcttccctaccttacttccttttcctttagtatgtttacatttttcaaaaggtaagaaaaataccatcgggatgcatttctagaggttttttttgcatgcttaaatatgagagagttatgtactatatacaaaacttatgctgaatctttgcttttgtcttttcttgtacttacaatgcccttttcccagtcccatctctgcctggcaaattcctgtttttccttcactgcttagattaaatctcaccatctcaatgaagtccatcgaaattaattagaagaatatctgcattttttcagtatctatttaatgattatattaaaatatagatatactattaaaccaaaagtgaaatgccaaatagattagcttagctttgaattatttcaagtctaagatcatctttcaatataaagaaaataatgagacatatattgaaagcatctttggataggcaagacctcttatttttatgttggaaaaatcattaaaaatacattagaatacaattaagtaataaaaatgaaaacaaaattaaaacaacatataaatcaagcacattttagatgtcttaattggtcatgtttttgtggtaaaacgctaattccttttagtagaaaaataatgttagaagacataatgaattgtgtagaattgtatacgcttgaccaaggcatttgttacatataagaatatttagtattttaccccatagtactataaaacgttattttagagaaaagcaatgccatgtattaaaagtgggcttcgcttattttctttttaacaaaaaattgactgactgctgtccacattaattttaattttataacataaaactgcctacagtagcgtctacagatttatctgattagcagttcataaacacaaggaaataagatattagcttaatttaccttaataaccaaatcaaatttctggtgaaagtctctgtttactggctccaggagactaagttctgctgtcctaggatgcatatggaaaaatcgtgggtaatcctcaggagtccctggaagacattgagatttcagtacataattgagaacaataagtaatatgtgtatctgctttttctatttcccttcatcagctgaggaacaaagctacaatttcattagtaaattaagtttcacaattatgcagttcagggaaagcagacacaaatgtggtatatagttattaataattagcatatcagtaagaaaatggaaaatgtttggatgatttttgaaattttttttattaagagggctctaattaatttgaatcttcatcacatgaaaatagacattaagtggagggagagtaaattttttattatgaaattttattttaatggtgcataaatcttaattataactgtttggtctttcaacatatattgtaataaatgattagtaatttgtaccaaatagtgagatgcttggaaattaatgtgaacatattttgttgcatatattatttcttaagattaatatcaagctaataatgttaatcatagtaaattaaatataggttctgatgatactcttaatgtctacacagggtatttatttatgtatttatttttgagatagagccctgctgtgtcacccaggctggagtgcagtggcttgatctctgctgactgaatcctctgccttcccggttcaagtggttcccctgcctcagcccccaaatagctgggattataggcgtgtgccaccatgcctggctattttttgtatttttagtaaagaaagggatttgccatgttggccaggctggtcttgaactcccgacatctggtgatacacccacctcagcttcccaaagtgctagaattacaggtgtgagccaccacgcctagccaagatggtatttcttaatgtattttaataatcaatatacatttcttcatgaagaaatgtcttctaattgtataatcttcctttgtgtactgcaacattcttttcccaaaatgaagaagtcaaatcataaaattgtatagtatatacatttgtaaaattaataaccataagagaaaaataatatagcttcctattatggaaacctactctgtgctaaatgctttatataactaatcatcaataactaaatcatttacattttacagatcatgacttgggagactggggagattaaatgacttatttaagttaaagggacaatctgaaacagagcttttattaaaaatccaggctgccagatgttaaaacacatccaaaaaggggcttattgttactacttattttcctcaactctgagacaagaagggaaattctactgggcagtaaatgagggggaaaaaaaacagaaacatatttcacaccattaaaaccgactgtaaaatctacaaatagtcaaaattatagatgaaatgcaatatatgataaagaagttatccctcctaataggagagtcatacagaaaatcatagagtttcatacattcttcatggaatatacatgagcaaaccccaaatgaagaagatattcataataataaaaaaatgagcactagtcatagatgaaaatgtggataaattttactctaatgtgagagtgagcaaacctttcctaactatggctcaaagtcaagaagtcaggaagaaaaagagataagtttaactatattgcaaaattgcatggtgagacacaatgaacaaagtaaaaccacaagtgacaaactgagaaaacatttgaaatttatgtcgagacggccgggcgcggtggctcacgcctgtaatcccggcactttgggaggccgagacgggcggatcacgaggtcaggagatccagaccatcttgcctgacacagtgaaagcccgcctctactaaaaaaaatacaaaaaattagccagcctggtggcgggcgcctgtagtcccagctacttgggaggctgaggcaggaaaatggcgtgaacccgggaggcggagcttgcagtgagctgagatcgtaccactgcactacagcctgggctacagagtgagactccgtctcagaaaaaaaaaaaaaaaaaaaaaaaagagaaatttatgtccagacaaaatgttcatatcccgaatatatatatataggtttataaattagctaaaaatagggccagtgagggatttaaaaagtgtggggctggctcggcgcagtggctcacgtctgtaatcctagcactttgggaggctgaggtgggcagatcatctgaggttaggagttcgagaccagcctggccaacatggtgaaaacctgtccctactaaaaatacaaaaattagctgggcgtgatggcgcacgcctgtaatcccagctactcgggaggctgagaaaggagaatcacttgaacccgggagacatggaggttgcgtgagctgagattgtgccactgcactccagcctgtgcgacagagccaaactccgtcacaaaacaaaacaaaatgttcggggctagagaaaaaactgttcacagaaagagaaaggcaaatgactctagatcataagcaaagataagcaaagatgcttatctcgatacataagaagaaaactacaaattattcctacattaagatttcattagtcacttagattagcagttgtcccagttggagactgtactctgttggcgagcctgcaggaaaacagacactttggacactggtggtgttaatacaagtgttgtaaaatttatgaaggagagtatgacataagctaccaaaataatattaatgtttactttttgacccatacatcccacatctggacattttcccatttataataacggaagataaatgaccacctaaatatacatcaatagtggtctgggtaaataaatggtgatacatcctaaagcagatgataattcaaatgtaatgataaatgatagatatctttagctattactatggagttattttcagctatattaagtaaaaaaaagcaatttggaaacaagggcctataatatgctaacctttaagaagaatacacatgcatatttacaaaggaatacatacacacatttaaaaatcgaagatagactgtaacataaaaaattgttacttatgagaaagagagggaacacgtggagaggataaacactgaaactaaatttcattacccatatcaagttttttacattttagagctacatatgttatatattattataaaactaattaaattcaaggacttctctaaaaataaaataaaataattcaatctaaatgtatatttagttgttggcacaagcacaaacaaaaagaactaccccaggtgaattttaaaagtagtactgacatcacacccacagtgtaatataggtgaagtaccagagaaattacaaaactcaaaaagttaagctatctacagtaatcatattggtggtatgttgtgattccaagatagttataggagtattttacaataaataagcacattattatgtgtcattctgattctattcttttcagtattgaaagctggattcttggcaggggatgataaagagatagaaattaaaaattaaagaggtaaaatagaacacctatggttttgattttgaattggcagtggaagtttaaactcaggttgtagtttatcttaagaaacaaaatgcatacaacacagctctgaatgctgaaacacagaactatatataatggccaatatagaagcgatgaatatttctaatgttcagactatggttttgaaatactatttaccaataaaagcacttaagatttctgagagagagagctgatttcaggtccagggcagaaaatcaacaaatagctgtgaaacatctgctcacactaagtagcaagaaagaattccgagactactaaactgatttgaaaagttttcaagagccaaaaggcttttttttgtttttttgttttttaagctaaagataagacaatttgagcatcaataaggatcatatcagtaatgatttgaaacagatcaaatatgtttaaattcataagtttacgagtgttgcaaaataacgtattgatcacttttggagcatgctagagaaatattttgtaaattagaaaataagaaaacagagcatgctttttccatatgagcttaacatggggtaaacaaataattgattaaaaagtgtctcattaagaaactatttcagctaataatttaagaagagtaatagtatcagagtgccatcattttacaacccctcataaatgaatggatcatggcattgagcactaaatgctgctaatatcacaaaaaaagagataaagccacatacataccactcaatagaagaattaattcaacatcatctgctatggcctgagttgtccccctcaccattaacaattttatgttgaagcccttactcccaatgtgaccattatagagagatagacccttttaagaaggtaatcagattaaatgagtctatatgggtgggctcttaaatctgatgggactggtgttctctttgtctctctttctttctatctcttccctctctctctgtccaagggcacacagaggaaaggccatgtgaagacacaagaaagcagctggagaagcttcatcaaataccaaccatgaaagcaccttgatctcaggcctccagaactgtgagaaaacacctttctgttgcttaagctactcagtctagggtgtttcttaatggtagtgcaagcagactattataccacctatgaaacagttttgagaaaacccaacaaagaaacaaacaaaatatgttatttgattaagtgtcaaaatttataggaaacatgggacagagtaacatgtaaaattaaaccaaggaaagtacaatcaagatgacgagaaactctataatataaacaacttgacttctcaataaatgaatcacaagaaaacaatttaaaaataaatggaaagagaaccactgtagattaaaagagacttagggctgggcgcagtggctcacgcctgtaatcccagcactttgggaggccgaggcgggaggatcacaaggtcaggagatcgagaccatcctggctaacatggtgaaaccctgtctctactaaaaaaaaaaaaaaaaaacaaaaaaaaaacaaaaaattagccgggcgtggtggtgggcacctgtagtcccagctactggggaggttgaggcaggagaatggcgtgaaccaaggaggctgagcttgcagtgagctgagattgtgccactgcactccagcctgggtgacagagcgagactttgtctcaaaaaaaaaaaaaaaaaaaaggagacttaggagaggctgggcgtggtggctcatgcctgtaatctcagcactctgggaggccgagacgggcagatcaccaggtcaggagatcgagaccatcctggctaacacggtgacaccccatctctactaaaaatacaaaaaaaaattagccaggcttggtggcgggtgactgtagtcccagctactcgggaggctgaggcaggagaatggtgcgaacctgggaggtggagcttgcagtgagccaagatcccgccactgcactccagcttgggtaacagaacaagactccatctcaaaaaaaaaaaaaaaaaaaaaaaagagacttaggagaattatcaatcccaacgtgtgaacttacatgaattctggtccccttgcatctctccctttccgagaaaaacaaaaacaaaaaaacagaaaagaaactaaaaaacaaaaataatatttgtgagaaagtgaaaataaacactgactgatatttaatattaaataaggattgttatactttttatttgtgctatgatattgtcagaatgctctaaaaatagttattttataagcataaattcaaatatttgtggattaaaattatatattttttcaaaataatgaggaaaaaaattgatagacatatatattttaataagtttggccaagtcttcataattcttgaaactaagtgatgccaaatggtgattttatttactatctcttattttatatatttttaaataagagttttcaaaaatgcaatataatttatcatttgctttggtttgcttttaccctagctttcatcagcatagaatggagcagggctcctggaagaatgaacccaaaatggtgaagataattgaataatagccgctgagctgggaaagattttcatttcccagagagtaatacttactagctgttaactagttactacggtgaaaatgttataatctctttatttgtaaatgatctatctcatctaagtttcaaaacaatcttatgggaaagatatttattgcttgatctgtgaagaaaccaacactcacagaagttaagtaaaatattctgaactctcacggctagtaaatgactaggtcagaagtcaaggtatctaaattcagagtgtaaactctttcctgttatgctatatagcctgagttcagtgaattagacactttggcttcatcggccatctgtttctggaaggttggtttttagacatccttacagaatatcaactcaacaagagtataactagcaattaaaaaatacatctccttagcactttgggaggccgagacgggcggatcacgaggtcaggagatcgagaccatcctggctaacacggtgaaaccccgtctctactaaaaatacaaaaaattagccgggcgtggtggcgggcgcctgtagtcctagctactccggaggctgacgcaggagaatggagtgaacccaggaggcggagcttgcagtgagccgagatcgcgccactgcactccagcctgggcgacagagcgagactccgtctcaaaataaataaataaataaataaataaataaataaataaataaataagtaaaataaatacatctccttggacaaagagtaaaaccaagtgaaatttatttccctgcatttcttaaaagtgtaatgcttttccagcgaggactaagaacacttaatgtttgtgctttcattatacacaatgtttacagtcaacctaaagctgttctttagaaacaaaaaattagccgggcgaggttgtgggcacctgtagtcccacctactggggaggttctttagaaacagctttgattgcctaaatttagatgtaaaattgataactatgtttattatcacaattataaataatacggtgaatttcagcattataattattagagccaacataattagtggttgccaaaacatttattttaatttttatatatgctaagaaaattctacgtttttcactttttcagtattatagaggaaatggcaacctaaattaatcccttggtgaaaagtttacaattttgaagattacgggttttctgtaggataaagaaaaaatgctacacaattatcttcatatatttaaaatgtagaattttaattacacgtgttgatcaagatagtatcaccatgactaagatagtaagcctatccataattgccagaaatttccttatgacaatgtctcctttctctccccattcatatttctcaccctatgcaaacactgatcactttctgtctgtcagcataataggaatgggatcatttatatagtatgtattcttttttttttttttaattttgagaaagagttttgctcttttttctagtctggagtgcaatggtgctgtcttggctcactccaacttctgcctcctgagttgaagcaattctcccgcctcaacccccagagtagctgggattacaggtgcccaccaccacgcccagctaatttttgtatttgtagtagagacggggtttcaccatgttggccaggctggtttcgaactcctgccctcaggtgatccactggcctcggcctcccaatgtgctgggattacaggcatgagccaccctgcctggccttacagtatatattcttttcgtaggtgtgtctggcttctttcaattagcataatgattttgaagtccatgttgtttcatttatcaatagtttatttatttctattgcctaggtgttattctattgtatggatatgctacaactcatttatctattcatacattgatgaacacttgagttgcctccagccacaaataaagatgctatgaactttcctgtatacctctctgaatgaatctatgctttcatttatcttgagcaaatatctaggagtggaatggctaggccatatgatatgtctatgtctaaatgttttattaagaatttttgggcagggaacaagtctgttaattttcagttacgtataggtttgtgtagtcaataccacaatcgggatatagaatggttttatgatcaaataactactttgtgttttccttccccaaagttaaatctttagcaatgactgatttgttcatcaccaccgtactttcatctttttgagaatgacatttagatggaattgtgtagtataaagatttggagactggcttctttcaactcagtataaagcattagagattcctccaagttgctgtgtatcaataatattatattttcattgttgagtaatgtttaacttttaaagaaattgccaaattatttttccaatgtgtctgtaccattttacattcttaccagcaatgtatgagcatttcagatcttccacattttcaccaacacttgatattgtcagtcatttaaattttggccattctggtgtgtatgtagtgatattcattgaggtattaatttgcatttcccaattagctaatgacattgagcaacttttcatattcttattttgtttataaatctgtaataatttgttaaaactttctgccattttataattgtctcatttttattaaattgtgttttcatatattccccaaacaagtcacttgttggatacatttcgcaaatacattctccttttctgtcagttctttttcagtctattgtcagtgccttttgaaaagcaaatgcgtttttactttgatgaagtcaaattttaaattttttcttttatagatttgcatttgttacatttaagaaattgttgccagccgggcacagtggctcacgcctgttatcccagcactttcgaaggctgaggtggggggatcacctgaggtcgggagtttgaaaccagcctgaccaacatggagaaaccccgtctctactaaaaatagagaatcagccaggcatggtggcacttgcctgtaatctaggtactcgagaggctgagggaggagaattgcttgaatctgggaggtggaggttgtggtgagccgagattgtgccgttgcactccagcctgggcaacaaaactacgtctcaaaaaaaaaaaaaaaaaaaagagaaattgttgccaaccctaaggtcataaaaatctttaccaatattatcttttagatgctttatagttttagctcttacattatgtatagaaagtctttcaagttggtttctatagatagtgtgaggtacggattgaagtttatttgtttacatatggctgtccaattgttctgcaatgttggttgtaaagattaacttttccttcttttaattgtcttttgcttcatattatttttgaagtgtttataccttaacagttttttctcatagctgtatttgcctatcatttattagcataatacttctgattccctacatatagtaaattgaaggaaatgtggatgcctgacctaaactatataattaccacttaatctttcaataatttttatttagagcaaagaatcagaagatggatgtacaatctgtaccacaaaaataatgggcatctagaggaaaggccctctaatccctcatcttgaaattcctgtttctgcttcttaaaatgttattgtttttgacagttccttgaattctggaagaaaacaaagtcctttcaataaatttccttaaacgccaagatgaacttaagttcacctctgtattttttacccaaagaggcccattcaggaaaacatttgtttttaatgcttcatacatttgaaaatgcacatctaatatacttcaaaggagcactacctcaaaaaatacagtatcaaatttttcccttcaccactgaaaatgtttatctttacatataaaattagtaagctgattaacacagaaataaaagagaacactgtcttctgggtgccatgaagatgtgtggtaattcctcagattttgacattgtagatatatagaaattatagtcagtttcaataaaacactgctaatgaaaacacccacaatttcctttggtagaacaaaaacaattataacatgtaacttatctctccaggtaatttttttgtgaaaaccttttaatgaaccatgaatgctggataccctgcagaagccaaggtattgaaatgtaaaaacattgtacgagaatagaaacacatgtctaagttcaaggtccctacagaatcccttatttatcccacttagaaaatgtaatataaactctatttagcaaagcttaattcatctaaaaatatagctgcttctgaaccatctctgaagctctgggttttatttctttttagtcattcccttatttgatcttgggattaattatattaatattccattcctctgacattaaattcacctgctaccccttttacataactaaaattttgttgataattttaaccattattttcatctatgccctaacaacacatttgtttttgtatcaagttatccctaggttcaaacatatattagaaaaattacctctaatttctcattattttcttccattaattttaactttagcactttttcttttcagctaatatgttctcttagtgcattctttgataattctaaatgcaaaaagtaaactacctttgtcctgcttttacagcttccaaaaatcattagttctaaatctgtctcctttgcaaaacttctttttcagctacttgttataaataacgaacttcattttcttatcgaaaatgtttttaataactgtgtaatagccaccaaaataatttaaatccatttttacatattattagggaaaactaaaattcttatcttagtagccaatatctcaacttcaaaaaatctttaccaaagattttattgggttgcttttcctatgcatatttatgacaatgcttctgattgtatagttcaggtatacctacactagaaagaccgagttcttgtcccagatcttctgaatcagaagctctgaaaagggaggtcaagagaatgcactttgaacaatctcactgaattcttgtatcctttaaagtttgaaaaccacctcttcatggtacatgatacgttcatatctgttatttaaacataaaaataattacaaaattcagaaactatgttattactaatagaaccaacattttttctgactacgtagattcaaatccccaagttactttcactagccagttctctacacattttccaagtgattcttccttaccttagaacgtctctctgatgtgttcctttttcatagtcctaatctcttaccttacttagacccttgtcatttcatacttgtaccacggtgatagcctcctaatatcttctgacattccattcccttataatcactgaaggaaactttctaaaacgctacttttattgcccaattatctagacaaaattttatctattgtgtactggggtaacccctaaaatagaattgagaataaaaggtataaatttatttttctttatgattgattcaatttacatatagtgaaatgcacagatcttaagctttaacgttttaggggcatagacccatgctattaccactcctattcaaactttatatttatttttaaataaaataatacaaaagtaaacttagctaatgctttatatactgactgacactgtgtctctgtatgttttagggacaagcaaggaatcttgagggagatgtgacaagtgtacagtgtgaagggataagcagcagtgtattattcagagttctttagagaaacaaaacaaataggctataaggacatattagtactgacagtgagaaagaaagagagagagagagggattgattctgtcaatcaattggctgattgattatgcaaatttgttgttttagtccattttcacactggtgaaaagacatacccaagactgggcaatttacaaaggaaaaaggtttaattggacttacagttccacgtggctggagcctcacactcatggtggaaggcaaggaaaagcacgtcacttcttacatggatggcagcaggcaaagagagagagagcttctgcaggggaactctgctttttaaaaccatcatatctcgtgagattattcactgtcatgagaacagcaacggaaagacttgccaccattattcagttatctcccacatggtccctcccacaacatgtgggaatttaagatgagatctatggccaggcatggtggctcatgcctataatcccagcactttgggaggctgaggcaggcagatcacctgtgtcaggagttcgagaccagcatgcatagcatagtgagatcccatctctaggtgagatttgggtgagacacagccaaaccatatcattctgcacttgacctctcccaaatctcacatcctcacatttcaaaacaattcatgccttctcaatagtcctccaaagtgttaacccatttcagcattaactcaaaagtccacagtccaaagtctcaccagagacaaggcaagttccttccacctatgcatctgtaaaatcaaaagcaggctagttactttctagatagagtggggatacgggcattggataaatacagccattccaaatgggagaaattggccaaaacgaagggtctacaggcccccaagtccaaaatccagcaggaaagtcaaatcttaaagctctgaaatgatctcctttgactccatgtctcacatccaggtcacactgatgtaagtggtgggcttccacagccttggacaactccacccctgttgctttgcagagtgtagccccctcctggctgctttcatgggctggggtcgggtgtctgtagtttttccagaggtactgtgtaagctgttggtggatctaccattctggggtctgtaaaatggtggccctcttctcacagctccactaggtggtgccccagtagggactcagtgtgggggctctgaccccaagtttccctcctgcactgcactagtggaggttcttcatgagatccctgcccctgaagcaaacttctgccttaacatacaaggcatttccacacatcttctgaaatctaggtggagcttcccaaacctcaattcttgacttctgagcactcacaggctcaatactttgtggaagctgctgaagcttggggcttacaccctctgaagcagggcctgagctctatgttggcccctttcagccacagctggagcagctaggacacagggcaacaagtcccaaggctgcacaagcatggggatcctgggcccagcccacagaaccatcttttctccccaggcctccaggctggtggtgggaggggctgtcatgaagacctctgaaatgtcctggagacgtttttcccattatctacaggattaacatacagctcctcgttacttatgcaaatttctgcagccagcttgaatttctcctcaaaaaatgagattttcttttctatcaaattatcaggctgtaaatattctgaacttttatgctctgtttccctaataaaactgaatgcctttaacagcacccaagtcacctcttgaatgcttttgctacttagaaatttcttccaccagataacctcaatcatctctcaagttcaaagttccacaaatatctaaggcaggggcaaaatgctgccagtctttttgctaaaacataacaagagtcacctttgctccagttaccaacaagttcctcatctctatctgagaccacctcagcctggttttcatcattaatatcattatcagcattttggtcaaagccattcggtaagtctctagagagttccaaactttctcgcatcttcctatcttctacagagccctgcaaactgttccaatctctgcctgttacccagttccaaagtcgtttctgcatttttgggtctcttttcagcaacaccccactcctgttaccaatttactgtattagttcattttcacacagctgataaagacataccagagactgggcaattttcaaaagaaaaaggtttaattggacttacagttccacgtggctgaggaagctttacaatcatggtggaaggcaaggaggagcaacccacatcttacatggatggcagcaggcaaagagagaacacttgtgcaggggaactcctctttttaaaaaaaaatcatcagatcttgtgagacttattcactatcacaataacaacacaggaaagacttggccccattattcaattacctcccaccttgtccctcccacaacacataggaattcaaaatgagatttgggtggtgacacagccaagcgatatcatttgttatgaatgctaagagcatctactctctgcaaattagagaaccagaaaaactggtggtgcattttttatcaggtccagaggcctaagaaccaggggagtcattggtataagtctcagaatctgaaagcctgagaactaagcactgtaatgtttgatggcaggagaagatggacgttccagttcaagaagagagaactcatccttcctctgcctttttgttctattcaggccctcaatggactggatgatacctgcccatattggtaagagcagatcttcttcactcagtcttctgattcaaatattagtctctttttgaaacactctcttagacagacccagaaataatgttttaccagctctttctacatgccttaaatcagtcaagctgtcaaataaaattaagcatcacaagcagccttctctcttgtctgtttgctttcaacacattgcagtgacttttagtttacatttggccagttaaagggatctgtattttataatattaattttacaccaaactaatgctcaaaaaaatgaataaatagctgagaaatatctctgcaaataaacctgagattaaaggtaacactaatgatatgtgtagaagtgaacaccaacagagatggaaaaatcccttcccattcctctgctaaaacagcttaatcagtcatgttattaggtcaaaaccgtggagatccaggcagaccggaaataaagtcagactgacaattttgatgtaattaatacaattatttataatgttgacttatatataatacaattaatcattttctatgtgatatatgaacattgaaaatttaatgactgataaaatacatgtataattcttaaatattagagtgtgtactcaaaaatattttttaattcatgggatgaaggatcataaaagttatgtattcattataaaatgtagctatcattaactaaatgatatggttttggctgtgtccccacccaaatctcatcttgaattgtaactcccacagtttctgaatctcatgggaggaagcttgtgggaggtaattgaatcatgaaggcgggtctttcctgtactcttctcgtgaaagtgaataagtctcacaagatctgatggtattaaaagtgggagtttccttcacaagctctcttttcttatattttgccatgtgagacatgccgttcaccttccgccatgattgtgaggccttcctgaacatgtggaactgtaaatccattaaacctctttcttttgtaaattatgtagtctcaggtatgtctttatcagcagcatgaaaacggaataatatactaacatacacacacaatcttgcctaaagttatttatgtcttaaagttcagagctccactttatgaaccctctcatctccttgaattacttgaattagatcaaagatggaaaacattttttgtttcctaacaagtaaaataatctttttttcccctcaccttaaatctgggcaggaattgtccttgctttgaccagtatatgatagtagattatttctactgattcagttctgggatcaggccttcagaagtttgatagctttcacttttgccttcttaaaaggcaggcatacatgcaattaaatggactattttaaataaattctataaagaacattttctttaaaaaataatttccaaaatgtagaagtacattaaaattagaagaagcattctagagaatggtaaggcatgaggaaaaatacaccttgggggatatatttaaggttatataatgtttgaaaaaaccacatgtgctcagctataagtgttcagttataagaacccagttgtgtagcacaaggatcatgaaacaaaagaaaatataaacaaaaaataagaaaacaaaaaaggaaacagaaaaatatggactctctgataactgtgaaatatgaaatacaaaatgaaatatggtaactgtgaaatatgaaatacacaatagaagaaatgttgggcccatgaacattttcatcccttctcaatgtgatatatgcattgaggaagggacaaaaaatgtgtttttctcttcacatttccaatatgagtatactgtatacttggccatgaaagtgctaatacttgataatacctaccacagttaatgaaggttgataaaaaaatttaaaccaaggtttctggctctagtatctccattcttaatcaatgggtgacaccaacattttagttgccagaatattcataatattattataatcatactttgaaaaattagaaaaaatactgttagcaatattatatttatgttttagtatgtaacatatatctcatctatatgatatttaatacatattacttttcacacattagctgctcatataagagtacttaatactacaagctactgttacaagctaaagtcagcagactttcttatattattagaaataaatacacattgtatgatatcattattaatgacagtgctgcaacagagcttgatagctgttaacatttacattaaaaatggtcagacttgataacacaattagaagcagaaatttcagctacatatatgattaaggggtctacagattatgcttttctttcagagaccttcatggcaggtttctccaccataggccttgagacttaggaggaaagaatggttttgtgggccaggaccacggctccactgccctgtgcaacctcaggacactgcttcctgcatccagccattccagctctagccatggctacatggcccccagatatgcctcaggcctctgcttcagagcatgcaagccatagccttggcagcttccatgtgatgttaaacctgtggacacacagagggcaatggttgaggcttggaagcctccacttacatttcaaaggatgtatggaaatgtctggatgtccaggcagaaatctgctgcaggggtggagccctcatggaacacctctaccagggcagtgtggaagggaaatgtgaggtgggagcccccacacagagttcccactggggcactgcctattggagctgtgagaagaaggcaactattctccagaccccagaatggtagatccactgacagcttgcaatgtgcacctggaaaaggcacaagcaccaaacaccagcccatgaaatcagccaatggggctgtactgtgcaaagccacagaggcagaaatacccaaggccttgggagcccaccccctgcatcagtgtggcctggatatgagacatgaagtcaaaggagattattttggagatttaagatttaatgactgccctcctgggttttggacttccatggggactgtagaccctttgctttggctgatttctccttttttggaatgggtgtattcacccaaagcctgtacccccattgtatcttgtaagttttttcaggctcataggcggaagggacttgccttgtctcagatgagattttggactgtggacttctcagttaattctgaaatcagttaagacttggggaactgttgagaaaggatgattgtattttgcaatgtgagaatgacatgagatttcagaggaaccaggggtttcatgatatggtttggatttgtttccccacccaaatctcatgttaaattgtaatctccaatgtaggaggagggacctggtaggaggtcattgaataatggggggaaatttcccccttgctgttctggtgacagtggtgtcagtgagtgagttctcatgagatctggttgtttaaaagtgtgtagtaccaccccttctctctcctgctctggccacgtaagatgcgccaacttccccttcagccatgattgaaagtttcctgaggcttctccagccatgcttcttgtacagcctgtagaactgtgagccacttaaacctatttttatttataaatcacccagtaacaggtagttatttatagcagtgcaagaacagactaacacagaagaggtattaaatattctctaatggtagaatttaccagtaaagcatctgatccagaattcttctttgtgggaagatctttttgattactaagtcagtctattaacttgttaaaagtctaccccaattttttattttttctgaagtcagtttgaatagtttgattccaggaatttgtccattgcatccatttgtctagttggcataaattgtatataatattccctcataacatttttttatttctctaagctaaatagaaggtcctctctttcattccaagttagtaaattgcatcttatctcttttattcctggtcagtctagctagaggtttgttaattttgttgatgatttcaaagaattgattttggcttcatttattatctctactgatttcctaatccctcttttattactttccactgtagtctctattatttctattgtgttgtttagctttctttctttttttttttttttttttttaaagagagtcacctccaatctcctccatcactcaggctggagtaaaatgatgtgatcgtagctcactgcagccctgcagccttgacttcccagacccaggtgattctcccaccttagcctcctgagtagctgaggccacaggtgcacaccactatgcccagctaattcttgtattttttgtagagacagggtttcgccatattgcccaggctggtctcaaactccaggtctcaagcaatccaactgtctcggcctcccaaaatgttggaattacatgtgtgagtcaccacagatggcctcccttctgctctttttctttagtttgcttaacatttccagtgtctttgtgacaaatattacattattgattagagattaaaatacatgttacaaagtattgttatttttatttgtctcaaagtatttttctgattttatttcttccatgagtcattgattaaagaatgtttaacttccatacacttgtgaatttccaaaatttccttcattataatttctaattgcattccatttttgtcagagaatagagtttgtattatttcaatcatcttcaatttaacgatattggttttatggcctaacatgatctatactgaagaacattctaggtgcacttgagaagaatgtgtattctgctgttagggggtagagtgttttgtagatatcttttaggtctagctgctttatggagttgttccatcttgaccttaagttactgcatttgcagagtttcaaggttagtcagagatgagagcttagggccttcccaagtgcttcctgagtatatatacagcttgcttttatctttttagaatcccagaaatatgttaaactttttaaaactccctatgaacatcattatctagcttttcctttaaagacttttggctagtcaataattctgccattgatgttcatgacagtagaaccattgaagaggttgacaacagcccttggatgacctcgtcatagacatcagcatccgtatcctcacatatagtaaacagagactgtctataacaaatggaagcaggagaggagtcgtccatgtggtaatttactgttagcttggagaaacacatatattcagaagtatttgtatggatttagggaaaattaagagttttgacaaagtacgtgaagtcagagtcatggatatccccttctgtgtgtgtgtgtgtgtgtgtgtgtgtgtgtgtgtgtgtgtgtgctgtgtctggtttttgtttttgtgtttccatttgtaccagactgatgtgacttaggtaacatgccttattttccttcctaatgctaataacaatgtcaactaaaatgtattgagcattaactttttttccaggcagcattatgtacatttacaatgtattggatcaaattctcacaacccttttgtacaaagatctatttttgttaatcctatattaaagaagaataatctggtcaggtagtggctcacgcctgtaatcccagaacttagggaggctaaggtgggaggatcgcttgaacccaggaagtcgaagcttcaatgagctatgattgtgccgctgcactccagtgcgggtgacagagcaagacactgtctcaaaagaagaaaataagaaggactaatttcaggtaaaggggggctaaataacttaaataaaattatgtctagtgtgagttaaagtcaggatttttaacatggacagtacaatttccagaggctacactctcaacccctacaattctcttccttctaaaaatgtaaatagtgtaaaaggatattattcatttaccttagctgtgacagcaaataattgtaagagtttatatctattgtttgggacaatccactatcctacggttgtaggctgatgaaactttccatcactgtgtcacttttctgttaaaattttttaattggctcctcatttcactcagagaaaaatacaaagtagataaataacatacaaggctctctagtttctgctctgttcttatctgtcacctttctacttttacctcactcacttctttccagtacttccggcccccttgttgtttctgaaacccacctggcaagcttcagttttgatctctgcctagaactcttcccggagatatcaacgagaataacttcctcagcttctgtaagcctttgctaacagcttaccttttgatgacacaagtgctgatgatactgcttaacactgcaacttctactacaatcctcctctgcttttccaatcccattcatatgatcgatttttcccatagcattcacaactttctaactttgataataaacacttacttattatagtaaatgtttattgcctatctcttctgccagaaaactggctccacaaagtcagtgataggggttgcttcacagggtaggtgatcgtttgttgagaaaaagaatgcacataacttttaaaagtgaaataaacttgaacaccaatgcatccaactggctctgagtatcataattatccaagtctgttattaaatttcatcctttggcttttgcacatgctgcattatctatatagataattgtctctctttttccacctggaaactcctgtctttctgctaaaatgacacttcctaagcaattctcataaaatgcttaatgctctcctctcatgagcctacatgtggttcaaactttatttagagtgccttaaatattgtattttaatttatcttttacgttgttttaatgttttttagccacagactccacgactccctaacctagaacattcatctctcatatttgtgtttttagcatctaataagagtgattgacatacagtcaagccttcagttaatgaaataaatgatgctttattatctacaccaagatctctatagacttaaaatagtttctgtttatgaaagttttttacaaatataaaagtctgagctctgcttatgatatttgtgtctttataaagaccaaaggcttgaaacagaattgcttgaattttctttacagacagcatttctaagaaggatacagtatgatatttgcaaatctaatatctgttggttgttgtgtatttgtatatgcacataggcttcaagtaagaggacagaaaggggttgagggctaatgctgaactccattaaagttatttttcaagcacacttcaaaagaagccctttctcccttaaaagatatatagcctgtctcacatgcatctgtctgtctagaggctatgcaaatcagcaacatccatatttcagcaaaagcaatctaagaagagcagcataatcaatttctcatcatttttgcttttgacacaattagtagtatatgcatagggatggattaggatggtttctgtggaatttttcaagaaaaatatttaccaaaggttaatatttcgtgttcccttgggctaatcgtgctctctcaccttttttttttaaatggctccaaaatagctctttttaaattcagtcatatattatcacaattatgtatagtaaccaaccaaaggtaaaacacgtgtaaaatgtttttcattttatattaaagctgaaagttggtgctagaggaagttttatatgataagttgatatgtagaaaaatactaatatgtaggttaatttcctaatattttgaattgctttgcttcttccataaaagttattcatttatcattctacacatttcagtccaacaaattgaggaagcaaatatcttgaattattatttttaaaatgtgtttatacacaaaagtaacaatcatgtcaaataataaactttgttatttaaaatatttccttggaattgagagaatttgttactgtaagattctagaataactgatagtgtaaaatgttatcagatacaaaccaacaaggatggaatagaggattcctggcctatctgatggcggttgaatattccggtcctgatcaatggcttggattggtggcgtaacaataatggggttcagttcttcctgaaaaaaaaattaagagagtttcattcagccgcattactaatacttcatgaaggattgagacagatgctttagtttggaaatctatataacgtctgagacagtaaactcaagtttcaacatttatgatctaataccttttactagttaattttgaatgttaagggggagcaaagtattctcaaagtcaaaatggtaagacatagtgattatgcacatagacatttatatcagtaactactcctaaaaggaaatcaaggaagaatgataatgcacttttaatcttctctagaggatttcacaaaagaaatagcagcctatcaaatagtttatgaagtaatgttttctctttgctttagacaagatttgtaagaatacttgtattctttccttgctaaatcattttttagtttcatacacatcaattatattaaaatataaataaagtaaataatttcataaaaataaaagtcacattattgcaaatttcatataattaaaattgattttaaatattgcaggtatttacatgtattttacaatggtctataagaaataatgtttaaaattataatatacttctttaatttggtgtttcccaatttaatgtccagtactattttgttgtgctatcaggactggcaaacatttttctgtaaagaaccagataataactatctttaggctttgccaaccatatggtctatgttgcagctaccctcaactctgtcattacagcaccaaagcccaagtgggcatggctctgttgcaataaaacattacaaaaacaggtggtaagttatatgaggttactgactactgtgatcataatagatatgctaaaaatacaacaataggtatgttgaaaaataataaaaagcttatctacacagatatgcttgggaaatatgatattaaatacagttttgaaagccaattaactgtactgcaaatcttttcagacttaattatgctaatctgcatactgactttctaagaaaagggtactatttgctcactttcaagaaacacccattaacctgtttttgaaatgatgcctttagaacacagtttgggaaacactactctaagttatgtagccctcatcccaaatatgtaagtggtaattctaaatgaaatacttctaaagggtaattctaaagggaaattccattacatatttgggctgagggctgtgaaacttaaactactgtttcccaaacatttagtatgtctcaatatctacaaccttacattctaaaaaattactgcaatgttctcatattatttcttctcaaatgacagaacattgaaatatgtaatgtacttttatacaaaaccagtagtttcagttctcagcaaaaatgtatagtgatggcatgctaaaaaaagagcaatgatattaaaacattatgtataatacttgattttatattgaagttataataaggataattattgaccaataatttaaacaccatagacattgtatggggtttctctcgagttcattatcactaataggtcctaagtagtctaaatgttatcagtattttcctgaaaataaagagttgttggtagtagcaacttactaatactctattctctcctttaaacgtggaatcagaaccacgaaaataccaaataaatatcaaaattactccattaaatccagaagattattgttcttaaaacgcaactctcactgaacttttcctcccatgctgcctctctctctctctctctcacacacacacacacacacacacacacacacacacactttcccaataatcaatttgcttggtatgcaatacctgtatttctccctaaactgaaaaaaaaatctgaagttctttgaaatatgtatgtttgagcacaggacttaagagttgacaagctctttctagtaatttcactgaggaatctgattgccatcagccaaagtcagcttatacttaagctgtatcactcctggttcatataattaaatctgcagtaatttttccaaaaccgaggctctatttggatcctgtaaaggcatttcaaatctgaggattttctgcagttccattctgcatctcatagtcagaaaaatattttcctaaacaatttttgctattataaaataagtaatttcttatctagaaattaaaataaaattgaatcttagcttttcgtttggaatgtaaaatgtaagcaaatcacaatatttgaggatatgttggctgatcaccttcatctatttatttctatagatttgctaagttacctacacataagcagttttagctttaattagtaatgtagtataaaatattctttctataatatatagaattgttgaaatgagcaacataatttatttacattgaattgttgtataagcaatgtaaaaactaaaagtaacacatcaaacaaaaccaagaggaagggagaaatgaaaattaaattcctcatcttacacatttgcctgtgattaaatatatatatatatatatagagtaagaactgaagaactaaaaagaaacaagtgtagtatttagaattatattaataattagaagatgaaaaactgtgagtatctcaggatactgagcatggaagtgagggtagatgggatagaaaatattttacataaagccatttggtactgtgtgactatgtcattaccatagcccgtactatttgttttaacattattaataaataaattatagtattgagaataaaagaaaataaactctcttgataaaggctttcacaagtttctgcaaatttaaaagaaatggtgtggtttaaataacttatcagaattgacattttatcttgtcctatagagactagcaacttattttacaatatttatttttccttctgctaccataaatgaaattgtcagataatctaggattaaaggtgaaaagaatgatttcttaactattatgtgtatgattacctctcaagtaaactgtgctccatgaagcttgaaatgtttaaatattattaatacatgacattaaagaatactaaaaattatgatttttaggatgaccttgttaaatatttaacatattttataaagatatgtagcattgaagtcagaggcagacaatttatatacattaattagaagaaacaacataaataacatgcattatgtttgaacttctgtctgccaacacaacctccacagtagatgaaaccaggcctggaaagggtattcatataagcaagaacaacccagattgaaatggttccttagaataagtgagaattttacagagagaacagaagtaaaataataataataatatgtacgtattcagttcaagtatttttttttaacaacagggtaaatccaaagaaaactgagtaaaaataaaatgaaaaaggaaaaaaaaaagtagtatatagtagtaaagtatccaatgctgatgaacaaaggaaacagataaaagaaatagtctttgattaccaagtgccagcatattactgtccttgaatttattgaaaaatagtatccttataatgaacctctttttccctaagttagtttcaggtcagttctctgactttaaacctagagtaccaatctaataaagggctaaagataagagaataacagatggtgtgttggctctcttagagacatttacttaaacttctaaattctgttatttattttcttttgctttttttttttttttttttttttgagacagagtatcgctctgttgcccaggctggagtgcagtggcgcgatcccggctcactgcaagctccgcctcccgggttcacgccattctcctgcctcagcctcccgagtagctgggactacaggcgcccgccaccacgcccggctaatattttgtatttttaggagagacggggtttcaccgtgttggccaggatggtctggatctcttgacctcgtgattcacccgccttggcctcccaaagtgctgggattacaggagtgagccaccgcgcctggccaattctgttattttcattgaacacagttacagctctatgaagagaacagaattattcttgcccatgaattgaaataatgtaatcatttacaggatttagcaaatagcagatatttaacataattttgccaacttattctgttgagttatccaaagagatcactactctctggtcaactttgtaatatccactagcagaaaatagtccatctgtggctactgccaggtcttccacagttccaaaaaggagattgattcagtgacttgtttcttctgaagaacagagtctcttcacatagacaataattgctgttgcttattctctgtcgtcctcatttctcctagtttttgactttactgcctatattacagaggaagtacggtatgtgttgaagaaattagaagtccacccatagctcaaatatgcttgggtatcctttatggaaagtatcaaaatgttcctctattttattacaattgctatatttatctttttgccaaaagctttattggtctgtgggcagaaattatcttatttgtacttacaaccctcagcctagtgcctcacagatttcaacaaatttttgttatcaagtcaagaaacacagaaagagctccccaaaccctggatggttcttttatactttgcctctgaagcaaagctgctttctttgctgtctcatttgtcttcaagaagaggtcatgtctcctgaattctgttccagttgataagcatatattagaagcacacaggatagcagatttgcatttcattgctgtttgaactgtcagagctacattccctgtcttagtcatggggacacataagtaaagtgaattaggtccatataaagagattcataatgagaaggtaatcatagaaacgattaaacaataacaaaaaaagtcttctgtgaaaatactgtgtaattatatggtttaagaaccttaaaattattattttaattttaagaaccttaaaattattctattttgaatacatgcttcctattcattagcttttctggagacacaccttctcttttgagcaatgttaagacaatgttttcatgcagaactgttgtattattctgagaggataacagtagccaattaacatttgatgtgagtgagggttaattatgcctcatgaaacctcactaccagattgaaaatgaacttttggtctgaattctatttttatatatatatatatatatatatatatatatatatatatatatatatatatatatatacacacacacacatacatacatacacataatcattaataaaaatatattagcaagcaatcccaaaagattaagaagcctttttgtagatttaataaaatctcagctttctggtcatttaggtgttcatatggttatcttgaacaaaaggtatattcaagagaaacactcagatttcagagattggatacattcactgtttagcttatatcaggttaacagaagtcatgatccatagaacaataagatttaacctattatatcatccctaatgttaaatgcatacatgatgcctatgattttcactgtttcatgcatgggtaggttgtctttaaaataatatgaaaccagttcttacttttaaaatacttctcacttcaccaatgaaaaataatatctatcatttacacaagttgatgggtcagtaaacttaaaaaaatgacatttcgcagactgattattaaagcttccagccttggttgagatagacataatagaagcattgttaaaatactaaatattctcaacttggcatttgaatgatgtcttcatctgagtaacgtatacatagtagtatactgaatgtgcccaagtatttcaaattaactgaaggcattataattatcttcaagaaagaatatgttctgatacatccctggaaaggtaatctgagctcatataagtacacagtttgctgttataaaagccaaactttgatgtattatataatattccacttatcattgcttagatctttacactgtattttaatcaagtaataacatcatagtatttggagaaaggttatgctaaaatagtaaaaatatgctgtaagtattccaagaccaataattaagtgatttgaaatcttagtaactatataatttaatacctaagttattgaatttattatttagtacttaattactttcactaattttgtgtgttctttacatttaagtaggtgctttttcaatatctattaaagtcattaatatttaatttgtacacttcctttaacaacagaaaatttctactacatttaaggaaagtcagtgtcacgcctgtaatcccagcactttgggaggccaaggcgggcagatcacgaggtcagggatcgagatcatcctggctaacacggtgaaaccccttctgtactaaaaatacaaaaattagtggggcatggtggcgggcgcctgtagtcacagctactagggaggcataggcaggagaatggcgtgaacctgggaggcggagcttgcagtgagcagagtttgtgccactgcactccagtctgggcgacagagcaagactcagcgtcaaaaaaaaaagttagtgaacattattagtctcatttcatattacattgcaaatgtactattttcctcaaagctcttgattattttcagccagattcttgcttgtttccatgtgttactaacatagagaattagaacaaatcaaaaattttctcaaacacattcatatagacataaatacaattatatgttacctttagaggccaaacaaccatttctgttttcactttgcttagttttgcttttttcaagggtcagaaatatcagattgtttgaaaaagtatcagacatatcgaaatgtttttcctggtgagattattttaaaaaatagtaacgaattggggtgagtagtatgggccaagccaattactttgaactttttgtattgttatggaagaaacacaggttgaacattcacaaacctctttgaaactgattcactgcatatatcaaagttcctcaaatggttttgacaattattatccttagaacagaagagtgaagagcacatttgagataggtatataattatgattcatgaaaatcataacaattcatgcctgatcactggaatttcgtatcacatattaaaacaaaaactcacttagctaacagaaaatacccttgttttattatttccatgagcaaattttatgacccctccaatatcatactctttattctaccaagtatgtgtaaatttaccttgtataatgtgactgaatttgtttccaaaatgtgcatttcagtatcctctcaattgcatatttgaatacttttactgatacttcccttattttcaaaatacttccttgaatgtctttgtctttaaagtttgtttacctgggattatatgcctccttttctatggatcatcaaatgatttctagacaggcaataaaaaccttggctggtggtaacccggtaattattttccatgaataaataataaaagcctgtaacaaaatcttgttggtaacaaaaggttggtgacttgttccacgctgtccaagtgacaaagtctgaagcattactgcaatcaagttggctttgactatcaaaaatcgttttccacataactcaaacctgagaatatgcatttcacagatgttgtaaggaggatacatagatcacagaaatatttcttacaaccctttctcacattcttatccatttctataacaactattctggttcctacttctcacactgccacagggctaactcaaaatcttctggttattcacctccccttcattcccatcgtgcacatcaaaaatcctccaaacgattttgacaagcatgacccactctggaagtcagaggaaaggaagaaattgagcagacagagtttgctttaccatgaagataaggagacaatcttgggagaatttatttgttcataattttagtctcattaaatttggatgaatatttcaatgataataatgatatggttcccattgtgtgctctcatcaggtcaggagacgactgtttttgtgatgacttcaattcattgtcaaatcacaattctatctaggacctccttgttagcagggactgtgtgagcactccctaggtttttcaccctcaatctctccatataaggcctccacactcaataggaaggcaataaaacaaggacaacaaatatgaaacatatataacaaagtaggccttttttattgatttgattttggagaaataaaatctgattttgcattatcagatgcagtagtttggtaaaagaacatacatttttaatttagataaatgaagcaaagtaatgtacagttttcccaagtggttttatcattttatatttctaccgagtatatgtgtaataaatgtgaaagttcaaatcaatgggagaaaatggatttttaataaagaatgattaaatattggttatcaataaatagagaaaaaaattatgatagatattgactttaccaaataaagctttggaagattgccagataagtctttaccagatacatctttggtcgattgcttatgccaaataaatttttgtagaacaaaagtgaatgtatgagaaaaacacatgtattagaagtcaacatagtagaaaataaggtaaatgattacttaaaaatattgcaaatgcttgcttagcaatgatttaaaacaatcccaaaaattggaactgttgaaggcatgaggagatgtgggcttttatatctgtgatggaaataaaaagcaggttaagttcaaggaaaaaaaaaatgaaatctatcactaggtttgacaatatgtatagtatagattaaagcatttcaatttgagctttatcttacataaatattgagagatatgctcggagatgtgttgagaaggatattcattgtacaatatacaatttgctttttaaaagaataaatttcttattcaagtacaacctatgagataccttcataaatcaatagttcacagtctgatgaattatcacaatgttataattataaattccaggaaaaaaattgatattttcacaaggtctgacaatatatgtagcttaaacttcaggattgcactttgagcttcatcttacataaatattgagagggacatacgctcagagatgtgttgacaagaatattcactgcacaatatataatgtacttttaaaaataaatttcttattcaaatataagttatgagataccttcctaaatcattagatcacagtctgacaaattattacaaagttataattcattcatgtaatcacactgtgatcaagaaatagaatattgtcagtatctcagaaaaccacttattaaattatctactcataactacccctacttccatcctagagatggcctgatttgtaatatgaaagatttgttttacctgttttaaattttctataaattgaattacatagtataaaaccttttatatatggctttttaatcaattattatgtcttatatgatatgtatgagtgtaagattcttgcatataattaagtgcagtactagtatactcatattaatggttatactatcatccattagatgaatacatcatattttatatgttagttttttttcaactggcgatgaactttgtacttcttctagggtatgctgtgaggataatgctcttacgaacactcttgagtatgtcttcttactgatatgattgcatttgtgttaaatagaagaataaagttgcagagtatgtatacattctgataggctagattactgtcagttttctaacgtggttgtatggtttacattctatcacagagtaggagaattctaactctttcacatctttaccaatttcagtctcttaagattttagcaaagccagtgaatatgtattattatcttatagttgctttaacttgaattttgatgatgattaatggggttgaacaactgtttgatgatcttggacatttgtaaagtgctgttccatatctcttgcctattttagttgaattgtctgttttccttaatgattcacaagagttcttcatatattataattaagtcatttatcagcttaatgttttataaatattacaattcttatggcttatatttagaccctattagtgttatcttgtcaaagaaaagtttctaattttaatatagttttatttatccctttctctttccatatatacctggctatttcctctacctgtacacatatcctgaatgtatgaagtatagacaataattttccttatctatttccatagataaaatattgcactcatccacatcagaatttatgtaaactgagttggcttccctacaactttcttgagagcaaagtgaaggtctattttcttttatatctgtaggaccagacagtacatatggcacacggagactcaaaaactttgaataaagtgtttctttgttgtagattatttagagtatttttaggctcatacacacttgccttgctctctgaatttctgtaggacatctaaatacaaataatgatgttttttgagaatctatttataatttcaatatctttgagcttcctaaattgctgcatttaactacaggccaaaataatctggtcataagagtgaatcatatacacatataggggctcacagcgcttcattgagatggccttttggggtagtacaataaacaatgtcataaacattccaatagaatgaacggtgaactcctatgtcctacaacaaaatatgccaagcttgccaataagtagcaataaagcttttcgataaactagtctcttagagcttgaattatgattttcaaggtgagattaataatatctacattacttgcaccactgcactccagcctgggtgacagagcaagactctttctcaaaaaaaaaaagaaatatgtatatatatatatctacattgcatgattgatgtgaggatgcatgaaagaatatatatatatatatatatatatacacatacagtaaatgacattcttaatatgtggaaattattatagttagttttttaaattgataattttaatgcttttaaattgtgtaatctgggtgttaaaattgactccaagttataagctagggagaaaaaaattttcatttgaaactagaagcttaattgataccatgtcttacacatctgtctgaaaataggacagtgatatgaattttgaaagtttatttagaattccatagttgatcaaataattgaggaagtaaaaagggattatctatctctgctatttaacttgaagccaagcttcaaatgagaaacttatgaattaaattatttaaaaatcgtacttaaaaataagatagtctgccagagagttgaatattcacttaaaatagttatcttattttgatttatttaaaggtaacttcagtgaaattattttctatagactaagacatatcatacttttatatccaataataaattcattccctacatttttattgtaaagagttgaagtgaaatttcttaatttgttaacattcagatgaattatataaatgcattaagcagttggcaggtaccaagaactctactaactgctcaagcagtagaaaataaattagacacaaattctggagatatgaaaaagctcacagtatcagggatggggattcaaagtgcaggtaccacaagttaatttagaaaatgttttgttagggcatttctcaatacatggtaagagaaagctctgataaaaaaattcatgctgtcaagtattaaaggtgaattataaaaaataacaacaaacagacattcaagcatgtgtactttgatccaagtatcaaatgtgatactgctagtgaaaaatgatgttcttgtctctgataggagtgggaaaaaagagtaacaaaatatagtagaaaatcatctagagacattttgaggagagtttctaaatcgccttaaaaatggaggagtttaattttcataaactgagttgccaatgaaaaacttctataggtaaatagcaaaaatatttattgtcttggtgattaaaaaatgatcctagagtatctttaaaagtatagttcagagaagcaaaaatatttataaccctaccacccaatgattatcatttttaatatttaaggtattttgtatcagtatttgttatctatgtatatatattgcttgtctaattgtccgtatataaacacatgtaatattttaccatgttccatatttaattttgttgacattttcatctcatatcataacattggtcttcatcaataaatatgcatcaaaaacctatttttgcaatagctttccaaacccactaatgtcataatttataaaatgatatatttcctcttcagtagtgtgtaaaaaagtctaactgcagatgcttgtcaatagtgagggagatatacatctagagtgttgctagttaagcataaagtataattttaaatttctttggtcactagcataatttacttgatatatttgtgtcttgcctgttcatttactttgcctattttgctttgttttaatttgggcattttaaaattttatttccatggcatatgtgaatagcatagaaatcaacactttgtcaccagccttaaacatattttcagtttgttgtttgccttttagtgttgtttttgacatttaggaggttggtgtttttatttactcaaatatttccctttccttttggatttcaggctagatactttaaaccatctgaaaattatgtgaatatcaaattatctattttttttcaagtactatggcttttttatatgtaatgtttcaatccatcaagaaattgaatagtaaagacttaatactcaccaaattataggtggaattttaatctttatcatttataacagaaataaaactagattgaaaaactatattttcccattgtatcttaaatggatatcttatttatttatttatttgagacagagtctggctcagttacccaggcttgagtatgatggtgcagtctcacaacctccacctcatgggctcggaccatcctcccacttcagcaccagagtagtagctgggactacaggtgcatgccaccacatccggctttttttttttttgtattattggtttcaccattttgcccaggctggtctcgaacttctgagctcaagcaaaaggcccacctcagcctcccaaagtgctgggattacaggcatgagtgactgcacctggcctataaaatgtaatctcattgcaaaactcaatgatgccatgcttctataatatgctattacttttttttttttttttttttttttggagacagagtctcgctctgtcaaccagttgcccaggctagagggcagtggcgcaatctcggctcactgcaagctctgcctcccgggttcacgccattctcctgcttcagcctgtggagtagctgggactacaggcacccgccaccacgcccggctaattttttcgtatttttagtagagacagggtttcatcactttagccaggatggtctcgatctcctgacctcatgatccacttgcctcggcctctcaaagtgctgggattacaggcctgagccaccgcgcccggcttattacattttttaacacaggttttctctagtagaagagagccatgatatttaggattatggatatgtgtgaaagctagacatttaaaaagcacacaatgacttgaaatatggaattgggtatcaaataatctggatttacggaaaactagtcacaaaattcatggagataaacaagatggaatgccaaacaagaaaagaccatgtaattgcatttgttaaatgtctctaatgtgttccacatccacttcccaatctctctctcacacacacacaacccaacaaaactgctttccttgtaaataaaatttgagggttgaaaaccaacatgtatactttttgcattacacatgtactttaattatcattttaaattcctatattaagttaaaaatacatatttagattaattttattggtttaattctttttcttcaacagtcaattgacagacgtctttgagtacttttattctgaagataatatgaatccttgtatatatgagaatgatgtttcattcttaaataaaaatttgattgaattttaggttctctatttacaaactttttctttcaatgcactgcaagttctacctaatctttgctttctttatgctttcttctttaaccatctggtagaaatttgcttttatcctagaaataaatatagtttaccagggattttccaagtatttgtctgtgctttaactgtgattcataattaacacttttgatctgcaaacacaggttctttatataacccttgagtgtttttgtctttgtttttgtttttccttacagtatctttgttattgtacttgcttacttctcctggtttattaataaacacaaactaattacatttttatctggctctctgatcttcgttgctttattctcctagtcagttcgtctgtagtctggaagatttttcaaacatgtaagagcatactataaaatcgtagagagtgctttttttaaccaggctgatgcagacaaagtcttgcctctcaaattagtttctgtgaactccaccttttgctggtctataaaataaagagtaatcttaccttctttaccaagaggtttgtttattaactgtggaaatgcttgtaaaacacctactaccattgtcctatcaagttctaaaaaaatatttgttattattgtttagagtcgcagctttgctttctgcatcttaaatcctatctttctgtcttaaatctcttcagtttaattatttcatttttcttctgtatcaatatctttatttaactttcaatatcatcctatatattccattcttaattaaattttatttcttatccaaacttttaaaaataatttaatagtgtttcttttagtcaatcttattaaatatatgctcccccctgcctttttatcttcagtgtaaaatgctgctctaatgttgtggaatctttcaagggattcaagtgtgtttgaaactgtgtattaagcgatgatcactaccttgctgactgcaaagtttccatatttctgtggtggagaggtagaaatctctcctttatccctgtctacatctcttttccctctactgctgctttcttacactagtcttggcaaaaatcgtacttagaccccttgtttctagtgttgatgcaacttgtcatccctttttgctgtctccacaagtacatcaatagggccatgagtaaaactaatgcagatactagtagctgcctgacatttcaattcagacctactctatgtatttcaatccaaacctactttaggttaagagatggaaaatgacatcacagaagaggtgttagttaaaactatgttttcaaagattgatacttcgaggcaaagccttctcctctaacttttccagatagaataatattgattatcctcactattcccattaaaatatgctttcctctgcattagattattaatcagaactctcacattcttagttcatcatcatatattttatagcagtccagtccagaggaaagcatgctgccatcagagccagaacgaccaaggtcttcaaaactcttctccacaacttattcattatgtaaatatatctttctaaatatcaacgttgtaagtgtataatagtaacattaatttacaacgattcatatatcagattagaccaattaatcctatgtcattttaattatagaacttttctcaggatttttttttttaaagtaacattagacggccttgcagtgactgtcccagggaacattcaataaatattagttttataatttcttattattctatttatgtataaatttctttctgatctgtactatagttatattgaagagaatgtctatttctttcatgttagtgccttacttggtgcctgacacattgtagatactcgattgccacttattgaatcaaagaaccaaggtattgattgaattatgggagtaaaataattacaacatgttataaagctgggagataggaaaatccaaaagaagagatacattttggggaaaacaattacctagtaaattcgattgaggattgggtttactagagaaatatcattttaaattcacaattcagaactggagaaaatttaaaagagtaagaaacagaaaaaatgaataaaaataactttgttttgatattaattttcatatgttgattgaaccttcaatataggcgagaatattaaagttactgcattttcctacagtttttttgggtatattctatatggaatgaacacagtggtttttattgtcagaatattcaaatattactactaatagcactatctgtcactgatcacattcactagcacactgtagaccctacatgtacatcgagaatattgagaaatctgtgacaacagtgagttatatattttattgacttcctctagttctgtatcatccagcatagaggacacataatactttacaaaatatacccttgctgtatgaagtaccaacatttttagtttcatttacagaacaaattctgaactttgtctctgatataaattatgttatacagcagcatttaaaagagatattagtgattagtgatttctttttataaatgcaatgtgaactttagtaatattaaaataattttgtcaccttactatatttatattaaaatatgcatatggtaatgcttgctataaattaaatcatataaataactgttccttttacagctggtttgaaaacattcttttgctgtcttttaacgtagattttagatctcaaatactgtatttttaatttaatagaacacatggccatttaatactaggaagaaaaagagatgttaatgtcattttccaatagtatttaatctaatatgttaaaaattttaaacatatacagcatttgtgcattagctttaggaaaaatacactagcagtaattatattctttgcagaaacatttctgaaattaacaaaatgaggaatataagtaaaccatttttaggcattgaaaaggataaatttatcctaaaagatgttgatttcagactcaaaataccataaactctatctgtttcttggtatttaaaattgaataaagaataataacatcctcttattaccaagaggacctactgtctcaccccgtggttagtgtatgtgacttaagaagcaatgattagaatttgtagagatgatgcaagtctcacattgacaaaaagaaaatttagaaaacagcaatgctaaaaatagaaatgcacaccaggatatactagcaacataaagttttaatgctttacagagctcatataacctgaattttctgagaatacaagaggagcgaaaataaaggttcatttttttgatagatagtcttggtgggattatgtctgcctcactgaacagtataaaacatttggcagagcatgtataataaccaccaatagcatggttcccaattcactcttactcaactcccacagctagcatctgaatcacaaacagaatagaagcttcccagaactcaaccactggcaacatttaaatccctcagcatactgaaggaccttgggagattagggtctttttgtggaagggcaaactgaaacacttggttttaatgtttgaaattatcatgacctaaatttgttttcacacttctgttttgtccttgtagtagaggtgactactttaaccacagcagggtactgttgataactctggatgctgatgcctgtaaggcactgatagatgcttcataaatctttttcaaatgacattcttgatatttgcccaccgggtctctggaagcatctgctaaacttctcaatttgtcttcagaatttcaacgtaattttttttctttctcctttctgcattggcaacaatttatgtcttccacataggatgtacttctttcacactatgtggatatttttaaaagtgtaggtaccatcacactcgcatcagaagcatctgttaaagtaatcacactggtgggggtgaccccagaaagcacatattctcataacaccttacaagagctgtaggtaatttgtattttggacaaacatgtcagactttttttatgtacaaaaaagatgtatacaaactataaccttttaaccctttctgataagccttcctatatcctgacatcgatttccttcttttacttgtttctctctcagtactcttcaaaaagagaggtggtgaccagtgttggaagagatgaagcagatgcacatcacttcctttgggaacttgctgaaataattctttgcattgcattttcatttacattatgctgaccagttctcttcacttagaactttcttagttgttcttttgattcttactgttgaaaaccaagattatgctcttgtgatgaagtgttttcaaatatcaaaatctgaataattgggcagcccactttcagaatcttatcatgaagtttatgctgcaaaatgtcagtttaaattgaaatattcaaactagtagcaaggtaccaatgataagacatccacagacccaaaagttaactgaattcatatgctattttttgctgaacttatctaactggtagccatacacagcaataaataggctggcaattatgcatgggggaaaatggagtttcaagtgtgtagtatcatgtctataagaataatattaatgatagcctgaaagcccactcagatatctcacagagcctatactctgtaacttagctatcatatataatctgtcctggggatttacaaccctggcccaagaattaccaggcatctatgaaaatgcgacctagaacaccagttgccctagagaaaaagacgcctcagcataggtgcaaatttcatagatgttaaaacaaagctaacccttacaagaataacttaaactccttatatgaaataaacatctgataattgaccaggactgaatacagatgtaagaaaggggaagacctccccaaattccgagaatagtctccggaaggataccctcccagctatttggtggccatgccaccagcctgctcccactgtcttgtaagagcactgccacaataaaccacttgggaatcaggtgatgtctaagactcatctttgaagcgtatcctactgaagagaagaagttgcctctggagaagatggtcagctaggctcacctaagaccctggagtgcaatggcagaaaagataaaaaaaagcatttaatgatgatctgatgactaacaaagcaactaataaataagttaacttttaaaggtaaagatgaatcagatggtcagctttacttagaaatatttgagataggttgtcctaattaattaaccaacaaacacttattgagagaaagtgagtagattggaagtagactaacatttattgatactctacttgcatctggttctgtaggtttaattttcacaattctactgttatagaacctatcaaaagcttcaagtaataagtaatatagattgaatcagaatctgactttgaatactctgttttttggatcaatttgactttccaccattatatgtgtaaggctgctgtttcctcacattacctacctgtcctggctgattgtacctcctactattgtgtttcccattccttagtatctctggtttatttttcttattaaaataagccaaaactttccttttccaggtttttcattggttatttctttagccttccatttatatctcacatttcaactcaaattctccttccttagagaagcttcactgaccactctagttaccaaagaatgctgtcttcttaatagtatgtatcagtgcctgaaattttttgttgaaattttaatttcctgtcttcttacactgaaatgtaagctccctgaagcagtaaaataacaatgtctatatccctagtacataaaacattgtcctgcactaaaagtctttcttgttcatgccttcattcactttctcattctctctctctcgatagattagatagatagatagatagatagatagatagatagatagatactgagatagagatatagtgtgtatgtatctataactgatggactgatttttttaggtaatgttccttgtcaaggagttgaaaatataattgtaaagaaagtttaactaatatatgatacaactaacaattaaaacaatgtatagtatgtggaactcacctactgaattactgagaggacagagggttgcgttatgagggaatctgaggaatacagatatcacttcacatttcgtcagaatttcacagtttaacatatattttatttcatttgtgcctcataggagctgtgtgaaataaagagaattgtcttctttttttttttttttttgtcaaagaagtcaaatgacatctcaatccacaaatccagtggtaaggcaaggttccctaaagaagataaacttgctaaaaatactaccctcctttgtttatttttcagaaatttaaattgctactcttcattgagaaaattagagcaaatgatgagattttttaaatctgctactgtgagtacgtgtatgatatttgatgaagttagcttgctgaaggcatcatagatcaaatccctaaaacaagaaacattttgtggccttacatgtgtaggattggagggtgtatgcatacactttcagtatattctagaaatcagtgagctacagtgtgatgtcatacagatatatttggccactgaccaaaaataaaagcatgctatagaagcattcgtcttgaaacaatatacttgccaaactgtctttacattggaataagccaatatttttatattttatatgtgcaggcaatcaataaaaaattgctaaggaacagagtctctattcacagtcctctgcatggggcacggcccagtacacattaagttgacctactgcatgatgtccagtcagtattaaaagggcttaacgattaaaaaaaaatcagatgtttaacatgtaaaagataattaattggtacattcaaagtctctcattcttttttgggatcatcctctgtgcttgatttttacccaatatttcagagccatttctgccagtgatgaaaaactggagatgaggttgcttagacacagcaaatcctgtatagccaaagggaagctgaaggtcaaagagtgaattagattgatgtcttgttcttgttgaaaacagaatttatttgttttgctgacagagaaggaaaatataaacagtcaagaacgggaagacatattattttgctataaaatgaattcaagaggaaataacagatataaggaaaaacacagtgaatattattataggaataattcattagaatagagagacaatgaacttaaacacttgctaattctcctgctgaaatggatcaagtgattgcttcgactggagaaaaatcctaaactaacctaaatataaatgagtgctagaggacaggcagaatcacatcatgacacagacttaaaggcagagccagaagtacaataaagttaagacctgagctctccatataaaacaaaccttgtgtaacaagtgaaccacccaggtatgtctttaaatttatttttgaaacattagtttctgtccttaattattttctaataaaaataaaatcatttgataaaagaaatacaataataatatccaacgtgaataaagtctgaagactcagagggaaaatatttttttcaataactgtaatcatcgtatttctccaaaaatctcatttgcaaataatattgtgaaaaaaacaattttcgtgatataactcacaaggcagaagtctgatataaaacataaaatgtccttttgtttttcgttttgcatttatttcttatttcatcctgataaaaatgaatgcatgcagttttcaatatgagcaaataagtttttttccatatatcctttaaaactgtcttattcacttcgaatcttataaaatatattcatttaaattatatttatagaaaatcttcttgagaaattatgaaacttctaaatttgaggagatagtgacctaaattactttaaaggtaatcttgatcataatagaatgctgcagaagggctcaaagtttcacttttagaaagtaataaattgcatggcatttaacaggcctactctaaataagccacagccttgaaaagaaaattgctttagacactggtcctcttgccaatgtactgatttctattattagccaacatcttctaccggcccctgtctggggtcaccttaggtctagctgaagctgtatcctcagggccctgaatggattcagaatcagcatgcaacatgcttgtggtggcagtataaaacagtctacgtgagagaatggtccatgagagcaaaatcaatgtaaggataaatgaatgtagatgggatcaccaatcccaaatatgttacaagaagagagtgaacaaagtgacacggagactaagagaagataagaaaagaagtagaaagcaaacatagggtgagtattatggaatagttcttgagtaaaattcagtaactataaaattataattactatggctctatctgttaatgtagtgggctatttaataagccaaagcagcaaaaactagggcattactatggattagttctctgtgtgtttcctgaaacctagagaagattgtaggatataaactcaattgtgtcctagaaactcattttctatgttccagtcttgtaaattctacaaggttctagaaatctgtagtctaagaggcaataaacctaattatgaatatactaagacttagtcccttccaggaaaaagataaagaaaatactagtgaagattatttccttatgaaatgtaaacatggccttaatctagactaaaatacattttttcctaagaattttagggattaagatagattttctgtggtagtaacaggagcacagccgctaaatttatgccactagaagcaaggaagatcataggaaagatataacctgtcaactttgattcattttgagaaatcagtactcatgtaatgacggtaatggtatttatcgtatgtaaaataaaaccataataagcttttaaaatagtttaaggtacaaaagagtattttaaaaacaatgaatttgatctcttaaaatttattatagttttgtcacgagttttattagaagattttccatgtgttctttctgggagaaactatttaaaaagtccattaactttttctaaatgtttaattttttttttgagaaggaatctctctctgtcgcccccaatttttatttaacatgagttaccaaattagggtcactgcattcttattaactatgctagtttaaaaaaatttatagaaactttttaatgcttaaatatgccatcatatcactgccaacatttgtctctttttaatcaatatttaaagtaactatttccagtttttcattttaatgatttatatagtctttaaaaacattcataatggtttcagtggaagccatctctgtgttgatttttatgcttttatgtttctttctttttttgagacagagtcttgctctgtcacccaggcaagagtgcagtggcgcgatctcggctcactgcaacctccacctccccggttcaagcgattctccggcctcagcctcccaagtagctggaactactactactactacaggcatgcactagtagtagtactacgactactactactacaggcatgcaccatcacctctggctaatttttgtatttttagtagagacggggtttgggcattttggccaggctggtcttgaacacctgacctcaggtgatatgcccacgttggcctcccaaagtgtggggattacaggtgtgagccaccatgcccggcctgatttttatgcttttaaatggcttttggtctcattctttacagtaatgaccgctgttggtttgataatcaaccttcataatgttcaaacagtttatatttctgcacatattttctatttaaatactgacaagtattgtggtcttagtctcttagagacaaaataatcataaaatatttgttaggataaaaaactgttaggataaagacataaaaatgaagttttagaaggaaatgtagataactgtttgaaaatgtaaaatcagtgagaccttatttattgtaggataataaatagctattaaaaatatacagatttaacactacatgaaaatttaaacatttttataaaaaagctatcattaatatgatcaatggataaatgacagattttggaaaaatagcatttaccagaatgatttgtaatacctataataatactaatgaaaattaataataataatacttcaaatagataagaaaaagcatattgctaattgaaaaagacaaagttgttaataggcaaattacagatgagaaatacaaatgacctgtaagcatttggaaaaaaaaatgtttaggttcattagaatttttgggtgtagtggatgcaagtattaaaaataatgtattagatttgtacctgataacctgtaggaatttcctacaagtggtttttaaagtaaagcaagatacattaaaatgtgtatacaagtattctattcttaacacacatatgcatattacatctattttttataatataaagaattgaatgtcagagtacatatcagtgttggaggaagagaataaggaggaagcacagaaagtaaaaaggaaaaataggcaccaaaaaagatttggagaatggcagatggccaaggagatgcagctgggaagtgcctcttccatggagaggaacccaaatatccagtaaaccgtcacattttaaacagatcttttgagagaaaacactgaaagttgatacagaggtgacacagacaccatggttgaagagggaagaaatggggcagtctgctcagagtcactagacaccaggactggcccatataccttgaacaaacccaaggaaggggtgagtgaaggaaccctgggacactacatacccacaatgtacttctgagatcctagctacaggagtttctacgacccccatagatctttggactggtaggagagctgcctcgagcacatgcagaggcacagtttgaacccacaccgagcccagaaggctttgttgtgcggtgcagctgcagcaaaatgcaaccctaggtgcccatcccacaagtctccatttcatactgagtggctaagttcctgctatctgccaggctgggagtgaaccgtgcctggcctgctcacatgcccaagataggccccatcacccatgctgcgtgattaaggtacatctggtccacatgcccccttgcctgtcaacgccttcccagacctcatgcctgaccactcctgcaagagggtgtccacagcacaacatccactgcccagcttaagtgttttgttaacagcctgggagaagttcaccaccctgtccccaaatcatagccagtgcttaaagcttagaggccagaggacaaatcagtgagcccaggcccgtgagctcagtcccgtgagcccagtcccaactccccaagactccagtacaccacgcagggacattgagctgagatttgtgacctaatctcaagtgaaggaggaggatcctccacagtcagaatgcagagaagaatgtggtatgggttctcatggggcatgggagctggacacccctccctttgcaagaccagacaacgaaaggtatggcctgatggtcgtagctttttttccagggagtatcctggcacagaatgcctggagtagctcaacaatgtgggagcagatggcttggggaaagcctagttggttgggcttgccgccagggcgagtgtctgtgggagatctgctgggttaggggagtgtgagctaggcagacaccatggttgccagctgggctgaaaatcacgggctgcaagctccatactggtgttgcacccattgtggcactgccctgcctggagatcctctacccttgaaatactgcattttctttgtctctacacttgaaatactgtattttctttgtctcatgttgtgttttgagacagtacaactcatacctaagttgtgtatcacagcaactgcggacataccctaaaacctgctctgactttggtaagcacagtagactggtgggtctctggagagttgtgtccctagagatgtaatcctcagtgtggaccactcctgagggaaggggagtgcagcctgccaaagcacaccatgagataaagaaaatgtggccatggcatcagccactaaaagggtcaccaccaaggcccagaaccagacttggagaaggaatcatgtcttgcctccatctccacttcccagtgcactgttgcggatgcagcagtagctcttcccataaggtcctagaaagtgtgcactgaaagaagttgtttctcatgatgctccagtgaggacaagcatgcaccaagaccccacctgccagctcttactcttaaatctgtctaccagattgaagtttgaattatagcatcacataaaaatacattgctaaaacaagcaacatctatgaaagccactgcaggaacctatctctaaccaaggaacatatatagaaacttcacccctgcaactacccagaaatgaagccaatgaatcacatacaccacagtcatactttcaaggagaataaaaaatataaaagccctgtgatggttaatattgagtgtcaacttgattgtattaaaggatgcaaaatattgttcctgggtgtgttttgagagtgttgccaaaggagattaacatttgagtctggactaggagaggcagaaccactctcaatctgggtgggcaccatctaatcagctgccagcacagctaggataaagcaggcaggagaagacagaagagcagacttactgagtctcctggctttcatctttatcccatgctggatgcttccagttcttcagattttggacttttgtacttacaccagtggtttgccaggggctctcaggccttcagtcacagactgaaggctgcacatcagcttccctacttttgaggctttgggactcggactgccttccctgctcctcagcttgcagatggcctattgtgggactttaacttgtgattgtgtgagtcagtgatccttaataaactccccttcaaatgtacatctatcctactacttcagtacctatagagaactctgactaatacaaaccccatctaaatgaagcaaattcaaaaacaaagtatcaactcccgcagatggaaaggaataagcacaagaactctggcaatacaaaaagccagagtgttttgtggtctccaaagcctctcactagctccctagaaaaggatcctaaccagatgtaaatgtctgaaatgagagacatagaactcagaagatggatggcaaggaaagtcaatgagacataagataaaattgaaatccaatacaaagaagccagaaaaacagtccgaatttgaaagacaacatagctatattaagaaagagccaaactgaacttctggaactgaaaaattcactaaataaatttcgaaatacggttgggagtcttaaaaacagactaggccaagtagaaggaaaaaattcatagcttgaagactgattcttcaaattaacccagtcttgcaaaaataaagaaaaaatattttttaaaaagacaaagccttcaagaaatatgggattatgtaaagaaaccaattctacaacttattgatattcctgagagaaaagaaaaaataaccaacttggaaaacatacctgaggaaaaatttcaagaaaatattctcaattttgttagagatgttgacatgcatacatcagaaatccagagaaccccttttatatactataaagacagccatccccaagacacatagtcattagactatccaaggttaacacaaaagaaaaaacaaatctcagacacagctagagaaaagagcaacactacccacaaagggaaccccatcagactaactggtcttctcagaagaaaccttacaatccagcagagattagaggtctatttttagtactctaaaagaaaagacattccagaaaaaaacattcatattcttcaaaactaagcttcataaacgaaagagaaatggagtctttctgagtcaagcaatcggtaagggaatttatcaccaccagactagccctgcagaaatgcttaagggagttctaaatgtggatgtgaaagaacaatacacacaaaagcagagttaagtacatagtccacagactctataccacagactctataaagcaactacacaattgagactgcaaagaaactagctaacaaaactatggcaggaacaaaatctcacatataaaagttaaccttggacataaatggcctaaatccttcacttaaaagacatagagtggtgaattggaattaaaaaaaaaaaaaagaatcatccatctgctgtcttcaagagacccatctcataagtaatgacactcatgggttcaaagtaaagggatagagaaagattaatcatgcaaatggaaaacaaaaaagagcaggagtttctattctatcagaaaaaacagatcttaagcctaaaacagaaataaggacaaaaaatgttattgcttaatgacaaagggctcaattcaacaagaataattaactatcttaaataaatatgcacccaacattaattggagcaccaagattcataaagaaatcactactagacctaagaaaagatgtagacagcccctcagtaataactggggacttctacacccaactgacagtggtagatagatttatcgaggcagaaatctaaacaaataaattctggacttaaatttgacacttgaccaattaaacctaatacacatctacagaacactctacccaacaaaccacaaaatatatatttttctcatcttcacatggaacatactctaagagtgatcacatatgcagtcataaagcaagtgtcaagaaattaaaaaaaatattaaataataccaagcatcctcttggaccacagtagaataaaaataaaaatcaatagcaagaggaactctaaaacgcagacacaaacacacacacacacacatacacacacacacagaaactaaacaaattactcttgaatgactttcatttgggtaaacaagaaaattaaggcagaaatcaaagaactttttaaacaaatgaaaacagagacacaatgaacaaaaacctctgggatgcaacgatagcagtttaaagaggaaaaattatagtgctaaatacatcaaaaagacagaaatatatcaaattaacaacgtaacattgcacctaaagaaattaataaaacaagaaaaaaactatatccaaatatagcataagaaaataaataacaaaaataagaacaggactgaacaaaatcgagattcaaaaatccatacaaaggatcaacaaaatgaaaagttggttctttgaaagtttaaacaaaattgatagactgctagcaagattaacaaaaaagagaagatccaaataagcacaatcagcaataacaaaggcaacattagatccagtcccatagagattcaaaagattctcagagactactatgaacatttctatgtgcacaactagataacctaggagaaatggataccttcctggaaacacacaacctctcaagattgaaccaggaagaacttgaaacactgaacacaccaacaatgagttacagaattgaataagtaatagaagtccgggactagatgaattcatagctgaattctaccagacatacaaagaggagctcatgccaatcctactgaaactattccaaaaaatcgaggatgagagattcttctctaacttactgtacaaaacctatatcatcctgataccaaaatatggcaaatacacacacacaaaagaaaaccctaggccaatatatctgatgaacatagatgaaaaaatcctcaacaaagtacttgcaaaccacatccagcagcacatcaaaaagataatacaatatcaagtgaactttattcctgggatgcaagggttgttcaatatatgcaaatcaattaatgtgatttatcacataaagagaattaaaaatgaaaaaaataagattatctcaacagatacgttaaagtatttgataaaatccaacatgccttcataattaaaaccctcagtagactaggcatttaaagaacatactaaaataataagaaccatctattgacaaacccagtctacattatactaaataggcaaaagttggaggaattctcataagaacaagaacaaaacaagaatatccacttttaccactcttattcaacttaatacttgaagccctagccagaatgatcgaccaacagcaagaaataatagacatccaaataggaaaagaggaagttaaattttatttcttcactgatgataggattctatacctagaaaaccctaatgattctgaccaaagacgcctaaagttgattaaaaatttcagtaaagttttaagataggcaatcaacatacaaaaagcagtagtatttctatacaatgcaatgttcaaactgagaaccaaatcaagaacacaatcccatttatgagagccacaagagaaaaaaatgaaatacttaggaatacctctaaccaaggaggtgaaagatctctttaagtcgaactacaaaacactgctgaatgaaatcatagatgacacaaacaaatggaaaaatattacatgcttatagattggaagattcaacatcattaaaatgtctttactgcccgaagcaatctacaaattcaatgcagttcctatgaaactgccaaaatcattttttacacagaattagaaaattgattctaaaatttatatttaactaaaaaagagcctgaatagccaacacaatcttaagctaaaagaacacagacaggggcaacacattacctgacttcaacctatactacaaggctacaataaccaaaatagcatggtatgggtacaaaaatagacacatagaccaatggaacagaatagagaatccagaaatgaggcctcattcctacaaccaactgatctttaacataattgataaaaatgcaatagggaaaggataccctattcaattaatagtgctgggaaaactggctaaccatattcagaagaatgaaattaggctcctgtctctgaccatataaaaaaattaactcaagattgataaaagacttaaatgtaaaactttaaactataagaagcctagaattagacctaagaaactcttttggacattgacgtaggcaaagaatttatgactaagtactaaaacacaaaagcaacaaaaaacaaaaattgacaagtgagaccaaattaaactaaagagcttctgcacagcacttgcatgttctattgcaaatatgaaatagcaaaggcatggaatcaacattggtttccaacaatggtggattgtataaagaaactgtgatgcatatataccatggaatactatgcatccagaagaaagaatgaaatcctttcctttgcagtaacatggatgtgcctggatgccattatgctaagcagatgctgggacacaagaaaaatctttaagatatgtcactgcttcttatcaataataatgttctagtgagtaacaagagttaagaacaccactaattatagtactgtaaatataattacagttctaataagacatacacacacagagaacaattttgtctggtggttgaggaaatcttcattgatttaagatattttttgatgaacaggatttttcaataactatcagacgaagaatgtctatgacttatttttaaaaactattttcttctctgccttgcatatctgacattttcatctcctatcttccttgaatacaatatagaacctgacatttctttcctttcaaagatccttaaaacatttcctacatttaatctgaatgtctttctcagtaatttttcttatacaagcaattatggctacattttcttaatataatcatgaaaaagtgagcaactgaaaatttaatctggagaatatatatgaaacatattcaattaattcaagttgttgttaggctgcatatgttcagctttcagtgaaggtgattgataaatgagaaactgaaagaaaacaaaccaataggtgtttttcagaaacagtattattaaaatgcatgtgctttctactgaatgaaagcaatatagactttttcctcgcattggtagttagtaaggtgtataaaaacgactttgtaaagaacaattaatataggttaatgaatcactgtgaagaggggataacactttattctagcaatgatctgcaaggtgttaaaagttaaaaaagatgaaaaacaattgaatagttatttcatcatagtgtttattaaattgattttcctgtatctgtcaagctttacagaaatgtcttcaacagaataacagtgttggaagccaaatgaaatgcattatgaaatatgattcttcacttggtatgcaggtatactctcaggtgttaactcaggcaaagagacaaattcaattttaaagttccatttgttaaaatttgatgattgtgattaaagacccataacaattctatctttgacattttagttttttcttcacagaagcattctactgcaattttcttagttttctttcctcttaactgtggtattacccataaatgctggatttctctgttttaagtgtaacaaacctacaatcaactatttctggaacaccacttcatcttaacaacaaggacccataaatattctaaaaattcaaagtgttttatataaaatgttaaatgatacacataataaatttctaagtagtaattatgattatgcccataattatacccataatttaaaaatatgttacctgaagtaaattattacatattttatgttggaagtattcatttatctttgatctcttttaacacactgtactaggtggtaataaaataaactgccttattgggtagtcatttatcttttgtttcatattttttactggactaatattccaacgctatagatagtgaaatataacattcaaacaatttgatagtagtcaatgaatccagtttttaaaaatgggatccattttctaaaattgagtatatagatacttcatgaaatgtcttatcatacatcctaaaccaaaccaacctcttcccttgactgtcttacagtgcgttattattttatccactgcagcaactagcacatttttcagaacctagtagatattcagtcattgtctatggaatacatgaacacattctaaatttggacagtcatcattcttggtgttttaaaacaaacacttcctgaattgcacaaactattttctaaatagccctgggaattcattgaaggaaggtatgggtaagttgggggtcaaactataaagatgtaggttctcctctcaaaacttcttcagcgtatcctcattgttgtttgtttgcttgcttgcttgttttgaaagatctagatatagtctaatgagagttgtataaatgtgatgttccacaatgattctaacttacatggtgcaaaataataaaatattacattctagctgtttgtggaaaatcagggataatataaaggatctagattttctctctcctctcctcctaagatttattcactcagcaaagttacctggtgactacttactgctagacactgttttagatacttgggctataacgttgataagaacagggcttgaattagtgaaaagtttattttaattagctgtatggcaaaataggaaactaacaaaaataaacatataacatgtcagatggcaatggctgcactgagaaaaatgaaggagaataagaagttctaaattattatatatgaccaatattaccaacatattatagaaagaaatgagttcataatgtttatcagagaatttcatgaaaatcactaaatttttccagaaagccaggcactgataagggaataaacaaacagataaccgattttaatttgatcttctcttacaagtgcagctatgatctgccattgtatataatttaaattttaaaattgtttatatttctttcacataattatgttcttacattttgtttgtttgtttgttttgagacagagtgtcgctctgtcacctaggctgaagtacaatggtgcgatctcggctcactgcaacctccacctcccgggttcaagcgattctcctgctccagcctcctgagtagctgggactataagcaggagcccccacgcccggctaatttttgtactttattagagacagggtgtcaccaaattggcgaggctggtttcgaactcctgatctcagattatcagcctgtgcctcagcctccaatagatgctgggattacaggcgtgagccactgtgcctggccaatattcttacatttaaagatcagacatctatcagattcccttctccctgctacaaacattgtatacttttccataggcacaagattttgttttcattcaggttggactcaacaagtattatttagcagttcattgcatttatccatttacccaatagaggaagtataaaagatacagatgaataaagtgtaataattcttatactcactatttgcccttacatcatgtaagtgctcaactgtacaacatgtttgtgttcccaaaacctaactggaagggataactcagaaaaatagaataaaagtattgtatatctcatacatcttcattttagaatattgtaggggtacagatcagtataaataaaatactttggtaagtgcccaccacatcatctgtttgtcatccttagagccagattataccattctcattaagaaagaaaacttactactgtacctcctacccagtaacatatatatgatatatatatatcatatatatatattttatatataatatattatatatatatataaaacatttgctactggttaggagtaacactcagaaaatcatacttaataatgtagtacaattgggtataaattcacctagtatttttaaattttatgtatattcatatttatatgaatcatcatttaaaatcatgtctactgatcctgatggcattaaaggcataagaggtaccgaggatattaatttaattttgtttacagctatgcacagatatttttagttcactcagatttaatccagtagtctattatttgattaattgtacagctatcaaatcattcaggactcccactgtttcaacaagagtggaaaaatattttttcatttatgtttatatgcagctatttgtagtctaaattaatattctggcaattgatggtgaaattaaaattatttctgtcagatatggtaatttgatgacagtggataagcatgggagtaagagaaagttttgaggaagaggggtactttttgtttacttaatgattattcaaaagatgttaagtaaacattctatagaatgctacagatagtggaatacaacattgaaacaatttaataatgcagtcaatgaatccagtttttaaaaatgggatccgttttctaaaactgagcatacagacacttcatgagatgctttatcacgcatcctaaaccaaaccaactccttcccttgactgtcttacagtgcatagggtatctctacattctaggaaaggaattatctgtttatatgccacttataaaatcatacttaataatatagtacacttaggcataatttcacttagcatttttaaatgtaaaatgttaacgaaaagtgttcttgaaaaatatttctgagaatattttctaaaaaatgaacaaatcgtaacacctaagggatgatatctttctagtgaattgattatcagagtataatgtggtatgttctgattatgttacataatattctgattagcagaacattttaaataagtgaatttagcaaaatatttagaggttaaggaaactgttttacactgactatgttttctgacccaaatgtgagaaagaacccaataaaaagaggcagccagataatgctgttgtttgtgaacttaaacagaagcttgcatgtaatttattgttcaaagaaaaataaaaatagaagttatactttatttagaacttaatgacagtgaaaattacataaaaaggaagactactgaatacagcaaaagctgaaattatataggaaatataaatataaacacacaaaataagtgtaaattataatgaagtaaaaatatatcaaagagaaaaaaggaagtagtacagtaaaaaaaaaaaggtgatgctttaaaaactgtaattaaatagacaaatttccagccagattgatgaccaagtaaagagaaaaggaaggagacagatcaaaagacacaagatgatgaatgaaaagggggtcagcacttataaatgtagtagcaatgtaagccataatgagcacaagaaaacattatcaacttaattttgaatatataaaatagagacacttaaaaaaactgaacaaaaacaacttactagttttaaaagaaaaaaaagtcatcaaacatatatccttccaaaagtatagacttcaaaagtatagccccagatgggtgaacaacttcaaaagtacagtcccggatgggtgaacataaaccacactttaagcaagaactctcagttataactgcttgcaattttagaggataacagccacactcctgaaccagagcttggcaccggctattccctctggaacacccttttatttccttctctaagcaaagacatggaatcaatctaaatgcccaccagtggtctgcgggataaagaaaatatggtatataaacatcatggcatactatgcagctataaaaaagaacaagatcttgttctttgcagggatgtggatgtagttggaggccattatccttagcaaactaccacaggaaaagaagaccaaacactgcatgctctaactcataagtaggagctaaattatgagaacacatggacacatagagtgggggacagcacacactggggctttttggagggtggagagttggaggagggagaagacaaaaaaaataactaatggttactaggcttaataccggggtgatgaaataatctgtacaacaaaccaccatgatacgagtttacgtatgtaatgaacctgcacttgtacccctaaacttaaaagttaaaaatgaatgaagcctgtcagaaccacccactttgtagtcttacattttccctagtattcccaaacccctttgcctagtcaacattttacaaagcgcttttcatcttctactgtgttataatttatatatttttagtgtatattttacacactttattagaatatgagttccttcaaggtaaggactgttgtttgttttgtgctccctgatgtattttcagagcctagaacagggcctggaataaaataagcagccaacactatgcgatgaaaattttttggtgggtataaatgcctttgattcgaaacaaaactcagtttaattgtgtgtgtgtgtgtgtgtgtgtgtgtgtgtgtgtgtgtgtctaaagtcaccctaagcacactgttaataaccctagaatgactgacgtgttcgtattatgcaattttttatttttttcatcatattgacagataaaggattctaattcctataccttttcaataatgcagaagccttcataacatttaaattccattcatggtaaagattcttagcaaataaagaataaattgaaccttgatcaattactttaaagtagttataaaagacctatagtgaatatcatacttcagtattagaagctttctctttaaaataaggaacaagacaaataattggcaacatgacttcttttcaaattgcacagcattagggatccaagccataaaagaaaataaaagacatgtggatcataaagaaaatataaaacgttacttacagacaataaagttgtctgcataaagattataagagaaagctaaaaactattacagtcaaaaagagacatcagcaagcttggtggaaacaaaacaaacaagtacaagttgtcagtgacctttcaacaaccaattaggaaaaaaatatatatatacgttaaatcttaacactgaaaagcaacaaaaatatggaaacagtgcttcttatatgccagattctgattgaaatattttacaagtttaactcatttaattttcccagtgattcttgaggtagaggccatatttttcttaactttaatagatgcagaaactgaagcacagagagcacttgacttgcctaaggtaaaagttaaaaggcggcagatgtagaattcattcacaacaatctagatccagagtatttcttgtgcccctgatgatatgccaattctctggactctatcactaactctattaaatgatcaagaacttgaaagaaaaaaatatttaaattagtccatgaacaggaaatgtccaagtcataaacctagtaatatttcccaaagataatgcttaatagtggtgtcattacaaccaaaatactaaaaaaatgtgcaagccaatctcaaatatgtgggagagaaaacccaatactaatttgaagaggataaaagagcaaggcatctcccttgctgacagaaaggcttcttataactacaacattcatactgaaatgctattatactagatctagcactgaaacaatccaggccactacaaatgaatgaaaaatgagtccagaaaaacacagatccatatatgaaaatttgttttataacagaaattgcattaacaaatcagaggttaaattttaaaaaccataaaatatttcagacaattaattatttatgtggaaaaaagtaaagttgactcattatcctgcccagtacacaaaaatcaattccaggtggacttaaaaacataatgcaaaagcaaaactttaacataattaccaaaaatgtaagtcatcatctttatggtatttaaataaaaaaaagacttctttaaaaagacacaaagaaagcaaaacccataaagagaaaaactgatactcttgaagatgttcaagtttaaaactcatgcaaaatagcaccaaaaacaaggtgaaaaggaagcttcacagaggtactagataattctgctatgtttaactagcaaataattagtatccagaataaataagaaagcaatacatcactaagaaagtgacacacaaccctatagaaaaatgggaaaaaatatgaattggtaattcacaaaagagaaaatccaactgaatactaaatattataagagaatgttgaacaagtcaaactattaaagcaatacaaattaaattgccaataacattattttattcccatcctattgaaaacaattaaaaattctgaataccatgtggtggtgaaaatgtgatttcatgagtatatagcaatttggacagcaaactgacagcatgtgagatagttgatgatattcatatgacccagaaattccactattctagaaaataatcttgtacatatatataataaaatctatataagaatgtatactgcaacattttaaaattcaattaaagattagaaaagctctaaatgtatcaaaacaaagaacttgaaaaacagattataaataaatttatacagtggaagtcagtaaactgataaatcacaaaaacataagtttgagtaacaacatcaagttgcagtagacatgttcagtatatcatttccacaaattaacaaaataaatagtgctatatttttatggctataacacataaaggaaatatacatatgactttctagataggtattatttcttgtatctacaagtagaaaatggggttgcgcagagagggtgatagctacaattgcttctgtaattattctctttaaaatgatctgactcacaaacttaagagctggtggaaattcagcacgttttttttcctctttttctctccctgaaaagcatggaggtgttgtcactctcttcctgagtccctcagtgagcagacgtagagaaaaataccctaactgatctggaagtggaagatttaagttaaataaccttcaggaaaaaaggccttaaactgttttaaggcactaatattaaggtggtttcattgttacaggataacctagcatacgctgactgctattagaattcctgccatgaatcctaaaatatatgatatagtcttagtgatcattgggtgagtggcaaagcaactataactaaagctgaaagcatggtaatacatcttccgcagtgacaggatatttgataagactttcaccagcaaaaatatggaaggtacatgacattcctaataaaattgtagttccaagagaaggatggccagatttagcaaataaaattgcaaggcattcagttaaatttgatttccagatataaaacagatattattgtttagtaaaatttccatgtgatattatactaaatgattatacatatttgtactaaagaaaaacagtgttgtttacccgaaattcaaatttaactggttttctgtgttttacctggcaatcccatcaagagggagacgttgtgaaatagaaaagtagcaatatttcttggttactataaaagttatttaacaagactttataagggaacatgaagtcagagaagggggcaaaacactagtcattttaaaaactaggtggggaaatttggaagtagaggtgaccagatttcacagaagattgtagggtgagaggagtatagaggaagccaatataatacatcaaggtttatggtttgaaaaatggaaagatggaatatcaattacctgaaatgaagaaaatagcacacatttgtaatttgagttgcttattagcacccaactagagatatcaaatagatagttgaatatctacatctttgaattcaggagagagattcaaactgaagacataaatatggacattgacagcatatagatgacagtatactaagtttataaagataaaatagtaataaaagctaatattaacctcttttgtgtcagtccttgatgtaaatttttttatgtgttaactcactgagtccccacaataggtcgatgtaattggttctactataactacactctttaaaaatggatattttagtaaaaagaaggactcaatttatactcaccctcaatttgtagccattggtgtcatctctaagacaatttttagtaattgcctagtcagtgaaccttgccatagtccttagttatgtaaatttattgtattttttggaattccttttcattagccataacgctttaataacatatttttaaaattttgactttaacatctatattgtagtgaatatttaaagaacttcctccaagtttaggatacagaaatgggtaaattatgtctactccctcatatttcactattaagatgatggtaaattagcagtccaagagatcatggtcctgaaagtacagagaaaaaaatagaacccagtgacccaacataactaaggagcatatttgagacattgtcattcttggtatttctgaagaagcactgggatggaagggagttgagatcattttgtcagctacagcactaaattttggtcatgaatatcaaagtgattccatctttatgaggagcctgtggagaatggcaacatgctatatgtatacattttagaatggattaattgccatctgcgtaccttttatcaggttattctatttgttcagcatgccccaagatctcttttgtactttacaaatctgcacttcaattcttcttagttcgagactcacttcaacctaccgcatccttagttttctgcacttacttgttgtttctaaaaaagtatacatgatattatacaataaacatctagaattatacatttatgtactatattcacagaaattggacttgcctttaagccctcctttttacatatattcctgttattgtctcactgctaagtaatattactggatggcaaaataaaccaaaaaacacaaattgattttaatgaaaaatatcaatattaaatattagcttaaataacacaaataagtaaatattgaaatagatgggcatgttaggctgggcagctttttgtgggcacaatcatacaatttcaacttcaaattccatcatataacaggatgttctattggtacaatatctccttgttcacatgaggaaattaagtatattgatattcaccgaacaccaatttttaaatgtatttgaaattaattattttaagtgtctctcaactctcccaatagtgcacaaatatgtagttatgctatatactaataattaaataactttggaaactcacaacttcaaaaaaatgttcgctgttgtggaaagtttccgcagtagagaagggaatgtgaatggtatcagtcttagataacaagaaaactactttactttgtttcaactctactcatttgccatccaaatatgatagaagatgctgctcattcctaacaaatatttccagatatcatgcattccttaaaggagatgatactgattgccctctctattttcactcactttcccattacaattagcagcagattcttttaattatccctgcccttcttaaagcagtctcagatatataaaaattaattgcctggaactcacatctttataattttaaccttttcatgcttcacttatttacggtgacatttatctaaaacacttatcaggtgactgcgcatggtagacatctggtttatcagaaaaggcaggagaaaaaataaatgtaggacattaagcttgctatggtgctttgagactttcctagaaatcgttagctcatcaaaacttgttttggcatggcagaaagacatgtcccattaaaaggatattaatgcaagatcaccattgtcattaaaccatcataccatatattacacatttatgctgaaaatgggttcaaactttttattcccttatcctttaattattagaagaaactttgcagattatagccagataatttaaaataataaaatcaatgtcacttacaaggtcacaggatttagtaaaaccctgctacccatttccttttaagtaacttcgcattttagaaatgaagactgcctattcatgtggcttctgtgattttgttaaacattaattaacaaaatttctagtttttttttttttttcttctagagcagttcagtggaatgaaagaccttttttatcctatgcctctaaccacaaccgggtgtctctatcttaaaagatatttatcaagtctctgcttcatatttccttctctacaccattacagtcctcagcaagccctgctatctcatgatcgcaaatcttggccctttattgttggtcttctttctttcattgctacatgttagaataaatggtgtaagagaatgcttttatctattcaatttctttctctttggctcctgacccactgtctttgtttcagaataattatcagtgcctatatattaccttcacatatgaggcctttgttcgtttcattctttccatctcaattttctgtacattcgtattctctaaagtcttcatctctgtcaattgttcccttatctccctcaagtggacactgtcggcttttcgtagatgttcctactcaaaagagatcttgcaagccagtattttacattaagtaattgttctatttctcgacttttgctggcctataaatataacacatataaaggtagccattgcaggcacagtaaattatttgtctatgaaatcacaatgtttgccccagtatcttaatacaactctcaaatttatataattttttaatttaaaaatttaaaaataactttgcttaaacaaaggcagtttgttttctaacttatctatgtgtgtatgtatatatacacagaaatgtatatgtatacacacatatatattcataaattattgaaagtttcatgcaaattttttactttgccaatatgccccaaaacttgatatgaaattaattatacgaaggagtacagccttgtctttaattagctagaaaaattctcagcccacttaaataaactgttcccaacttggggagataaatttaaatatcttatcttggcaacgaacttataacccttaaaaacatttgctatggcatctatatattatatttcccttgatgtgaaaaataagaaacatttcagaaaaacccacaattaaagaatatcacctggcatcatgtctaaaaatgtataacagtaaaatagaaaagatttgtggatatgacaacaattctgcttgctttcaaaattattttttgctttgttttttgcaaagcctaattaaattaatatatgaatattgagtctattaatcttctctcttaaaaattcaaagcactattttaaagtaaattatcttaggaatattatctaagaatgaacttcatgtggtaaataccagcataagtcattactaaatgtgtttagggtatacaatggaagcagagtctgctgctaggaaaaattgaccttttgttttacaatttataatttatttagtgcagtatttgaaaatcatatttagatataacaggtgacaagagagctctatactaggaaagataattttagtactaccatctataaaagagactaataaatatgaaatgaagatgctataattaaactgtaactcttgcccatgccagcccaacataactattataaaattgtacataactatcaggctgttaatttgaggtaatattgcaggcactacaaaaaaaattcagtaactcatcaaaactattttcttatgaaggtaataaaagctacaatacctgcccatgtcaattatttaaaggtgttcgaagcaaatttcttaaataatttaatttctggagccagacataacagttgactttgtgctctttgacatttactactacagactgttgctaagtccaggcttcaagaactctcctgcatttattctttttaaatcaatggtacaaattatctaactagctatatgtgacgacagcagtggttctcagtttggttttaacaccacctggaaacctgcaaagtctcaggtttcaccccaggtctaccgaatcagaaacactagggataagccccaacaatcactgttttagtaggatcttcaagtgatttcaatgcaggttaagtctgaaaacactggaaaagaggagagaaaaagagagagagagaggagagatggagacaaattcccagaccatacactgcactagaaatagagtgttaggactttacaacaggttcaaaattttagagatgaattatagctgacatttgaacacaaaggaaaggagcccattagtccagggaacatctctgattataaacaacttcatttcctgcttaggtattattcaaatgtatatttaacagtataatgcttctctacaatcaagtaaagctcaaacaaatttaagatgtctttttttttaatgttgtatgttgatgagatttaaactaatagaggcttagctcaattggtgattaaggtgatgagtctgccctggaggtggaaataaatatttcattagacttgtgatgaattctagataattttgacactactagaatgattttgaaagtctggatgatttttgaccaaatatagacccaaatacaaatattgtgaataaaagtattgctaggatttagaaactttaacaagttacataatgtttaaattcatgatttctgtgggtaatttgtggtcagtgctttggggggcagaatgttaaagagatttctatatgagattatgagtaaaactttgtgacaaacaatttgaaaaaatagttgaaaagaagaattcagtaggtaaagttaaaaaagtagaccttactatgaaaaaaagagtagggatatatagaaaatttagatattacgagttgaatgtgtgcagacttcccaagatctatgaatgctataaggaccactacagttgatagcgtagagaaactaaggcaatatttatgcagtgttttagaaggccacagctccattccattactatctgatgatattttagcaaagctggactctgcagtatccttttttgtttgaagaggaatagtagaaggagcatttgtcactcttatttcaccttcaacttctcattatttcccatacacgctcctgttacaattcttgggaaataattaaaataaacttacagccttttatatgggtaatttaaccatatttactagtgtttaaatgattcaaccactgctaggctgtgtagaaaatacaagtactggtagttgtgtgaaagttagctgagtttagataagaggtggcctgaaaagtcaagtctcactagagcactgagattttaaaactattctctgggaactagctagctagctagctagatagatatagatgtttctcaataacaacaataaagaaaattatttcttcatgtatttattacaataagcaaaatattgactaataaaaacacaagaaaggaaaaatactaacaaaaaacatcctgaatactctatatactaaagtgtaataccaaaataaaaattagacacttagcattttctgtgagataaaatagaccaagcaatgagcctcgcttgatgcttcatacaccaggagagctggaaggatgcacaggttcagtaaaaacatgccaaaattaacatgagaagacatgattttatttacttatttatttattttttagagacagggtctcactctttcacctgggctgggatgcattggcacaatcagagttcactggagcctcaagttcttgggctcaagcctcctgagtaactaagactacaggtgcatgccactatgcccaaataattttaaaaaaatttttaacagaaacggagtctcactaagttgctcaggctggtcttgaactcctggcctcaacccatcctttcatctcggcctccctaagtgctggaattacagtcatgagccatggtgcccggcctaataaatgattttcaataaattatatttaacaaaatggattagaattaaccaaaaaataaaactagtaattcaaagctttaaggagtggatgtaggtatgtatctacgcatggatgtctgttaattttgtttctttttaaatcagagaaaacaaatttgaaaagatgctttgaaagtagctgccttcttattgtaattgttttaccaaatagcaaagtctagttcttcaaaattgtcagaacctgttatttatactccatttattcttatgattgggcaatgtgtggcacatttaaggattattttccagtatatcataaatatattaacaatgtgacactttaaggatctaaggaggactgaaaattttatctgaggaattcgttagtctatcacagaggtagctctttgatacctaagtcatcaccttttatagaacgtaacataaaggttgaagttttcacagaataagtaatactgtgaattttcagatagagtgtaaactcctctgggttggctggcttttctgtccttacagagctgcccattgtggtcaaattgaccacatgagaagttgatgatgcagttatgccatgcatagcaaccgcagcaggccttcctcattccaatgtaaatattcattatatgaagcattatctaagacccttttgccttgaaagagagagtaaaaaattaatcaggagtagagtctctaaaatattcatttccctggttcatggagtcatacaagcttctttatcatctcagcattttagtctagtccaaaagcccaaagactaaataaagtaattgatacatggcatccatgaaaataatacaagtaaaatatggctttatgttgactatgcaaatttcatatgaaagaaattgtttccaagaaacttaactcaataaaatttaaaccataaatatttttcaccaattttattcaataaatacttactgagaacctactgtttcctggccttgttatacttgtttggaattcatttgagaagtcaaccatataatacttcatgacattggtctaggcacaggtttttttggataaaaacttaaaagcacaaacagtgaaagaaaatttaaaggcatcttaacagaaaaaaaaaacaatcagcagagtaaagagacaacctaagaacaggaaaaaatatttccaaaccatgtatcagataagatattaatatccaaaatatataaggaactcaaacaactcaatagcaagaaaacaaataacctgattaaacaatgggcaaaaaaatctgaatagatatttctcaaaagaagacatcaaaatagccaacagatatatgaaaaatatatttaacattactaatcttctgggaaatgcacataaaaaccacaatatcatctcatcccaattcgaatattatcaaatagacaaaaaataacaaataatggcggggatgtaggaaaagggaaactctattacactgtttgtgggaatgtaaattagtacagtgtttatgaaaaacaatatggaggttcctctaaaaattaacaatagaactaccatatgatccagtcattctactactgggtacacatccaaaggaaatgaaatcagtatgtcttagagatatccacttccatgtttattgcagcactattcacaatagccaagatatgaaccaacctaattgttcatcaactgataaatgaataaagaaaatgtggtatatatacacaatggaataccattcagccataaaaaaataaatcctgttattcaaggcaacataaaagaacctgaaatgaaataagccaggcacagaaagacaaataccacttgatctcactcacatggaatttaaaagagctgatttcatagtagagagtaaaacagcagttgctagagactgagaagtagagtgagaaggaaagatggagagagactggtcaaaaaattcaaagttacatttgcacaggatgaataagttctggtgctttattgcacattagagtgattatggtaaaaagtattgtattgtatgtttcaaaatacttagaagaaagaattttgaatgtttttaccacaaacaaaatgataactgtgtgagatgatggatatgctgtataccctgaaaagattattacataatgtatagatgtaggaaacatcacactataccccataaatatgcataattattatgtgtcaaaaacaaaatttttaaaagttaatcactctctaatgaaagtatcttttggctcctagacacctgattttttttttccattttgccaaaagtcaaattctacatactaaaacaaagaatttattgtatcctttcaaaacaatatattttaatagcatctatagattcatcaagcaatgatgtaatgaacacaataaaagcttgagtaatctaactactttacaatagaaattgtaatgtttttgtttttgttttgtacgttcaatcctctgaaaaacatgactcttcctgatttttttttcttttttgaaaggagtcttgctctattgctcagtctggagtgcggtagcacgatctcagctcactgcaacctccgcctcctgagttcaagcaattcttcctgcctcagcctccagagtagcttggattacaagcaccaccaccttgccaggctaatttttgtatttttttagtagagacggggttttgccatgttggccaggctggtgttgaactcctgacctctggtgatccacccacctcccaaagtgctgggattataggcgtgagccactgtgactggccaatattttaaatgttaatgtctatcattatattttctcattctcttttgctgtacttattaaatggtctattatcctagaaaataggtaagaagatgaaaaacaaaccagtagcataagatctgaaactgattgataagttatacattaaatatatgatttgatttgcttaagacctctagtatttctattccttttttaatttttagagtttcaaaatttcattataattttggttaaatttactgacttctcaaaacttctaaagtttaatgaactatatacccatcagtgtattaagcagaaaaatagtttagaaaattgtcaccaaagtatgcactttgtatctgaaaacaataatgaggcttctctctgaccattaatcttgggcttttatgacacacaacaattttactattttgtttatttgcttggtttatagtacatgaagacagaaatattatagtttctgtttcatgtagcacatttctttaaaaatgtgttttaaaatgcctttttttctgcaaaactgaattccagtacctaatttctctgttactttggtgggccaggagtcctgccgagaagaatattgatgtctctctcatcagaggtttttgataatgtcaggtttccaatatatcctaggggtatatttttacctttttaaaacaaaatttatttttgcctatttttttcgttctaaggctctttatgacaggactatttaaagcactgaggacaagacaagatgtttatatatacttcctgctgtttaatattcatgcaattctgacaagattaatatactaatttctctgtcattagtttcattaacagatattaattatatctgaatctaaatgccaaatgaatagacagttgggattcaattctatttaagataatcgaagttctctttacaatcatgattggggtggcatacataccatctattctggttagagatggactctggacgctagataaaacacttgggattaaaacacttatcctagaacttatcattataggcacttcacataatgggggaaactgaatatttacaataaccttttggaatagttgatgatgatgatgatgggaaagagagagagaaaggccaggtgtggtggctcatgcctgtaatctcagcactttgggaggctgaggcaggtggatcatgaggtcaggagttcaacaccaacctggccaacatagtgaaaccccatctctaccaaaaacacaaaaattagccaggcatggtggagtgtctgtagtctcagctacttgggaggctgaggcaggagaatcatttgaacccaggagggagaggttgtggtaagccgagattgtgccactgcactccagcttgggcatcagagtgagactccatctctaaataaatacataaataagagagagagagaggagagagaaacatccttttttctggtaaaatttagagactagattgtccaatgaagatggctgaataggaacagctccggtctgcagctcccagtgtgactgacgcagaagatgggtgatttctgcatttccaactgaggtactggttcatctcactggttgaatagtgggtgcagcccacggagggcgagccacagcagggtggggtgtcacctcacccaggaagcacaaggggtcaagggatttccctttcctagccaagggaagatgtgacatactgtacctggaaaaatgggacactcccgcccaaatactgtgcttttcccaaggtcttcgcaactggcagacaaagagattctctcctgtgcctggctcgtcaggtcccacacccacagagccttgcacactgctagtgcagcagtctgagattgaactgcggggcagcagcctggctgggggaggtgcgtctgccattgctgaggcttgagtaggtaaacaaagcagccagggagctcgaactgggcagagcccaccacagctcagcaaggcctactgcctctatagactccacatatttgggcagggcatagctgaacaaaaagcagcaggcaacttctgcagacttaaaaatccctgtctgacgctctgaagagagcagttgttctcccagcatggcatttgggatctgagaactaatagactgcctcctcaagtgggtccctgacccccgtttagcctaactgggagacacctcccagtacgggctgacagacacctcatataggcaggtgcccctctgggatgaagcttccagaggaaggatcaggcagcaatatttgctgttctgcagcctccactggtgatacctaggcaaacagggtctggagtggaactccagcaaactccaacagacctgcagctgagggacctgaatgttagaaataaaactaacaaaggaatagcatcaacatcaacaaagcagaaaggaatagcatcaacatcaacaaaaaggacatttataccaaaaccccatctgtgggtcaccaacatcaaagaccaaaggtagataaaaccacgaagatggggagaaaacagagcagaaaagctgaaaattctaaaaaccagagtgcctcttctcctccaaaggaatgcagctcctcaccagcaacagagcaaagctggatggagaatgactttgatgagttgacagaagtaggcttcagaaggtcagtaataacaaacgtctccaagctaaaggagcaagtttgaacccattgcaaggaagctaaaatccttgaaaaatggttagacgaatgcctaaccagaataaacagtgaagggagaccttaaatgaactgatggagctgaaaaccatggcacaagaactttgtgatgcatacacaagcttcaatggccaattcgatcaagtgaaagaaagggtatcagtgattggagatcaaattaatgaaataaagtgagaagagaaggttagagaaaaaggagtaaaaagaaacaaacaaagcctccaagaaatataggactatgtgaaaagaccaaatctacatttgattggtgtacctgaaagtgatggggagaatggaaccaagttggaaaacactattcaggatattatccaggagaacctccccaaactagcaatgcaggccaacattcaaattcaggaaatacagagaacaccacagacactccttgagaagagcatccccaaggcacaaaattgtcagattcaccaaggttgtaatgaaggaaaaagtgttaagggcagccagagagaaaggtcgagttacccacaaagggaagccaatcagactaacagtgggtctctcagcagaaaccctgcaagccagaacagattgggggccaatattcaacgttcttaaagaaaagaattttcaacccagaatttcatatctagtcaaactaagcttcctaagtgaaggggaaataaaatcctttatggacaagcaaatgctgagatattttgtcaccaccaggcctgccttacaagagcttctgaaggaagcagtaaagatggaaagaaacaaccaataccagccacctcaaaaacatgccaaattgtaaagaccatggatgctatgaagaaactgcatcagttaactggcaaaataaccagcgaacatcataatgacaggatcaaattcacacataaaaatattaacctaaaatgtaaatgggctaaatgtcctaattaaaagatacagactggcaaatcggataaagggtcaagatcaatcagtgtgctgtattcaagagacacatctcacatacaaagacgaatataggctcaaaataaagggatggaggaagatctaccaaacaaatggaaagctaaaaaaagcaggggttgcaatcttagtctctgataaaacagattttaaaccaacaaagatcagaagagacaaagaaggccattacataatggttaaagggatcaattcaacaagaagagctaactatcctaaatatatatgcacctaatacaggaacacccagattcataaagcaagtccttagagacctacaaagagacttagactcccacacaataataatgggagactttaacgcctcactgtcaatattagacagatcaacaagacagaaggttaacaaggatatccaggacttgaactcattcatttgaactcgcacttataaaattgaccacataattggaagtaaagcactcctcagtaaatgtgaaagaacagaaatcacaacaaattgtctctcagaccacagtgcaatcaaactagaactcaggattaagaaactcactcaaaaatgcacaactacaaggaaactgaaaaacctgctcctgaatgactactgggtaaataacaaaatgaaagcagaaataaagatgttctttgaaaccagtgagagaaaagacacaacattccagaatctctgggacacatttaaagcaatgtgtagagggaaatttatagcactaaatgcccacaagagaaagcaggaaagatctaaaatcaataccctaatatcacagctgaaagaactagagaagcaagagcaaacaaattcaaaagctagcagaaggcaagaaataagtaatatcagagcagaactgaaggagatagggacacaaaaaaccctccaaaaatcagtgaatccaggagctggttttttgaaaggaccaacaaaattgatagacctttagaagactaataaagaggaaaagagagaagaatcaaacagacacaataaaaaatgacaaagtggatatcaccacagatcccacagaaacacaaactaccaccagagaatagtataaatacctctatgcaaataaaccggaaaatctagaagaaatgtataaattcctggacacatatgccctcccaagactaaaccaggaagaagttgaatctctgaatagaccaataacaggatctgaaattgaggcaataattaatagcctatcaaccaaaaaaggtccagggccagacggattcacagcctaattataccagaggtacgaagaggacttggaaccattccttctgaaactattccaattaatagaaaaagagggaatcctccctaactcattttacgaggccagcatcatcctgataccaaagcctggcagagacacaacaaaaacagagaattttaaaccaatatccctgatgaacattgatgcaaaaatcctcaataaaatactggcaaaccaaatccagcagcacaagaaaaagcttatccaccacaatcaagctggcttcattcctgggatgcaaggctggttcaacatacacaaataaataaatgtaatccatcacataaacagaaccaatgacaaaaaccacatgattatctcaatagatgcagaaaagaccttcaacaaaattcaatggcccttcatgctaaaaactctcaataaatcaggtattgatgggatgtatctcaaaataataagaggtatttatgacaaacccacagccaatatcatactggatgggcaaaaaatggaagcattccttttgaaaactggaacaagacagggatgtcctctctcaccactccttttcaacatagtgttggaagttctggtcaggcaaatcaggcaagagaaagaaataaaggacattcaattaggaaaagaagaagttaaattgtccctgtttgcagatgacatgattgcatatttagaaagccccattgtctcagcccaaaaattccttaatctgataggcaaattcagcaaagtctcagatacaaaatcaatgtgcaaaaatcacaagcattcctatatgtcaataacagacagagagccaaatcatgagtgaactcccattcacaattgctacaaggagaataaaatacctaggaatccaacatacaagggatgtgagggaccttttcaaggagaactacaaaccactgctcaatgatataaaagacacaaaaatatggaagaaaattccatgctcatagataggaagaatcaatattgtgaaaacggccatactgcccaaggtaatttatagattcaatgccatccccatcaagctaccaatgactttcttcacagaattggaaaaaaactactttaaagttcaagtggaaataaaaaagagcccgcattgccaagacaatcctaagcaaaaaagaacaaagctggaggcatcatgtaacctgacttcaaactataccacaaagctacagtaaccaaaactgcatggtactggtacaaaaacagatatatagaccaatggaacaggaaactgggctcagaaataacaccacacatctgcaaccatctgatctttgacaaacctgacaaaaacaagcaatggggaaacgattccctatttaataaatggtgctaggaaaactggctagccacatgtagaaggctgaaactggatcccttccttacaccttatacaaaaattaattcaagatggattaaagacttaaatgttagacctaaaatcataaaaacctgagaggaaaacctaggcaataccattcaggacataggcataggcaaacacttcatgactaagacaccaaaagcaatggcactaaaagccaaaatagacaaatgggattgaattaaactaaagagcttctgcacagcaaaagaaactaccatcagagtgaacaggcaacctacagaatgggagacaatttttgcaatctacccatctgacaaagggctaatatccagaatctacaaagaactcaaacaaatttacaagacaaaaacaaaaaaacccattaaaaagtggtcaaaggctatgaacagattcttctcaaaagaagacatttatgcagccaacagacacatgaaaaaatgctcatcatcactggtcaccagagaaatgcaaatcaaaaccacaatgagataccatctcacaccagttagaatgacaatcattaaaaagtcgggaaacaacagatgctggagaggatatgaagaaataggcacacttttacactgttggtgggagtttaaattatttcaaccagtgtggaagacattgtggcgatttcttaaggatctaggactagaaataccatttgacccagcaatcccattactggatatatacccaaaggattataaatcatgctactataaagacacatgcacacgtatgtttattgcagcactattcacagtagcaaagacttggaaccaacccaaatgtccaacaatgatagactggataaagaaaatatggcacatatacaccatggaatactgtgcagccataaaaaaggatgagttaatgttctttgcagggacatggatgaagctggaaaccattattctcagcaaattatcacaaggacagaaatccaaacaccacatgttctcatagttgggaatcgaacaatgagaacacttggacacatggcagggaacatcacacactggggcctgtcagagggtggggggctggggaagggatagcattgggagaattacctaatgtaaatgacgagttaatgggtgcagcaaacaaacatgccacgtgtatacctatgtattcaatctgcacgttgtacacatgtaccctagaacttaaagtataaaaacagaaattagagacattttctgcctcaaatagatataacgcatgttactaatttattaagcagaactcatcaagatgccaaaagataaaaatctactaaatcaatgatatagttaccaaaagtcaccctgtataattcatggatttaggacatgattaagtacatacttagcataattgaaaggtgtccacctgaaagcaacagtaatcacacacacacagacacacacatgagtcaatctgtcaaaattacacaccaagcttttaattaattcatcaattatacatcagtgtttctggattattagaattattttgacacattaaaaagtaaacactcctaatttaactcatattatttttgataaaggcattgtggtatgccatcatttcataatatacactgaaacatattcaaataaaatgaaactatatctgagacatgcttcaagtaatttgggaagaaaggatgggagaagatatagttggtgcaagtatgcctatgaattggtaattgttgaaactgggtgataaattcatagtgtggtcatgatggtcttctgtttttttgtatatatttgaaaattgctatataaacatttttgaaatacaaattcttaggccacattccagtcatattgaattagaataccctggagttgaagcttcaagtgagaggtgaagccagctgagcttctgggccggatggggatttggagaacttttgtgtctagctaaaggattgtaaatgcaccaatcagcactctgtaaaatcacaccaatcagcatgctgcaaaatggaccaataagtgctctgtaaaatggaccaatcaattctctgtaaaatggaccaatcagcactctgtaaaatgggccaatcagcaggatgtgggcggggccaaataagggaataaaagctggccaccagagccagcagcgtcaacctgctcggatccccttccatgctgtggaagttttgttctttggctctttgcaataaatcttgctggtgctcactcttagggtccacaccacctttaagagctgtaacactcactgagaaggttcatggcttcactcctgaagtcagtgagactacaaacccactggaaagaagaaactctggacgtatctgaacatccaaatgaagaaactccggacataccatctttaagacctgtaacattcactgtgaagctccgcgcttcattcttgaagtcagcaagaccaagaacccagtggaaggaacaaattccagacacatttggcaaccacgaagggataatcaccaagtagtgagtaccatcggacccctttcacttgcaattctgttctatttttccttagaattcaggatctaattatcgggcacctgtcggtcagttaaaagtggttggtggccgggcgcggtggctcacgcctgtaatcccagcactttgggaggccgaggcgggcggatcacgaggtcaggagatcgagaccatcccggctaaaatggtgaaaccccgtctctactaaaaaatacaaaaaattagccgggcgtagtggcgggcgcctgtggtcccagctacttgggaggctgaggcaggagaatggcgtgaacccgggaggcggagcttgcagggagccgagatcccgccactgcactccagcctgggcgacagagcgagactccgtctcaaaaaaaaaaaaaaaaaaaaaaaaagtggttggcacggccactggaataaaaacacgggtgtcaggcattctaggaaagggctctcttacaacccctgactcttcggggttggaagcattgatttgcctggaaccagcttccacttttcttgtacttctgggctgagccgagggtagacagagtggaaagccattcagctccagggtcccaacaacaagttggttgaccctgaggctgagcggaactctcaaagacatgtcgcctaagggagactcgcccatctctcctatctatcctgacccttgcctcctgggtcctcatgcctgtcagacaaacttcctcttgcctctcttctctgaggctagtctcgcttctaaaaaccactccctgtctctggtgcttttctagtttctcgtataagaatgatttctagcataaactttaggactctattcccttctttaggcacccaggctcaccaatcagaaagacataatttttgcccaaagccccatcggaggagccagactatcttatctggaattttaggacccctcctcaggctagcaggcctaacaaaggctattcctgaagctaggatatggggagcctcagaaattgtatccttgctattcatataagtgaggacaaaaggcatcactcttccaaccctggagatctcttccctctctcagggtatggccctccacttcatttttggggcataacatctttatagggcatggataaagtcccaatattaacaggagaatgcttaggactctaacaggttttctagaatgcattggtaagggccaataatccgaccttcctcattcctccttgtggtctaggaggaaaactagtgtttctgctgctgtgttggtgagcgcaactattcccatcagcagggtccagggactgttgtgggtgcttgggcaagaggggtttctgctgccacgtcagtgagtgtaactattctgatcagcagggtccaggggccactgtgggttcttgggcagggggagaaacaaacaaaacaaaaccgcaggtggttttgtctttcagatgggaaacactcaggcatcaatgggctcacccttgaaatgcatcctaagccattgggaccaatttgacccgcaaaccctgaaagaaaggcagctcatttttttctgcactatggctcggccacaatattatctctctgttggggaaaaatggccacccgagggaagtataagttacaatactatcctgcagcttgactttttctgtaagagggaaggcaaatggagtgaaataccttatgtccaagctttcttttcattgaaggagaatccacaactatgcaaagcttgcaatttacatcccacaggaggacctctcagcttacctccatatcctagcctccctatagctccccttcctgttagtgataaacctcctctaatctcccttgcccagagggaaataagaaaagaaatatccaaaggaccacaaaatcccccaggctattggttctgtcccctttaagtagggggaggggaatttggcccaacgtgggtacatgtccccttctccctctccgatttaaagcagatcaaggcagacctggggaacttttcagatgatcctgataggtatataggtgtcctacagggtctagggcaagcctttgatcttattggaaagatgtcatgctattgttagatcaaaccctggcctttaatgaaaagaatgtggctttagctgcagcctgagagtttggagatacctgatagcttaatcaagtaaatgatagaatgacagctgaagaaagggacaaattccctactggtcagcaagccgtgcccagtatggatccccactgggacttcaactcagatcctggggactggagttgtaaacatctgttgacctgtgttctagaaggactaaggagaattaggaaaaagcccatgaattattcaatgatgtccaccataactcatggaaaggaagaaaatcctgccttcctcgagcagctatgggaggccttaaggaaatacactccactgtcaactgactcactagagggtctattgatcctaaaagataagtttattacccgatcagccacagatatcaaaagaaagctccaaaagtgagccctaggccctgaataaaatctggaggcattattaaacctggcaaccttggtgttctataatagggaccaagaggaaccggcccaaaaggaaaagcgagatcagagaaagactgcagccttagtcatggccctcagacaaacctaccttgctggttcagagaggacagaaaatggagcaggccaatcacccagtggggcttgttaccagtgtggcttgcaaggacaccttaaaaaaggttgtccaatgagaaacaagctgccccctcatccatgtccactgtgcagaggcaatcactggaaggcacactgccccagagggcaaaggttctctgggccagaagcccccaaccagatgatccaacaacaggactgagggtgcctggggcaagtgccagctcatgtcatcaccctcactgaaccccaggtacgtttaactattgatgaccaggaaattgacttcctcctggacactggcatagccttctcagtgttaatctcctgtcccagatgactgtcctcaaggtccgttaccatccaaggaatcctgggagagcctgtaaccaggtatttctcccacctcctctgttgtaattggaagactttgctacagatagtaagtatgcttatctaatcctacatgcccatgctgcaatatggaaagaaagggagttcctaacctctgggggaacccccattaaataccacaaggaaatcatgcagttattgcatgcagtgcaaaaacccaaggaagtggcagtcttatactgccgaagccatcaaaaaggggaaggagaggggagaacagcagcataagctgctgacagaggcagggaaagaccagcagaaaggaaagagagaaagagacagaaagtcagagaaagaggaagaaacagagagacaaagaggaggagacagagagaggaagagacagagacaaagaagaagtcaaagagtgagagagaggaagagacagagagacagagagtcaaagaagtaaagagaggaagagacaaagagggagtcagaaagagaaagacagacaaagaagagagagacagacaagaagtcaaagagagagaaagagggagatagaagtagtaaagaaaaaacagtgtaccctattcctttaaaagccagggtaaatttaaaatgtataattgataattaagggtcttctctgtaaccctataacactccaataccaccttgttgtcagtgtaaacaagggtgtagcccaaaagcactgaggctactgacaacccatagccttcctatcaaaaatccttaacccagcaggtttccaaacagggatctaaatcttaatgaattaccatacaaaggtctgaccagatctaggaggaactcccttcaggacaggaggatagatggttcctcccaggcagttaagggaaaaagacacaatgggtgttcagcaagtgataaggaaactcttgtagaagcagagttaggaaaatttcccagtgattggtctgctcaaacgtgcgagttgtttgcactcagccaaatcttaaagtacttacagaatcaggaaggagctatctataccaattctaagttaatatggactgaacgaggttttcattaatagtaaagaaaaattataatcccaaacttacaaggctttcaactaaagtttgctaaaagttaacagtgtaatatgtattatcctgctaccacacactcttaaaggaattctcagacagtttgcaagaaataacgaaatctatccttactctacaatccgaagtagactctttggcagcagagactctcctaaactgctgaggcctagacctcctcactactgagaaaggaggactctgcaccttcttaggggaagagtgttgtttttaccctaaccagtcagggatagtaagagatgctgccaggcatttacaggaaaaggcttctgaaatcaaacaatgcctttcaaactcttataccaacctctggagttgggtgacatggcttctccactttctaggtccggtagcagccattttgcaattactcacctttgggccctgtatttttaacctccttgtcaaatttgtttcctctaggatcaaggccatcaagctatagatagtcttacaaatggaaccccaaatgaactcaactaacaacttctaccgaggatccctggactgacccactggccctttcactggccgaaagagttcccctctggaggacactacagctgcagggccccttcttcgcccctatccggcaggaagtagctagagtggtcatcgcccaattcctaacagaagttggggtgtcctgtttagaggagggattgagaggtgaagccagctgagcttctgggtcggatgggggcttggagaacttttgtgtctagctaaaggattgtaaattcaccaatcagcgctctgtgtctagctaaaggattgtaaacacaccaatcagcacttggtaaaatcgcaccaatcagcactctgtgtctagctaaaggattgtaaatgcactaatcagcgctctgtaaaatggaccaatcagcaggatgtggatggggccaaataagggaataaaagctggccacctgagctggcagcggcaacctgtttgggtccccttgcacactgtggaagctctgttttttcactcctcacaataaatcttgctgctgctcactctttgggtctgtaccacctttaagagctgtaacactcactgagaaggtatgtggcttcactcctgaagtcagcgagaccacgaacccaccggaaggaagaaactgcagacacatctgaacatccaaaggaagaaactccagacagaccatctttaagagctgtaacactcactgtgaaggtctgtggcttcattcttgaagtcagtgaaaccaagaacccactggaaggaacaaattctggacacacaagttcctaggcttcatccaaaacattaaatcagactctttgaggtagagtaagacacatatttacaagctagttatgcaagttatgatccaggtaaaacactaatcgattgtatccaaaatataagtcttctatcattctgttgtacaaaatgaatgaaatctctaaaatatttctttaggaaccaacacaaagatattccattgtactaagtttgttttctggaaaacaaactctcaggtaaatttgcatgtatgatgtttataagggaattaacttttaattaattatgagaggggagttgaaaagaagtacaatccaggcagagacaacaagcccacagaatatcttaaaaggaatggcttcctgagttctcatgcactgaggctagatgactgggccttgatataactctctccagccccactgaccagccatttgatactatgcttccaggtgatgaatttgtgtgaaatggttgtctttaaatgaagggcaattcctcaggagagactcaagtaattttcactagccagcaacattcctagcatgtggggatgaaggtaattgagaggggagaattcattgcctcaatggttacacatgtaacacttcatagcacccaccacatctataagagctaatatattttttctgggaatttctttactgtcttttctcatttatctttatatatcccttacaagtcaacaaagaaatactgcagtggtggttatagtgactacactgtggttgctggctgtttttttagtgtttaaattaaataatattacccttaggaataaaatgtaaaaccatttttttaaaattcccatcaaaatcaacataacatactgtttgtgttagtaacagaaatatatttaactgcatagataataatgaatagcagtctggattttcaaataaattatttcaagatgatatttactaggttagatacatgtaccctaactcccacccattcacttcctagaaatgtgttttaggtgatgttatttaggtggtaaaatcaggtcaataactcctactgaatccttagatattatgtgttgtacagggaaaaggtagtataggtaaaacttgtgtgagacacactttgttgttttagactagactgtaagttccagctgtgtctgaatgtttgtgtttccccaaaatacatatgctgaaatcctaaccctcaagatggcggtattagaaggttgggaggtgattaggtcatgaggggtgttaacaatagttcccttaataaatgaaaggcctaagagagacccgtcgcacattccactatttgaggacaccactaactgtgagccaaaagcaggacctcctcagacatcgaatctactggtgcctttatcttagaatgccaacctccagaactgtcagaaataaatttttagttttataaatgcctagtttgtggtattttttatggcagtcgatcagactaaaacaaatgtttactctgttgtgatcagatagtttatataacttacctaacacataataggtactctagtaggtcgctcctcctttgacctcagacctttccatttgagaaattttacaactttatttcaaaatgcattccatctactttacaaagtaaaaatacaaaggcctcttatcatgatgtgactattaggctttacaagcctatatcaaagtgtttcatgtaccccataaatatatacacccacacatattaaaaatttaaaaagtgaatgttatacacctccccacttcctttacaaaacttagctcaattccatctggataataagaaaaataggaaactttattgaataatgagtcacttctatgtgtaatttccactgctagtatgagccttcagaagggactggctttaagaattggtacagttcttgactgagaggaacttccaccacctagcagatggggcaatagattacaagggcaattatcactcagagaattgctgataaggtcaaattactgctgtcactttattcttaatctctgtatgcatttttttttctaaaagaaaactgcatatacaattctacagaccaaaaatattgcaaaaaatatgagtttatatgtcctaagagggttccccaattatcacaattgtttcaaatggaaacaatttcatatcccatatgtacatatatataaaaatatatttatgtatgtgtatatatatgcatatatatgcacacacatacacatttctctgcagatgttagtatgtggaaatgtattgctatataatagggacaataattagaactcaaaatctagagtaatgcaactgaaagtcatatcatgcatgtattacaagtaagatactctgcaatgtatacaagagaatgtaatttttaaggaccaaatgtgtgttattaatcaggtatacactctgtaaacactacgtggtataaaattgcttctcaacacaggaaatatttataacctaagtatacagtccaagaagtactttatttctgacacttcataccaaagcaaccagactgacaaataagcattctgagtaaaagcagtgttttaaataacttttgaacccaatgcatgcatgcaaggctgataaatgcaaacccttttacataatactcaaatcatattaaagagatgcttcttgacagagatacacttaaaccattctacatttctcctttttgttctcctgtgtgaaaatgtcaccttaaaagcaattttttaagaaacaagtgctgtttcatttcatgtcttcagatacattgtctgcccatgttttagcgattaggaatttagaggtttttggatgtttattacaactctttgacttatcagtataaatatttatcataccaatcatatttattctttgattatcttgacatggcaaggttttttcaattttatttaaaagagccagctgttttgtatcttatttactcacccatatcattgtttcccgttaaattaacactggcataagccagctgcaagttgcaaggaaatcgcactgaaaacagagctactataaattgtattcgcctctatataccaacaaaaacaaataaaacttttttattaatctctatgactttgttgttgtttaaagcaaatctacattaggaagagttgtcaggaaatttgggaagttatattgtttcctgaaacctgatattgattgatgagagtataccaatgattgcaagttctgagaaaagagttttacacaaaatgaacagcaaaagcttgggcatgagaacaaacttagaatgtccaagggataggaaaaaacgtcctggcagcagagcagcagataggcaggaattgaatcatgtgtactttggtaagccatacacgggcattgagaattttattcttaccacagttggaagtcactggaatattttaagcaagagagtaacttgaactgatttatgcttttaaaagattaccctgattggctgtgtgaaaaataagcgatagggagcaaaagtagaaacagggacaggagatgacagtggcttatgtataagatttcttctaaggatcttgaaagcatcatgaactaacatcacttgggaagtagataaattcattgctgtgtccatagtctgtttatttccctttttttttgtatgtatttgcagaatatgttagtaaacaaagtgaaattcaaggaaatcactattagggctgcctacaaatcaagtcggtttagagctattatagttgagtagtaatattctttcagaaaaaatcttaatcataaagcccaacacttatactatggcttcttaaaagtgaagctgcaaaactgcttgtgaacaatcttacagctatttttataactttttaaagtgttatgtacataatttcttttctgatgacctcattgaattctaaaccatcttttagccacacataagccccaacagttaaaactattaaaatgcattagcatgtccttcattatttgttttaatcaagaagaactgaaataaggaatatgtaacataaatttagttttgctaacgaatacatcagagagaaatatatctccttagagaggaatatattttatctaggtattttttttgaacagtgaagcactttttaaaaaagtaatactgtacacagaattccaaaatataaaacagacaaataaattaaggtacctttatacaaagtcattctatgcagctattataaaaagtaaaatatatatgcattgatagggaagttttaatttattccatataagtaaatattaattgagcattttatatttgagccatcatcctaacagtttgtgataagatagcaaatgatatagggaaagtctctgttttcagatgtttttatattttgaaggaagtagacaaatattaatcaattaagtgaatatgcaagaaatttccacatagtaaactaatctgcagaaaacaaagtcatgaattatctaattcttgagggaacctattacagactgtgttattagggaagccttttttaaggaggcatatatgagggaaaatctaaataactaaaggagccagccataggaaaatagcagaagagaatattctggaaaaaaaaaatggcacacaaagacatttcacctcagccaaagaatatgggatgataaaggacagaaaaaagaccaggaagcaggaggaagagaggtagtagaagcagatgggatgaggcaaatgagacaagatagtgtaggaccttacaggtcatggtagaggaagacacttagatatgattacttaataagaagctatcatagcactgaagcatggaagagatgtgatctaatgtctatttttcaatgccattctgaccagatttcgggcaaacctggtagacacccatagtaagactccaggaaaaaaaaaatttgatggtttgattatatatttgctttaaacatttggcttttcagctgccttgcatccatttccctttaacaatttatctgtttttaaattaatgaccttttctattagacacactttcatcaggggccctgtattgattggtatcttccagagaaacagaaccaataaaatgtgtgcgtatgtatgtatatgtgtatgtttctcagagagagagagcgagagaaagataatttaaggaactggctcatgtgattgtggagttgggcaagttcaaaatctgtaggacaggccagcaggctggagacatagggaggaattgtcatagtttgtgtccaaaaatagtttgccagaatcctcagttttttgagggaggtcagtctttttacttaaagccttcaactgactggatgcagccaaccgatatcatagatccaaagtccagtgatttaatgttaatatcatctgaaagcataccttcacatcaatatctagatatatttgacagatatctgggtaccatgtcttagccaagttaatgcataaaattaactatcccaggctccattccctctggtcaaagggcaagcatgtgattcaagctaggtcaatcagttgctctctccctcaaatttgcactgggttaaaaagacaaagaattacatcctgtctatacagtcatgccaaatcacatgatccatctccaacccctaaaacacataggtatggcttttgttctcaaccttcagctcctaattcctttaaaaagttaccagtatattctgtgaggccacagtgaatcttctaatagtttacttttatgtaggccagagtcatttggcttgtttgaaattaaatatatatatatatacatatatatatatatgtgtgtgtgtgtatatatatatatatatatatatatatatatatatatatacatatatatatatgtgtgtgtgtgtatatatatatatatatatatatatatatatatatatatatatataaaattgcttcagtcaggctccaggtacttggaaagacattcatcaaattaataatggttatcctggggactgggctttgaggattgaggatttctgatttttaatatgtgtctaatctttttaaatgtttcagtataatttataattagcagccaattattttataattaaagtaaatcctgaaaaactttctacattagtgtgtggaaaaacagcacaattgccaaatttatagggcgaagaagtcctatgtttacctagaggggaaactctgaaccaccacagcccaacaggaggctctgtgggacaatttggaaaacattaccataatctattgtttttatatttatttagaaaagaaacaaagggagcaagatacctccccgtctgacatttaaaatttgattcactgatatattttggctcacagtatcaccttgtggcatttggcatctgctgctccccctccccaaagtcataatatactgcataattaattcagcacaagtagtgacaatgccaactctgtttatttaaaaagatacctcgactgttcttttgaataaatagattgcattcctttaaaaatccaaaataatactgaattaattagaagtagtgcaatcagaataaattaggtcctatctacatacaactcagttttaaagctagaaattcaaattaataactaatttgaattagctacttcttcccatgtgtctctgagtaaacaccaagcagacgaaaaatttccattgccaataataatagtaacaatagcaaatattgttaaactcttactatttgctggtaactagttaagcatgcttcataaatcttcttttatagtagtcatgaaaaccacatatctgagctattaccttcattttgtggatgacaagttcaaactgagttttagagacagtaagcaacatacccaacatcacacaagatttaaattcagactctgagtgcttacaaactatcttacgctgtgatggtaaacatctttgcaaattttccctcataattgagtaagccatcagagtttcagaataaatgtgtaggaaaacttataaacatcagggacaagcttaaggacttgacatcttttacttttgtgtgtgtttcatagaaaaaaatagctcaaaggttaatttaaagtaatactttgaacaaactccttaacaagaagagttagacttcatacttgttattcagcagaatagtgactttgttcatacaactaaactaacgaactcaattcctcctttcgactgtttcttttttttgcctccttaatagttattttatacctgtttcttattatttatttattccactaaaaatttcaatgtcttcacattatctataattggtgctatggtatattacagttgaatatagttgaacctgttcaaatacattttgaccaatgataaggagaaccaaggattcctttgctttcatattacttcacacatgactttttaaaaaatttactttaatttctgggttacatgtgcagaacgtgcaggtttgtaacataggtatacacatgccatggtggtttgctgcacccatcaacccataatctacattaggtatttctcctaatgctatccctcccctattccccgacccccagacaggcccccatgtcacacaccacttttagaatcacaatacaatttcacattcaggacaatacttgctgaattttagtttgtgtttgtgtgcgattgttgatgggaagaacaaaatggcagtcacatcatatgttgactctagatgtgttatttatcatttgtttcttcaaaatattttgacaaacgatcttcgcattaaaaggctgtgggcagtttgggagctaccacctgtttccctcttcattgatcactttgctggccccaaaacatatccacagaaaaaattttgaaagtgattggccaagggactcagtgaggatatactttaatatttagaacactattaaaaacaaaaggagacattattaacaatatgctgggacaagaattataacctgggactttctatggcaaatgggatatatgattacttgatctagactgtataaaataaataatatatttggataatctacaattacaataagtatttatacacacaaacatatatatacgtacatacacacacacacacacacacacacacacacacacacttcacatatgtacctttacaaccaatatactttaattgagactgagaggacaagagccatgattattcatatttatattcaatgacttattacataataaacatattttgaaaatttgatgagttaattcaattcaaaatatgcaaaaaatatcaggctgggcacggtggctcatgcctataatcccagaactttgggaggccaaggcaggtagatcatctgaggtcaggagttcgagatcagcctgaccaacatggtgaaaccctgtctcaactgaaaaaatacaaaaattagccgggtgtggtggcacatgctggtagtctcagctacttgggaggctgagagaggagaatcacttgaacacaggaggcataggttgcagtgagccaagattgtgtcactgcactgccttggtgacaaagtaagactccatctcaaaaaaagaaaaaaaaaatactgtatatctgctatgtgaagccaatgggtttcaagttaggatataatgacaaagaagtttaaagaattcatagcgtagtgaaagaaaaacattcatagtaaatgaacacactgtaatgaagagtttaatatttatagtaggaataaatgggatcacaaagagaaactattagttttgaggatctatcattttaggttaactgatatgaaccttcaataacaaatatgtgcttaacatatgaaacagagagaaagtagggtaattctcagagttgttcagggtcatatgtgatgttctgtgtgcctagacaagttgtactatgtgtgttagaagagatgagactggaaagtggtcagatataagttactttgaatgataagataaaagccgtggaattcatttggtgtatgatggaaaacactgaacctttttaaacaccaaaaaatcagatcagcattgtattgaaaaacaaaaacaaaaacaactttggctttattgtgatggtggttagaggagtgagagactggaggccggatgccgagtttagagtatgtctttaaatagatgttctgacagtgtaaatagacaggtgtcaaacagatttgagtaagagtatataggtaatgcagaaaatggctttggagattgattgagtttggaacggaggtcattgaagtctaggttcaaatcaataatgaccacaggagtaacaatacatagtaagtatggatacattagaattggatagaaagaataatgaggcatctgccagaaacacagttaaaaatatccagaaaaagacgagaaattcaaacttggaactcaagacagatttcaagttagaagacttatctacaacaaatacataatccctatttgaggaaaaatagaactctatataggtttgctcaactcaatcttagtaaaacaataagggagaaaaaaagaattacaaaagagagaagccttggaactctttaaaatttaatcataattttaaaataaatttcaaaataaataaaagtgatcaaagatttaagaggcaaaatccaaggccaccaagggaatgagaaaaaacggtacttccataaaaaagcaagagaggagagatttcccagactgtaatatatttaatgtgaggctatgccaagaagaaatgataagtgttgtagatcactgaaaatcatcattacttttctgataactgagaaagcttccccggagggagagggtttcatagataaaccagagaagctgtttttgacatgaaagctagattttttaagacaaagattgaagttgagatgtttgtcactagaaattattgggatccaatccaatggttttaaacagggggagagaaaaagatgaccatgttcagtgagcaactgatgttgaaatactgaaaaccacatggtgcaataattaaaggaaggtatacacagtaaacgcatagaaaatacgttaatatatcattcatttttctgtccagggataaataacactgcaaaagaaaaaacagccaaccaatcaagcaaacacataaatgtatgctactgttcaattgaaaaaaatgcataaggatttatcatggttttatctgtgcttcattagaaaataaagccaaggattttatactccaaattctacagacttttttcataataccagaaaaccttaactttacagacataataactttaaaagagttggaaattaagaataaacatacataataatatatctgggcaataatttatttcatcctacttgcctagcatcctcaacgtagtttggcatacattaaggtcctatagaaatttatcaaattaatactaaattagcagagtactatgaattgctttctacctttgtaacaccagatgtatatatttatgtgttcaatataatattaatcttagtgtttgtgaaaacattaatttgccaaagagagttgtttatattagaaaaccgtgtaatctacatttataaaatcagtgtatttctaaacaagtgactttaaattttgatataaagcgatttttatttttattatatcatagttcatgagataaatttattaatagactatatttttaaaagtttttctgaactgacaaattctgcatgtattataatggggttaggaatggtttctcaagtcaagaataccaccaaagtaaggaaaatttcacatcaacataggtgaacaggtggcaagtcttccaaaatttgaagaattctttcaagaaaggatcagcaagtatgtaattagagtcaacatgttctgtttagctgacattaatggttagctttcactctggagagcaagatcttattgaaatttcatgaaattttagcagaatatataaaggaaaatagaaaaagagacaatcaaaaagaataaaagtacagacataaacacagtaatttgaatgtgaagctcaaaaactaactccagtttttatacctagtgttctagaatggattcaaaataacaatatacataacaatgtacataaaaacctgatgccagtactaaggatgattttattttctaaagattgccacaataacattttcttttccatatgctcttcttataatgtgacttggacacccctcatatagggaggtggagtatgtttctaccccttgaaactggcagagatttgactacaacagaactgacccttcaaattccatagctaatttatgaaaatttctgcctaattctcttgggaagcttgttgtgacaacccactgtcttgctgtgaggaagccccaacagcctataagaggcttcagtggggtgaaaatgaagcctcagtcttcaatcctggatgagcaccagccaacagccaaaatcaacttggtagccatctaagttaatcattatgaaagtggcacccagccctcagttaaagtgccacagctgatgctgcatggagcaaagataagatgttttctcaagtcttgctaaaattgcagcttagtgagcaaattaaatgattgtagtttgagcccactaagttttggtggcctgttatacggtgactgataatctgaccaagtgcctaggcttacaagtaaatatatctatatttttgtacatgaaataaaaaaataaatatttgccataattacttaaatgtataaatcttaaattctcattttttcaaagtatgttaaggaatggctcaatctgttaaaaatgataaaaggatcaagattgatcattccagaatttcttccataatatttaattcaaaaagcaaggttttaaaagaaaataaaagagtaattgttcaaaaaaatatttattgatcttcagttaaagacctcctttttttactggcaagaatccactatccttaggatctttcatgctctttgcccaaacactactttacaaaggattcagagcataaaaaatttcctgacttatttcttcaccattagttcattattctccttatgttaggatatgcaatatttaatattggactgggtttgtcatctgaagactgaataagttttatccttggactagttctactttgagtactgatactcaaaatatgaatattatagtacaacaagggagatagtgaggcattctgaccaaaaatttgcccatactctctgaaaatacttttggatataaatatttttcaacaactatgtccacctacagagtgaatctccaacttaacccaggctgccagagccagaaaaaacctgctatcaatttttgcatgtagagctaggactcaaatgtatcttaattttatttactcttcctaaattgtatctatatacttaaactgtctaccagaaacgtttttgtgtatattcaacacatgcaaccagttaatatttgtgcagagcttagcatagttcattacgaacagaacattctatacaacctctagacattatgatcacttacgttattaccccaaattgaaagtataatctggtctctagcattaaactgcataggaatgagagagatgctcagtctgtaatctggagaggaaaggaaggtcaatgattctttgtaaaattaagtttgtacactctgcttttcaagcagcagtctctatcttcctttactttcctcaatgaactaactactagtaaacagtcatcagactgactcattgaattggattattgcggtttcaatgtataccttctcttggggtcccactggtacactagctgaatctattaactcggaaacataaattaatactaaaaatatatttttctttttccttttttatatttaaaaggattttaattggaagtacacacacacacacacacacacacacacacacacgcaatacagagtgccaaatttgtatggggatgattgaaaaagattattatcaagtattaaatatttgtttcagcatatttgttttttcactgttgtctttccgaatagaaattttcgaatgaaacaaaaatgcacattttaataccagcccaatatacttgatccttacatgtttaaatttcatgtgcaaaaaatgattagtcatagagcaaacccaccctcttgtagaaattttaaaagattttaatgccagcgtaatatacttgaaccttacatgcttaaatttcatgcacaaacaatgattagtcatggagcaaacccaccctcttgtagatattttaaaagataaataaaaatgaaacttttttaaaaaaagagttatattttaggttcaggggtccatatgcaggtttgttacataggtgaagtcgtgtcatgggaggttgttgtatagattattgcgtcacccagttagtaagcccagtacccaatagtcatcttttctgctcctctgtctcctcctaccttccaacctcaaatagacttcagggtctgttgttctcttccttctgttcatgagttctcatcatttacctcccacttatatgtgagaatatgcggtatttggttttctgttcctgtgttagtttgctaaggaaattagcctcccactccatctatgttcccgcaaaagacaagacctcattattttttatagctgtatagtattccatgtggtatatgtacatcattttctttatccaatctgtcattcatgggcatttagattgactccatgtctttgctattgtgaatagtgctgccatgaacattcatgtgcatgtgtctttatggcagaatgatttatattcctctgggtatattcccagtaataggactgctggatcaaatgggagttcttcttttagctctttgagaaattgccacatggctttccacatggttgaactaatttatactcccaccaacagtgtataagtgttcccttttctctgcaaccttgccagcatctgttattttttgactttttaataatagtcattttgactgactgtgcaatggtttctcattgtggttttgatttgcatttctctaacgattagtgacatttaactgtttttcatttttttattggccacatgtatgtattcttttgaaaagtgttcatgtccaaaagaaaacactttttgatgtttttatttaattcttgtaattttaaattcctcatagatgctggatattagacctctgtcagatgcatagtttgcaaatattttctcccgttctgtaggtggtctgttcactctgttgatagtttattaagctgtgcagaagctcttaagtttaattagatcccatttgtcaatgtttgcttttgttgcaattgctgttggttctttgttacaaaatctttgcctgtgcctttgtcctgaatagtattgcctaggtggtcctccagggtttttctagtttggagttttacatttaagtctttaatccatcttgagttgatttttggttatggtataaggaggggggggtccagcttcaatcttcatatggctagccagttctcccagcaccatttactgaataggaagtctttttgccactacttttgtcagctttgtcgaagggcagatggcagtaggtgtgcagccttataaaaattatgtttgtcatcattacttttaccagtcctttcaagtaaaatttttatgttcaccatctttaatagtttgtgtgttttttttgtttgtttgtttgtttttgtttttgttttttgggttttgtttttttttttggctgggattcaacaaaataacataatggcatataactttaggtattctacatctattttgtccagtcaagttctgattagcttttttgcctgcaaaaatacttcatttggctgaaaacatatttttatccaatgcacataactatttatttttctctccagctgttttttttattcatgcaagttaactggaccagtgatcattgctgtgagtagactcaaaagtgattctcagctattttagatctgctgtgagaaaaaccaatagatgtattaatattataacattggataagcactctggctttacatttaggaggcattcctgttctattcctcaaaatctcaaatagaggaccctcagaacttcagttctcatgtattttgaggaaaaaaagtcaagtagcttccaacaaattctaacactttgagccattttgggaacccagagagctgattgctttccagggaaatagcaaaaatactggttaaatggttaaatcctagaccacggaatttttaaaaacagaatatgtgtatacacacacacacacacacacacacacacacacacacacacacacacaaatacaccttttaggggagaaattgatatttttgcctcagcaggatatccatttgccttaaaattcttattcttaggtatgtacatcaatcatctggggaggtccaagctgtgaaatccaaactgacagaaatttatagctccattagcatttatcaaaaatacaggattaagtgtagaaaatatgtattcatgcttcacctttctatatctttactttaagaggtaagtatttgtattcagtatttgttagctcctaccttcaaacggccaaacataatctccaataacatttcagaattctactgggccaaaaatgtatcctattgacctgtgtgtcctctgacttacgactgcatgtttaaatatgaatttaagaaaatgctgcactgattatttggagtttttcagaatggctagtgaattccttggtgatttattggtaaaaaaataaaataaaataaccatgttggactgttgtttcataacatactttctatttggaaattatataattactctttgtgttaaaaatgtattcatactccctgaaaatagtttcggacataaatatttttcaatgtgcatatactgagttttgctattataaattatatgtctacaaaatacttgaacatgatcccattgggttttaaaacatgcaaataaatggagaaagataagagtatatttaccggagttctcaactcaggtatggcagcttgataagtgagtggacggcaatcacgagtgtttggcacaaggacacaaggaagaaacattggacccaagtcatctccatccagaacatccactgtgagagtggtggtggtggttcgcctctcattcagattttgggcacggtcctgttagggagaaaaacaaacaacaggtagtttatagaaattaggcacaatagccaggagcagtggcccatacctgtaatcccagaactttgggaggccaaggtgggtggatcacttgaggtcaggggtttgataccagcctggcaaacatggtgaaaccccgtctccactaaaaatacaaaaatctgggtgtggtggcaggagcctgtagtcccagctacttgagaggctgaggcaggaggatcgcttgaacttgggaagcagaagttgcagtgagccaagatcacgccactgcactccagcctgggcgacagagtgagactcagtctcaaaaaacaacaacaaaaaagaaattaggcacaatgtagacttagttttcattgaaaaaaaaaagattggtaaattaacttgcttaaaccaacagttttaagtggttgagtcaggatgtaaactgagatccaattgtcttcaaagcaactttcttgaaagtatgttacagtagttaagcttttgtatgttaggcctttacctaacagttcacattactagacagcctaaccataaaggtcactctcatctcattagagcatttactttagaaaccttgtaattgtaaattccttctctgcgcctctgaggtgttaatcttttataagctgcttgtcagttctacaaaccaggcccatctttttcatgccctggggggccatctctttgaaatgtaatagtcaaggaagaagcccgtatttcccagtttctgtgggaggttaggagcctgacttcctttggaggcttgctccaatttctaaaactactttctgtcatgaaaattcaaggaaatttattttcctttgggaatgccaattagtaaacacatctggtctgtgattcccccacacccaagtccactggagtgtttaacagctctccagccattttttctattagagatcagttcagatctagtctgtattctggtctctcttctctattgcaatagctgtgaatacagtcttccttatcatttaactttgtctagtgcaattttgctgtaggaatacattgttactaactaaaatccaaagtttctttagatttccttagtttttacttaatgtcagttttctgtttcaggatcccaatcaggataccagtttgcatttagtcataatggttccttaggctcattttggctgtgacaagttctcagacttttgtttttgatgacattgacaattttgagcactggatattttgcagaatgtcccttaatgggtgtttatctggtgttttcctcaagattcaactgcggttatgtgatgtatgtaggaaaaccacaagtcaactgctattttgacatatttatcaaaagtatatgattaatatgacttatcactgttgttaacttcatcacctggctgaggctgtatctagtcagttttctcaactataaatttcctctttcttgtttccctttcatttctttggaaggaaatcatgatggacagcacacacttaaagaatgggtagtaattttattagaaatgtaaattgtttatatttatctgaagaatgtttgtcataggacagaagaaaataatattggacctaagtcatttccatgaagaacatccattgtcaagggtggtggtggtagcatcattcattatgacagaatctggaaatgtttttactttcacagcatttagttattattttgaagaactattatgcttttctgcctttttgaattctattttgtacaacattgacaagtatacttgcatgcatgttcatgtagcactattcacaacagacaaaacttggcaaaagcccacatatttatcaatgaataaatggataaacagattgtggtatgtacacacaatagcatatgattcaagcataaaaagaaatgaagtactgatatatacaacaacatgaatgagccttgaaaacatcatgttttcaaataaagaagccagacaaaaaataaggtcacatattatacgatccatttatatgcaatatctggcagcagtaaacatattggtggctacaaggagctggggaggggatatggaaagcaactgcatgagtggtgccagctctttttggagtgattaaaatgtttgggaactggatagaggcggtggttgcacaatactgtgagtgtaccaaatgccattgaattgttcactttaaaatggctaatcttattttgctaatttatgttaaataatttttaaaagtaattatactaacagacctgtatttttttttttttgttcataaaatgtcttcctttgtgacagttcccagacattaatatttgccttccaattaaaaaaaaagtccctcttgttaaacatggttaatagtacattttggttaagctcattcccagtctggttgctcataaaaacttgtaaagcaatgcttgagggtaaagttttaggaaacacgaatttctgttggtggaattttgtcagtacaaccttgtctagaatgtaataactctgtggttccaggattctttgatatttttatacagtataagacagactgcgataaaattatagcttaaaaaaacacaaaatgtttaaattttcaaagtttcggaactcactcagatccctagaggcactataaagattattcaaacctaaagacatttgagattcaacaaacagaaagaagtcttttctgaacttcttttatgtcactaaaagcagatacttatgagagtgaggctgccatgaattccctctgccaagaaagtttatgaaaatgaagaaaaaacaaggaaatctattcttacctacataaacatgatcacaagctattttaatctcccctttgactcctagaaacctagtttttcttcccttagaagcctcctccctctcattgtgttaaatatatacaccttcttctttagctgtttaaggagctgtgtatatgcactcccatatgtatatcaacctctaggccagttgaaaagtagagtaggagcaacatgtggcatgtgagataattttggtggttcacaaattaactttataaattattcttaagatgtatgaattttgaacatgtagaaaaatattaatttaaaataagcgtatgtgtatattttaaattttaaaaaaaaatagctcatcaaacttgccacttttttaatactgatcttttatttaattgggttatagctatgtctataatatatgaattaatagacaaatgatgtaatgatttgttcagtcagcatatcctgagtagcttccaaggggcagattccaatacactgcttctgacggtcttaaaaaaatgatgaggacatgtttcctcatcccattattaagagagtcatttagtactgaaaattactaatgttaagataatgtgacctcataaagattagtaggttatattttcacatatatttccctttgtgttgcatcatccagtgttttaaatcattaagtaatctcatcttccatatttctaaagttatattaaagtttaagaactaaaacaaatctttaaatttctaaatatatatatataaactggaagcttctttaataggggtggtaaacttttgttacatttattaatgattttacatttgacatttttctcaataacaaataagttaataaaatgacatatttaatatgtatttgtaaatttacttgtggcactggagttaatatttgaaaatttttttatttataaaatatttatttatttatttatttattttagaaatgagaatctcactacattgcctatactgacttcaaaatcctgggctcaagtaatcctcgcacctcagccttctgagtagctaggactataggtatgtgcctggctttaacccaccatttaaaataatgattgcttatgaagttttaaaagattgaattaatctaaatttaatttataaaaatagtaaatagataataaatattaaatatttataatattttatgtgatacatgaatgtagcatgcagatataaacacacatatatatgcatatatacacatacatgcatataaatgccagaggcaatatttctacccttccatgtcactcagccttctttatatgtaatcatcaaatcactataataaacaaatttgaattttttaatgttatgttttctttcagtctgtcagcatcaaatctctcactattatctgcttctttgggtcattgtcactactccatagaatagatactggtgtgttaaagatagtgtatttacaggaagtgtataccaaaatacataataggagttttttctcatattggggaaagatattgcttacaaagtgttgagctctaaaatttgtatttttaagtgggaaataaaaataatcctggcaaaatgattgtgagcagagatgtagcaacaaaatctactaacagtttccacacgtgggaattctcccacattttatcaccaacacatatcacataggaaaatatataaaaatatgtctcatgcacactcataacttgtgagcccataatggtaatgctaattcatgatgttctcccaatttggaatcagatttgatcttaaaatatccatttaaaaaataatccttcagcaattgagataaaaatcaaaacaaaaacaacaaaaacagaaaaaacaaaacaacctacacttttgatctttatagtaatatactactgctcaaggctcttctgagtaaatgaaataacattctaaattgtgagtggtaaaaaataaaaaataactatttctataaacattccatataatttaattatgttttcatttacgttatgtgataatctaatatatattaaaatccacaaagaagatctcctttcttccctttcccattttcatctgcatttctcttcttttttaaaaaataagaatatatatttaacttcaattatttaaaaataacaggatattacattaagttaggaaactgtgattctagttggcaagcaagaatatcttttaaaaagttaaacaagttcaaccagtactctgaacagaattgtgtctcctcaacctcaagctagaaaatctagagtaaagtgatatgtttctggaaacacataatgttccaagatcgaatcaggaaactattgaaaccctgaacagatgaatattaagctgtgatattaaattagtaataagaaacttaccaaccaaaaaaagcactggaccagatagacacacagctgaattctaccagacatacaaaaattgactcaagatgaattaaagatttaaatgtaatacctcaagctataaaaatcctagaggaaaacctattaaaactcttcttgacattggctttagcaaggatttcgtaatgatgatatcctgaaaagcaattgcaacaaaaacaaaaactgacaagtagcacctaaactaaagagcttcggcacactaaaataaactgtcaatacagtaaacagaaaatggaaagaatgggagaaaagctatgcaaactatgcatctgacaaaggtctaatattcagaatctataaggaacttaaacaatttaagaagcaaaagacaaacaatcccattaaaataggggcaagggacatgaacagacacttctcaaaataagacatacatgcagccaacaaatatatgaaaacatgctcatcagcatttatcatcagggaaatgcaaatcaaaaccataatgagatatcatctcataccagttagaatggctattattaaaaagtcaaaaaattacatatactggtgaggctgcagagaaaaggaaatggttatatgctgttggtgggtatgtaaattatttcagacactgtggaaagcagtttgaagatttctcaaagaatttaaaaccaagctaccattcaacctaccaaccccattactgggtatatacacaaagaaaaatagtgcattctaccaaaaagacacatgcatgtctacattaattgccatgctattcacaatagcaaaaaacatggaatcaacctaggtgcccatcaatagtggattgcataaagaaaatgtggtgcatatacaccacggaatactacaaagccatagaaaagaatgaaatcatgtcctttgaagcaacatggatgaagctggaggccataatcctaagtgaattaatgcagcaacagaaaactaaatactacataatatcagtttttcaatgggagctaaacaccaagtgcccagggaaataaacctgggaacagtagactgtgaactgctggggcaaggagagagaatggatcaaaaaactacccattgagtactatgctgaccacctgagtgcaatacacccatgcaacaaacctacatatgtactccctgtgcttaaaataaaagttgaggaaaaaaataatgcttctatgaacattaaccagaggaagttgggtattctattgtcttgtaaacattttttgtttgagatatttgcctaatatttcttattttttatgcaaaccagtagacagaattatattatcatttatagccccaaatgctcatgtatctttagtagccaaacactcagtaaatattaggtcccataaaccatcacctgctatcctcccatttcactctcactcctcagaaaatgcccaagaaacttgcagagttaaaacaatggggttacaattaacactaattccacacatcagtaggaagcagaagtgagggaaggtcagggtagaggttatttctgaaaagttgtttacaaggttgaaatataaaatatagaaaattaattttacctatacaaacacatatgtttgcaatgcttacacattttatttgaatatttctgtccataaagataaaaaattgagctaataaagaaatagtaatattataattttaggaattatatcttgttaggaaagatagctagcatcccttctctagattttgctatttgagaaatatacaacacccttgctattcataaaataatttagaaattataaattattcttgccatgattctaaattaaatttaggccgggcacagtggttcatgcctgtaatcccagaacattggaaggccaaggtgggctgatcacttgaagttgttaatggtttcagaccagcctgtccagcacagtgaaactccgtttctactaaaaatacaaaaaattagctgggagtggtggcacatgcctgtaataccaactactcgggaggctgagttaggagaatcatgaacacgagaggcgaaggctgcagtgaaccgagatcacccccctgcactacagcctgggtgacagagcaaaaccccatctcaaaataaataaataaattataaaataagtaaatataaacttttttctttctggtaattaagaaatcttgattacaaaagtgttcttatatatttcactcaggataacaataatataaaagagagtttgctttgaagaaaaatgatatgtaaagagattactttgattctatgtgaattagggtaacatatcaaagttgaggttataataatatgtagtaaatttcaacaaaaagaaaacccatttgatctttctagatctacccccaaaatttttgtctggaattaatcattccttcattatgtatttatatttgaagtcaatagcatgggtgacaatattgcaaatattctcaaaaaaatatgtgacagggttttctaatatgggtcagtcaaaactcaattaccttaattacggatcataacatgtaaacacggataaaaagaaacctccaaactacatgtaatttgaaggattctcttcgaaaatcaaatatttttaacataagcaaaaccaggtcaaagctgggtaatgttcaataatttgtcatgatacctgtaattattcttttagaggccatatactttaaagtcaaaattgattgctcatatcttaattctccttatgacttcaagataatatattggtgcttaatgtacatgacttacattgtgcataccaccaacacaatataaaaaaccactgccaggtgcagtggctcatgcgtgtaatcccaacactttgggaggctgaggtgagtgaattgcttgaggccatgagtttgagaccagcctgaccaacatgctgaaacctcgtttctactacacatccaaaaattagctgggtatggttgcacgcatctgtaatcccagctactcaggaggctgaggcacgagaatagcttgaacatgggaggctgaggttgcagtaagctgagatcatgccactgcactctagcctgggcaacatagcaatactctcctcccctcccaaaaagaaaatccaggtgtggtggtacgtttgtggtcccagctagttgggaggctgaggcatgagaatcacttaaaccccgtaggcggaggttgcagtgagctgagatcgcaccactgtacttcagcctgggtgacagagcaagactgtctcaaaataaataaataaataagcaaacaaacaaacaagataaatgtaaaaaaaatggaggtacattttagatatatggatatcattatcatatacaaacaaagatatgttagacttatgttactattggtatatacaaaacagttaatgattaacaaccagctatcagataagtagccctgatttgtagcactggcactttccatactgtaaatgctcccagcatggctgcaaatgtgagatcactgaactcagagtttgaaagagaaacccacaattggccctcaagcaagtctcagctgactttccacctccaacaacccacagttttaagttacagatttaaaatgttgtgaaaatgagcatccttctttatcatttgtggaagtgtgatatgtcacaacactttgaaaaataatatagcattatctactaagattaaaaagtatgtgaatatatatgtacaaatacacatacacatatacacatatatatgcatacatataattttctcaaagcaattccatttttaattactgatttttaaacagtaaagtaccagtattttagtgatttatataatactgtaataatgtctcaatatatttcaagcattagtctaagtacttttttgtttgctaactagctaattgtaaccagaacaatgtggtatgttttattaatatacccattttactggttaggaaattaacatacaaagcatgccccaaatcacacagccagtaaatggctgaactgagatttgaactcaggtgacataattcactacactcactgcctctcttgaacatcatgagggtagatatcaatttggtgccaaaaacaaatgatcaaataaacaaaaacggagtattgttgaatcaatggtgatccattattattatcttacattatgtagctattaaaattatttgttcttaaaacttttaaaaatgcttaaaatgttataactttctatatttaacatttcattgtgtactgtatgacttaagtttataacaaaaactgttattgcatttaaattcaaatgttcattcgacttcttcctaatgctattccttccttttgatgattcacatatgtacttctgttttataactttatccctgaaatgctaaaaacttgtcactacctcagtgatgagtagtccatcatgttggatagaagttgttccagatgtctttataaatattttaaaactagacaccaattcagaatcttttaccttgcatttctattaaaaaattatatctttttaattgcatgataaaaaaactagcttacaaataccttccacagcaatctgacttcataaaaaagacattctaccttttcttcacatcttcagttaaatagaaaaaagaattttctgtgtttttgaaaaactctgagtggccctccctaatacattttacttttccccatatctacagttttcactctgctctatgttacatgacattaaaatatatacacacatacagacacacacataatacatataacatcttataatatataattataatatataaaataataaatcatttttaaaatctgaagaaatataaataaaagcttccaaacttagcttcaaaaattagatctatatgtctatctacatatttctatctacatatccctaattatatatctatctaggtatctatctatacacatacacattctgtgtcaggtgatatatctctaagaaaggcaagaaaatgacaagtttgtggcacattttttcatgttaacttcttcagaacagctaattgaggttattttccttttagcatcccctgctatctatctgttctgctgtatgagcaagattacaacgcttaggagtcattaaaggcacaggatggcttcagagtatagctgctttaaaaaagaaaaggctattaatttagagcagttttaggtttatagaaaaattgagaggaaggtatatacaccatgtctccacacgtgcacatcctccccacttacaacatccctaatcaaagttgtacattggttacaattgatgaatctacattgaacaatgataatcaccaaagttcatcctttacattaaagatcaccgttggtgttgtacattctatgggaatggacaaatgtataatgatatctatccaacttcatggtatcatccagagtattttcactgacctaaaaatatttcatgatccttctattaatccctttctacctgcctttaccaccatatccctgacatccactgatctttatactatttccccagctttgcctttaccagaatgttatatattggaatcatccagtatgtagccttttcttaatggtttattttgcttataagtatgcattcaagatttctccatactttttatatctttatgcctcatttcttaacggttatttcaaaaacgtaagcttgtcacttaatatgggactttttatgtgacctccccttctagcttttttctcaaggggtactcccattcatcttgctaagaaaagaaaaatgttttcaggtcatcagtgtgcccagtctcaggatatgaactatacatagtataattcagaagtgaataccgcatatccctttgacacatatggacttcctcaaccttcgttcctattatgctgacacaggtgatacaagtctagaaggagatgttggatgggagaaaactctgaagagagtatcttcccagataaaagaaggaagaatcaataaacgtaaaagaaatcctagttttgctaccctttctgcctgttgcattcagacttgaaatgcagttgtgatgcttatggccatggtacacaaatacctcccagctgataaggcattgggaaaataaccacattccagagaagagggaagtataaggatggaaggaacctaagtccctggtgatataattgaactgtcaaaccaaacattgagctgcataattccagaaattttattaaacttccactaataataactataataaatgtctatgttttataagcatataagcatgtctatgttatataagcatgtaaggatatctatgttttataagtatataaaccatgtctgtgttttacaagcatatgtttggatgtcctgttattgttatctacatacattagcataaacttcagttatgggaatattagctgatatctagtgaacaattactcaataaatgatagccatgaggaagaacacgaccaattaggcaatgattctttgcctttagtgtaccttagaattccctgaagagctaattaaaaatgcagatattccacttccatcatctgagatttttattcagaacatctgaggtagggtccagaaatatgtatatttaatacacacccaaggtgattctgctgctgttaatttgcaggatcctactttgaaaaatatttcagtatagtctaaaaaggttggataatggataatacatatgaataatttagaggtcaaagaatacagtgaataaaaacaacctattctatccctttctccatctataagagtattatatataaacaccaagggcaggagtgccctgatgaagaagtgagtggcacagagctctccaagagtatctgatacattttggatgagttttttacttcataaattcacagaagaaatttaaaagaaattgaatactcacattagcttggattatgacaaagtagcgagtcttatcttcatagttgagcctcttccttaacactatatttccagtcaacattaggggaatttcaaaggtgtcattggatgtctgcaaatattaaagatacagacttcagattatttgaatgtaagatgaattaataactcaatattttggattaatcctcttggaagttagagatgacatgcttatcatctgaaaatagaatgactataagcttcagagtcaatattgttatcatacttccaaacatttaattttgatcaatgggtttccccagagtcctttggtaataataaccagaaaatttgtttcttgtcatagtttttaatatattactagtattattcatcaacagtcttggaatagttctaaatcaaagtccaggtatctgaaaaacttccctgttaccacattatcttttcactgtgttctttaacaccaaagcattcaaacactgaaatctgttatttctacatagtatcaattgtcaacattgatatccattctgtattttaagtatttttaagtattatctggcattaaatacaaaaaaaaaaatacagttacgagtcacttagtgatgaggtacattccgagaaatgtgttgttaggtgatttttgtcattgtgtgactattatagagtgtagattcacaaacctaaaatggtacagcctactacatactaggacaagtgatatagcctatggctcctaggctacaaacctgtacagcatgtcactgtactgaatgctataggcaattgtaacacaatggtcagtattttctctataaatgtaatctaaacatagaaaaggtatagtagaaatacaacattataattttatgagaccaccatttgctatgtgatatatcattgaccaaaatgtcattatgcagagcatgactgcgtgaacttgaatcagttcattattgtggaaaaaaaaatccaggttatatatcatttttttcttttaggttccacaacttctgctcattagttaagttctctgccctgtctaggactgagttttttcctggtaacatggaagtcataagggcaacactagtgctctggtataagcagccctcagtgtaactgtattcacaccttaagggagtataatttataagataaatctcttattcttaagaagaccttatgtcacttttgtattttagtgccattttaaagaatgataaaattgtttctagtaggctcaataactcagtgttattttgttcactgaaattgtcttgtggttgttcagttgccttgtgtatttgtgcttgtgatttttttgtgaaatatttagtttgaatctgcattagattgctgcaaaaggaaggaaagagagggaaagaaaaatgagaggaaaaggcaaggggaaggagaagagaaagggaaggggaagtgtggaagaagaaaaaaactgtgtatgtgagagagaaacagagagagagaggaagagagagagagtgttcacaccctcaacttagtgtaagtgtattcctaagagtcacataagaagttaaactcaatgaaaaaaaaaaagctgattcaaatctctcagctcaggctcaatcaatgaaatgtgtgtagtttagccttccatgtctagagctgtgatctgtctcctttctttctttctttgtctctctatctctctttctctcggggatgcataaagacacacacactgtacattttgcagaattaatatatatttttaaatgattcattctgtgctcctcatgtaatgggccttgcaaatcgttcttggatgcagtcatttaaaagtaacaatttaaaatataaatacagaaaatgaaaatgaacaacacaattaaaaacagacatttgacattttccctaattttttgcctattcaactttgcttatacctatgagtggggctggcattatgacacaggagtgtgaaaatgattgaatctaaacatgtaagttgaatatgggcaaaaccttagttaataattgctgtttacactgttaaacttatcctaatgtgttgttatgaggttattacattttagtgactcaataatatagaaatatatattggtttctagcataaatatggaagatactgtggtcttaccacaaaactaccacatctctggactcagaaccccaaattagctcacatatctggtgacattgtgcctcagaggaggctatgtctctaaatgagatgagtcttgaatagtctagcttaaaaacagtaattccattctcttttaccaggaagtattttgcaaatgtacatgtgattccattttgagtaatgaaaaaatttctcttaattgcaaagatagagagaagctaaaaatcccttttcaggttatagaagtttctgtcaggatataaaatttagaacttcagcagccatttggggactattgataaaattaattacggagaaatagctaacatgctagtgatagcagagtataaaataaaaagagcccggatctgtgttgtctttgagttgctgagcaaatcttgatattaccccatctctgaaaaacttattatgatagataataaattacctttttggttaaatcatctttaatttagttttttacatatatataatatatatataatctatattatatattattatatataatataatataatctatattacatattattatatataatataatataatctatattatatattattatatataatataatataatctatattatatatataatatatatatagtaaattttctgcagctgaaagcactttgatacatgattattcctgtctctatgtgtttacactgtaggcctctctcttctccaaacaggccatggctcttcacacctgatatttgctcttatttttctcttgcttaaatatcccatcacttatttctctgtgtactaatctttgcaaactttactcagtgaaacctcttaaatgtaatttagacttaagtctttgatgtgatctcacattattttttccaaaaaacacttatttgggatcttctgttttgcttgacagattcctcaagggtctcagtctgtgatgcagaaataacctatccttaaatgtctagctaagcaacttaatgaatctttgcaatactttttttgttgttgacagttttcattggacgtttgtagaattattaaaaataatagttattagtgactttattgatcttcagagcactttcaattgcactgaattcttatcatcttaaatctatcctttagagattttatagattcttagattttaattttactttttatatgtatgtatttatttatttatttattgagatggatgcagtcttgctctgtcatccaggcttgagtgcagtggtgcaatctcagctcactgcaacctctgcctcctgggttcaagcgattctcctgcctcagcctctgagtagataggactacaggcatgtgccaccacatctggctaatttttattttttacttttagtagagatggggttttaacatgttggccagtctggtctcgaactcctgacctcaagggtatgcccaccttgcctcccaaagttctgggattaaagatgtgagccaccatccctggcctagattttcattttgttagcacttgtattctataaaatataagaataggatatactttatcatcaatggtgcttctgaaatgttgcatattgaaagccactgtattaaatttaatttattaattaagcaattattgagtattcattctgtctctaaaatgtagaataataatcaagaaaattagaagcaaaatatagatatctttggtatctttatgatagtcttctttttcctctagtaaaaagaatactggattagatcaaccctaagtaaaagtcttgctttaatgatatttctgaagtgtttacctaaaaagtttaaaaaaaaaaaagctaaattaagcaagggaaaaaagtagattttttaataaataaatacatgataaagccatgaaaaaaacaaaacaatacttagaacattcttaaagtttagaatgcacaagaatcataggcatgtatcattaagactgtagattcctagcatctattacccaaaattcccgaaattcttgggaatcggcatttttaacaaacctaccaggtgatcctgatgcagatgattcaggttttacttttgagaaaccactgtactacgtaagtctaagagtgactgcactctctgtccttgctatttatttttctcttctttcattcttagagatttgttccaccaatgaggcagaaaagtttgggaacagagcaatgcccatttacttaagcaaccttacatttctaaagccaggacattgccccctttctgatagtcgtggatattctctttaaaatacaaactaacattggcttttttgggtgataagaatttaagtgctgactacctgcactgtattaatgagaaaaatccaattatggttaaatgatttaatacccacacgccccaaacacctggcctccattaagaaaggtccactcactactttctgacagttcagtgacaacaactgtcaaataagggacaattctccatttagtaaaataagggcataaggcagtttaagcaatttatcactatcacagatatgggaagcagggtaggagacagctgtaacatccacgccacacacattcacattcaataatggagagagaaggaatgttgaggctctagcaactctgtgtttcccaagatgattccatccccccagaatcccctttactaatatgggtttgcaccagtttagataaaacggcagctctctgaaaggaggtgttgaatcctacagttaaagatgctctagaaatggaatatggggttattagcactatttcttctcagctgatagatttggtcattcatcatttttaggaaagagggaaagactccagcctttcacacctatgttgtaagcattgtttgtaatattctcttttcagctgtgatgactagaaattcagttcaaaagaagataatttctaaagaacacacacacacacacacacacacacacacacgtgtatatatattttctggtgacctaaagacagagacttagtacaaaagtgcctcaatgggcctgtaattgagaagtggcggaaatgtagataattacgattttctctttatctctgtaaattctcttgttctttgacacttttttttgaagtatcttcccttatctttgtgtctttttctgtacctctctcttctctctttgggtttcccccatttgttcacattgaatataactgtgagtctgtgttttagttccaataagcagcatcaactttgcccttatcaatctttagacagccttaagcttgtctctgattaagctcaggctactgtgccatcagctgctgaaaattctatgttattgtcattgtttgtgtgtctcctctaatctaatttcctaaagtaaaaagtggaggactaagtaaggctatgcaatttttgtccacccaagagggactgggatttgagcaggcaacattaactttgctcctaagagaaagtcccaacactctaatcattttttctgtttcatactgttaaaacatgtccctggctgacagacaaaatggactccctatgactaactgaagtaagttaaaacaaaaccaacaaaaccaggtggccatgcctgagtgacaaagtggtcgcatactctgtgttctcagaaagatgtcaaagcatcacaggatcttcctttctacaattgatatggtttgggtgtgtcctcatgcaaatttcatcttgaattgtagcttccataattcccacgtgttgtgggagggagctggtgtgagataattgaatcatggcatttccccatactgtttttgtggtagtgaataagtctcatgagatctgatgcttttataaagggaaatcactttcacttgattaaattctctcttagtctgcttccatgtaagacatgccttttgcctcccaccaagattgtgaggcctcccaggcacatggaactgagtccattaaacctctttttctttatacattacccagtctcacgtatgtctttatcagaagtgtgaaaacagactaacacagtaaattggcactggtagagtggggtcctgctgtaaagatatcaaaaaatgtggaggcaactttggaactgggtggcaggcagaggttggaacagtttggagggctcagaaggacaggaaaaggtgggaatgtttggaacttcctagagactttttcattggctttgaccaaaatgctgataatgatacggacaatgaaatccagggtaaagtgatctcagatggagatgaggatactggagtaaaggtaacccttgctatgttttatcaaagagactggtggcattttgtccctgacgtagagatttgtggaaccttgaatttgagggagatgatttaggttatttggtgacataagtttctaagtagcaaaacattcaagatgtgacttcagtgccattaaaagcattcagttttaaaagtgagacagagcataaaaattcagaaaatttgcagcctgataatgcagtagaaaagaaacacccattttctgaggagaaattcaagccagttgcagaaatttgcataagtaatgaggaaccaaatgttaatcaccaaggcatggggaaaatgtctccagggtgtgtcagagacatttgtggcagcccctcccatcataggccaggagccctaggagaaaaaagcggtttcatgggccaggtcctggacccccctttccgtgtgcagcctaggaactcggtgccccgtgtcccagctgctccagccatggctataaggagtgaagacatagctcaggctgcggcttcagaaggtgcaagccccaagccttggtagctttcacatggtgtggagcctatgggtccgcagaagtcaagaactgaggtttgggaacctccacctagatttcagaggatgtatggaaatgcctggatgtccagacaaaagtttgctgaaggggcagggccctcatggagaacctctgctagggcagcatggaaaggaagtgtggggttgaagtccccacaaagagttgccactggcgcactgcctagtgaagctgtgagtagagggccactgtcctccagaacccagaaagtagatttactgatagtttgcactgcatgcctggaaagcagcagacactcaaggccaaactgtgaaagcagccaggagggaggctgtaccctgcaaagcaacaggggtggagctgcccaagaccatgggaacccacttcttgcatcagcatgacctggatgtgagacatggtgtcaaagaagatcattttggagctttaagatttgactgccccactggatttcagacttgtatagggcctttagaccctttgtttttgccaatttctctcatttggaatgtatatatatatatattcatacccaatgcctgtacccccattttatctaggaagtaactaacttacttttgattttacaggctcatgggtgtaaggaacttgctttgtctcagatgagactttggactgtgagcttttgagttaatgatgaaatgagttaaaactttgagggactgttggtaaggcatgattggttttaaaatgtgaggacatgagatttgggaggtgccaggtgtagagtaatatgatttggctgaatccccacccaaatctcaccttgaactgtagctcccataatccccaagtgttgagggagggacccggtgagagataattaaatcatgggggtggcctccccagccacgtggaactgtgggtccattaaacccctttttctttataaattacccagtctcaggtatgtctttatcaacagcgtgaaaacggactaacacaacaataaagcaaaaacagatcctgttcttggtgccaagataaactacagctggaactacttccttttgccccctatgccatccctacactggccctttagcactagccctttgaaagaaacatctgacagaaacttctggtttggggcttggaaatcaaccaatcagagctcacctgaatcaaccaatcagtgtatagaacagtcatgactcatctgttttgaccaatcagaattaagcaaggatctatccttcatttggatgaagacagcttattgggaacctgggtgggaactatagctataaaaccctaaccctctctttgttctctgaaatgtgtcttagcttgaaaccacaggctgtatatccatggtttgaaaactgttcactgaaataaagtctctttcgtccaaattcctttccagagaacatttgcttacaatataaatttaccactctccctcacacaaatacaaacagattcattcacatttaatgatgcattatgattacaatgcagttcaacttatcttattccatccaacttccaaggaaactgtatttgtgtttggttgggttttgaaacttaaaagtcacagccttggtgtgaaaagactgaggttcgaagttttacacaaagaaggcctttacaccagtcttaattatacatgagtttccagtaaaatgagaatattatgaatttatggaggcatggaaatctcatgatataatgtaccctgaaaagtattattaaactacagtaaattttttagtaacctacctaggaataagtaatcactgttttagcttaaccttaaatattttattgacatctgaaatttggactttgacatatatacacacacacagaactacttcaggatggtgatttttttaaaaatcgtttgtccttaaaatgtggttttaacttcctgactcaggaaattcaaatgcttacacattacaaatgaaaattatggcttacattttctgaattatctcaaagctacggggagtcaaacatattacaaaagaaggacaatttactcaggaggacttgataaaagatgttaccacccactgaaacaccactgtaatacctcaaagaaagaagctgcttatgcatattgcttaagtgtcttcattttttttttctgagtagtaacagtagtgaataacaatgttatgctgcttcctcagtaaactggagactgctacaagggacatgtcatcagtctcctccttatcactttaggtcaaacttaaaatgctgaataaacatgcctccagtctggcattaaaataaaaaaaaagatcaaaaagacatgataattattgtctaaatagtcttatcaatcttgctaacaatgagatttaatatatcagaatacctatatttagatttttccatataagacaaattctcaaaaatgaaagttactgcagatcatgtgatgacaaattcttatcaatttcagagttcttcttttattttttcaaaacaaactaattcaagcttgtctaacccatagcccacaggctacatggggcccaggttggctctgaatgtggcccaacacaaacatgtaaatgtccttaaaacattataagatttatttgtgattttttattatcagctcatcagctgtcattcacgttagtgtaatttgtgtgtggcccaagacaattctttttcttccagtgtggctcagggaagccaaaagattagacagacacctctgaattagttcagtgcattatgaacactcttactttgtattaccatgaaggcattaaacaaaaaaaaaaatcagcagtattttacaataactgtgatgagtacactagaaattgcatagaaattaaatgcccctaattaaaggcctgacaacatatattgtccagtacatatttttacatattgtctactaccaagttccaacagataattcaagtggtacttaataaacaaaaggtgaccaaatgagaaaatgaacttatacaaaagaaagaagaatgcttcttcttctgaacaatagtgcagactgacaaagattctttgcctggccaaacttgatcaggcttctgaatcttctcctaggctcatctgtatacttcctcataaaatcactttttaacaaagaaccatactatatcactttaccaagaactcctctacctttgatgaatgatctatcttgaaaactcatcaggtttctcatcctgcaccaccccttaggtgatgtctgatcaccctgacttgtcttcagcaacaatcgtattagcgtgttttagccagaattcccctaatctctgatgtttcctcctagtaattttccatccagtgaccctgaccctgctccttggttataaagtcccacttgcccatgctttatttttagttgagtccaatatctctctccaactgcaagacctcattgcaatgatttctatacctattgcagtggtcctgaataaggtctttcttaccatgttttaatgtatcattaaataatatttttatttaacaattgtctagaggacttttagaagaagatatttactaaattatttttttctaaatacatcagccatgaaaggatagggaatgctgcaggaacaaacccttaaactttcatttttttctttacttttcatatctacatatctaatatgcatcagcaagtggtctctttttattgttgtcattggctaatgaatgtttctcctcaacatgtttttctctgatcacaacagcaggggcagagaatatgattacttgtatattggttctttgagtttacatttcattagtcaaagcaaatacttttctccaggcaagaaaagtacacctctagtatgaatcaaaagagaggaagaaccaaacatttttggtaaacagctcaagtgcttttgttaacagcagtgaatccatatgggtctgcagcaactcggtcctaacctcagaggaaagaatgtgatttaggggaagaagtaagtttaaggcagagggagagattgaggtgagttttagagtaagagtgagagcttattaaaaagttttagagcaggaatgaaagcaagcaaaatactcttggaagacggctaagtgggtgacttgaaagatccaagtgccttgttcatcccttcacttgggggttttctacattggcatggtttgggggtttgccattctcctcccttgatttttcttttggggcaggctgtccacatgcacagtgcctgctggtgcacttgggagggtcttcatgtgcagtatgtttactgaagttgttgcatgcttacttgaggcatttttgccttaccagtttaacattcccagaaaaaggtcatatactagtgaaattctgccattttgcctcttaacgtgcatgcttcagccctcttgcccaacttctaagctcttattgggaagctgctgatcaccagcttcaagtgttttctatctattgggagactatatttccctggcactggctgtgatcaattattcttttacagaaaaagtttaaaagccacctaaccatcacctgacgatcagctgacattcctgggggtggtcctctcctgccctgctcatatctgcctaaccatctagttgatatggtttggctctgtgtccccacccaaaacaaattacaatgtcaaattgtaatccccatgtattgagggagggatctggtaggtggtgactggtttatgggggcagtttcccccatgctgttctcccgatagtgagttctcacgagatctgatggtttaaaagtggcacttccatttttgctctttctgcctcctgctgcatgtaagatacaccatgcttctccttcaccttctgccatgattgtaagtttcctgaggtgtccctagccattcagaactgtgagtcagttaaacctcctttctttgtaaattacacactctcaggtagtatctttatagcagtgtgataacaaactaatacaggaaattggtactgggatagtggagtactgttaagatgataacctgaaaatatagaagcaactttggaactgggtaatggtcagaggttggaacagtttggagggctcagaagaaaacaggaagatgtgggaaagtttggaccttcctagagactttgtgaatgctttcaaccaaaatgctgatagtgatacggacaatgaagtccaggctgaggtggtctcagatggaggtgaggaacttattgggaactggagcaaaagtcactcttgctatgctttagcaaagagactggtggcattttgcccctgccctagatctgtggaacttggaacttgagaaagatgatttagggtatctggcaggagaaatttctaagcagcaaagtattcaagatgtgacctgtctttttctgaaagcatacagtcataggcatatatgaagacattatgtgaaactggaacttatgtttaaaagggaagcagagaataaaactttaaagaatctgcagcctgaccatgtggtagaaaagaaaatcccattttctgggggaaaattcaagctgggtgcagaaatttgcataagtaacgaggaaccaactattaatagccaagacaatgggaaaaatgcctccagggcattttagggatcttcatggcagccgctcaaatcacaggcctggaggcctaggagggaaaaatggttttctgagctgggaccagggccccactgctctgtgcagccttaggacatggcatcctatgtccctgccactctagctccagccatggctaaaatgtacagttcaggccattgcttcagaggtgcaagccccatgccttggtggcttacatgtggtgttgggcctgcaggtacatagaagacaagagttgagctttgggaacctccaccttggtttcagaggatgtgtgaaaatgccagcatgtccaggcagatatctgctgcaggggtggagccctcatggaaaacatctactagcataatgcagagggaaaaagtggaattggagtccccacttgggactgcctagtggagctgtgaaaagagtcccactgtctcctccagatcctagaatgatagatccacagacagcttgcatcatgtgcttggaaaaaccacaagcactcaatgccagcctgagaaggcagctgcaggggcagtaccctgcagagccacagggacatagctgcccaaggccttggaagcttaccctttgcattaatgtgccctggatgtgagacatggagtcaaatgagattatttcgaagctttaagatttaataactgccctgctgtgttgtggacttgcatggggcctgtggtgcctttatttgggccaatttctcacatacagaatgggtgtatatacctaatgtctgtaccctcattgtatcttggaagtaacaacttgtttttgattttataggcttatgggttaaagggaattgacttgtctcagatgaaactttgaacttggacttttgagttaatgctgaaatgatttaagactttagggaactattgagaaggcatgattggttctgaaatgtcaaaaggacaagagatttggaagaggccatggttggaattatatggtttgtctctgtgtcccgactaaaatctcatgttgaattgtaatctccatgaatctagggagtgacctggtgggaggtgactggatcatggggcagttttccccctgctgtttttgtgagagtgagggcattctcatgaggtctgatggtttaatagtgataattcccccttcactctctctctcctgctgccatgtaagatgttccttcctccccctttcccttttgctgtgattgtaagtttcctgaggccttcccagccatttggaactgtgagtcatttaaaattattttattataaattacccagtcttagttattctttatagaagtgtgaaaatgcacactactgtaacactttcactttaaattggatcaatcagttcagcaactatttattcccaaacttgttgcttctttgttttagaacaccatttgaattgcaataaaaagagttgcttaagttctttgtagatttgcggggggaggtgggaggggagagggacagcattaggagatatacctaatgtaaatgacgagttaacaggtgcagcacaccaacatggcacatgtatacatatgtaacaaacccgcacgttgtgcacatgtaccctagaacttaaagtaaaataataaaaaataaaaaataaaaataaaaataagttgaaacataaaaaaaaagatttgcaacaaaacagaaaggctcaatttaattattccaattttattcatatattaaataaaatagttatggtgaagaatttacaatattttgctttattgaaatgttattattttgactagtaaaagtgccacactatggtgctattaatgtaagcagaattactagagatttagtagtagcagaacataaaatttatcatgtattttctcacaggtcttacaagagaagaaactggtactgaggtttacactaattttatatgaagtctaaaagtggattctctccctaagattgtaccttggttaatccttttttccttcaatacatcctaagttaagtgtcatgatgtcttactattttttccacagaattaagagcattttagcttgctaaaacatatattatttatttttcttttttcatttgtaattttgaaaatgcatgtggttgattggtttatccactctgtagggagtaagagttacatattatattgtacagcaaacctacacttccctggaatggggaggcattgagacagaattattgcacagttaaaaaagaatttaagccttattaactgtctacattttaagcagaaagatagtttaaagtaatatatttttgctctcaaactatatctaaacattgaatatttttatgcatgcaataaatatctccctaaaaaacatggactagtcatttgatacttgctgggaggttttatttttacaccttggggagtaaagattagaaagtaaccttcataaaatttgagctagaaacatggcgcacacgtacaattaattctttaaaaaaatacctaaagagcaaacaaaataaatggtttcaaaatcgaatgttcagtcagctgtttctacatttaagaaaaagcatttctgctgcccttttctttgctgtttctttgctacttcccacttcatttcttatgtaacccttcatactgtccttctctgtcacattctcatcatatccccaactcttggttttattgtctctgcctaaaaaaaagtcctcttttagagaaacaaagcaaaaaaaaaaaaaaaaaaaaaacaagactctaaaatctgaccttcaccctgctaataaaatgtatatatatatattatatatatatacttattttccaaatttattaaaattttaacacagccagtacaagttttttttgtgagaacacaatagaggaagagtatactgaaactggattttacagttcagaagtagttttctaatatgacccaaatcacttcacttacgagttttctttgctatgcaacagagataatactacttttaactgatttgtgaggataaaatgagaaaatgcatccacaatttacttaacataatgcaataaatttgtgatgtagatcttactgtgagttctcagactctactatcccaatagagttttttgtttgtttgtttttgcttgtctgtctaaagtttatctacaacatacaatggtaaaaataagggcaaaatgttaacttcaccattgtttatatttctaatatttattaaacataaaagagatgcattcaatttgaaagcttatttaagtagtgcatttataattgctttggggggcccgtgggattttgaggagctgcctcaaagaaagtggggagatgtgaggcaaggcttccagctctagcttcagttaaaaaaaatcttactttgtctgtttttttgaataatatgtcattagaggaaatgattcatggccttaaaaaacaacatagaaatcttcttgtctatttgggaggccgaggcaggcggatcacgaggtcaggagattgagaccatcctggctaacacagtgaaaccccatctctactaaatatacaaaaaaattgagcttccagtgagccaagatcacgccactgcactccagcctgggcaacagagcgagactccgtctcaaaaaaaaaaaaaaaaaaaaaaaaaaaaaaaaagaaatcatcttgtctaatggaaaaaaaggaagaaaaacaacaaaataaaacagactatagctagtggctttgtcttgtcttcttctctatctttggtttaactggtggacggctagaagtttaaaggcttatcaactccagcaatacttggtgtgtgttcttgaggtatagcaacaatattggtattaatttatgagttgcataaaattcatgtttgacacttgttatctcatctccagtgatttatttagaatgctttggagaccacaaacataacagaaatttagtaaatgaggcatattatacctatgaatatattttaaaccttatctaaaaataccatcaaaaattagcttctagcaataaagcataaatattacaaataattcaattttgagacatttttaaataatagtatcattactaatctggttctggaagttactgaataatacaataactatcagctgaaaaaatcattaattttattccttttaagaaaattacattgcaaataggtatttacataccggatcatctggattatactgaataacatactctatctgtccatttggtccatcatctatatctgtagctccattgtctcctgaaaatcctgtgaatattgtggtaccaactggagtgagctgaaaggaaaaaagattttaaatatcaattttcattttatcaactgcacaccagaaatgttacagcataaaaatcagctctttattacctaaaggaagataccagttggcagcccacaaccacaaactgaagtgtttcaaaagaacagttttgagccttacacaggagttcttaaaatgtctgaaatgtccaactttgtgattcttgctatgggcgaagaagcagaagacgctgattccgtgttaaacacatttggaccaatttatagccattagtatgttagctcctgtggagaaactgcatctgttgtttctcctcaaaacccttgatgcaatgttacccacaggctagaatttaaactgtaagaaaaagttagtttaaaataaacgatttacgagtgagcaatgaaatccaggctgatgattatatgcaagtggcaagtttgagaaagagaaattggagacaatgaatagtctgtatattagaggaaaatactgggagtttcttgagtccttctgatattggttgagtagaacatgatcaggtcacagcagctggagagatagcaacatcttttcattttggattaaaacatcagaacttaatatgtgtggcatacaaaaccatgatttgatgtgtgacctaaattgctagtcttaattcttacttatgcccacaagagaatcaccgttatttttttttacctgtaggtttttgcgcaatgtgctcttataaccagagtaatttttttaaattttcccctcccagtttttaggttttagctgaaatactactcattagttaaatttcaacttaattagatatcagcttctcccataccacccctcaaatagcattacacacgccacatcagaagatgattccccttttcttgtgcttgcattttgcactttgttcctataatcattgcattgttagaggaactaaatgcacttcatcaataaacataagctctgtgcctctacagactggacgcttttaatgtttgctcagggatttgttctcttaatttttgactaggattccttgatggtaaaaatagcttaagaggcaacaaaaaagttgccttattcagttttactttcagaaactgaaaattcacattttacaaggatccctcaggtaatgtaaatgagtgaagcaagcatgatgagacggtggaaaatagatagaacatgccctctctgatgctactcagagagggtagctgctactagtagctgctactcaatcccagcaaattcttgccatcttggaatatggagcccatgctaccaagtcttctaatattttaattgtatataaaatatcttgatgctaagattgacaacagatttttattatttatttatttatttttgagatggagtctcactctgtcacccaggctggagtgcagtggcacggtctcggcttactgcaagctctgcctcccgggttcacgccattctcctgcctcagcctcccaagtagctgggaccacaggcgcccaccaccacgcccggctaattttttgtatttttagtagagatggggtttcaccgcgttagcaaggatggtctcgatctcctgacctcatgatctgcccacctcagcctcccaaagtgctgggattacaggcttgagccaccgcgcccggctgacaacagatttttaaacattaaaatataaataggtaaaataaaatatgcccattgcctcaacaactacactagtttgcaatctctgatttaggaaaagaatataattatgacttaaaaataaaccataagtacaaggaagttcaggatttataaggcccagtttcctagcaggcagcattgaaggcaaactttggagagctgagaatgaagtgagacgagatcgtttaagtagtacctatgaggacatcgagggaccactggggatagatttagtagaaatgttagtcagctaaattgcttccaagctgacgttcaatatttttcttttttaatggaattcctgttgcaaaagacatccttatcttttataaatattcacccattcttatgtagctgtactttgatatttttattaccaacttatttttaaatcaacatatagaattttgtatatttgttgtgtacaacatgttgttttaaaatatgtataccttgtgtgatggctaaaccaagctaattaacatatctattatatacttttttgtggtgagagcacttaaaaaatctattttcaaaaatagatagttattaactatagttaccatgttgtacaatagatttattgaatttattagttcaagaaatttaaattttgtatcctttgaccaacatctctcaatccatatcccagcccctagtaaccactcttatactgtctgctgcaattacttcaactactttagattccacatacaagtgggatcatgtagtatctgaatatctgtgcttggcttgtttcacttaacataatgtcttccaggtttatccataattttcaaactgtgaaattttatgattggatgacattgatttgtttccatatatctaataaacttaaaaattttgttgccaaaaaatactatgtcatggaggtagatataaaagcaaaacaaaaaatcaaaataaaacaaacaaattttaaaaaattaaacagtatcgtctgtggaaattttgaggaaataaagggggtgcccatgcctttcaatctgcttactggggtaatgtatactattggaccagatttattttgaagagcaggatcccaaagccctacaacttagggagataaaattggtcttgcggggaagatataggacatccagggagaacttcacgtttgccactcttaatcaagattaaatttctggaataaatatttatatgacagaaatttgttggaatagatggtttgaaagattttagtccttacaatgtaatatttgtaaagttgaaggcatatttctaaattcaatatgcaaactattgaaaagatcaatgtttttctctagctctacaatgtttttttgaaatgatgaaaaggccacataaaagtagcatgatgtcttaatatattaccatcaagtaatatttttcttcatcactgacatggctttttccatgcagaaatcacatttgtaagtataatgtttaatatgtagtcctttaaaataaactctacattgttataatgtttaatatgtagtcctttaaaataaactctacattgtatttctttgattgactttcaaaaaatatacttgctgatgaagcctaccaaagattgataatagaccacaggaaaaaaattgaatatgcatttgcttatggtttcaattttaagcttaatccaaagagtaattcaatttcaaatgttctcatttcagaatatgagctcattttgtgtgccacaggtaaatttccctaatcatatttgtgtggccatatatacttttattatttctgaaaaattgcaagtagaaatatgattctataataaatttcattaatttatatctttgaatagaaaataaaagagaaacaattgtattagccgtaggaatagagaaaaccttttttctataatgatattatataaaggttatgaatcatccctaaatataattttaaggtcttttttagacaaaattttagattccttgaaaattaaatgaaaagcattagtgtaatagcaatagatttcagcatgttctttcattcatggctgtctttcttgacaatttcagtaaaaatttctccctaatttcacaaatatggtatttactggctgacaggggaggatgggcaggctcaggaattgtcccaaggtgaggtttgctctcctccatagttccacatttaaggcaaatgtcttagcacagatcactcctgtgtatttctactactagattgtgcaagcatgtacaaatagccattcatatgtaaaatgcaacacaaaatggatcagtcatacatttttctcatgatctgctcaaatttcatgatttgttcaaatggtagacctgttcacatatgagatagggttgaggctaatatgagagaaatagccgagaaaaaagaagataagttatatgggcaaacatgggaggtctgaaaagtctaaaaaggctctaatgaagaggcctatgccagatgcaaaaaagcagaagaaagtagaagcagaaaaaatgttttttaaaaaatagtagatcctggccagatgccatggctcacacctgtaatcccagcactttgggaggctgaggcaggaggattgctgcttcaagtctgagagtttaagagtttgagagtagagatagatagatagataataggcctggacacggtggctaacgcctgtaatcccaacaatttgggaggctgaactagatggattacttgaggtcaggagttggagtccagcctggccagcatggtgaaatcctgtctctactaaaaatacaaaaattaaccaggcatggtggtgcacacctgtagtcccagctactcaggaggctgaggcaggagaatcccttgaacccaggagactgaggttgcagtgagctgagatcgtggcactgcactccagcctggggcgagaacaagactctgtctcaatttaaaaaaaaaaaaagatagatagatagtaggtggttatatgtatattatattcagatcttttttgtgctattataaaactgtgaacaaagagacctaccttatgtttcatagataactctttaatgctatatctcaaaatcacaactaccttattatcattacaaaaaccaaacaaaagacatggcagaaagcccacacctaaatgggcaggtagcattgaaatgtatgcaaaaacagagtgttagtagtgaactgaaataaatttaaaaggtccctcttgacagcctatttgcatccaaaagctctttaaagacagaccataatttttttctttttaaaaaaatatttcatagcatcaattgtagaaactggttcatcagtagaaactcaattaattattcttatttatatatattatttatgcagatgagactgaaacttttcacaatttcttcatattttaatatactaaatcctctacaaggcctctatactggaatactgtatccacatcctcatcctctacctgcctgttcctggttcctcggacaacctcacttttagaggtgatttccacccattcattatgctgttcaattgcaacaggatggccagagcttctggcagctcactgtcaaaaaaccctgcccacctttttttgcttccatgaagaaaaatatgtagatttcactgtgaagtctagttcttcccatgctcttgccagttttcctacaagaaaattttctacagactgtccatgaataaactataaccataataggacccaatacagcaagcacatgcaagtagaataaccttatattcacgaaaccgatggtatgctgttcacttggaataaaatattgagaaggatatgtggtagaaagtcctccacaaatcataatattgtgttgtacatatatatttggtgattagaaaattccactggcatcaatatcattgtgttggtagataacaatgattttctgtttcatattttctggagtctcatgtgtcatatcaacacagaaacaaaaagtttagtaaaaaataaaatactaaaaaatgatttctgaatacctaaaatagtttacacatgtattccacaccaatgccttctgatagattctaatggctttaatgattaaacagaaaccatatgagagtcctaagaagagaaaacatatatttttatgtaatagacacaacttaaataatacctcttcaactggaagacaattggtacaaaaggatattattcaatttggaaacttgcccccaaaaagagccaccctagaggaaaaatttaaaatacgattgatgagattttactttttcccatgcttcctcaagaatccaagttttttgttttctcctacccaggaaaaatggagaatatctgaaggatactgaattttagataagctgaaacagaattaatcactacagttacttatcatataatgatgatttgatgaaagaaatgctaccggggtggcaggtgctctatttctactaatagacattaacaaaaaagaagcattacctttagtgatgcaagattacatatcagcctatgttaaaacactacacatttattttccaattgttaatatcattgatctgatttatagtattaggcagccacttcatgtcaattaatctcctagaaaacccaatcaagataaggcaacattctgtacaaattatcattactagtgaaactgaaggaatcttccacgtttaatcaacaatgagaactatgattcatcctttaactttctccccagataaaataatgttatagattcattcttgcaattaatccctgccttggaaatatgctttagaaatggtaaatttagaaattttaaaccaaagattctccacacatgaaatccagagttgattttgtaaacaggcagtcatcagtggaatattattgaaaaattcaacattttctgacaattatgaaattacaatgtctctgaatctacgattatttattgagaaaatatcgtttgccaaatcattgtttctgtgaccattatattggtcttactttaactagtaaatataacatttgttttattcaaccatttttccaaatcaaacatccgtttgaagtccatcttaaaactttccagaactgataaaaaaaatacatattcttgaattcaaatacagtgcaagttatcttgtaatgatttattaacattaaagaaaacataagaaaagaggtatagccctttttgtctagttaacattaacttatgaaggtacaatttatattaaacaaaatgcagagatcttaaatattcagtatgttgagttttgacaatttcatgaacccatgtaatgaacacctacacaaaaaatataatatttttatcacactgtaaaatttcctaatatccctgtacagactatcttgtcagatgcagctgcttttgacttcaatcaaaattgcttagttttgcctgttcttggacttcaatagagtgtgtaccctttcctatctggcttcttttgctcaacttaatgttttttttgtttgtccttggtccatctattttattctgtttcattaatgtttttcagattccctttaacataatatggttttcatacctgtgttaaaaatcttgatttcattaaaaatcttgattccattttttatcacaaagactagatgattaatattaagggttactttctctgaataaataatagacaaattcatgtagataagtgtatttaaaataaaaaaagaattattactgttacagagaatgataaataactctatctttactaaaaactgaggagcaattaagcttaagttgaatatacatatgagcttatttatttatttatctatttatttatttttgagatgacgagtttcgctcttgttggccaggctggagtgcaatggcacaatctcggctcaccgcaacctccacctcctgggttcaagcaattctcctgcctcagcctcccaagtagctgggattacaggcatgcgccaccacgcctggctaattttgtgtttttagtagagacgtggtttctccatgttggacaggctagtctcaaactcccgacctcaggtgatccgcctgcctcggccttccaaagtgctgggattacaagcaaaagccactgtgcccggcccatatgagcttagaagttgttgaatatttgaatacttgaatgttgtaaaacagctaaaaaattgattcccacgtacatgcttaaagtaaaaagaaatgtattaatatgtgcttctttcacttcctttaatctccttatctctttctcttttttaactgtttcctgattctcagagagaatgtgcccatcctatggaagagaaaaatggggacaagtaagaggaactagagattagtcttacttctttctttaactttagattaagtgccagtactgcatattcaaagaaattccataaatggggatgctcctgaaggcccagtgatttttattccttgaaaagttgaagatatcgagttttgaactccatgatccatgtttctaaaccataatttatttcatattaaaaaatcacttaattatacctagaaattgtaaacaaaacacacaaaatatgtaaaaaaggatattcaactctataaggaatgtcagtgttatgcttctcatgaatactgtctgtgcttttagatttaccagaataattctgataaaaacagatgttcaaaatatatgtattaaatggaaggagatgatataaccacaatgaaatgtaaaagaatagcataaaactatgagaaatggatttggaaagcaaaaactcaaattagatagattcagaggtaatgttaatttcaccacaaagctgaagtctcaataatgttccactaattactgcctgtttataagtgtatctctacactttcatgtgtggagaaactcttggttttcaaatctgtcactatttccaaagcgtatttccaaaacaggaggattgcaaaaaaaaaaaaaaaaaaaaaaaaaatggctaaaacctgcactaagtattttaaaagtatcacctcctttaatcctcaatacaagtttatatcattatttattttgttatcatacttattttatggttacaaaattataggcttagaaagcttctgcctgatgttattattctaatacttggtgaataatctgaaatgatataatttagattatgtatctcattaaagataatttattttgggcccctaagaaaaatgttttgggttattttacagaaggagaaataaattcaacttaattataaaatatctcaaataatatatggcacagtgtcttgtttaaaagtattcattcttaaacactgtgcaatatgttatttgagaaatgttagaattcactattaatgaacttctgaaaaaatgagaaataaacaggaaaacaaaatgtggcacataacagaacccaagattcacagacaatctgaaaccatataatttagattatgtattaaagataaattattttgggccctaagaaaaatattttgggttattttacaaaaggagacataaaatcaaattagccagtacctgcattttaggaaactcttcttcaaataattattactgtcagaaaaaaattggttctcagcaagcaaattatttaataaatttccaaattcaccatgatttcagtgtgcaaacctttacattagtaatcaaatctctattgctagaacatgcctaaaccattgaaaagcattcaataagcgctcaaggagcaaagagaagaagaaatatagccaaccacagtaatttacactttcctcaattatatttcaaaaaataatatttcaacaatcactaataaaaatggtgggtaaaagttcaatgagaaacaggatagttacagtcttaacctagttccccacaatatagctttaatacttattaagtattaagtacaaaattactggtaaatacagaagggaaagctggaagacactgttttgtcaaagtgataaaagccatcactaccaataatgaaacagatacattgtgtgtcttttgtgttacatgctatgataaaaacagtatcatttttgaaacattcatgcacaaagtctacgaatcatgagaaaatatcaggtgaattaaaatttagagacattttatacactcctctggtcctgaaaaatattaaggtcatgaaagtcaaggaagtattgtggaaatgctaaaattgagactaaaaaaattgaaaactaaacttggttttaggaaatacacaataaagtagtaagggctgaagaagtttcatattttcaacttaattttcattagtataaaatagttatgtatttatatatgacatatagtatacattatatataattacatggtatatatacacttaatgtatgacatacttatatatacatataatatatgctgtatatttatcatacacacaaaaatctacctctatgtgactatttatcaattagtaagaggaaagaaatattgtctgaccagtgagtctcaatactgtcaaggtcatcaaaaacaaaaaaaaagcaaaaactatcacagtttagaggagactgaagaaacatggtaaataaaagtaattgttattctgtatggggacctggaatcaaacaggacattaggtaaaaagcttatccaccatgatcaagtgggattcatccccgggatgcaaggctggttcaatatacacaaatcaataaatgtaatcccccatataaacagaaccaaagacaaacaccacatgattatctcaatagatgcagaaaaggcctttgacaaaattcaacaacccttcatgctaaaaaatctcaataaattaggtattgatgggacttatctcaaaataataagagctatcaatgacaaacccacagccaatatcatactgaatgggcaaaaactggaagcattccctttgaaaatgggcacaagacagggatgccctctctcaccactcctattcaacatagtgttggaagttctggccagggcagttaggcaggagaaggaaataaagggtattcaattaggaaaagaggaagtcaaattgtccctgtttgcagatgatgacatgactgtatatctgaaaaccccactgtctcagcccaaaatctccttaagctgataagcaaattcagcaaagtctcaggatacaaaatcaatgtacaaaaatcacaagcattcttatacaccaataacagacaaatagagagccaaatcatgagtgatctcccattcacaactgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctatgaatgactttcttcacagaattggaaaaaactactttaaagttcatatgacaccaaaaaagagcctgcatcgccaagtcaatcctaagccaaaaccacaaagctggaggcatcacgctacctgacttcaaagtatactacaaggctacagtaaccaaaacagcatggtactggtaccaaaacagagatatagatcaatggaacagaacagagccctcagaaataacaccacatatctacaactatctgatctttgacaaacctgacaaaaacaagaaatggggaaaggattccctatttaataaatggtgctgggaaaactggctagccatatggagaaagctgaaactggatcccttccttacaccttatacaaaaattaattcaagatggattaaagacttaaacattagaccttaaacgataaaaaaccctagaagaaaacctaggcattaccattcaggacataggcgtgggcaaggacttcatgtctaaaacaccaaaagcaatggcaacaaaagctaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggctatcagagaaatgcaactcaaaaccacaatgagataccatctcacacaagttagaatggcaatcattaaaagtcagggaacaacaaatgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactagaaatcatgctgctgtaaagacacatgcacatgtatgtttactgcagcactattcacaatagcaaagacttggaaccaacccaaatgtccaacagtgatagactggattaagaaaatgtggcacatatacaccatggaatactatgcagccataaaaaatgatgagttcatgtcctttgtagggacatggatgaaactggaaatcatcattctcagtaaactattgcaagaacaaaaaaccaaacaccgcatattctcattcataggtgggaattgaacaatgagaacacatggacacaggaaggggaacatcacactctggggactgttgtggggtggggggagggggagggatagcattaggagatatacctaatgctaaatgacgagttaatgggtgcagcacaccagcatggcacatgtgtacatatgtaactaacctgcacattgtgcacatgtaccctaaaacttaaagtataataaaaacaaaaaacaaaacacagggaattaaaaatgaataaatttggttctctatatatgtacatagtgctctaactttttaaagcttaaataaacctttaaaaaactaaaaaaaaacaaaaactaaaaccatctgaataagctatgaatttgaattaataatgtaccaatgttggtttattagttgttacaaaaaatgtactatattaatttaagaagttaacaatcagggaactgtatatgggacatatgagaactgtacacttctattaaaatatcacttaggtctaaattgttctcatattatttaaataaataatgtaaaatatagttgtaaatagaccatttccattaccattttcattataacaaagctcaagacttgaatatatcatttaatataagaaaaataatgtttaaatgtaatatagctttacttctattacatttaatttttataaatataatgcacattgaaccaattatttgtcaacaaatttaataagatatacttatagaatgaaacagagtaaacagagaggaagagatagattttcatgtttttctgtgctttcatttggctgaagtttggttttttgtgtgtctgctaattgataaaatcattaaaaatgtttttagtcattcctttaaaatttcaaagaaaagctaaaatatttaaaaactcattgtttaaaattaagagctaattgatgcagtaggtattgatgaaagatatgattatgtcatgttaggagaaacaagcataataatatttaaaataaattaatatgcaattactaattaaatcagcatgtaataccaggtaagaagaaatactgaaactggtctaatcatcccacagaactgatgtttatgttttcgtctgaataaacctagaaactgatgctcccagttctgaaacttgcaaaagttacatttgccctgtctgagttcctttcccaggaaaccaaccattagacctcccaggtagtatcaaggaactggagtttgccagatcgccacatcaggaaaatgagatgccagaccgcttacctgtcttgattgtctaaccaaccacctgcttcctattgaccttcatttcccctccctaattcccattttcccacatatgattacttttcttccctgctatataaaccggcaattttagtcagccaaagaaatgaatttgaggctaatctcccatctttttggctgaagcacctgattaaatccttcttttctggcaatgtttgttgcctcagtgattggctttctgtgtggtgagcggcaggacctagaccaaagccctggcattttggtaaaaattacctctatggtgagctaactattatgcatgtagttgggcagggtgttcatcttcatgggtcccatttcattaccttttagagttttttcataaatttgtgggattctatagaaaagttattaaaggttatatattcagtcaattataactttttataaccatataatcacatctgctttttcagccattgaattttgatcctacatcatcatcatcatcctatcattctattcttcatcctatagctattattttgtaagtaaggtcttttacagtgtcccctcatgatcaattaaagggcattttctggttgctactcttacaaagtttgaatagaataaaaatcagaacttgtgttgatttgaattgacaaatttatcatagggaaagtgcccatctgtgaatagaatgaagtttaaaagtatgtttattagtcttgctgttatatgggatttagcattcttcattttgtttggttataccactatgttaaccatttatttttcttatttcaaaaatataactagaaatataattagaattgacatgacatacagttattccataaaagaaggtggtaaaaacaaaaatacagttgtcccttgccatagccagattattagttctaggattcatgtatataccaaaatctgcacatactcaggtccctaattgaccctgtaaaacccacagaggtttcacatccatgaatattgtatttccatctatgcttagttgaaaaactgcatgtacaagtggaccctcacagttaaaattcgtgttgtccaagggtcaactgtaaagtttaataaaatatttcctcaaaaagaaatgcttcatggtgaaaataggtgtattttacttttagaataatattttaggaatcatgattggatgaaagcagaaactgctggatataattagaaagctcattgtcatcatcgttcctaccattcaatgagtgttatctattcattgcatgcacccagcaccataggtctcatgttacattctctgtatcctttaacctttaataactaccctaaaagtattatagttttttttaattgagaaaactaagtccattagaaattaattaattttccattattatacaggtaggaagtggtcatcctaaaactgaaacctatgctgtgtgactcaatagattattcccttttctcataacactgaaccttgaacatgattattttactaaactgaatcaagtgcaacttttctgaaattagtattaatatttattcatattaatggtcttacactctacactttcagattttaagactcgggaaataaatatgaattttcaaaatcgcatggaattttctctatgtactcaagccctatcagtctcttgcctaatgtatgtatacaatatggtgagcaagtgctcagttttggagtgagaatgttttggttactgacttagattggctacttatcagcagtgagatcttgagcaaattcattaatgcttccctatttctacactttctcatctgtaaaatgaaaacaatgaacacacaaagtttgagtctgtgggcagctatctataagtactaagtaagttatttcatggaaaacacttagaatttgcttggcacacaatgcaattaataaatggtaactcaatggtaattattataattcacttattattgtaaaatacctttatttcattcaaagtcaggaggtatgatatcagaaatgtggtaaacatatctatgcagtattcttattatgaacaaatttggataagaacaaatttaaaattggtctagtatgaaattagttcctaatgagtatgcctaatgacaaaaggagtaagaaaaataaacattaaaattattataaatctaaagtttgaagacatttaacctggtaagcaggacataattttctatatacttgttatgtcaatatttaccaaaaaacttgattctttcagaaactcaaggttatttaaactgctaatactcaccttcctaaattgtgaatggcattttaaatgtaaatttatgaagcatcctttaaaatttcatgttattaatactgaaagaaacagaacttgattaaacacaaattcattaagctgactgtgaagcacttgggaccctttgcgttgatccttatagagccgtgcgtctagaaaaacctttcaacgaaaagaaaaggtacatttggtcaaaggggaatcatattaatgttgcttaatcaatgagtttagtatttccgggacatgaaaagtagggtaaaaaaatctcaagtggcatgacagtcatataatgaataaatacataatttctctctaatgttttataaatagaccgtaattcatatagttcatatttatcaagttttaaaaagtgttttttgttgttcttgtcattattcttgttttaatctatgtaatttattataataatctggaaaggttatactcgtttctttaaaaaatttactctatatgagcttcttcataaatttaactcaaagcaaactcttgctttctatctcaggaacatcagcgtagaaatatatatgttataggatatttttctgtatgataactgtgccattcctaatttaatgataaacctacttatagtacttctgtaatgtgccaggcactgttctactcaatgaaaaacaaagtgccagctttaatgcagattcaattttaaaggggtagatatcataacaaaaagcaaatacatatgcagtattgttgcagataagtggtataaagataaccagcttcagatagtctgttacaagagtcataaaatatgcaggtcatttatcatacatggaaaagttgtggggcttttttctttctattttaaaatttattatgtgtcttcattgaaccttgtgaggcaaaaattctaatactaccattttcgttttcaggtgagaaatctgaagtacagaacaaattaaatgaaatgtttttaagaaagacaaatgaaactaacaaatggtaatccagcaccagcatcactgtatatttgtattgtcagcagatttagctactatggaaaatctttgaagaatctttctcaacatgatttttgatatacacatgctctaatttattgtgggtatattcaacagagtagaattgctgagtcatagggtgtctgcctgttcagtttttgttgacactacaaaataactaatgtaattgtgccaatttacttatctaccaacaatgtatgaaagttgtgattatccatatctctaccaaaacatgagagtatattttctttcaattcaaagtgtaattgaacttaaaataaataaatataattaaaactccattttggtaggtattataatccatggatggattacttttaaaaatttcattttttatttgttgctgatgtataaaatttatttcttttaaaaaatattggacggtcacagtggctcatgcctgtaatctcagcactttgggaggctgaggcaggcggatcacctgaggtcaggagttcgagaccagcctgaccaacatggagaaaacccatctctactaaaaatacaaaattagctgggtgtggtggcgcatgcctgtaattccagctactcgggaggctgaggcaggagaatcgcttgaaccctggaggcagaggttgtgctgagccaagatcgtgccattgcactccagcctgggcaaaaaagagcaaaactctgaaaaaaaaaaaaaaaattgaccttgtctgcagtaaacttgctgaactcactttttaactgtaattttttttttctgtaaatactgttgggtagttctatatataataatgccatttgtaagtatttaatttaatgccattttccaactataaggagcatttctagtttgtatttattgattttaagctcaattgtttgatgattagaaaacacattctgtataattttagccatgtgggggacatgttgatacatccgtgaaaacccagcatttggtaaattattttatatgttccatccatgtgcctgaaaagaataaacttcatagttgttggatacatcattttaaaatacatcaggtcaatttcgctgatttcaatgttcaaatcttatgtttccttgcttttttttctttacttattttgacagttactgagataacttttgcattagttttctattgctgtcataaaaattatcataaattttgtggcttaaattaatataatttactctcacacagtttggtcagtcagaagtcagagatagctctcaccaagctaaaatcaaaatgtctgtagcactgcatttctgtagactctgaaaatgaattcacttccaagctcattcagattattggctgtatttatttatttttatgttggtagctgtcgactggggttccttcaagagtattcttgcattttcaggctatattatagctccactggtgttcaaaaccagcaatagtggctaagtccttctaagtcttagattgtctttgatctccccttatgcctcatcttatccagttcctcttcccttgcctctctctgactctagccagagaaaattctttccttttaagggctcacactgagattgggcctaccagagtaatccaggataatctccctattaacttccataaccttaatcgcatctgcaaagctatttttgccaggtaagtgtacagatatctttgggaggctttaattcaaattatatgacctcccaaacatcaattttctaatttctaaaacagggatattccttccttgtaaagctactgtgaggactaaataagataatgtgcataaaaagagcttaccacagtgctcataatatagatatagctccataaacaatacattttaatttattttaatatactataggtaacccatgctttagaggtttttatagttccttcctgtctgcctcaggatggtaaaaataaataaatattgactgaaaaattttctctcaatgaaaagatcattaaaaaccagacatatataagctctatattaacttgagataaattcttcacatgaccaagaaaacattatgtctgccttgacttgctcttgtttacttacatcaaaataaattttggggggtgagatgaacctcaaaaacctgccatcactgtcgagaaagatttgtctccaaaacttgcataagaatgatcagcaactgtgtaattttttcttgaaaccaggcaaactatttacttaatgatacaattgtttaaagctaattgagtcttcacttaaagagagaaaactacttcaatgtcttatgtcttgctcatgagaaagacatttgaaaccttgttataacccgtgttcaacatgtagatagaggaattaataatgttttggtgaattcttgacaaactaatagaagaacatgtttacgaagagcgtaagagggtagcatttaatgcatttataaaagtgctgattgtgattatgatataataccataaatgtaaatcatatttatttgtaaaataaggtacatgaaagtagttataatttagaatactagaatgtttattgataagtagtgaggggatgattgacctaaggacttgagttttattcccaacttcgtggtcaattttgtaaccatcaatttatactactgctccagttctcagttttctcatggtgaataaaaagagtgactaatcaggactttaattttggaagcttcttttataaatctgtgataatgactttattatacctgtcttttgtattttaatgaagtgtgaaatattttgacattaacaatctattaaactgtgaacgatttttttggaaaaacatttagatctttcttaattgcataaacttcatgtcttatactaaaaggacaaatagtatgaaaaataccttgcaatcttgcacagaataaaactcatttcatttaattttattacaaacacagcattgtagatgggcaagatagggatatctatttatacacatacacatatatagtatgtatgtatctaattttaatgtatcttcctaatacataattcataatagataaaattcatgtcaactaaaccaatagataattcataatttataattcattggactaaactaagtactagtactatggaagaactattcaaatgaaaaatgagaataatagctaaatttctattttttttttgatgctatttcaagctttaaatgcactgttttttttttcaagaaagtaaatataaagagtatgggcaaaatcaaaggtgaaaaatatgaccatcaagtacacacatttgatattatcaaaccatagaagatatgaccatagtgtcaatgggataggatgacctcagttatctaaaaggaaatgcattgtgagaaacttaccagttcaacaatgtattgacagctttgcacagtaatatagcttctcaaaataatgtttaagatcaaatctttacctttcctataaattttatcactctgatgtttaggagtttagggtttgaagaaattgaagatcaatacatgtaaatattgattatttcataaaaataaatcaagtaaaagagatgaacaaaattttgagacttgcatggtagggaggatcttattctaggcaaaatgaacagtgtgagcaaaggctaagaaagggagatatttatgagatgtgagagagttaatctgaacaggataaggcattatcagggagaatttgagaatgttcagaatacattgacaaatggtcagattatggaaaagcttgaaggtctgccagaagaagtgaccttttgacacccgacaataatgagaaattgcaaaacttttgaaaagtagagttgcatgattaaaatgatatttgagaagttactgtttaacaagacactgaaaagattagagagggaagtggaaacagtcaaatcacataggatgctttgaacttcaaattgaacattataaatttctgaaagaaggatgaactatgaagagggatccaggggcagttagtgacatggatgaggctggaaaccgtcattctcagcaaactaacaagaacagaaaaccaaacaccacatgtcctcactcataagtgggagttgaacaatgagaacacctggacacagggaggaaaacatcacacaccggggcctgttgggggagtgagggggtaggagagggatagcattaggagaaatacctaatgtagatgatgggttgatgggtgcagcaaaccaccatggcacgtgtatacctatgtaacaaacctgcacattctgcacatgtatcccagaactaacatatatatatatgtgtatatatgtgtgtatatatatacatatatatatatagattctgtaagtagatttgttgcctaagataattcacctatcactttataccaaaaataaagttagcactcaaccgaacaaagcaaatgtaactcaaagggtgtatttcaaaataagatcatttatatataattaaaactagttacttggaaattaattagtatctgtcattacagtagaaactcattaaacaaaagtgactcaaagaggtgaagcatttatcgaccagtaattcgtcttgttaaatttaaataggagtttgtattttgtttttaagttatataatttagaaagtctcagattacaaggaacataatttcttcaaactttcatgaacacaagaatgttgaaataactaaaaaatatttttagtaacttcaaaaagaatctagaggttaaaggcccaaatgatctgtttaattcacaaattacagttattctcctgtaaagcaggcatgcaaatttttaagattaaaaaaaaatcttgaaatgaaaagatggtctggtaaaatatgtactatcacattaatgtcattcattttttcatgtgtctaacatacacataataggtcacattagaggtactctagaaatattttgtagcttaattaactaaaaataattaatacagtaaccacggtttaaaaaaaaataaaagtggttcttcacttatgcactttagccaaaagagaaaataaaacaaagcaaaacaacaaacaagcatgtccttaaaaagttacaatactactttttaaatataatttttctaatttgatcagcatttttctataagaattcggttgtgatttgtagttaatttttggatatttcagaacttgattttaaaatccagaaaataactttacatttatagaaccgcagacattttcttccagtatttaattagtatgaccacctcagaaatacaaaggcaatgtatttgtattagataaatgccttaggataataataataactcgtgttatgcctaagtaagcatgtagatggatctaggcaataaattttcaaagatgatgaaaaataaaatatctattattataaatacattatttttcccatagttaaatgaattcctaaaataacatcggaagtcacatacttcttctgagtactatttttttaatgttttcttgatatttctaaacagttaagctcataattttaaaggaatcatttataaacatttattgtatatagttagatacatatatcaacagaaaggacagagagagagtaaatagaaactgacctcattcactgtggcatagtagctttcatgcttgaaagtgggtgagttgtcattcctgtctctcaccactattcgcacttcatggtagataatagtgcccacttttttgttgatgcactggacctgcaccacaatggagtgtatgttcatcggtggctgcaatgtagaaattgcatcttttaaaatactaattaaaaacaaagcttctcatcactgtcaaagcactcgttcattcagtacatttttctattcttgtttatttttaaattataataatctcaaagaaaatgatcattttaaggacaagagaagacaatcataattaatttattgtttaattttgtatctcagcgtgtggaattcaggtagcattatgctcacagttagtggatggctaatgagcgcacccacaaaattaatgcttagaattgatgggattaaacgaagtttgcccctccaaagattaaagaagcaataatataaacttttaatttgaagaaagtgttaattaataaattcctggagaagagagattgtttaacttttatgtttatttatatttttgctggaatattatatgttcattgctgatcaaattaaaaatactgattaccaaaagagaaaatccaaaagccagccaactaaacttactcattctacacatttaaatgcttattttgctaatctttttcactctctaaatatgtacatattatagacacacagacacacagtgaatatcagcccatgtttataaatatagatttactatagcattttttgtataatactatgaagttatgttatgtgacagcaatattatacttcattgtaagcctatagcataatgtatccaagtaataatttaaaatgaactactccaggctattatattttgtcattataaaaaatacttcaatacatagtatacataagcatatgcttacttatctaataatttttataataaattccttgaacgggaaaggtcaaagatatacttcctcaagtgccatggctaacagtttgcagagctggaatgcacacctacaaatatttgactctagagtcagagtattgaccactacaaagtatttctttgtgatttttaaccccttttgagcttatgcaactttatctctaaatatgtcatttttgcagtgtcctatcctgacccctccatcttaaaaaccttgtctccaacctgacatctcctttcaaatttcttccaatttatttttctttattgcatttctcaccgaaaatttggctcgttgtatattttatgtacttgttttggtttgtctgccttcactagactggaagctcaatacaacctgtgtgttattttagtcatgatagtatccctctttccagtaaccagccctatgcctaagacagatgatctggagtcaaactgcatggcttccagttccataacctactaactgtatgatccaggaaaaagtacaaagtatctctatgcttcgtttattcatctataaaattaaggctaatagttacaccaatgagaattgtaaatactgcatgtgattagactatactaggcatatgttaaacacctaagggattacatacatatcctattttatttattaaaaaataaatatccaaaatagtgaaaaaataaaatctataatgcacgacacatttgtaaatgagaaaaatgctacagaaactatatctaagctgaaggaaatcattatttagtttcaagatatttttatggccaacaaagaaaaagaaagttgacttgaatttgtagctgtctgaatgatgctacctagaaagaataaattgaggcatcattgacatacgaaaagaggtctctagtgaaatcacacatagctctgtgtttttatatctactctatttctcctttaatcactgatataaatgaaggcattaaaatcatgtgtataaaatctgtgaatgttacaaaccttggaaggatgtataaatacatttaatgacaaaagacatggttcaaagtcatcttaataagtcataataatgggttacaaaatggtaaatttttgcaataataaattttatcctccaatttgtaatagaaaaaaaatcacccaaatgtaatagacagctacaaacattaatgtaaaaatgtaattgtgaaattttgatagctaaaagctgattttacatgacagcactgtaaatgggctactggaacactaatgcatactgtacattaattaataatatcagataataatatataggtagattataacaggtaccattttacaggtgcatagaagagaaatttgaacacttttgagaatgtataaaatgggaggattttaaatttaacaacatatgatttgtcaaatatctaaatggttgtcatggaaacatccattagttgacttactgtagtttcagagagcagaaataagaaaaatagttgaaaaatatttcaaagcatgttttcaccataagtagagggcttctcttaatccaaatttgcaccaaataattatgtgcctctatcaaagtatctcatgtaactcatatgcacctactatatacccataaaagtttttaaaaaataacaaatagagcagagattcttatcagtagaagagtatagtttatgttagaaataaatttatgccttcgcacttccaaatacttttcctctgccattatgagctaaaatatttgtgatgcttcaatttctttttttcacatttgtctttgtataaaataaagaaaaatcaggaggaaaaagtgacatggaatagaacagactattctataaaacaagacccatcactgaaatatgccagtttgaggataaaagaccattgaaaaagactagctcttagaagtttcctggaaagaatttgaattagatgacctccatttttactaccagctttcaagtgtgtaatagaccttttaaggcatgtccagcatattttaattgtaaattaaaaacaaaataaatatgtgtactgtttgtccttggcacacctcttggaagacaatgaggtgaattatgcacttttaaagttatttatcttccaattattgcaagagagacctataaaaacattctatctcaacttctaattctacttggagtggtaccactgggaccaaaaggtcaaaatcttatcaaatagaggatcaaatgcactgtgtactgaggcctcacttagtcctgctaagtacccataaattagatctaaccaggtcacctggaacagttatcactctcaactttagctccctatgcaactgttagtggcatggctagaacttagagggcaataaattataaccataatggatcacaccgaaggcaaaaattccctgtggctaatatataacacacaatgtaattttgtattggcatagattcaattctgctgtataagaaggtcatacataaaagtacagttctaataagtccattagtgagagtttagggactctaagatgcttaagaatgcattagggaaattttgctttatctttcataactggtggcaaaaataagccatggtaatttgaccttttctaattttctttaattgctttattcatcaaacaaagaagaaaaaaaagctaggtagaaattgtgttcatataactatttaaaactattaccattcatatatacctaaacatgcaagctattctttcaatttaaaaatgagtgcttaacacaatactctgaacgtatacttgcacatttgtgtattagtgtacctgtgtataggttatgatatgtgtatcaggaatgatatatatcaacaattaaaggatactatcattaaaaagtgggtttgagagtatgaagagaaaaaattttcccacaaaaatgtaaaaattttgtaactctgaaaaagaaaaaaatataaaatagaaatttttgttatgaatttctcaatcatttaggattcaacatgaaaattaaagtttttataggggatttgttgatattagcagtttagattatagcacaaatcttcaatccaatatattttttttctagaaaccaaatgatttggaagtcaatgatttggggggcagggaatgcatttttggcaaatctgtaggaatttatttttcataaagtataggcaaagtttgtctaattctcaggagtgaattttttttgtcatgatatttctgtctatggacttaccacctttataacataatcattcctatttcacaagtaatgtggaagacagtgaaaggaaataagacactgtgtgttttagaaacgacttttacataaaaaagcaaacttaaaggaaatggctggccagagttgtcagtgtccttcacaaattaaattttcacaatgaatagtagcatatttactgaagatattacctaaaaagaaaatatcaatttgtaaatacaattatgcatatgtgacatgtagatacatctatagatttttcacagtgaattattaaggacattcagtctatttaatggtaggtatttgttatatgaaaagtttaatgtgggttaggattaatatgacttagtccttggatactaatagcaacttttataaaactgatatgaggtgatcataaataaagtcagtcaaaaatactattaaataatatggattttagaacaaggaattgcataccagtgttattagaaaataatttatacagaagcagcatttaagatatctcttagtagcacataaaattcaactgatagcactggataacagtgatttcaaagtttatgttcaaaagaacatcagggaaggtatggtaagaaaaaattggatatggtcatgggacaataattacattagttttcttagtttgtagttcatacatttctaaataaaaagaaaattatatagacagggtgcatcttgaatctagcaaaactcaagagacagatagaaaacagtttgcaatgaaaaggtatctgtgggcacagtctctgtttcagcactctggttgtagaataggttgaatcaagacaggtggtagacaacaattagtttatatgagtgatgactaagaggtcttatactaaagttatgttgactgatggagatgcaagatacaaggtggagataaaactactaaacttagcagttgaatggacactggcctgggcaggggagtcaagccccttttgcagctaccaagttagagtctgaaagaaaagaagctaagatatttgatgttgttatgaacataatttctctcgtttcaaaagcttttaaaattttgcccaggattttgagataagtattataggactgtaccagagtcatacttttctttctgttattattttaattattgatattgtcatgaccattattatcacatgcccaatagtgatgagagcattttggccatgtgagacaatcatttagcatttcaaaatttttatgtgatgtgcctttattactgagactcttcatgttcaccccaaatatcacattctggttgtttctcttttgtgacttttaattttgtaactcttcctttctttttttaatttttgggtgctgaaaatttatgtaactttagtgaacaaaaaaataaaaataagacataaaaataaatgatgaccataagggaaaatcttataaaccaagttttaaaattataaaacagttcatagtcatacaatctcatgtaaatgctttctaattaaatacaaatatctgagcgttgggtatttttattctttatattcttcctcggaaattttcatgaagatcatgtttatcagcttatttttaacacactgttaaaaatgtttctgtctatattgtttgcttttaattctattacagccataattattcaaacgtccccattaagagacagtttattgcctcaatgagaaaatgtagaaaacatgatttgcatcactttctctggaaaataaatttttctctaactgttgctaaaaagatggtataattggatatggatctaccatgtggccctactccttgctccctggctatagattcaaaccagtgagtatttaattgttatttctctcagaaattttaaaacaaaacaaaacacagtgactttaagccttctttaatggccactgcatcaaaagtttatgaagaactggcatggcatgaacacagaaaacacttaaagtcaaatgaaaaacaaggaagtggagtaaaattataagtgtataaaggaatctgctctgcagagagaaaaatagagaatatgcacagagaaaggcagaaactagagaccatatggtccaagaccaagtagttttcctctctccctggtaaacatacaatttccataaaagtaaattattttttatatctatgctattggtattgttaatattctctcccatcagctggaaatcatttgaaggcattgttgtgtcttccttataagccaaataactttgattaaaatcagaatattcttagaaaagcataatttcataacaaaaattcagtggaaaattttctataaaaataatttcaagagcaatttaccactaagaagggttaaagttaattataggctagtgattataatacaaagctttcgccattgttagtaggatcaaactcaaattgttggttctattttgatattcagagcatatatatatatatttgaaatggaatatatatatataatatataaataaaaatatatttttgaaatggaatatatatatataatatataaataaaaatatatttttgaaacggaatatatatatatatataattttttttctttttgagacggagtcacactctgtcacacaggctggagtgcagtggtgtgatcttggttcactgcaacctccgcctcctgggatcaagtgattcttctgcctcagcctctacagtagctgggattacagggtacctgccacaatgcctggataagttttggactttagtacagacgggttttcaccgtgttggccaggctggtcttgaactcctgacctcaagtgattaactggccttggcctcccaaagtgctgggattacaggcatgagccatcacacccagcccatattttttattttgattcattatattcataaaagaacaaccaaaaaactttgggcaacaatcaaaagaattacattttaggtaaatgccctatattttaaaagaaactacaaatattttggtatttatcataataatatagttatttaataataatgtatattttatctatatttagcttttgggaaaaaacattttacattaaataaaatttaaaacagtgtaaataaaggtatatatatttacatatatgaatatcatagtattaatatatatttcattaatactggagagcatattttcaaatacaatctatataaaaagtgtgcactcactttttttaaaatgaattctctactatatctttgtagaaaatattaactaggatcatagagaagcatacagaagaaaaaatatcttattctatatcaatgtaaataatgttaaaacaataaagtaaaaacatacaacacctctccaagtaaactaagattatttcaaatatttacataatattattattttatttcagacattacaattatttagcaatattggtatggaagcatatagggacaatatatcgagaggaccatttagtaaaatggataaaactccctagtccagtaatataatgatggtaaatgaatttatctctataaaacaactaaacaattgtagaaagatgcatgtacaaaaattttcactgcagcatttttgtaattcttaaaaactgcaaacaaacttgacttccaaaataggagattcattttttaaaaatctcttatttattcatgcaataaccaatcatgcagctaataaaaataattatataaatatacatttgtttgcattataattttacatgtattataaattttatgtaaaaagtaggccgacagcaaaatgaacagcataatccaatttaaattaataagtattataaatatacatatcaacacacataaatgcttgaaataaaatgtggcagaataaacattaaatgttattttccctaactgataaaattatcttcatatatatgcttcttattttctgatatgtttaccataagcatatattattttacaattaaatgagactgtaatttccagtagtgattagatttggactaaaagcccagatttacctcactatttgtctagcagtaatggtctataggacacataaaacagatgggcactaggttaaggatattcagaataaaagcccttatgctttgatgaatgaacccctaaaagcactgtggcagcaggaaaacataattcacaagaattcaaagaattcataagtaataaagcacatagtaaactgtagtaaaataagaggcaaattgagatttattaaagactccaaattttagacatgaaatagtataaagtatcaaccactccataacctattgtaaagtggatcataaaccctgagcaatgatgtgaaatgattcaggttcactaagctgagtatctgacatttggatttcataagctgggaacttgtgggtaagcatgtttagagttactctctgagttttcccagggcccagtgcaattactgattataatccactaccctctgcccctctgtactcaagaaagactgagatgcaaataagtgagtacaaagttactttagagagctacttatacctattaatttttttttaatttttccagaaatgaaacatccaactacgttggtaatttagcaatttttttttgaggtagtgtctcgctctgctgtcctggctggagtgcattggtgtgatcatagttcactgcagcctccactccccaaccccaagctcaagggatcctcccaccacagtctgcagattagtgggactacaggcacgtgttaccatgcctgcctagtttttcaaattttttgtcaagacagagtcttactctatttgccaggctggactcaaactcctgggctcaagcagttctccccactgggcctcccaaagtgctgggattacaggtatgagctactgctgtgccaagcccaatatagatattcttaataaaaaaaaatttatgctatctgagaactacttgactggcatattaccatgaaactttttctcattttttttttcttttttgcaactatgtaagacatttccacagttttgcccttcaaccaatgcttactagttgtaaaagcaggctcctgtgagtgcacccaccaaactacatcttcaagccggcagctgagtgacacacttacatgttgccattgttggacagaaatgagttatagccatgcttgtcctactttgccaagggtaccacctcttttttctaagcactatattttcttcttgttcagaaattgacaagcttccaggatattaaaggggaagtctaacggttctccaggacacagatgttcccttcctttctcattcttctttaaatgagttaaagaaactgttgttgctatactcaggaaataaactcaaattatgtaaataattcaatatcatataaacacacacatagacatttaaattataataaacttatattacaggggcaaagaaaaaaaatcactaacatctctatccagaactcttccggtgctgttcaggaaaagcatttgcttaacaggatccatcaacacccagtaatccacattatcctttaaagaaagttctatggtggggtctggtcctccagcagtccctttgatcagcatgttgtccaccagaattgtacctgcaaaccaaagaaaggtacttgaaaacatattctactcatatgaattctttagcaaagatcatgctcttaaaccgcggctggctcacaatcagttttaaagctgaaaatactcaactgtatatctagcataagacagaaaatattctttaccaaaaggccaaagtatctgcattatattatttataaataatatttttggtggaaggcagagatacagacatggtgagttccatcatccattttgtgtttccctctaacaacataaatctgtttccccccatctatcacttctcacaggagttatcactgaattttatcctgaacaaaaggaaatgcctgtaatagcagagtctgatgtctcaattaattctgttagacctctgatgtgaaaaaaagatattgtgaaactaagaaaggaagaggaaatagatttttaaaaagtagctgagcctcccatggtgagaactgcttctttttatcttagagcaaatacataaaacatacatcttgacatgaaagacaaaactagtgtgcagaaatggaatagaagccattcttctttaagacatgtctgggttactctactagaacaacgcactaggccagtgtaacatttcagtgattgctttcttattattttttttcagcaagctgaattgtagacagtttttgaataaaacttgaaaagattatgtctctaaccctttctactgtgttaaagatcccatgcattttacatgtcgaatgcaaacagcactgatgcaactcaaataccatttttccctcacgcagcaatgatctctttgccaaataataatgtaccatggcttagagcaatcattttcaaccgatccattttattaaacttatagatatagaagagatgtggctatgcaagtaaaatgtagcctccaaaaaaacactagaataaatggcaactatcgagagaacacatcgccttaggacagcactcaagaatatacagagaatccataaatacgaatctggcttgaaaaatataacgaaaaaagtatctgttgcattttcttaaggcatgaaattggcctaaatgttataccgttgcataattacaagaaaagtggaaggctctttaaaatattttctcagtaatttaataataactataattatctataatatttctttatcatactactactaccagtctttatccgcctaagaaatgctggaaagaaccatgaatcttttgtaacaagccagaataatgtttaaacacaaatgttgtctcacatacacatacttttgtaaatggcacattttttgcactttttcacatactaggacataattacatgaatattgagtggaatgagtatttttatttttgactgaaatggcaaatacacaacctacatacaatacactccaaagtatagatcagatattgatggcattttattgcctataaatatgttcaagaatgtatatatattcaaggccccagtacatactaatttacaaatacttcacacaactcaccatgaaaagatatttgatctgtatttcaatatataattgagaaattgaaagggaatttattttctcatcaagaaaacttatgtacaataggcaggtcaactaacattaacattaataccttgactcaatagtgtttaagagtagcaactgcaaatcttctgattgtgtgtatgcatgtatatatatatatatatatatatatatgctccatatatatatgctccatatatatatgctccatatatatatatatatatatatatatatatatatatatatatgctccaagctgcgagcagatacactaagggaaggagccattgaactatctttacaaagcaaatagtttataaccagataaagttttaatagtaactaatattaaagtagtgaaacaaaaacactgtatctggatttatattttatttaaagattctaactttcatggaaaagatctatagttttcttgctctcagctcactcctgagttcaatgattgaaactcaacaaaaaatctttctactgctggtgtgttgaaagagttttgtttgcttgcctgctttcccctttagaattgtccatttgtattgccaaaaagaaaaaaaaaagcctctcaaattttcatatacaagcttgctttaagccaaaatttaggggagagagagagaagagagcaaagcttaggcagacatgatacaaggagcaatatacatattttttaaaaattaacctaagtgttcactctgaattgcctgaacaactgtgcccatacccctctccttagaagaatacgtgacacccaagctatagttagcattaagccagaaactcctgtctctccctatcccagcagtggtgactgtatctttccacacatcctaagttttcaagatctgaaaagctagtgttctagacaatattggcaagcagctaaacaccagaatactctgggtgtattgggataatgtgctctctttcctccttcgttactttgcaagcttccctttttgccaataaaccttttgcttaatgtgtttcatttgatgtttaaatgtattctcttctttgacttcattttaaatattacagataagttaaaaataaaaagatgggaggcacgacacaacactaaataagaaaactggatggctctattaatgtcagctagaacaagcaatgtttaatagtggtaacgagacatatttaattataataaagggatcaacaggaataatcctgagtaggcctgtcttgcagaataggtaatacccaagatgggattcaccttacatgaaattttcctttcatcataataaaaatggtggcagttcagaaaatggaattaaatttagtttgatactcatataatagaagttaagagagctggccctggaatggataggcttagaatccaatccataatccaccacttaccaactatgtgaaagtggataaccgcatttaccctcgatttttctccctacaaaatcagtactataagagaaaaggcatttctactataatactatatgtatgttcctgaaaaagacttgttctcttgtatttagaataataaaaatcaaaacaatcacaatcgtgttaaaaatattagcacagttaaatatttattgacattttcaacacatttcttggctggtcaatcttttacagccttaaatactgggatttgtgcttcatcctttaagaagtaggtattgagggccatttacctctagggacgttttttataaaaatggaaaacttcctctttcatttagcctctttattagcctattaattcagaaaaataactttgcagcttctttttatgtacttcctgattctcaagagagattaacatattaaattacaggagttcatgtaactgctaatatagactctatttgtacagaataaatgttcttcaatagattttccattttttcttaagatcttctcacatagctagccctttctttttaattgtgacattagagcttgccacccatacaagaggatagtgggcattaagtatggtccaaaaaacctgtgacatgcttctaccccaaagaaaagtctatgtttctatttcccatgtatatgattatgtggttacataacatgagattctatgttgtatacatgtgtctatgtgtctgtataacatgagaacacaaactgtgttgtgttctgagtccataaggaatacataacaacctgattgaacttggaagcaaatgcttccctaaccatgtttcagatgaaatggtagccctgacaattccttgattatactcttgtgaaaccttaagcagagtacctggctatgctgtgtctggactcctgactcaaagaaactatcaaataataaatgtgtgttgttttaaattacctaattttaatgatattgttatacaataacaggtaatttacacaggatttaatgtcaaaagatctatgttcagaatcttggccgcacactattaactaactgtgagcttaagcaagttcccaagatttttacaatcagcaatatagagttctatgagaaaacaataaaaatgaatgtaagtggaggcacgcaactacccaatgaataacatttttcatcctacagctactagcaatttatatagatttgagcatataaaggagttatatattatttttcattaaattgggaacattatcaacaaaatgattttaaatgtaaaatgtactttctgtacaactgaaataagagaagcacagaacatacttaaataccagcaagaaaaaaaaaagactatgtatgcatatgtaaaatataaaacaaaaagaaggcaacagtttattcacagtaaccgttgataacttttcatgaaataaaaggccatttcttgctggcaaaagcaaaaatgaacaagataataagcaaaaaaagtcatactactaagatcaaaaatgcttattagtacttattagcatttgctgactgtattaactggactaagagataaaatagaaagacgttcagggaattaccatatttaattatcagactggtgtaaatgggaaaggtttataccctcagaatattgcaatattttattattttcaggccatcaaattgctgcagttaaaattaaaagtacaagcataccatgccgtgtatgtgtgtttttgtgtgtgtgtgtgtgtgtgtgtgtgtgtgtgtgtttcaacataatgattaaagtgggtaaaaaacaatcttcataccccactctcctcaaccaaaaaaaaaaagaagagtatagaatctaatcaggcagttctgttcattagaaaaatatgtcccaggggttgaaatcaaagaaacaaatattggttattttattttattttatttttgagagagtcttgctctgttgcccaggctggagtgcagtggcgcaatctcggctcactgcaacctctgtttcctgggctcaagcgattctcgtgactcagcctccataatagctgggattacaggcacctgccaccacaaacagttaattttttttttttttttttttttttttttagtggagatggggttccgccatgttggccaggctggtcttaaacttctgacttcaggtgatccatccgcctcggcctcccaacgtgctgggattacaggcgtgagctactgcatccagccaaaaatatggttttaaaatgtatgtgaaagattgatttgaaaagataaaagccaaaaaagccctgcttgatgaaaaagctcaacctcttaacctgtgtctccattagaatcaattataaacctcaaattttgggtttttcttccattccctaaccaaacaattaaatctctaccaagctgaagatccccccccttttttttttttaactaaaacttcatttcaacttgtgaaattcctttttttagtgaaaatgcaactgtagaaagttgttgttgttgttagatatgtgatttaaaatataaactttttgactgcgattttaaacactatttcaaagttttaaatgattcgattcagtaaatttgtaagtgtgatttattagattgaaagaattgattaagtgtcttaagaaaaaaatcctcttgggtatgcttgcctacccttctagatgtttgaagagtttgtattaaatttatcaacatcacagtagtttaattattaaagattgcatatatagtactttggataggggaagtaagtttgttaagcttatgagttaatagaactttaatcacagaacaaattaaagttttttcccttagtttttcagtcttcctacggttatagcaggaatgaaaatatttacgttatatttatggtcaaatacgattttgattttatctgtgtcatttacacatatttaatattagttaaaactcaagcaatattccatgaaaagacaacccacatattcaaaaaataaacaaaaacacctaattgactgtaggacaacaaacaattatataagacaatatgtttaagaaatggatgtggaattaactggtagtagtgaatcaatgaacatatttcaacaactccatttatttcattttttgagtttctggttgatccaaatccaagtgtatattccaggcagagagaaaggtcacatcataatcctcctccatttctcctctgatttcagatttaatttttaatataagatatttaaaaccttttattccatagataaatttgtacaatagaaaatgtggttttttagtacctctaggagaattctgagttgtcataaccctacagttaaatctgttttctcacctataaaatcattcagattaacaattctgtaaacaataaggcaaaattatttaatatgttattgaaaataataaaacagatggatgttatgacaatactaaatgtgaattagaactatgttacagaaaaatgttttgtttctataggtaatttgcttctggaaacaattaattggaggacatatttaataaccatacgtgctcaagcagtttgcttttttcatgtaaaagtgggcaagtattaagactaaattctgtcatttttttctatggcagtgcctatcgtagaaaaacaaataagcttaagtttgataattaaagcagcaaaaatgtaattaactaaagagtactcaaatattcaaagttttctgataggcttatcatttgagaggttaatccagccaaacaaatttaatttaaagtactctctaactgcaaatgaagtaaactttctaagtcatattccttttcaatagcacaagtacttgccctttttaaaaaatcaaataaactaactaaattaaataagattctttcaggtattttctaaaggtcattttattcatttggtctgtaagatgatgaaaatcattttacacattgaagaagctatttcaaagcctgacgaagtactttactttcaaaaatattttctaataatcattgcataaatgtttcacctccttggttaaattgattcctttgtgttttattctttttgatgctattgtaaactgaactattctcttaatgtcttttttagcttattacttgttaggtatacaagtacaactgatttttgtgcattggttttgtatcctactactttgctgaatttagttattagttgtgtgtgtgtgtgtgtgtgtgtgtgtgtgtgtgtgtgtgtgtagactctttagggcagggatgtccaatattttggcttccctaggccacagtgaaagaagaattgttttgggccacacaggtaatacactaacactagcgacagctgatagctgatgagttacaaaaaaaaaaaaatcccaaaaaataatcttatgctgttttcagaaagtttataaatttttgttgggccacattcaaagttgtcctaggctgcatgtggcctgcggatcataggttggacaagcttgctttagggttttctatatgcagtgtatttaagaaagaggaagattgtttaacttcatataataataatcagatacttgaatatgttttattatttatacataatattattcaaatattaatcagagaaccacctgaaagtgattatctactttctcaacataactttttcccactataaacattcattgttatgcagaatatataaagaacttctgaaatccaacgaaaaacaaatgatctgattgaaaagtgtgtaaagaacttgaatcaatagtttttcaaagaagatatacaaataatcaataaacacacagaaagatggtgaacatcactaatcattggggaaataaaaatgaaagctacaataataaaccacctcacattcattaggatggctactagacaaaaaacctaaaaaatagcaagtgttggcgaggatgtggagaaattgaaacactacaatgttggttggaaagtaaggtggtgcagcccaaaatttcagttacacaaaagaaacaagttcaagagattaattttacatcccagtaactatagttaataacaatatattgtacacttgaaaattgctaagagagtagattttaagtgttgtctgtacaagaagtgaggtaatacatatgttagttggcttgatttaaccattctacaatgcatacacatatcaaatatcatgttttacaaaagaaatatatacaatttttattaataaattgaaagtttaaaataaaatcatatggaaattgtggaaaacaaatgtttcctcaaaaattaaaaacagtattaccacgtgattcagccattttacttctgagtatatactcaaaagacttgaaagcagtctctggaagaggtacttacatacccatgttcctggcagcatcattcacaatagctaaaacttggaagcaaattaagcatccatccatggataaatcaataaacaaaatgtagtatatacacaaaaggaatattattcagccttgaaaaagaaggaaattctgacacatgctacaacatggatcaacagtgaggctggtatgctaagttaaataagccactcatgaaaaaacaaatatggcatgattatacttgaaactgacccaatacttccatatattttttaataaacatagatgtgtactcttctgatctgaaagtttgaaatttaccaaatgatcttcaggcctctcaaagtatcaaaaaactcaccatatcaccacatccagacaatgagatgcaggatccctcattcattatgcttgcttccttgcccctctgtaattcctgtttcttgcacattattgcatttcttccctgctatataaacccctagttttagtcagtgagggagataaatttgagacagctcccatctcctcggcagtatcacctgattaaagccttcttccttggcaatattcatcgtctcagtgattgagtttgtgtggcaaacagcaggacctagaccaaatccctggtgttttggtaacacacttatatggggtacttaaagtagtcaaaatcattgacaaagtaggttgttaccaaggacttggggagggagtaatggggagttattgattaatggtatagagttttagttttacaagatgaatacagttctggaaatggatagtggtaatggctgcacaactgtatgaatatacttaataccactgaactgtacactcagatatgtttacatctgttcctcttgcttcacttgtccttatcgtatttgctacaaggcattaggatcaattatcccccacaagtatggaaagtcttttctctgttcaaacgttcatcagcatgaagggtccaaaaatggccagaggacaatctgagcttccaattagtcagaacaatagttgagtttcgttgtcaaagcgttcaacttctggtcctagaacccaaatgtcacccagctgaaggtcacagacaagaaagccaaaattattcacgaagatcattaagtaagataggaagagagatcactttcatcttcacttcaagttgcccaggctctgttatgtcatgccatctcctgcatagctattcaggagagggcatgccttcgtgacctctaatttaaagcatacgccacatactgtaagagaatgaccaaacctcatagaagttcatcttctactagccgttatctgagaattaagaattctatcccaccatcttcttctgctagctgcttctgaatggtaggcattgtagtaacattattggattaagctgtggtgtgagctctttgctatgatccttcaccttaaaataaaataaatcaccttgttggaaatgaggttgtatgtccaccagataatgatcaaaagcattggaaagacgttctctgagcacatgaatgttgtttcaggtagaaggtctacagacaacacaaatccatactgaatcatatttatccatataaggaccctcctccatgataaaagtgggtttaatgccactggtcagtgagctggttccctgaggaatgataccataatagggattcagatttgggttctattactggcacattgagtatcagcaacagaagtaaccagattagccttagtaatgctatcttcttgagcccacatattaatcccatttaggtcactatgagcactttacacacagggtcatttatttatccctattgagaccaggaagcccattctgttacagcgtccctcactgacatccctaatctacagaggaaaaaaaaacaaaacaaaacaaaaaaaaactgtagggctcttcaaggaagccagatgcccttttaccaatatacttgttaaatcttgctgaagtgcatgtcctctggttatcttagaagtgtatagataaaggctggtttatcagattacacatgaagataaattcattgcacatttccatcactctgaacttttaaactcctctaaaatagggcttctcaattttaatgtgcccatgaatcacctagagatcttgttagaattataacttatgatttagtagatatagagtaggagggtagagccgtctagttgatgctgcttgtctgtgtgtctcactttatgaaagcaggctttatcacaatgtttctaaagtgtggtcccctgacataagtatcatcttcacacgagaacttgttcgaaatccgtatttgcggctccatcccaaactattgcattagaaactcagagatcccatttcagcaatctgtgtttaaatagccatccatgaggctgggaatggtggctcacgcctgtaatcccagcactttgggaggccgaggcgggtggatcacttgaagtcaggagttcaaaaccagcctggcaaacatggtgaaacaccatctctaataaaaatacaaaaaaaaaaaaaaaaaattaaccaggcatggtggtgggcgcctgtaatcccagctacttgggaggctaagggaagaaaatctctggagcccaggaggcagaggttgcagatcgtgccattgcactccagcctgggcgacagagtgagactccgtcttaaaataaaataaaataaaatagccatccatatcattctgatgcttgttgaaatttgagaaccttgttttataatgtgctgtaaaagttcagacattttgacttcattaactataagctattattgagacttggtttcagttagccaatctagcagactattaacgccacttttcattgtggtagccaaaacatcacaccctgaattcagggtgaatgcattcatgcaaaagaattcagcttcagcaagttttgtattttgttgtccattgtctaacgtctttagaattcactcccatgcatgatttctagctccctgccaatagtgacaatgacctataccttttgttttgttttgttttgttttgttttgagacagtctcgttctgtcgcccaggctggagtgcagtggtgcgatctcggctccctgcaacctctgcctctggggttcacgccattcttctgcctcagcctcctgaggagctgggactacagctgcccaccaccacgcccggctaatttttttgtatgtttttagtagagacagggtttcaccatgttagccaggatgatctctatctcctgacctcgtggtccacccacctcggactcccaaagtgctgggattacaggcgtgagccaccgtgcccagccaacctatacctgttttgtagtataggctatcttgttttaaaaaagatcttatattcctgtcttgactaaaagctaacatttcttatggccctagaatcaatgagagatggtataagtgggtcatgaaaagaattgacattagctcttgaggaaactgtccaaatatagttactgtaaggctattaggcagaagaggactagagaaagtgagagggtctatgttcactagccagaaagttcatgaaattgagatattcaatgttttcaccattatcattttcccatctcatgtctcaatgtcccttttcttccccagtgccaattttcagtgccttttctataggttaagaggatcaaaagggttgagagttccaagtatgttgcatctctgcaacacttataatcataaaaagatgggctccttcaaagctgccctgatgaccttctgtttccccatgtgctcttattgcattttatacctgttagtttacattttccctatatacattctcaagtatatagagaatatacacttggttgtcatgagaaaccaaatgtaataataattacaactattgctacagtgagtaattgctgcagccacttgatcatccaatactctatacctgcactcatcccatgccaccacaggtgtcatttgagtaattgtgatgccacacctggcaaaaattagccacatgctatgtgaatctcccacctccacgaaaggagtttatgcatggatccttaatatgcacactccaatccaagaatctcattttgagttattttttttttcttagagacaagtcaagcaccaattactataatacttggtgtaccagcaagaaaatgtcaccctcaaatttagataaaccaatgtgtttttagtaaaggaaagcttaagagaggtgtgagtagggtataggggaactataagaggtaatgtcatacactgacaaacaaggaatacagaagaaaaatttcatcaggaaaaaaaaaaaacaacataatctaatggggaaatgtcatataacatgagccatgtttagaaaagaaggcagccagcttggagagaacctatgcaacacatacctggctattatttacctctttcccttcatattctcctttctttgcccatttgtggaagccaactgaatgtcagatggctcaggagccttctgatgcaatccatgcatctctgagaaggtgaagagtggatgtaaaaggcaaacagatgtatctgcacattacctcctcaaggcattgtcttctgaattggtcttgtcaagagaatctcaatcaacaatgggatatagattcgggagaaattgagaggaaatttatgagttaaagcttaagtgattggcttaggaaagcaagtgccatatagtgtgaggcataataacactgtggtactggacattgtttagttgtagtttcctttatgtgtctgtataaaatcaacttttagttatataatttgctctatagtacaggtactttgtttcaatctctctctttccactataagaattgcatacacatttgaaagctagtttaatttaaaaaaaagtactaatttggccgggcatggcggcttacacctgtaatcacaacactttgggaggctgaggcaggtggatctcctgaggccaggagttcaaggtcagtctggtcaacatggcgaaacccatctgtacttaaaatacaaaaaaatttggtaggcatggtggtgggcgcctgtgatcccagctacttgggaggctgaggcagaaaaatcacttgaacccaggaggactatgttgcagtcaggctagattgtgccactgcactccagcctggcttgggtgacagagtgaggctgtctcaaaaaaaaaaaaaaaaaaaaaaaaagaaatgtattaatttattagcttttattgtgagtaatgaaagattatacttctgtccttagatcatattgatagtatttataacgttacataattctatattttgctccaaaaaaaaatctgtggccaggcacgctggctcatgcttgtaatcccagcactttgggaggctgaggtgggaggatcacttaaggtcaggagtttgagaccagcctggccaacatagtgaaaccctgtctctactaaaaatacaaaaattagctgggcatggtggtgcgttcctgtagtctcagatactcgagagtctgaggcagaaaaatcgcttgaaccctggaagtggaggttgtagtgagccgtgattatgccactgaactccagtctgggcgacagagcaagactcaggctcaaaaaaaaaaaaaaaaaaaattgcattgctgcaacatgagaaagctgctcctctagtcagagtatggctaagggaagtacatcataacttttaatcactgatatgtgattaaaattttaaagttttgataacattttaattaatgatttaagatgtttggctaatttccatctgaatttagattcaagcactttgcaagcctgttttaatctctatgcttaaaaaatctacatattaataaaatcagccttactacatacaagctgtcaacaaactctgttctaaacacagtggtggtatgaagtcaagtacctttctagctaatggtagtcagcttacacagttgttcaatggggcaacacaatcatatctccaactgttacagagattgaaatgattatcatctgaactactgcacttgtggcaaagttttctttctcaagaaggtttttggtaaaatacagatctatcaacaggagataccattacatttttagcacttaccatatcatttgcagagggatagactcagaatatgatagttgccatgaaaaatagtgaacagtaaaaactgaactaaatggaatatagaacacaagtattggaatgggaggcaaacgttaagaggaagagatatgggaaaatatatcaactcattattcaagcttatttaagcttcatttacatcacaaaaagtttccattcacaaccttttcaaataaaactgaaaggtttccatgatattttaaaaatataatctgtattttatcttaacaagaacttggaacaatattctatccaccattcctgatccaaacaagtgcccaatcttcatctatcttgcctcatattttcagtataaagagcccattcactttttagggaaaaaagacacaaataacacaatggcacaattgttaagtttctcattatatacaaccctatagctaataatgcacatgtcatttccatttctaggttgactaattttgatgggcagaagtgctctaaagtatgcttttataaacctcatatcacgtggtactccatggctgaaacatggcttaatgcatgttttaggatggtgaaggaaggagagaagggaaaaagaaaagacgaagaaaagaagaaagaaaaaggaaggtgaaggaaagaaagagagatgaagaaagaaaatgaaaatatgaccatgttataaagaaaattgaaaacatataattattttttcttaattttagcctgtgtagaaactcttaaggctgatgatgagatagatattttttgccataaattacatgaatctattcatttttacattcttattatatagcattagaatatgttgcattatatgtagactccttagaagatacacgtaaataaaattatcggggaacctgccccgatattcatgtaggttcttttctgtttttcctaagcatctgccagcttgagaagtaaagggacagagtacaaaagagaaaaattttaaacctgggcgtccaggggagacatcacatgtcggtacgttccgtgatgccccacaagccacaaaaaccagcaagtttttattagggagtttcaaaaggggagggagtgtgcgaataggtgtgggtcacagacatcaagtactttacaaggtaatagaatatcacaaggcaagtggaggcagggcaagatcacaggaccgcaggaccgaggtgaaattaaaattgctaatgaagtttcgggcaccattgtcattgataacatcttatcaggagacagggttttgagatcaactggtctgaccaaaatttattaggcaggaatttcctcttcctaataagcctgggagcgctatggaagactggggtctatttcatccctgcagcctcaaccctaagaggcaggcgcacctgggggcgctgtttataagcctatacctccaggtgggtattctctttcccaggaatgtttcatgctgagaaaaagaattcagtgatatttctcccatttgcttttgaaagaagagaaatatggctctgttctgcccagctcaccggtggtcagagtttaaggttatctctcttattccccgaacaattgctgttatcctgttcttttttcgaggtgcccacatttcatattgctcaaacacacatgctgtacaatttgtgcagttaatgcaattattacagggtcctgaggctgtaattacatcctcctcagctgacaggattaagagattaaagtaaagacaggcataggaaatcacaagggtattcattggggaagtgataagtgtccatgaaatctttacaatttatgtttagagactgcagtaaagacaggcataagaaattataaaagtattaatttggggaactaataaatgtccatgaaatcttcacaatctacgttcttctgccatggcttcagcaggtccctccgtttggggtccctgacttcccgcaacataaaataaaaaaaaaaaaagatgctttcaacttagtgactattattcctgtctatctctatgtgcatgtattacacacacacacacacacacccacattaagaacccactaaatattgttaagttcttggaaaatatgaccttaagtgaaatgacatacaataggtccttgaataacatagtcatttagatataattataatacgcaaaaaatggattttgttatgcatcgttttgattaaagtcacagtttccaagaacctactgatgacattaagtttatacacacacaaacatgcacacacacaaacacacacacacacctacacacacaaaggtagttatacacaatatactgactgccttataagaatgttttttctatcttgtaataatacatgagtaccacatttttcaatgcatttaatcatgctgtatctgagaatgtgacttattaagtcccataaatatatctaatacattttagagtataaatgttcaatgtattattgtagatataatatgaaactgtgcatgggagtggagtgaggaataattgaagaaaaggctcttgctgaaccaatttacctatgggagatcagaatatgccaccccaatttaggatggtttggcataaggtttgttgagctgaaggcaattaagaagcagatgaagaaaagctctctgcctctatttacctaaaaggacgatatacatttacaaagacaaaaaatatcccccttcccctctaaaccggggaggacaaatgttatccactgaagagaactttagactgttatgggcctggagatggcaccagaggaatctacattaacaagctttacttagcctttatctgccttttctttgccttgcctcaagttgctgtctttagaaattcaaaatccttttcctttgtcatgtcgcttccctaaaactttactgttctttgttgaacaatgcgttatataagctgaaattcaaactcacctccttggcggctactcattcccttgctgtcttccatgtatatatgaaatacacgtcaataaacttctctggcttttctcttgttaatctctcttttggtccatgggtccattccaactaatactttatcagaattgaggaaaaaaatattattcctcttccaaatagctatttagtattttctggctgacagagcaagtgtcttgacagagaactcacatttcattctctttccaacactcttcttttgatacactttaattataatccttaaaaatcagtctctgtgttagaagttgacatgatatatgaaggaaaagggccactttttaattctggaagttaatgcaataacataaagtagaaaaatagcatattttgaaatatatttcatgtcaaacacagacatatccttctaaaatgcagcatcaggaaatacttaggcataataacaaaagttcaaactatgatttcaaaacagagaatttgacaattcaagtatggatatgataagcctttattctgatttttttccaaatattccgacagtggaaaatgttcaaacaaaatttgaaggaggaggactgtgtactatcttattttccctcaatatttttcttatatactttaaagtaattttattctgcaatattgtgtcgaactatgaatttctcaaccattgtttctgaattgcaataaagtcaaaccgagcaagatggctttaatattgccctcatcttgacgaaactttaaacacttttcttcctgactgcatgtcctgacctttattttcttagagtgtttacttcagaaaattttccattgtaaattcttcctatgactctttgagatgtaaatagtctcccagccacttgtgagttttataacccagggatgtcttaaaaaacttggagacatccctttgaaatattgttatccagaaagatattttcccagtctcccagtttgtatggataataggagcctaaattccataagcaacaattaaacaattaaatgtggtccaaactcagggaacaaccttcccttcacttcctccaatgcttttccactaaaattttcttgcattgtgtttcaaaagaactgagttcaatttctatccactattgcaatagccttgaataaagtcttgcctgtttaactctatctggtataatttttcttcaagagaaccttaattagtcaagttctattttggcaatgggattcatattggaacttaattttatattataaaaatggataaataatcacaaacataaaatatgaatatatgtttccaacaacattgtgtgcatcaaaccaggcactaaatggcaaaggtataaataatcataataacaacttttgtggtgatagagttttttctagatgcactagatatgctgatattcttaaaataaaaattcttacatattagccaaaagatacttctgccagacaaatgttttattcattattacaaggattctagaccttttaaaattaagatattctgtttcaaagtcaatgtacaaattcccctaagttcttaaaaaataggggcaggtttcatggtgacctgttcaaagatctattgctgagatagattttagtaaatcaatttggttcactatcccagttggtcacaaatatgagtttttgttattacttcaattatcttattcattgcttactcaaaataccttttaagtcttatcccatgcagagatcagatggtaaggtttttaaagtaactatatgactatcagacttatttccatgtaacttgctttatttttgcctgtctttaagattttattacataaaaagtaataaaaattaattttaatgtattcctaaaatttcaaaatcttgcttgtttaaaaaaaaattagtcttaattaaaaaaacactatggaagaaaataagcctttaagtgatctatattatcctaatgatgttgttatgttacttaaatcaaaatttgtgaaaaaaataggttcacacttctgaatctcaaataaactttatagatcaaaaattaccaccaaaggtgctcagaaacaatgactaaaatttccatctctagcaattttttatataacaaaattgtcctaacaatactagctaataaattagagtttggttacaaaatgaaccatgataaaatctatcacagcaggaaaattttagaaaaggtcaagaccacttatgtgatcttaccttcaattttagaccaaggaaagtttgtaagtgaaatttaacccttcaaaaatgccccccaacatagtatcttattcttgtgcaacctggaaaaacaaaaaaaactgatattagaacctaggttattttatttgctgctggattatttgcttatttgttgttttaaatcagaaaaaaaaccccaaatattctggtagcctagaaataatcaatagccttgcagacaaccaagtatccgggttgccttatgaactaagcataggatagaattaaactagacactgctaaaatgaatggacaatttttagtggtatgtatacaaaccttaaagttcaaataatgtaaatggccgacatcaaacatattttctaaactatagaattttacaccaaacagtatgttctgccacagtaaactgtctctggctttcttaaaagtgatttattttatactgcaaattattctgtcatgtccacttggcatatatgtgttcctttctgattttctcaacaactctctcttagaaggaaagcattttctttttagaaaccattttgaatacataatcacatacatgtaacagaacatttaaaaagaaactgtttcagccaaaactatgctacctactctcagtgaagagagttgcagacaacttttgtaggacatggaaaagaagccactgaagttcagtgtgtaacatttatatgattaaatataatataaatataaataatataatgattaaagatgggaggctcaggtagcttggacactgaggatttgggaggaaagcaatattacagtgtgataattgcaagttatcaacaaagagtcatcagacttcttgcatttctccataagcttgatgacaagaacatcaggtgggtttctctgaaaagaactaaatttacagaagttagagaatttagagaaattagttgaagggtgtctgactttcacttgacaattttaaagggtgaaagtctaaatgaagaacttttgcagattaatggtctgcggttaggaaataactgtattccaactagagatgagtctcaagtgagtatttcccaccagcaaatgtgggccatgcaagagagtagacaagaaggagatgatctcaagcccagcccaagagaatcaccatgaggaatgaggagacctcagcagtaagacgctgggctgtgcagccacatccgcgggaacagcaaaagttagtgaccagaagacaaattctccagccatcccaggaattgccagaaacagctatccaaatttggaggtctccaaagaatctgcctacgtggttcacaatctcaggagttgccaaaatcagacctagagagtacagcaatgcaccctttcttttctttttacctctaatgctttttccagggtcaaacctggaggagatgaaaatcagtatttagtaagttgaagaaacagagatgaataaggcagagagagagcaaggttgttgacacccaggttctaaggcagctgggatgcctacaaaaggatatccaagcggaaaaaaattgaagtagatttctagccaaacttagaagtcctctgtgtctaatgtatttcagagtaggagataaagtatttgttggattagcacattagcaaaattatctagagaaaggaatacatgtgtaatgtccaataaaagccagtgattctccaattgaacataaaatggactaagttgataagaaatgtggggctctttcaacaaatagtttaaaatcaaaatcatgaaggtggataaaatatttctttacccccagaaaataaacggataaagctacttctactatctttgttatttttcactctactagccctaattatttcattactaacttatcatcaattgaaagttataaaatgcatgtttccatcatgatactatgtcatatatattttaaaagatggttataaaagtcatctgtcattattaaattaaattttgagtcaatatatatttgtattgggctatgaatatgcataagaaattaatattctgaataatatgtactctttcagtgccctggaaaagacaataggagcctgatacaatttgtcattcttgcacagtgacagttaatcgaaaattattaattcattatcaaagtatcatttccatgacaaagacgagaggaaaacatgcagactgtgtccagatttcttccagatatctaccagcaaaatatcaccaaaattaaacaatgaaagatagacgaaaagagaaaaaagccagagggagaggagagagaaagagagagaatgattatgttttacataaaaaacagtaaattgaattccttacttgatttttataggtattgttcatctagtttgtagtaaagggaacatagctatagacaggaaactgtcattgttgagaatttggagcttaaaagtattcagtaattttaaatgcaggacatgtattttcgaaaccattcataattaagaaattaaaaagattttagtaacatttgtgaaaaacagaaagaaaattatttaaaagtctttgctcttcagagatagtgcctggctcttgtagattcctttcacctctacactatgctaaaacctggctttgtctaaaaacaactttagctatagatggtcactttctgtaaaggcttttctttgttattgtcatagcattacagaatattgatgacttcaatatcacctacacagaaaaactgtatatgacttttggaaaaaaaatgagagatttagggcaagcaaagttatgctgttgtagattcaaaaaaaaaattgacattttaggttaagtatattttcaatgtttcaattataactgtaaatctataaatgctggtagaggtaacctcattagaaataactccttattctaagagcaaagagaaacctgaaatgctaaaatggatactcattcttaataggatcaagaaacaccaaatacccgtcaaatatccgaagattatattcaatgactctgaacaaggaaaaaagcaaaaaattaagtgaaacatgaatgaaagaaattacagaaatctaaacaaaggtataatctatattaatggattgtaaaactcagtagcttaaggatgctaaaatctcctcatgtaatgtcaataaaaatttcatcaattttgaataaattgaagaattaagtctaaaacatatacaattcaaattacaaagtatatgcccataatttatgactttactgcttaattctaccagcatataaagaagaacacatcttaaacaaactattacaaaaaataataggaaacacatactattttggtttttgatgctagcataaccctgataacaaacctgacaaaaatacatcaaagaataaaaagtacacatgaatatcctcattaacacagatacaaaaatacttaatgaatttatttagaaaataaatcaaatccagcaatctataaaataatgcattatgaccaagttggttttaccaagaatgcatggttggtttaatgtataaaatacataaaatcttattaacagagtgagggaaaaaaacataactcaaacaacacagaaaattcatgtatcaaaagtaaacgtgttcaagataaaaaatattaagcaaattaggaatagaaagtaacttcctcaatctgataagcaaaatatttacattaaagaaaacagaactaaattaaagctgacgggaagaagaaggcaagattatacaatcttataatttctattcatcatggtagttggaattcctagccactgaaataaagcaaggatcaatgacatatattaacaacaaagaagaactatgctcctatttagaaacagcatgatcgtttatgtataaaatattaaatacagataggccaccttttattgctttctttattagtttattgaactccataaatacggcatttttttaaaagtttgaagatttgtggcagtccttcaaataaatagcaaatttattagccattttttccatgtgctcacatcatgtctgtgtgtcacagtttggtaattcatgcaatatttcaaattttttcattgttatatctgttatgattatctgtaatcagtggtttttactattaattactattataattattttgggatgccgcaaaccattcccacattacattgaacttaattcatgaaatgttttgtgtgttctgattgctccacctactggccattctcccatctttctccatctcttcaggcctctgtattccttaagacacaacaatattaaaattagaccaattaataaccctacaatggcttctaagggttcaagtgaaagagttgcacatctctcaccttaaatcaaaaactagaaattattgagcttaatgaggaaggcatgttgtaaccaagataggctgaacgctagacatcgtgcatccaacagttagccaagctatgaattcaaagaaaaacttcttaagggaaactaaaagtgctattctagtgaatgcacaaatgataagaaagccaaaaaaccttattggtgataagtagaaagtttgagtgatctgaatagaagatcaaacaagacacaatattttcttaagccaaaacaaaatccagagcaaggacctagctctctacatagctatgaaggctgagagaggtgaggaagccacagaagaaaaattggaatcttgtagatgttggttcataaggcttaaggaaataagccatctccataacacaaaagtacaaggtaaagcagcaaccacatgattacatcaatagatgcaggaaaggctttcgataaaattcaacacacattcatgtcaaaaactctcaaaaaagttaggtattgaaggaatagaccttgaactaataagagccatatatgaaaaactcacagccaacattatactgaattggcaaaagctggagtatttcccttgaaaaccggcacaggacaaagataccccctatcaccactcctattcaacatagtattggaagttctggccagagcactcaggcaagggaaagaaaaaggggcatccaaataggaagagaggaagtcaaactacccctgctagcacaagacatgaacttatattcagaaaccctcaaaatctaggcccataagatccttaaattgataaacaacttcagcaagtctcaggatacaaaatcaacgtacaaaaatcactagcactcctggacaccaataacattcaaggatccaaatcaggaaatcaatcccattcataactgccacacactcacacacacacacacaaacacacacacaaacacacacacacctagaaatataattaaacaggaaggtgaaagatctctaccaaagaactacaaaacactacttaaagaaatcagagatgatacaaacaaatggaaaacattccatgctagtgaatagaaagtattatttttgctaaaatacctataatatccaaagtaattcatagattcaatgttatttctattaaactaccaatgacattcttcacagaactagaaaaggctattttaatattcatattataaatattcatatttattaatgataaaatattctattttaatattaatattcaggccccaaaaaaggacctgaatagccaaggcattcctaagcaaaaaatacagagctggaagcatctggctacccaacttcaaattatactacagggctacagtaaccaaaacagcatggtactggtacaaaaacatgcacatagaccaatggaatagaacagagaacccagaaacaaggtcacatgcctccaactatctgatctttgacaaagctgacaaaaacaatcaatggggaaaggactccctatttagtaaatgtgtagggagaactgacaagccatatgcagaagattaaaactagaccccttccttataccatatacaaaaatgaactcaagatgcattaaagacttaaatgtaaaaccaaaaactataaaaacccatttctctggacacaggaacaggcaaagatggcatgaccaagatgccaaaagcaactgcaacaaaagtagaatttgacaaacgggatctaattaagctaaacaggttctgtacaacaaaagaaaccatcaacagagtgaacagacaaacctacagaatgggagaaaattcttacaaactatgcatttgacaaaggtctaatattcagcaactaaaaggaatttaagcaaatttttaaggaaaaaaaccattaaaaagtgggcaaaggacatgaatagacacttttcaaaacaaaacatacatatgagcaacaagcgtatggaaaaaaatctcaacatccctaatcattagagaaatccaagtcaaaaccacaataagataccatctcgcaccagtcaaaatggctattattacaattaaaaaagtcaaaaaatagcagatgccagtgaggttgcagaaaaaaagcaatgcttatacactgctggtgggagtggaaattagtccaaccactgtggaagagagtgtggtgattcctcacggacctgagaacagaaataccatccgaccctgcaatcccattactgagtttatacctgagggaataaaaattgctctatcacaaagatacatgcatgtaaatgttcattgtgtcactattcacagtagcaaagacatggaatcaacttaaatgcccatcaatggttgaatggataaagaaaatgtggtacataaaccaaacttggaatgcggtacattccatgtgtaccacatggaatactatgcagccatataaaggatgagatcatgtcttttgcacgaacatggatagagctggaggtagttatccttggcaaacaaatgcaggaacagaaaaccaaatactgtatgttctcacttataagtgggatattaatgatgataacatgtggacacatagaggggaacaaaacacactgaggcctattgaagggtggagggtgggaggagggtgaggatcaggaagaataactagtaggtactaggcttaatgtctgagtgatgaaataatctgtacaaccaacccccatgacacaagtttacctacataacaaacatggacatgtactcctgaacataaaataaaagttaaattaaaaaaaaaaactaaaaattacatgcaatatttgtagtggtacaaatatatttatgtaactgtaaaaaagagagatgtataagaatatatacaaaatgtaataatggttacttccaaacaatacatgaaggctagaagttgaggtgttttttttttaatctgtaaggttttaattcttttaaaaaagaaaaagtattagtgtattgtttcacaatttttaaaaaatgtacaagaatgttcttatttctaccatattggtctgcttctttgtattttttctggcccaacccaaatcagtcttttcaaagtttatctacattggttagagatggagccttatagaacattgaattaaaggcagacatccaaacagttattgtatggaacagatctgcgtactaaatatgaatgtgtgtattgtgtgtgggcttatagtattaacaatacacattatgtctttttgttttttatgtgtattgtctgtgtacctgtgaatttcagtattcgtgagctatgcattaatgtataccacagttaaataaatgaattagttgcagaaaaaggaagatcaaagttggaaggctttatctatctgattttaagatgtactaaaaagccacagaaataaataaataaatgaataaataaataaataaatggactagaataggtaggaattagtcaactttatccttaagggccagatattaaatatttcaggccttgtgggacacatatgaggtgtctgtcactttttgcccctcttcctcctcctttctcctcttctgcctctttttctacctcttattttgacaatactttaaagatgccaaaattgttattagattgtgagccacataaaaacagcccaggagtcataatttggcaatttttggaacaaaggcaaaaaacagaaccgcagtagcctttccactaacacttcacaggaatttgatggatcaggaaaaacctttgtaacacatgatgctaggacaactgggtatccatatgaaaaacaaaagttaaccttaacccctacctcctaacaaacacgaaattaatcaaagaaggagcaaacgtaagagtaaaaggccaaactacaaagtatttagaagaaaacaggggattatcttcataacctgctatgaaacaacacagtaagaaacaaccataaaagacaactttaatatattagagtttcttaaaaatttaaaacttttattcttcaaaagatacctctacattaattataaactggaagaaaaatatttgcagaacttgtgtctaacaaacacttgtatgccaaatacacaaaactctatgacaactcaataacataaggacaaattttaaagtggacaaaacacttgaaagaaacttcctgaaggaatgtgcatgaataagtaataattacatgaagtgctcaatatccactgataaaaatttcttaaataggcaaaatgaatctatagtgatagaaaacaaatcagtggttgcttggggaaaaggatggagaaaattgattggaaaagagtacctgggaactctttagagtatttaaatgttttataccttgtcagagtggcagttacatgtgtgtatatacttttcaaagctgtatagttaacgttggtatatttcattgatttcaatgtaggtaaatctaacctcaaatatccataaatataataatcatatggaaggtcacttccaaattggtggaggaatagttgaaaaaatagtctaatattatcattttttaatctggataatggctccaggatagtttgttatggcattcaatttattctgtatatgactgaaattttaaaactcttaagctaaaaagcatttgtcacatgtttttgctgaaatattggttccttgtaatttctcacttaattcaagcagacatctaaaggtgatttattttccacccagaaaactaagagtacaaggattcacttgtgtccacaagggaatcaagtgatccaggagaacgtgcttcactattttttgcttttcctgacccttaaacagcttctaattcctcttgctaaaaaaggaaaagggatggctgggcgtggtggctcccacctataatcccagcactttgggaggataaggcgggtggatcacttgaggtcaggagttccagaccagcctggccaatatggcaatacctcgtctctactaaaaatatacaaattagtcggggtggtggctcactctcgtaatcccagctactagggtggctgaggcatgagaatcacttgaacccgggaggtggaggttgcagtgagtggagatcatgtccctgaactccagcctgggtgacagaatgagactctgtcaaaaaaaaaaaaaaaaaaggaaaaggaagcaaagaaaatagaaaagttacttcctctaaggtaaccctaggagttttcttcactatatttaggaacataattagctgtttttttaaaaaaaaaaaattgatgcatgcttgctttctctctatatagaactatattttgcagaagtgttaatgatgttttgaaggtgacaatgttatcccacaacatataatttcctctcttaaaagtactatctttgaaatgggctcacataatatgtaaatatatggggataaatgtatagtctcattacaaactataagaattattccatatatgtaaaatatgaactactataattgggtgtaaaaccaaggttgtaaatttaattttaataatttgcctataatatttatcagtccaaagtgatttgaaaagaaaatctattaacatgttttacaatattcttacattatttctatcattatgtatgagacaaatcatgatgtgacagcatgtgacaagtgtagcagatgctgtggatcagcttacacaaaacttattccaactacctcctttgcacatgtttctgaaccgcataactgagaagctaaaattatacttaaaggattcaattgcagctatgattctatgtatgattggggttactctgacaagattattttttatataagacattgttcagaatgtactatgaaggggacaggtgttacactttttgcagttacaaatcggggtggaagtgctgtggttctggtgttagctgtggttctgtagttggcaatgttggcatcagctttctggaaccaggcatctggatcatgggaaaggcagcatttcctaggtgatatggcttggctatgtccccactaaaatctcatctcaaattgtagctcccataattccctcatgttgtgagagggacccagtgggagataattgaatcatgggggcagtttctcccacagtattctcatggtagtgaataagtctcatgagctctgatggttttataaggggaaacccctttcacctggctctcattgccttgtctgccaccatgtgagacatgtattttgcgttttgccatgattgtaaggcctccccagccaggtggacctgtgagcccattaaacttctttcttttgtaaatcgtccagtctcaggtatgtctttgtcagcagtgtgaaaatggccaaatatactatagcagatcagttatgttgtggttttgcatctcattcctggcaggtcaaaacagaatctatttcttccaccctttcaatcatatgtgaactatttatgccacttaataagtcccttcagcttgaagaagctagggtatattgttttttgtaactaatatccctaactgatattgcagacttcacataaaaacatcctgttgaagatgaggaactagaagattctttccccagggacatatgatattaaaaaaaagctacaggtagctggtctttactgtgtacattatcaacctcttacccaaaatactatagtggtattcactgctataactatttacagtatattcagctgttttcttacagtcttagcaaaaccatcttctcatctgttatgacttgcatgtaccccccaaattttgtgtattggaaactaaatgcccaaactcatatgttgatgatatttggaggtggggcctttggaggaggtaatcaagattagataaggtctttagagttagtcccccatgttgagactggtggctttagaagaaaagaaagatgtgagctgacttgggtgctcttgccctctcactatgtgctgccctctcaccatgtatgatacagcaataaaaccctcaccagatgccgatgccatactcttggacttccaagcctccagaaccataagaaatattttttttctttattaattacccagtccacagtattctgttacagcaacagaaaagcaattaagacaccatctcacacctggttttgtctataccttgtgagaacctcacaactgtaattcttctgtataacacatcaattaaaatagaatctagacaaaatgtcagtattaaaacaatcaggaaaacagggctgggttgataataaggccacaatatttgctgcctctgagaatttgggaagggatggatttgaagaagaagttttctgcttgcatatctagttcttattcatatgcacacaagcctaaggggaaaaattcaggctcatcgtccttttgattgcttaaaagcatgtagcagcttccaatttacctttcctaaagaacaagtcaggctgcagaaagatcatggttttgaattcagccatggcttttaatttatttcttttagactttgcttgactggaaagctctggaagctggggttcaaaggcaattgtgtttaaagaaaatacttagttgggaatattctaacagcaactgatgggtttaataattcttgtagatactatataaaattttgaatagctagtatttaggtaaataattgcaaagaaacactcttcttttggaataaattacatggagtcctgttgctgtctacttgcaaataatctcattcacgttttgatgaaactcacaatgtacacattttctgaggaaaatggaaacaggaggcctcctgaagatacaataagatgattatatttattttcaaacctttaaggaaagctcctgcaagttaggctaaaatgtaaattttagtgaggattctattagaagttccaaggcaacagttactttcaaaaatgatagacccactgtgagcaaaagagagaagataaggactctgaccgagctggcattgttgaataaggggccctgatttgctgctcaatagctgactctgcaggtttcaattataggaatagctggaataatactgctctacaatattactggtagaatttgcaaagaattgatatatagagtttaagtatgtgtctctgtatgtgtgtttgtgtgtgtgcatgtgcagcacacagacatgcattatgaaaagggagttattcaagtaaaaagcacctgccgctaccataacaggtatgatctaggctgacccatgatgcttgggtgggtggtgggacattaagaatagaacatttaactacaggcatgcttatattccagttatatataggcccactgcacctctaaattgttgcactagagtctttattttggctggatttaaaggccacttcccaaaatttgtgcagaatctttgtagttacataattaaaaattgaaagaatttaaaaaatgacaactgtagtctcactgactttttaaaataaaattaaaagaccagtataactgtaagcccttgttcagaaaaatgttaattccttacgatctagactcagaatgtggggtttgaatcacaattctatcagtcactagcaatgtgatcctgagaagattacttagtctctctgtcccacagtgcctggtttataaactgggaataatatttattttaaaggattaaatgataagctacagatatgtctttttgcagtgtgactagaaaatagtaaacacgtaataagtgctggttgctgctaccataatgatcagtgtatttctatattgtttatttctggatatcagtacttttgatataagactagacagtgaattcctcaattacaggggctatgtctccagtaaacaagaaaatgcctgtcacacagcactcacattaaaagcttagttgaattgatacaacttgtcagagagactaatactgagggcacgatggccttatcatcagcatatcctcattactttgactagattatttaatttattctcttttactccttcttacttctacttcagttaaaggcaactggggagtatagaaatttgaatatttagctttttggggctatgtccgtagtttattcactacttagggtgacctgtgcacatgctaaatgattaaagaaggcaaattctaggatggtaagtagagaaatgtgcattatagattgaaggcatgtgatgggcaaaagagcctgaggaactgacaatagatggaggaactgacaatagatggaggtcagtaaacaaactgaaaaacaaatgtaagggaaaacatctgataaaattaaaaaataaatatcttatttaaaaatatacatcttcttaaatatatatttatattttaatatatatttaaaattatatatatgttaagtaaaacagaagttactaaaggaacttccacctttgtatgtttgcttgaatattacatctttaaaatagcttttgcaagagatgtttcacaaaagaagttgatcttacaggtattgtagttttctctaaaatgcctaaagattaatactccgcaaagtatttcagtcaatttcaagttggggaatttggatgaccaagacatctctgttctctcaattcctcagaggacatacaccgaagttagttgtgatagtagttattatgcctattaagggtgagatccttccaggttctaacttctattgtcctcaaacacagcactctgaaattctagcattaatgactgttactggctacttacaacaagcaacttcacttggatctaccatccagtttccaagctaccaacattaccttgttgcattgtttttgttgctgttgtttctttttttgcgacagagtctcgctctgtagccagggtggagggcagtggcgtgaccccggctcactgcaatctccgcttccctggttcaagggattctcctgcctcagcctcctgagtagctgggattaaaggcatgagccaccacgcctggccattacattgtttatgtacaagctagatgataaggaccaggcaacacttgtgctatcatattgcatgtgtgcaaggctacacagcctgttgatgcacacaggagagactaagaaaggcagacctggccatggcctacctacttgcttactgaactttgtattccacgaaagaagggagcatgaacatatgtttagcaggaaacttaaagtctagcaaatttcctggcccatagtattgtattctagttgtttgttaaataaatgaatggtctgtatacaatatagcatctctctctctctcaacgaatagcaaaattttttaatagacaagtaacgaagggccttccaatttaatgataataatacatggttggctatctattacagctctttgtgattgttggtttgtgaatctgaaggcactatttctcaaagtgaagtccaggaaccacttgatcaaaggtcatctgagttgctgtttaaaatttcagattcctggggtcacttcctgcatctccacctctgacaacaatattcaggaaactatataatcaacagtctaccaaggtgattttatgtacactactatttcaaaaccttagtgctagctcattctctaggtgaacaaatgaaacaagtataaatatgataaaaagtaagagatctattgatcatatttctacatgaagagattttctatttcagaaattgaagtaatcagctttttaaaaaagcctttttgggaatcaatgtaagtttcataattcagccagctgaccaataaatattaaaaaatgtttaactttcttatatttcatcatttaaaaaaatgagaaattattccatagtctatgtctgtctgtatacattattcagctcccacttataagtgagaacatgcggtattagactttctgtttctgagttatttcacatacgataatggcctacaattgcaataatagacattggagacttagaagaatgggagggtgggaggagggtactggatgagagactgcttaatgggtacaatgtacactatttgggtgatgattacactggacatttggtaatcatcacccaaatcattacccaaatagtgtacgttgtacccataaagcaatctctcagcctctcactactacacaatatatacatatgacaaaacaacacttgtaccccttaaatttacacaaataaaacactacaaaagaaaattgaagaatgatcctatttataatagtgacatgaactaatttgaaaccatgtactcataggagatataagaagaaacaataacatgtcctagaaggccaaaaactgaagacttgaatcaaatgaaagacatatcattatcttgaatgagaagattgaatattacaaacgtgttcatttactcgaatctacaaacttaacattaatctacaaaattaacataattccaatcaaacatttttggagggttttggacctggcatgtttacatgacggaataaatgtgaataatcaccaggtaactctataaaaagaaagttattaagacagagttctcctataatgaatgacaaacataatattgggctacagaacagaagtaggtatacaaatatggaagaatatattacatttattttgaaattaaatttttgataaagttagaattttcagtcagtgaatacttgatactttatttaaaacacagttgtcaactttttactatacgtcaggctatatgaaaatattaactgatttaagtctctttacaatcttacaaagacttacaagttaaaaattttaaatttataattttagatacatgccattatcagcattatataacacatgagaaaacgaagcccagagagtttatgtcacttgctgaaagcaacagcaatagtaagtagtagagccaggttgtctgaatgttctttaataccatgatataagatttaggctggcacttgaagaaaaagaattaaaatcatactagagttcttattttaaaagcagattaaaaatagaattttatttcatttaaatgaacaacataaaaccaggaacgtattagaaaaaaaattggtaagtatttgcatcaattgatgtggtaaaacgtgaaatgtgatatcaagttacataaaggaaaaatattcaaccagaaataccatttcacatagaaatgtttaaaatgtttcatatttcacatagaaatatttaaaatctatacctctaaagtatttatgaaaaaattcaaaatatgataagaaagtacattgtggtatatgtttaaattgtggtaatatgtttgtttttttcctattgtcacagcttaattattgataaggtctttatccacaaaaggggttcaaactgtgcaatacatttttgtcacactaattacaaaggttagtattactatgaaacaaaagtttcaagatcaattaaaaaatatggatgttccaagaaaaattgaagaaatttttaaaaatagtcaatagtttaaaaaaatcagacagagaaggaggtaataaaaagagagaagtactaaagtaagtaacaagagaagaaaaaaaggtagaaagaagaaaataaatattccatgttgtcaagaaggcaggagattctcaaattttagcaatgggattatttgaaagtaatttagaaaatagttaagtatttatgcaaaattattttaaataatattcacagatgtgatatatgtgaaaagaaaatagttgaacataatcaaaaaaattcaaagattataaaatgtattattacaatctatataccacatattatattggccactagggatgatataaaggtaaatttagtgtgacagacaaacaatgaaaatattagaaatggtagaaaggtgactttattgacataaacaaaaatgacaaaatgagaaataaaatgggaaatgttgtatgatctcgattgggtaaaagacaatttatctacatgtgattttcccatacaaatcatttgatccaaatggtatttccaatgacaactgaaaatataaagtgaatttaaggaggtgaataggtataatattttttaaaaaatcgacttttttattttttaaagacaggttctcacttggatgcccaggctggagtgcagtagtgtgatcacagctcactacagcattgacctccctggcgcaggtgattctcccacctcagcctccagagtagctgggactacaggcacatgccaccatgccaagctaaatatatatatacacataaaatttttaaaatttttactttaagttctgggatacatgtgcaaaacgtgcaggtttgttacagaagtatacgtgtgccatggtggtttgctgcacctattgacccgtcctttaagttgcctctcctagctccccaccccccaaaaggccctgatgtgtgttgttcccatccctgtgtccacgtgttctcattgttcaacccccacttatgagtgagaacatgcagtgtttggttttctgttcctgtgttagtttgttgggcatgatatcttcgagcttcatccatgtccctgcaaaggacatgatctcattcttttttatggctgtgtagtattccttggtgtatatgtaccacattttcattagccagtctatcactgatagacatttgggtttgttccatgactttgctattgtaaatagtgctgcaataaacatacatgtgcatttgtctttatagtagaatgatttatattcctttgggtatatacctagtaatgatattgttgggtcaaatggtatttctggttctagatccttgatgaatcaccatactgtcttccacaatggctgaactaatttacattcctagcagcagtgtaaaagtgtgcctatttctctacagtctcacaggcacctattgtttctgactttttaatagtcgctattctgactggcatgagatggtatctcactgtggtcttgatttgcacttctctaatgatccctgatgttgagcattttttcatgtttgttggccatgtagatgtcatcttttgagaagtgtctgttcatatcctttgcccactttttgatggggttgtttttttcttgtaaatttgtttaagctccttgtgacttctgcatgttaagcctttggcagatgggagactgcaaaaattttctcccattaatatgtttttgtagagatggggtttcaccatgtttcccaggctggtctggaattcctgggctcaagtgatccacgcaccttagtctcccaaggtgctgggattacagatgtgagctacctcatccagcaaccaaaattttttagtgttattcgccaatgctgctattaaagaattacatttcagtttacacttacgtcgatctactttaggaatttgtatactgatttgcatttatccaaattggaattttttttaaatactgggacttttctctcacagaagaggtctgagatcttagtctagcataaatgacgaaatggggagtgatagaatagaaaaccaagagaaaagaagttatttaagagattaaaagaaataattatctgaccctttcacatagtcttgggtgctgaattgcaaattctgctgtttctgctgtgacagaataataataattttcttttcaatgatatagagatatttaacaatgtttactatttcatagcactagcaaaacaggaaaaaatgcttgatgtaataaaattatttcacccgattattaatcaaatatagaatgggagaatgtatattaacattatttgtcttttgaaataatattatcacaaatattaacaaactttggatagctttttgatatcttaattcctgataattgctactaattcatttctaagtaacaagtacaatataaattccagatttaaattaaaaatatttgatcattcacaatgctatgactgtattacatttcaatattttacctcgtgttattttctccataaatagagtggttatggttcacaggtacacatgctatttgtttatttatttcattttgtagagagggtcttattattttgcccaggctaaaatgcagtagctattcaaaggtgcaataaagtgcgttacagcttcaaactactggcccgaaaagatctggtttagcattctgagtagctggaattgcaggtgcccagccactgtgcccagccacaattgccactgtgcccagccacagtcagctttttcaagaactgtttaagataacaggttagggaaaatcaggataatattttgaggggaaagaaggtaaaatcaattaagacagggtgcacagagtacttgaatggtacagctgatgtttcatcctttgtactaaatggtgtgtatatgggaattggttatattattttgactgtttgtagtcatattatgtacatatgtgtatacataatttaaaaataaaagacaaaagtaatataagctaaaattatagatattaatattaattttatttaaatataacaaagatttgccagtattcaaatgtctgcaattatccttaaaatgcacagaacctatgtttaggtatagtatcactgttcatccagccttcattcactctaatctactcttatctaaaatttgtagtgtaagtaaaattacattcggtatgacagaagacaaattacagtattagaacattatggaaaattggcataacattgtacaatcacccataactttattatttatcattttgtaacttttttattatattagtcaaaaaatctaactgtacttaatagctaatacatatattatttgattttttaaagactattattaaaataataataatttgggggtgagaaggcctattgaaaaatgaccaacatataaatcataaataagtttgatgcaacaaatatttgtaagtcttataggtaaaaatataaaaatttattctaaacaaagctaaaagacaataatatgcattgggaaatatttgcaacattcacttcaagggttgatgtccgtagagaatttttacaaattaataaacatttaaaaagttgaggagtggcaatagctatgagagataatttacaaacacataaaaaccaatattaaaactgtttaatctgtaagtacatcaataaaaattttattatagtagttattttatctattaaattagaaaaggtcaatacaactgataatctcccaagggaatatatgggagaagcgctttctcatacacttataatatattgttagaatgccattaaataaacatttggcaaaaatctatatcctctgtcaaaacaatttaagttctagatctctagaatccacatatacatatacatatatacatacacacacacacacacattcacacctatatatcaacaactcaaatccaactccaattctttcataagcagtattttgtccaacaaacaaatttatctaaaattcttcttggcttttctccattatagagccagcaattttgtgtagctctacctctaattccttcatttgcatttatttctgctttcaagcccttatatgaggcaaatgggattaatttatttcattatcttaactagattcattgctttaatttgtcaaactctgattgatttgctcaactcaatcttgtgtgttcaagaacttaatgtggatttctgttccacctcatgaaagtcttttccaaaaacttgctaaattcttgactcaagacattccagttagtaatgcatttctctgctcaaatacaatagaagtgtgctctaataaatactcttcaacaatgtgcagttatttctccccaactatcaattccccttaaagcagaattttactaaaaatggctttatccttctgggaataatcagtaaaatggcaattggagggtgaatttaaaatatactaaaagcagatggcagaacatgagtgcagatttttactacaaagcttaggaagaacaaaaggaacctgaatagagaaaatgcagaaaagctctccctgggctattaggatgtagagagcagaagtatgtttaggagcttcaaagagtctgtctctttgcaactgtttatcttaggactttaaggaaataaaaggtgcaagtgaaccactctggattataaaatagaatttcacacagaaaaatcaactcagttaatatgcatgttgcttacatggaaatgttgagaaatttttagcaaatagaaagtggtagatggtaggtatatataaaataattgcagaaaaaatgtgaaatgaagatgtatggtattacttttatatttaaattgttaatatgttgcccataatgctttatttcaaagaatgaaaaaccggaaaaatagttccttcctaacttcccctgcagccttgtcttgtggagcttgtattttacttcatgagaaatgccaaagatatgtcatttaagctgaaacctccagcagaattagccagaatatttgggaaaaagatgtttccagaaaaagagctagtataaatgtccttaagcaagacggagctcatgatgattgaggaacaacaacaacaaaaagattatttcacccaagaaaagtgaattgggagtacagatataaatgatgagatctgaatacgattcatggagcaggtcaaactaggatgtttgggtgtggtctaaatgaatgggtggcatgagttgttttaaggagaggagtgacatgatttgacaagttcttaagagatccctttgattactctggggagaatagaacataaagtagcagaaatgaaagcaaaggggagatagtgggaaataattgcacatttataagcaagagatgatgttggctgggactctgattatagcaacagatgaagaaaaaaggaaatactgagaatagttgattggatttgctgacattctcaacataaatggaaatcagtatttttttctaataaatatgatatgcataaatatttttaaatatttaattcttttaccaccagtggggcatgagtagacttcaggaaacatgccagtacagaaccatataaatgtgatcattggtagagataggctttaataggcatttgaatgtctccctcaacctggaataccacgaaaaaagcttttcgcttcgcatgttgcattattatcataccctatagctttctaccattttcagttacttaatattatgttttgcctcaataaataatagtactttctcttattgtattgtattgtatttgcagcaattattagtgaagttttacgtttcaatattacatctaaaacaaaacaaaattgtcccatactattttccattaaaacacgagatcactatgacaaaaaaagctaaaatgtcatgaaatgacttaaattggatgagagtatatgaaatacattaagaaataatctctgactctgtagtttttttatttgtaggttttactagaacatgaaatcaatatgtgaatcctggctggagtttgcatctaaatgtaataaaataaaatgaagtttaatattatcattgaaccattagtgtacattagtgagctggactatataaaataaactttattatatttagcatttgatttttatttatgtatattataaaatgaatatagtttatattataataaaaataaaagaagtagtatgttaactaattcgtataagatgcctacaaactacatacctgcctaaatttttgacctgtgaaacttcaatggtttgtgttagggcctacatttatatatgtacatgtgtagtgtatatatacatatatatatatatatatatatacacacacacacacacactatatatatttttgtgttatatatacacactatatacacactatatacacactatataggtttgtgttagggcctacatttatataggtacatgtgtagtgtgtgtatatatatatatatatatatacacacacactatatatatatatatacacacactatatatatatatacacacacacactatatatatatatacactatatatatatatacactatatatatatatataaaaatatatatatatatatttagggagggcattgttaatcctttaattttaaaaattttaactttgcagacaaagttgattatacctgtggcagaacaatgcatacagcaataaataaataaataacttttattttctgtggagctcccagaattatgaattattggatagattgagatttgccgaggtcattttcttagagttgcaagagcataggagaaagtcaagggaaataataagcagcacttgatttcctttaccacagaggatgggattctaaaaccaaattatctgactataaatcaagacctatcttttacaggctatgtgattgtggatgttacctcctctatgcttcaatttcctcatctgtaaaatggaattatagcctaccctattttgtagtatagtgaggataaattgagtgaatgtatgtagttcctagaatagagcatgacacatgataagtggtcaataaaatattgtttactactagttatgtgacagtcacttcacacatagtaatgatttaataaaggagcaagaagaatgtagagcacagcttctcaacatcggcactacgacattttgggtcagacaattatttaatgcagagggggccataggatgtttagcagtgtctctggccagtagtgtacctcctcctctccaagttttgacaattgcaaaggcttccagacattgacaaatattccctgaaaagtaaaattgtcccggcttgagaatcacaaatataaagtaaccactcaaagattacattactaattttgattgaatttgaccagcattatgaaatcaacataagcttaagtttctacacttgattttgtcattgtcagttagggcagcagagaactccagttctgaaaattctgagcatgtgctaatagcctataatataatcaaaactttcattttgaattgtatttcttaaaaaatagaaaacgtattaagcagcaacatggaataattaaccacaaaaatatggaacataaatctcatttgcctaatatctcttttgaagtcctgtttcactgtataagtattatgtgttttgtttcacagctagatacagccagttttttctctaagcctaaggttactcctcaaatttatggtggctttttgctcttctaagtttctataaaacttcagcaacctgcagcaggttgaaatttattgatatttagttattcaccaggccatatttacagtcagggattgacttacccaaaccagatgctccccctgccagcagatcactaggagatattgcaataatttccctggttactaaattagcaaaagattctcagggagagagaagggcaagatggcacagtttaatacttactattattcttttattctttaccatcattccttttgaatggattaagaatctgacatacacataacttactaacgaaagggagttaggtgagagggaagacatatttgtctaagaaaagtcttagagaaatattttgaaaagagatagaaagaagagttggattggagtgggtgggtagggaatcacagtaaggagatggatcattcacaatttctttagacatggtgaggcagccacaggaagtctgaacttgttgaaaccctaatccgaagccaaaaaaagtgctcaataaggtcatactttgatcacctctgcctaaagcagttattcacaccctacttttgggagaggaaacatctacaaacctttgttctctttgtttgttagcagagggatgacatgaatttgggaaaaaagtttgagagacagaatgagatttagctcaaacaaatgattgactcatgctgggttgaaaatgtgctctagccgtatgtagaaagctgaaactggatcccttccttacaccttatacaaaaattaattcaagatggattaaagacttaaatgttagacctaaaatcataaaaaccctagaagaaaacctaggcaataccattcaggacataggcatgggcaaggacttcatgtctaaagcaccaaaagcaatggcaacaaaagccaaaattgacaaatgggatctaattaaactacagagcttctgcacagcaaaagaaactaccatcagagtgaacaggcaacctacagaatgggagaaaagtttgcaatctacttatctgacaaagggctaatatccagaatctacgaagaactcaaacaaatttacaagaaaaaaacaaacccatcaaaaagtgggtgaaggatatgaacagacacttctcaaaagaagacatttatgcagtcaacagacacatgaaaaaatgctatcatcactggccatcagagaaatgcaactcaaaaccacaatgagataccttcgcataccagttagaatggcgatcattaaaaagtcaggaaacaacaggtgctggagaggatatggagaaataggaacacttttacactgttggtgggactgtaaactagttcaaccattgtggaagacagtgtggccattcctcagggatctagaactagaaataccatttgacccagctgtcccattactgggtatacacccaaaggattataaaacatgctgctataaagacacatgcacacatatgttcactgtggcattattcacaatagcaaagacttggaaccaacccacatgtccatcaatgatagaatggattaagaaactgtggcatatatacaccatggaatactatgcagccataaaaaatgatgagttcatgtcctttgtagggacatggatgaagctggtaaccatcattctgagcaaactatcacaaggactaaaaaccaaacaccacatgttctcactcataggtgggaattgaacaatgagaacacttggacacaggaaggggaacatcacacactggggcccgtcaagcggtggggggaggggggagggatagcattaggagatatacctaatgtaaatgatgagttaatgggtgaagcacaccaacatggcacatgtatatatatgtaacaaaccggcacgttgtgcacatgtaccctagaacttaaagtataataaaaaaaaaaaaaaaagaaaagaaaatgtgctttttcaacaggtaggttgaaaatgtgcttcagcatttaggataccagatgtaaacatccatgcatagaattagaaaggttcaactttcatggctgctatggtttgaatgctccctccaaaacttatgttgaaatttaatccaaaataggataatattgagaagtggactttttaaagaggggattggatcatgaaagttcctccctcatgagtggattaatccattcgtgagtggattaatgggttatcttgggaaggaaactggtggatatataagaaggggaagatagacctgagctagcatgttagcattctcagccctctcgccatatgataccctgtgctaccttgggactcttctgagagtccccacaagcaagaaggctctcaaaagatatgccccatcgaccttggatttccaagcctccttagctgtagaaaataaattcagttctgtataaattacttagctttggatatactgctataagtaacataaaatggactaagacaatggtcttatcctgaactttgtaaactagaattggctgtttagcttcagcatgtatttttttatagattcaaaataatttcattttgaattgcataatgaaggaatgtcataaggttttcagcatatagaggctctaaatatcagtctggcattgtgataaagcagagagtttaaaccaagtcctatttgtgacacatgacctttctttctggttacagctcagtaacataggaatggatacttaactcaaggataagcatataatacatgaggctttttttcaaaattttgatttagaaaatgaagtattctagtatgttaattatagacatttcaactgagaagtctaatagcattggaccagaatagtcacagcagtccaaagccatggataaacttaagttaaaggcaacaaataataagagccttccacattaatctctatcagagaagatgataaacaggtgaatggggactagaaaccatgcagctttagaactagacataaaacaaacagctatctaatgatttcctatttactatgagcccaagatattcttgtatcctctcagttaagctcctgttttactaaggaaatttaagtaagattctgtctcttgcaagaaaataacatctaagacatcttcgaatttaatgctgctttaattttgtttataccagtggtccccaacctctttggtaccagggattcattttgcggaatataatattttcatggacagggttggggggaaggtttcgggatgaaactgttccaccactcagatcatcaagcattacactctcataaggagcgtgcaacctagatcacttgcatgcacagttcacagtagagctggtgcttctatgataatcaaatgctgccagtgatctgacaggaggcagagcttaggagtaatgctcactcatccacctctcccatcctgctgtgtggcccagttcctaacaggccacggaacggtaccagtttgtggcctgggggttgggacccctgttttacactataacatttgcacacgtctctcatggcctgtctttcagatctgctgtttgtctcgactcaagtctagctacctgaaaattagattttttttttaaattgaatttgaatatcttaaagttgaatacacagtctccacttttacacggcccctactgtcttacatcatacctctctagccctggaagatagcaactttacattcacttttcctgttttagggctattattttatcttcagttatcaaaatctatctacttttaaatactttaacttgaaaatacatagtaagcaattatggattatttaaaatagttttcccatgagtataaaaaaaaaaagaatagcaaaagcaatatttgttgagtatttaaaagtgccaggcactgtgcaacatgctttgcttaagtaaatgtttgacaaaatagaaggtcttttaaaagttccatgttttaacgttaataaccatatcaagataaggttagatattctatcaaattaccatttttgtgaagataggccttttctgctatatagaatctcctcaaacctgagtgttcacattatggattatctagtatactccacagctatcaagtttgtttgtgtttctttctcaagtaagctatcttatttatcttatttctccttatttcttcagacttttcctctcatttctttctctttttctggttttttttttttttttttttttttttgagactgggtttcgctcttgttgcccaggctggagtacaatggcatgatctcggctcactgcaacctccgcctcctgggttcaattgattctcctgcctcagcttcttgcatagctgggattacaggcatgcaccatcacatccggctaactttgtatttttagtagagacggggtttctccttgttggtcacgcttgtattgaactcctgacctcaggtgatccgcccacctcagcctcccaaagtgctgggattacaggcgtgagccaccatgcctggcccctatcctctcatttctaaggaaatgacaaattaagtattttatgcaaatacagtgtagggtcatttaaaatattttttgtaatagatgtctctgtacataaatctatttaattttttcttttacaataaaaaggtattaatgtgttttagtttcaccaaaaatttcagtagaccaactgtgtaaaggtacacatttatatcaatttttttgacctagtaaaaactaaagagggaaagttattcaaatatttcagcataaattccctttccttgaaattgcaatcgtcatgtgtagctacaattgctcagtattactctgtagtatgagtagctacaattcctcagcataagaaacactgaagtagacaattgttaagaaaacaaagtcataacaaaacaacaaaaacaacaaaattaaaaactaggatatagaaacattaactaaatgttactcttgaagccgatataagagaaattattgtactagacactgtggttcatcatccagatcccatcttcatgggaacacatcaatcccacactcataggggatatcagcagctgaccattcacatctgtacctttcacgaaatattgccctaagacaaactaaaatgaactaacctgcccaaagcggtgtctcctttcggagagcatccattgactcatagctggctaatgtagtgatacaaagatgcaactgctttgcctcaatttgggacaactctgaaagatgcccagtaggactggctgaagactcagttcaaagttgtcaaataaagtaaaccatgcccagttgaatttacattgtttagtatgagtatgtcccatgaaatatttaggaattacataaactacacattattcatgatttatctgaaatttaaattcaaccaggcaacttgtaccttcacgtggtaaatctggcagcttttacttagttgcatctgcattgtaggtaagcatgtcggtatgcacagacctctcttccgtgcttccttacaagtgcgtcccagaaaacaagtattcatctcagagccaacgggcattgaggcattcgataatcatactcccaaaggtcaaggataaagaaaatatcccaaaagcagcaagagaacaaacaagcaaacacataacatacaatggagcttcagtatatctggcagcagattttcagtggaaaccttacagccaggagagggtggcatgacacatataaagtgctgaaggaaaaaataaaaaataaaaaacttttaccctacaatagtgtatccagtaaatatatcctttgagcatgaaagagaaataaagaccttcacagataaacaaaagctgaggaacttcatcaataccagacctatcaaagaaaaggttgttagtgagcaagaataaattatctgaggatacaaacctcactggtaatactaagcacacagaaaaacactgaacagtgtagcactgtaatggtgatttataaattactcttgacttaagtagaaagaataaatgataaatcaatccaaaataataactacaataacttttcaaaacatagacagtataataggacatcaagagaaagagcaataagttaaaaagcggggggagattttcaagtgtagaatttttattaggtttctttttggtgtttgtttgtttatgtaaccagtgtaaaattgtcatcagtctgaaataatggtttgtaagataatatttgcaagcattgtggtaacctcaaattgaaaaaattacagcagatacacaaaaaaaggaaaagaaagaaattaaatcctactgccaagaatatcacctccactattgtaagaaaggaagaaggaagtgaagaccacaaaatcatcagaaaacaaacagcaaaatggcaagagtaagtccacacttatcaatgataacttgtaatgtaaatggactaaatgcttcaatcataagacacagaatggctatggctgaatggatttaaaaaaaaagacaaattatctgttggctataagaaacatttctcctataaagacacacatcgactgaaagtaaaggcacggaaaaatatattctatgccaataaaaaccaacgaaagagcaggagtatctatactcatataagacaaaatggatttctcgacaaaaactgtaagaagagaaaaagaaggtaattatataatgataaaagaagccaattcagcaagaggataaaatgattgtaaatatatgtgtacccaatactggaacacccagatataccaagcaaatattattagcgataaagagagatatagaccccaatacaacaatagttggagacttcaacaccctactttctgcattggacagatctaagacagaaaatcaggaaagagacattagacataatctgcactatggacaacaaggatctaatagatatttacagaacatttcattcaatagctgcaaaatacactttttccttcttctcctttttttttttttttttttttttaaagacagagcctggctctctcacccaggctggagtgcaactgtgtgatctcggctcactgcagcctccaccttctgggttcaagtgattctcctgcctcaaccttctgcttagctgggattacaggcatgtgccaccatgcccaactaatttttgtatttttagtagagaccgggtttcaccatgttggtcaggtggtcttgaactcctgaccttaggtgatccgccagcctcagcctaccaaagtgtttggattacaggcgtgagccaccacacccggccaaaatacacatttttctcttcagcacatggaacattctcaaggatagaacatgtgttagatcacaaaacaagtcttaaaacattcaaaaaaattgaaatatcaagcatcttatctaaccacaatggaataaaactagaaatcaataaaaaattaattttggaaatttaaaatatatgctcttgaatgaccatccagtgtttcagtgaaaaagttaagaaggaagttcaaaaagatccaaaacctatgatataacaaaagcagtactgagagaaatttatagcaataagtgcctacatcaaaaaagaagaaaatttcaaaataaataatcaaaagatgcatcttataaacctggaaaagcaagagcaaaccaaacgcaaaattacttgtagaagaaaataaataataaagacaagagcagaaaaaaaaattccaatgaagaaaacaatacaaaagaataatgaaataaaaagtttgtttgttgaaaaaataaacaaaatggacaaacttttaaccagctcacttagcaaaaaggagaagacccaaataaataaaagtggagatgaaaagggagacattacaactcataccacagaaattcaaaggataactactggctactatgaacaactatataccaataaaatggaaaatctagaggaaatggataagttcctagacacatacaagctaccagaatagacgcaagaagaaataaaaaaactgaacaaccaataacaagtaacaagattaaagctgtaataaaaactatcccggtaaagaaaagcccaggacccaatagcttcactgctgaattctaccacacatttaaagaactaataccaattctactcaaactattctgaaaaataaaacaagacagaatacttcaaaactcattctatgaggccagtattatcctgatatcaaaatcagacaaagacataaaaaaaaactataggccaaaatttctgatgaaataaatatcattgcaaaaatcttcaacaaaatactagctaaccaaattcaacaatacattaaaaagattattgaatatgacaagtgagatttatcccaggtatgcaaggaaatctcaacatatgcacatcaatcagtgtgatacagcatatcaacagaatgaagggcaaaaactgtatgataaattccattgatgttgtaaaagtatttgataatgttcaacaacctttcatgataaaatgtctcaacaaactgtgtttagaaggaactaacctcaacacaataaaagctatatataacagacccacagctagtattatactgaatggggaaaacctgaaagcctttcctcttatatctggatcatggcaaggatggccactttcattactgttgtttaacacagtacagaatgtcctaggcagagcaatcagacaagagaaagaaacaaagagcaccccaactggaaagaaataagtcaaattatccttgattgtagatgttataaccttacatttggaaaaacctacagactctatcaaaaatctattagaactgataaacaaattcaggaaagttgcaggatacaaaatcaatataaaaataaaaaattttagaaataaaaaattcaacacatttacaatagccacaaataaaataatatacctaagaattagccaaagaagcaaaagatctctagaatgaaaactacaaaagactgatgaaagaatttaaagcatacaaagaataaaatggaaagatattccatgttcataggttggaagaataaatattattaaaatgtccatagtacccacagcaattcacagattcaatacaatctatatcaaaataccaatgacattactcacaaaaatagaaaaaaattctaaaatgtatgtggaatcataaaacacccagaagaaccaaagctatcaaaaaaagaaacaaacaaacaaaaaaaacctggagaaatcacattacctggcttcaaattacactgcagtgctacaataatcaaagcagcatggtctgggcatacaaacagacacatggactaatgaagcagaatagagaacccagaaacaaatccacacatctatagtgaagttattttcaatgaagatgccaaaaacatacattggggaaaagatagtctctttaaaatatggcgctgggaaaactggatatccatatgcagaagaatgaaacttgacccctatctactgccatataggaaaatcacatcaaagtggattaaagactgaaatctaagacttcaaactatgaaactactacaaaaaattgaagaaactctgcaggacattggtctgagcaaaagttccctgagtaataccctacaagcacagaaaaccaaagcaaaaatggaaacatgaaatcacatcaagttaaaaatcttctgcacagcaaaggaaaaaatcaacaaattgaactgacaatccacagaatgatagaaaatatttgcaaactaaccatctgacaaagtattaataaccagaatatataacaagctcaaacaactatataggaaaattgataacccagttaaaattggcaaatatcaaatagacatttctcaaaagaagacatacaaatagcaaacgggaacatgaggaggtgctaaacatcactgaccaccagagaaatgtaaatcaaaacaacaatgagatatcatcttacaccagttaaaatagttttatccaaaaaacaggcactaatgaatgctggagaggatgtggagaaaagggaatcctcttacactgtgggtgggaatgtaaattagtacaactactatggagagcagtttagaggttcctcagaaaactaaaaatagagccaccacatgacccagaaattcaaattttaggtataaacacaaaagaaagaaaatcagtatatcagatatatctgcactcccttgtttggccagcactgttcacaaaagccaagatttggaggcaaagtgtccatcaataggtaactacatttaaaaaatgtggttcttatatacaatggagtactattcagccataaaaaatgagattctgtcatttgcaacaacatggatggaactagagctcattatgctaagtgaaataagccaggcacagtaagacaagcataacatgttctcacttatttgtgggatctaaaacttaaaacaactgaactcacagagatagagagtagaagccttggaagggtagttgggggtggagggaggtggttaatggatataaaaattagtaagaaagaagcaacaaaacctagtatttggtagctcaacagagggactatagtcaacaataatttaattgtaaatttaaaaataactaaaaaagtgtattggactgtttgtaacacaaaggataaatgcttgaggggatggagactcaatttttcatgaggtgatttttacatattacatgcccgtatcaaagcatctcacataccccataaatatatacacctattatgtacccaaaaatattaaaatttaaaaatatttaaaaatttacttgtaaaacagcctcaggccaatctttcaggagatattgcacaagaaggcattgttattataggagacaacagctccatgtgtgctattgccccaaacacctttcattgggacgagacgtggacgtggaagacagcgatatagatccacatcttgtgtagccctaggctaaaatgtgtttaacaaaaaaatttaaatgttaaaaagtatacatttaacaaaataaaaaacttatagaacaaggatataaagaaagaaaatatttttgtgcaggtgtacaatgtgtgccttaagctaaatgttattacaaaagagtcaacaagttaaataaaagtttattaagtaaagatacagtaagctaagattaattactgaagaaaaaattaataaatttattgtgatgaagtgtacagtgtttataaagtctacagtaatgtacagtaatgtcctaggccttcacatttagtcacttctcattcactgactcacccagagtaacttccattcctgtaagctccattaattgtaagtgccttgcattggtgtaccactgcttactatttatacagtatttttatcataacttttccatgtttagataatcaaatattttccattgtgttatagttggctacaatttccagtacagtaacatgctgtgcagacttgtagcctaggagaaataagctataccatatagcagaggtgtgtagcaggctataacatctaggtttgtgtaagtaagtacagccaatcatgttcacacaatgacaaaatcacctaatgcatttcttagaaactatgcctatcatcaatcaaggcatgactgtatatcagaccactttacttatccaaaatgagccttgtgacaaattcactctctagaacaaaattggatgatgaattagtaaaaagaatcccttaacacaaaaattatgacattttcttacatcttttactttgttagaccaagaatagaagacttttcttctcactagtaactgcaatcaattggtatgacttggagtaccaggtatatcactcttggcaacacatctatttttagtaggacaaaactgatgtgaaaaactgaaaatctcttcaataagagcattgaaactaggaaaggggtttagtgagatttagtatatgtatttatttacttctctgtggtttttaaacttatcttacttcctctttttaaaactctgtcagatttatcactgatttcagaattacaatctttaccatagactacaaatccctgagtagttatgtgatttcctcccttctatcttcccagtccatctcataccatacatttattggtcttctatgtcctagacacaccagccttttaagaggactctttattaatcacaaagatgttgaacagatgattctgacagcctggaattttctctctccacttttctttttcttttacctaggttgaattcattgtttagatctcaactgaaatattccttctttgtggaagcttcaccacatgacccagattatgctaggtctcataacatgctggggccttctcaatattgtgattaaccatgagcatgatgtattttgcctggactatattgcagacaaagggcggactgcaaatgcagctgccgaacaaatatctgtggaaagaaaaaatgattccttattttagacctctactctgtctcattagcattaaatgtcacacaagtcttccaagcttatttatctgattttccaacctgagataaaatagaagcagctaatagatacacagcacagtggaaaggcaatattagaaataggttcagcaggacaggcgcggtggctcacgcctgtaatttcagcactttgggaggctgagaagggcggatcacgagatcaggaaatcgagaccatcctggctaacacggtgaaaccccatttctactaaagacacaaaaaattagccggtcgtggtggcgggcgcctgtagtcccagctactcgggaggctgaggcaggagaatggcgtgaacccgggaagcagagcttgcagggagccgagatcgtgccactgcactccagcctgggcaacagagcgagactccatcttaaaaaaatgaaagaaagaaaagaaaagaaaagaagaggagaggagaggagaggagaggagaggagagagagagagagagagaaaagaaagaaagaaagaaagaaggaaggaaggagggaaggagggaaggagggaaggaaggaaagaaggaaagaaagaaagaaaaagaaagaaagaaaggaaggaagaaaggaaggaaggaagaaggaaagaagttcagcaatggaaaagaaagtaagtcataaaagtgaattagaatgcaaagtcaaagaacacatccacatttaatgggtttttttttgtttgtgtttttgaaaatttaattgaagaaagtaaagttaccctggcttataataaagttagatattataacaaaagataagtcagtgaccttaatatgcaatgtgttttggtttactcatcagataaaatatgttattaatgaacaaaataaaaaaatctaaaaaaggaacatgtagagaaacctagagcttagcagtatagttctctgaaatattaataagttaagaaatatacaccaatgagaaatgacttcagaagtttcactccaagggccattatagctctggaaattcttaaaggattcattaaattttcaagcacagaaatttgttcatttaattgatttttatatatgctttttaccccttttgttagttctgatcatccttaacctacacaccaaatatgctacaattaaaaagagaaagctcataatattttaatccccaaacataaaaactgaatttattaagtacctactaaagtctagaaactttgttacacataccacataattttataactaaatatgtaacatcacaaaatcgagattcaaaatctaacattggtggaaaatgcaaagcatgagtttaataagatattaaccaaaatgcacacctctgtctctgctataactacctcacctctggtttgcactagacttgggttgccacttgatccatagagaaccgttattaaaaacaaaccagagagtaattatgtcaaaactcacaaagccctgatttaaatcatgagaaatctgaataaagcctcccttgtcacacctgtctaattagcacggactctaaattgaggaggggagccctaaaaaggaattttgttgtagctgtaaaaatgtatactctttaccagcagttacaaaaacaaataatcttcatttgaagcaagctctccaatttttcaccaggatagtgaatgagcaaagctacatatatcctgcagagttgctagacacacaaagcaaaggatataggtattacactaattaacaacaatgggacaaatcattaaacatcaagtagaacattcagccaagatgatgaacaaattatctgtaagctaagattaatttgttactgaagaaaaaaattaataaatttagtgtgatgaagtgtacagtgtttataaagtctatagcaatgtacagccatatcctaggctattaaatgttataagtattagtagtagcagtattggtagtattatcctcttttcaaattttaaccacagagcttacatatgtataatgataacatgataaataggaatcagtttttacattggttttgatggttcacactgtctcaactcatggtatcttgttagcaaaagtgcctctattgtccagttaggcctgattttagtctggcatacaattaaatctaatatgtggatgcacataaacagtttgattagatttttggggaagtaggtttctgcagacatgagccactgcttgaatatgcaatatactaatccaatcaatcaccttgatacatttagttgttttatttttataattctctataacaggtttatcagtcaaatttattggttatacttattggtgtaaatgaagaaatactttttttgttccctctcatcactacctttaaatatgctcgttggaatctctttttcccatcacttgagaataactccagccaatctccagctatctagcaatttccaaacacactttcaataaaattgaaagacaataaatctatttttggtaaatttgacttactttcaggttttaaaaaggtctagttgcatgtaaattaaaactacaattttgcaaccaaattaaaacattttccctacctgttcctcacctagctcagaattgatatgtaacaggaagacctgtggttgtttatccagatgtccttcttttgtctatggctccattaggattgtaatggggaaaacaagaatcatagcaggaagaattaaaagaaaagagaaaagctttttttttttttttttttttttaaataatctcatctttatttctattgagaggcaggcacccaaatgcttcttctgtcggggagtgaatttgtaagttctttgtaactctgtgctacctatttgttaacctgagtaatttgttctcctgctcacttcttgctaacacttgccagcggatacctgaagcctcttacatcttctgtggcatgcacttggcctatatatagcatattcattcacctaaagtgggaagaataatctggcatcttttctctttccccatcttgccatcaaaagctgcctcaacgagcatgtagccttcagaattttgaaagccagaagcaggtaacaacttgccatgtttagcttcatcttgaaactcttgaggacacctatcaaactttcccaaaactgtctcatcatgtatggttccattgcaggatgggtgcaatgctgagtgccagcaggggaggaatatcccattctttccttcttgaaattgcccccagtctttttgagctctcttcctatttggaaggagaactaaagcaagtttagttctcctcacaaaagagaaaataattgaaagcactctcacttaggcagctaattcactgtctatatgataattcttagaatgcctagtcctctctttacataagagcacaggtaattgaggtcaatgaaggttgtagagtcacagaacttgtctggctactttttattaaatcctgcaaagacttaactattcttctgtaatttagggataccggtcatttaatagggaataaacaaaaatctgagacataaggaaattctgtatccattctatatatgtataaattatatatagaaaaatagtttagaagagttaatatcaatttgaaaataggaattttaaagctgtgaataatacatagcataaatatgtataaggattcagcaaaatgttagttgacatgtggctaaataaacttaaagtttaagaaagataagaaaagaaaccaaatatgcataaatctggggacaaaatttgatattgctgctaataaaaaggggaggggcatcatattgggaagcttcattaataaaagtaacaaattatgagaacaaatagtcttattatagtttatctggtgaagcattttaatgaggcgtagttgtctgttccattacggaaagagttttcttatgtgtgctctggtagattttcatgtggccacactgaaagatactcccaaatgtctgactaataattctatttataggcaactgttctgaaggtttaaagtaaggaggatgaagttcatttggaagcagtggggaaaaaaatggtaatgctgggctttgaattttatggatgctgtagctgttctttatttttcaataaataaatgttttaaatgccatgttttttagctattgcagttaaactgccctcatctttttgcccagcaaaaaacccattaagttattcactgagattgactctagattttttataaaattaataactttgctaccagtttctcaaaaatgagtagaaacgacttttcaatgcaaatgccagtttttgctacagtgaaattattctgtctgtagtgactatttgaacatttatgggcaataggacattgagagatttagtatatgaactacgaatagatttatccttagattatctaatacatgttttccaccttgcaacataaaacctgatctctttttaaagtcctggttgttctgaaaaatgaaatgaaattatagtaaatggaattttgactggggggaaaaaaacttcacatgatttaagagaatggatgctggcaattgactatctactgtttattcaaagcttatagattagcaaccagatgtggcagaaagttggctgtttttcattcacaacaaaaacgatgctgtgcttaatgaacggaggtttgttatcccagtaataagtaaaaggaacatgaaagcccttgtgtttaatgcttatgcaaataagctatttgcaggtggcttttgggcagaaggtaaaatagtttcaaaactgggtcaagttttttaatcctcaaaaattgccagctagaggaaaacctcctaaaatctttattatgctatttgccaagtaaatgaaatgacatcatttatcatttaataaattacatatgaaaattcttttccttatgatttcatcaatcaacaaataaattctagaggattctagatacatttatttggcatattttttaatgcggtatcaaattttgtggatattcttttagagaatcaatttcttaaaatggcattgaacatttaatttaaaatgcccttcttgaaccatacatgtttattagaaaattattttatataggttgtccattaaaaaacaattttctatgtatgtaaacatttatgataactgctcaatattttggtccatatttatttatctacctatttattacacaatacaaatattacactttgtaaaattaaaggcctagtctaatattactctatgtcggaagtaaaataattcagagaagtctatattaaaagacaagataaaacacaaaatgatgagaatcacaaaaccattgccaaattttcagctatgacatttattctccatgtggccttaggtatcttactctcttattttaacctttgatgactataaaaataatttgttactaagaagccctctcgctttagtagctgtgactataaaattaagaacataattcacaaaaagtgtttgagtcttcctgaaaacattttaaaatatcaattaatcattgcacaatacacaatcgcctgatcatttgctaaaagagggttgcattctcatctctgttcactctgtcctttctgagactcatataggtgtgagagctagaaaaaatattaatgtgtagcaattcagattttctcattgatgaatcacttcagcagtgcacagaatactttgtaattttaaaaaggtgtttttattaatatacttctactattctaccccaatcaacagcaaatttacctaaatcatgagactgctggaactgctaagttttataaataaaagacttaagaactactattaaaccctgtgaatcctttatctacaatgagaatgtccatgagtcagctcttctgaccctctggccagtgttctggagttactgatctgcaactttctaattgaactctagcttggtatgtgagagcagctgtgggttaaccagcggggcgacatttaagtcttgacattgccattaatgattcaccacctgttgcaagttcaataagttattcacacaccaaattgtggccacagaattcattgagataaactaagttagaaggattgggtgtcaataaatgtttgctaaatcagaattgttaatgatagaaatccgtagcttaacaaagttgagaaatcttgtcttcttaacgtgtatttattgacttcccaggatatgtcttagtgaggaaacatagcttctggcatttattattagagggataaggaataataaaccacagtgattgagagacagggaaaggccgggggacctagagacacagtaacagaagaagtttaattggctaatgaaataaacttgagataagagagcagagaggaggttcaagagatgaaaccacatattcctctctatctgctcccaccatcaagggaattaataacatattttataatgaatccctgataaatattagtgtataattgaaaatctattaaaatgactatttctcagggtgcagaaaaatattaaaacaagtaaagttgccataagatggaatattatattttcctgcatgtctgcttcaaggctgaatcctaatggtcatgtatgtaggtaaattattcttcctacagcaacttctgggaggtggtatgtggtggggtataaaaggccaggggtgtagtgagggtaaagtgtaagtactttgatcttgagccttgactatattggacttgggatctcagaaatcttggggataaaccgtggattaaatccataaattcataaagtgttggttatacaacgggtagaaactacgtgccacttttggagggacagtctcctttttttttaaaaaaaaaaaaggccttaaaggctatatatatatatatatatatatatatatatatatatatatatatacagtcttttttattataataaatactattttgttttttttaaatgaaacaatctgcacatatacaactccactctgaaggcaattatttacataattatgcataaattcctatagttatgttagtagttgcctttcttcagagtggagtcatatatgtgcagattgtttcattttaagaaaagaaatatttatttatttgattaactgaaattatgcttaaaaatgattaaaatgcacagatctgtcttcatgaagtttaaatgtcttataagaaattaaagtaataaagactacaacatttattatttaactgtaactgtagtgggtagtaaaagagaaagcccagtgtgttggctttcagtagtaaaaaacccaacttgtggttaggaaacgccattgtttattgtatctaaattaatcaagttgtatcctgtaacaggtttcctgttatccactcgtcttccaacttctgaagtatgctttaaatgacaagggagaaacccagacactacattttctaggatctcagcacaacagagctccaggtgaaattatgctaaatagtggcatgagcgtgagatgtgggtggcataaagaagaggtttagagtgtttttctggtgacctcctgtttaagtttgacaagcatctgaaatcactgctagcaactttcccataattattgtgtttccagcctttatgaaaatagcagcaattttttttcctttctttgcctatgtacaccatctaatcatgagataagtctccttcttagtccctatattaaatatctttttacatgaaatacatagattgggatctttttctgacctgttcctgtctgacatattcttcaactctaagatgagttcatactcatcttcggaagcccctgggaaatgggaagttttttttcatattagatgttggtagatatagaggcccatcctttaataaacatctatgtgccagaaaatgtactaggcacttagatacattattcatgtaactctacacaaatgtatcaacaacacaaaaaaaaatctgtataaaataataattattatatcccttatatggaaacagatccagagaggaagatacactagcacctgtaaatagaggatccaagaattaaacatccatctgtcggactgactacaagctctttctttttcataaaatgctaatttctctcctgcttctaatatttgtatcaaaatttgtcatctattgttattgggtttataggtgggtagtgactccttggcttctattttgttctagtggattactgtcttctttattttcattctagtgtttattgagagtcctaattaatcaacctggctgctctgacttccatcagctcaccattgtctcttttcccagctcataatttctgtaacagagctctaagctatgctaaacttctgctatatgctgtcagcctctctaaatccaagtgctcttatctgccaagtttacatacacatgtttaaaatcttcttattgaatctacatacaaagtcttcatgtcttcctccttgaaataatagcattgtgagagaaaaaaaatcttcattctttttaaaactaattcagaatgtctaggtaacacaagaacactctgcaacaaacaagaggtaagggaatatttacctggtatttctgtgcctcattatcattctcactcattataaaattggtatctgaaaaaaatcttgctgtaaaaacaaaaagtaatgtatagagagtataaacaaagagtttgcttcacatcataaccattatgcatcccattgccaaagggaagatagtacactacatgattccggggaggagcatcattcacatagactatagtgtgcatggcacatgcaagagaccccacagtactacccgctttgttctctttgtagacacactcacggatgattcatactccctgacctggagtagccaaataaagagttgcatcagtttattatcattctttccagaccactttctaggtattcccattatacattccttcaaatagaaagattttattctgtaaattgcatcgcactgtacacatttttttctgaaatctgaataatttcatacagtttcaactgtgagagtacctgacagactgacctaactctaagctaaaacactcataaactagcacagaagcttgtcatatcattacacatttatccattgctctaaattacttatagtttttcctgaaacatctattaatattgcagttatttgagatgactgtgagcttactatttgccagtgatgacatgagcaccttggtttagtctagtgcctggcatttaataggaccattctatttattttcctaaactctggcagcaagattagctctaagcatatttttttatcacaacaatcgtccatctttaactacatgtgaggaaagcactttcttatattgcattacacatttttatatggccacagaaatccttacttaatctgacaaaattaagataaatttctttctcctaagttcaaggaaagaatcattctctactgtttccaaggagatgattctccttttctcaattgccaattgtctactgcttgtcctgggttccatcttttcatatgtcatgaggattctcaccccagtgttctgctcctctgagtcaaagcccttgacttttcacttctcaattgttttgtttgtaatttttttgcttttatttttttctccataaatgctatgaaagtgtatgtaaaaatttacccatcttttattttatatttgttatcacattttattcacataccaaactatacaggaaatgaatataagcacatctttcttagtaggaggtagaagtaaaattttgtttagaataaaaacagaaaaaaagagaatccaattccatatcaccagtttgctcctgaatgtgcaataagtttccacttatgagcttgctactgtacacaacgcaagagcttttaaaaaattgtctacatgatagtggttaagagcgtactttaggctaggttactttaaaaaaatatgtcatcattacttctgccatcaaaagctaattcaatgtatcataattgttaaagttgagtagggttaaggattcttctcattctatggtttccttataaacacagtttctaataaatgtctatttttttctgtgaaattaaaccactagatattgctgaatgtctgtatatttcttacatttctagaatctcattcttaatttttttcttatatttttccttcaccaaagtcttaaaacctatgcacctggtgtctattatttaaattctgtgatgtattttatttgactttatttgtgtttttagtcttttcacagaaattagtttattgtgatcttcttttccaaaaggacttaattcatatctcttttccatacctatcttcattagcaggttgcatttcagtttcttcagtgcttttttagataatatattttactacatctttcttcacaacactgtatatgctctgatgatcaggtctctcattttttttaagttcttgtcccctttgggacccatgacaaagtaaagggcagattttttctcacctggcttaaaagtaaaaagccttcatatgtttctcctctgattcttcttaggcccagcatttccaaaaacaaactagtacacaaaacattagagttgcaatgatacttcaaaaggttcaaatactaatttttgtctgctttctctctatagttttcttgtagagaaattttctgttatgaaggttgaactatttgctatatgttaatattttccaaataaagtttccaaactgatatttaaatacattctctcatattcaaacatattctgaactactttctgttgtgtctctagatcaatatttataaaactagacagttcatataatttttttcctttgctaactttcaagatcatatcaaaaagtactactgttgattcggttttttgtgtttcattatttgaaactgtattgacctttttcctcttatttctttatcatttcctgttatttcatctttgtgagtcttcccattaatgtctttttctttttgaattatttattttttaattgacaaataaactgtatatatttaagatgtaccacatgatgtcttaaagtatacatacattgtggaatggctaaatcaagctctttaatgtatgcatatttaatatatgcattaccttgtaattgggccccttgagattttagtatctcagcatttttagtgcctgagatttaaaaaagtcggattaggctcttgcttgcttgcacaaaagccaacatcccttgttctcacaatacaattgcaaactgctgatgtactgtttctttgtcaagcaggagaagataacttcaaggtaacaaaaaacattcgcagaaggaaagaatgcctataagattgttgcaactaactgttgagacccagaagtctggttgctcaggatgttatcagagattaaagaaacacaaacttccccattggttccctaaaactccccctctcttactctctggctgcaaacaaacctctctgctttctcttattgttaagacatatctgacagatcttgccccgttctcgctttggccaagtggaataaacttttatctatctctaagcgttggtgtgtcagtgtttggtttcgactgagcatctggtacatgagcctgaatttgggtctctacaacatcttcacctagttactatttttgtgtgtgtgtggtgagaatacttgaaatctactccattggcaattttcaaatataaatgtattgttattcactgtagtcaccatgatgtgcaatcaattttttgaacttattcctcctggctaactggaattttgtgtcttttgaccaacatctccgcaatttcccccatgccctagcttctgatgatgaccaattaactctctgtttctatgagttttacttatttaaactctacatataagtgagattatgtcatgtttgtttttaagtgcctggcttatttcacttgacataaagtctcccaggttcatacgtgttgttgcacatgacaggatttctttcctttttaaggcccattaaccttttgtagatctgttactgaggtaatcaaagcttactggacaattatgttatttgagtaaattgaaacataacagcttataaagggtcaaatggtagtaatagcctaagaaataggtttggaatattatttcttagcataaaagacaaagataatattggtcagagtcttctaggcttgaattcttggctacttagattttatcaagtaaattgtaaaaggataaccaatcaatatttcacatgtatttctgtatgaattttgatttgacaagaaagactgtgaaaacaaaaccactattatctgtgaactacctaatgtggaaataaatatccttaaataaaaccttgagaaagtatattactcaattttttttctacagatatcccatatgttataatatttaactgaaaacaaaatctttcttcttaagaaaagattttattcagttttagaacgttaaagtttctccactctaatatatacagaacttctctaacctttaaaaatactgctttgcttattactcatgataattgggccacatacataattaaaacacaccatttattattttgccatgtgaaagtggcatctggttccccaacttgacttcaaactgtaattttaaacaaataataaagtgttttgaaacattaatgtcattaattgtcttatctattgtctatgttcatcaggagctgtgacatgcccaaaggaaggtaatcagaggaaggaagagaagaagctaagttctagagaatccattaatcattccttagatgactgaccattttattattttcccaagtaagctgaggctgacaatatcatgaatcatttacatatatcagtattcaaatgttccatttttaaattgggagggggtatgttttagaatagaataatgaaattccctccatctcctcctaatgtacatcattaagaagaatctaatggaaacataaggttctaaggctcttgttggaaaccataatcagaactggaggaattctcttatggaaaacattaaaaaaaggaaattctagcaatagaattcattgttaaagctgtaagttacaacaatattgtctctgcatgctgactgtaatcctctataatcttcaaaggcaaacaggaacagtaataatcttttcatgtactcttaacttccttctctgaaaggctagaaaatgtcttacatgtagcactcatagtgtcatttaatcaaacccagtttctatttttcttcaacttctagatgaatggatgcttagtctttcgggcacaatgtgaatttcttaagggtctgtagactacatctcctatttttacttctcaaagtttctctcaaattgtgataaaaagtttcactctattggtactgttaactgccaaccactttgaaggcctcctcctccacttttttctttttccccatatctaggcaagcagtaagaaaactcagagtctctattccttggctacggcagggaagttcaaaccatttaaatcctgaactattggggctgagggtaagggactcacttgggcccaacccttaaccccattaaataccagaactccactgactcttccttaggtttcacttcccactgaacctgagccctttttgttgtggattattttgccctttagtaggtaataataccatgtaagtaataaatttgtttcatttcctttcagtcttgatatccataaattactaggggcaggggtggtgtagagttgcctagtattcaccaaataaagtaaaaacaacacacacactgagagaaaaatctagagaaacattcccacattgccacacacagttttcttgcttgcttctggtaaatataaccttctctatccatgagttcaattaacaactttggataggaaatattcataaggaaaaatggatggctgcatgaaaggagagtgttctacctgactttattcactaatcaggatatgcctaaaaactgggtggcaaaaactgaactgtaggttttgagaaagattctaataacaagaaaaatgtacaaacatttttattgttgtttatccctaagcaagacagcataacaactatttatacaacatttacattgcattaagtattacaagtaatctaaaatggatttaaaatatatgagagaatataagtaggttatatgcaaatactaggccattttattaaaggacttgagcatctggagattttggtatctgttgggggatgggaggtagggcggcaggtcctggaatccatcccccatggatactgagagacaaacatacatagaagctacaaaagcaaattacttatttcgcctcttgctgttgacttaaggaaaactatgcactgtatcatcagtatagagagttcttgaaaagcctagatcctcccaaagtttgaataggtgttgcaaatagcgagatgtggtgatagctcaaatagagaacctctcgggaaaaccatttccacatttagaagcaagtttgaagtggcagatgactattccttttttataaatatatatatatatatatatatatatattatactttaagttctagggtacatgtgcacaacatgcaggtttgttacatatgcatacatgtgccatgttggtgtgctgcacccattaactcgtcatttacattactttttctactgaaaatattttcttggcttcctgtcaagtaatgtgagttgcaaaaggcattgaagattggaccaactaatgaaatggaatcaggacatggtttcataaaataagagtgtttttttgtaattatttatagtttcttcctttttttatttttttaacttatttatattccaaatacggtttgtcatttagctcaactttttattttgccccacatatcttcttacggcttcttggtttaataggataataaaatttctaaagcaggctggtctatggcttccttaaattaaccctgcctcttctcttacaaaagttactaaaggcaaatataaataatcatgaccaacatataaagatatgaatgagatttacagagaataactttactcagttatatagcgttacccacaaagggaatttactagcttcaattgaaaaaaaaatcccatgacacctatgatatttacttctgtcatctccacattcaaaagaaaacaaacagattacccacatatttaatcactttttattttacaaatgctctgtaaacaaaatgcttctcagacctattcaatacaattaaaatataacatagctttgccaaaaggtgtattccaaagttatcagttagatttattaactgataaagattagcaatttaatgtgaatgttttctttagtgaatatacagaattctctcaaagttaaattattaaaaacatacctaaattcacctaactcaaaaatgtagtattcttatactcaatatctgcacattctcacatatacaaaaatataatctaaatgttatttttaacaatataaaatttgtttctctctttgttattgccaagattgcactgactgttgaaatataaaagaaaaacagcattaaatcaggtgtgataaaatcacctttttctgtttatcttcactactggcatttattggcacttggaaactatttataaactcatattcttattgctaacatcaattattatgcaaatacttgaaatttttactgacttcataaataatgcatgaaagtctatagacttcaactagtgagcattatcttttgtggtttataaatacagaatacagaataaggtatagtttggatgagtctgaacaacagatgtttctgctttatgaattctggtcaaatcatttggaaagagttttgtttatacaataagcatctgcgttttggaaagttaaactaaaaattattttgtcattttctctaatagcttgggacctacataaatctgttaagttgaccttaaatagaactgaaggtgatagtagaggtatttaaaacaagtttggatagtttttacacatgtaaatctataacatacatttaccaaaatctaatatttaagaattaatggaaattatacagttattccaactctaaagttttatgacacaaatatattacttagatagtatcttcacattaattttgtttaaaaatctccattatgctttagaggggatttcagtgagaatatatataccccatcatattttatcaagctgaaaactgattatgcaactttttgtaagtacagagcaagtttaatccatttaactcatgccagacttcaggcatttaagaataactatcaagtattcctttaagaatttttctttacaggctagtcatccttacttccttcaagtaattgttaatttgcttgatgccaggagctctaaattatgtagaattcattttactaatttccattataatatatatttcgtatatatcatttgcttcctcaaaacccacagttcagtttttgccacccagttctgaggcatattctgattagtgaagaaaagcaggtagaaaactcttttactaaaaataaccaaaacatagttgggaggaggtgcttagggcatacatttttgaccttgtttacctcttagccaatactaagtgctttcacatataatcctataaaatgcttctcctccatgctacacttgaataatcaaaattttgaggttatatatatataatttcacaattgcctttttctttctctattcaacaaattctaccccttagacactggctttctctgtttcttctgtggtagttgatagaattttacctatatttatgctaataaatcaattatccagctatattttgcacaggggtcctgctaatcttcttgaattcttccaattttagtatacgtgctgccaaagcaagtgccagctatttttgaagaactgatatgtactcctaagaacacaagataaagagaatcctaggactaaagttggtaagccagttttttttttccatttcctattctttctttttacttctcgtcttccattctagagctgattcacaggaatccttcaaacacttcttggataggtctttctggagtcccttcaaaagttcctgtttatagatgcacataagatatgagagggtctgaattcttcatgagtccatctcttttgttggaactcaagaaaagagactagactggagagtagaactagattttttgagtcatgtgtaaataatgactacaccgcatgtacacatttagatgctgtccccagttcaagagttctgtccactgtcaaaattcatgtccacctggaacctcagaatgtgagcttgtttgtaaatcagtttttgcagatgtaactagttaagatgaggtcgtactggagtagagtaggccctaaatccaatcactagtgtctctataaggaacacttttacactgttggtgcgactgtaaactagttcaagggttgtggaggtcagtgtggcgattcttcagggatctagaactagaaataccatttgacccagccatcccattactgggtatatacccaaaggattacaaaacatgctgctataaagacacatgcacatgtatgtttatcacggcactattcacaatagcaaagacttggaaccaacccaaatgtccaacaatgatagactggatgaagaaaatgtggcacatatacaccatggaatactatgcagccataaaaatgatgaattcatatcctttgtagggacatggatgaagctggaaaccatcatcctcagcaaactatcgcaaggacaaaaaaccaaacaccgcatgttctcactcataggtgggaattgaacaatgagaacacatggacacaggaaggggaacatcacacaccagggcctgttgtggggttaggggagggggtagggatagcattaggagatatacctaatgttaaatgacgagttaatgggtgcagcacaccaacatggcacatgtatacatatgtaacaaacctgtacgttgtgcacatgtaccctaaaacttaaagtataattttaaaaaaaagaaaaaaaaaagaaagtgaaattcagacacggagacagagaagcacacaaagaagaaggtcatgcaaagaaggaggcagagataggaagaaagcagctacaaaccaaccagaaccaaggatttctgagagccctcagaatactggaagaggcaagggaagttccttccctagagccctcagaggaagtacagccctcagaggaagcaccttctaacctccagaactatgaaagaatacatttctgttatttttaagccaccatgtttgaggtaatttgttacggcagctctagaaaacaaatatacacaggactcttctttccaataggtctgaaatataaatgtatatttatatacatctccttgaatatataaatataatagagattaaatataacagatttatagatttataaacatataacagatttatatatttataaatataaaacagatttatataattttgtaaacacaaaatagatttatatagttttataaatgtaaatatatgcatatatatttaatttttaattactaaaattttttctataggctctcaataaggcaaatacacaatgaccaaacagaataataattgcttttcatttatagattataaatgcttttaattgatagattataaagaatttcatttatagattataaagaattactgtgggcaattaaatcaaagccttttcaaaaatggtgcaaaactaaatctatagtattcaactgatgtttaataaatattaaacattattaatatttattgttaattttaattaatttttaattaataattaaaattattaatatttaataaatattaataagcatcttattcaactgatgtttaataaatatttctgtggattattcctctgaaataatattttaagaatacacatgcatagacataaatgtacatacatggttcaatgtggtgttttattccttgcctataattacacgggtaaaaagaatgcatatttatgctgaaatgaaaccattttgctttctaaaaagaaacccagacacacatttctaagtgcaatgacagcaaatactgatacattcacatacattcttttgtcttttgaccttttcaagcaaaatcgtgcaagtatatctaggttacatctgattagctttcacatgttttagcaggttttgagaaattttgttttataactttgataaggtttggctgtgtccccacccatatatcatcttgaattgtaattcccataatccccatgtgttgtgggagggatccagtgcgaggtaatttaatcatgggggcgattactctcatgctgttcttgtgatagtgaatttgttctcacaagatatcatggttttataaggggtttttccctttttgctcagcacttctccttcctgctgccatgtgaagaagaatgtgtttacttccccttccaatatgattgtatgtttcctgaggcctctccagccctgtggaactgtgacttaattatacctcttttctttataaattaccaagtctcgggtatttcttcatagcagcatgagaatgactaatacagaaaactggtagtgcagagagtggggcgctgctgtaaagatacccaaaaatgtgcaaacaacattggaactgggtaacaggcagaggctggaaaagtttggagggcttagaagaagacaggaagatttgggaaagtttagaacttcctagagatgtgttgaacggttttgaccaaaatgcttaaagtaatatggacaactaagtcaatgttgaggtcttgatggagataaggaatttgttaggagttggagtataggtcactcttgctatgcagggagactggcagcattttgccccgcagaactttgaacttgagagagatgatttagggtatctggcagaaaaaattctaagtgctaaagcaatcaagaggaagcagagaataaaaggtttgaaaatttgcaacctgatgatgtgagagaaaagaaaatctcattttctggggagaaattcaagccaatagggaaaatgtctcgaggacatgtcagagaacttcacaatagcccctcccatcacaggcctgaagccctaagagggaaaaatggttttgtgcccctcttccgacaacccatgcagcctcaggacatggtgctctgcatcccagctgcttcagctccagccatggctaaaacgggtcagtgtacagctcaggctgttcttcaatgggtacaagccccaagccttggcagcttacacatggtattgggcctgcaggtacacagaagtcaagaatagagctttgtgaacctctgtctagatttcagaggatgtatggaaatgcctggatacccaggcacaagtttgctgtgggagcagagccttcatggagagcctctcctggggaaatgtggaaaggaaatgtggggttggagccccacacagcactgtctagtggaatagtgagaagagggccaccatcatccagaccccacaatggtagatccatccacagcttgcactgtgcacctggaaaggccacagacactgaatgtcagcctgtgaaagcagctgaagggggggcataccctgcaaagccacaggagcagagctgcccaaggctgtgggagctcacctcttggaaaggcataacttggatgtgagacatggagtcaaaggatatcattttggaactttaaagtttaatgactgtcctattggattctgggcttgaatggggcctgaagcccctttgtgttggccaattacctctatgtggaatggatgtatttaaccaatgactgtatccccattgtatctatgatgtaactaactcacttttgatttcacacgtttgtaggcagaagaaacttgccttgtctcagatgagactttggacttgaactttcgagtacatgctggaatgagttaaaactttggggaactgttggaagagcatgattgtgttttgaaatgtgagtacgtgagatttgggagggactaggggtagaatgatatggtttggctgtgtccccacccaaatctcatcttgaattgcagttcccataatcttcacatgtcatgggagggacacagtgggaggttatttaatcgtggggttggttaccctcgtgttgttcttatgacagtgagttctcaccagatataatggtttataaggggtgtttctcccttagctcagcacttctgcttcctgctgccatgtgaaggacatgtttacttccccttctgacatgattgtaagcttcctgaggcctccccagccctatggaactgtgagtttattgaacctcttatctttataaactacccagtcacaggtgtttcttcatagtggtgtgagaatgaactaatacaatctttttcagcttttgtttcttagggatgcaattcaagttaaggtaagagagtagtgtagtataaatcagccttgctaagacttctataaatcatgaattcagcagctaattcaaagcacaattttgtatatggtacaaaagtatctattgtagatgactaatttcaactctaactatcaaagtgacaaaaaaacgagctatcaacatcagccctcctcaaaaatgtatgcactattttactaatagtaacaactaaacaatgagcaatattaggaagattaaaacccataatgtaatgtactgtttgacagccaaagactttaacaatgtcctattctttctagtacctctggacgctttattcttctgctaacgtcagccctcctaatctttcacattacattcctatattgcaccatttcagaattttctgcctcacagttggaatgttaccagatactcctcagtgtatggaccacctgctattgctctcagctcatgtttggagaaaactggtttatgtaaaattttattttttttcttctggtaaatgaaagctaatttgcaatatgtttccatgggaaaattctaggcataaaaattatataaccacatctaaaattgctaaacaatattttttaaaatacttaaaatttaatgataaatcatagtcataagcccataaaataaagtaatatcaaaatgaaaattaggaacacaaaactatgtgctacagggaaaaatataatccaaaagttctcaaacagtctacaatatctataaaatctgtgtattgagtttctactctgcattcagcactgttttatgcccaaacataatacaatattcctgtttcaagtggagaagtttgggctgtatatgggatgttgtttccatacatcagtggccactgaataacaataaaactcacattctattctcatgaaggcatgcttgtaatggctactgccaaatgagactctattttacaatagggtgtgtatttcttatgtatgttttatgtatctcccttatttaaaggatttctttccatatgcttttcttttattaaagttgaagattctgttctactttacttttagacaactaacttttgttgtttattccatagagtctctatttgtttctcaccaatcaatgttgggcatgaagccaggcccaacagaagcccttagtccatggagaattacttttattcacactaccgtaagaattagtatcttaaaaattttccaatatgtgaatgtagtgcttagaaaactttaatcattctacattgcctttggcattacaattaaatatctggcttaatatataaagcctttcacaatttaacttaatggcagttatcttctctccatacaattcactcaacctcaaaacttaaaactacataaccattcgtggttctttgctttttttttctgtttgccaggctgtatctaagttatatcagattactcaagtgtcatctcttttatacaccctttgtgatgcttgcagggtgaatctttcctatggctaatagtttatataaacatctatcatagcttatgtttttagttatatatttacttgcagaacttgttctttgattacaggcattcaccatacatgcctccctctgacttccttcaaaacatacttcagtgactgaactcaacagtcattgtagcttagtagtaaaaacaacgtattcaggggccaagattcttgcctttggatcccagggtcacgtactagctgtctgaccttgagcaagttacttacttaaactttcagtatcataagtttcattactagtgtgctcatactagtgtacagcaggttcttaaataatgttgtttcattcaacatccttccattgtaacattgatgagaaaaaacaaattcctggtgggatccactgcatgtatacagtttgcaccttctccccatgtctgcgtgggttttctctgggtactctggcttcctttcctatctcaaaaatatgtcgtgttcattggtgtatctacatggtgctaaaatgacagagagagagaaacagagaaagagagagagagagtgtgtctgtgtgagtgtgcccttgatagaacagtgtcatgtacaaagtttgttcccaccttgtaccctgagttgcccagaaaggctttggacacctgcgacaggaacaagaaggcgaataattatcttacttgtttttattaatctttcttaaaagtacatatagctcatgtttatttcaatatttaatattataaatatttttatctttatttagaagcttgatgttttcatgaaaagaattatgtcataggaacttgactcttgtttatatcaattaccctatgatcaagtttgttcctatataagttgttttgcatgaagtcgtagttgtcaagaacctatggaggatgttaagtgaggatttgcagtataaaattcttaggttatttggagaaaaatgacttaatataattagtcccataatgtaaagattttagagattgacgtgaagtcagtgttttatgaggatattagaaaaagacaggtgagagacaggatagaaataagaaaaataaatattgaaaacatcgtttccaagaaagaataatttctatatgtaatcataaaattgcagtaatggatggatttactaaaaaatctattccagtgctcagatgaaggaactgaaggcctgtgaagtcacacaagtttaaagcagatataggaataaactcctatttcactggtctcttccagagaggtttttgttttatccttgactaaagtctgcaacgtgttttccttatgtcaaatcttgctcttaatgtttttaggcattctgtgaccttttgttgactacttgacttagctctttctatttgccattactttaaatgtatattataagcctgcattgaagtttttcaaaataaaaacatacccaagctgttcttttccacagatgatttggggaataaaaaaggagaaataatacagtctaatttcactattgaaacagagatcagttgaactaaaacagaagaataaatggggtataaagcagtccactaagatattcataatttcatactgaactctttaggaattgtgatttcttaactagattcatttatttatttgataaagttttactgaataccggctatgtgcctgactcatctattgattagcaagattaacatggttcctacactcacaatgctcacattttgctgtagaattcataataataaaaatcatcataatcataaaacttgaaatagggacaactgatagccatggaagtacttttctgaaaggagtaatattaccatatttcaggttttaaaacgtcatttcagaaaaaatatttggagacagttggaaggaaggtagagtatatgcaaggagaaggagacaaacaagatgctaatgcaacagggcaccaaacaccaagaaataagcaagtaaaacatggagcgggaatcccagttttttgcagaagattaaaagagaagccttgagagacatgtatttggtataatacacaaaatatcatcatgcatttaatatagggagtgagggaatgaaaggcatcagaaataactttcatctctctggcttgagaaacattgagtagacaatggtggcatttaatgagataaggaaaatggagaataatatattttatcgaggtagcgagttgaaggatgatatgaattttgaaccactgagtttgaagtgcacttgaggaactccaacgtgggagagtgttaaatagccaatgctaattagaaacattcattgaaaaatgtatttttaggagaaatcatgacattaaaactagaaagaacatatttttgaataataccatttatattaatgtctgataaacagatacaaagtgcctaaaggattcttttttataaattattgatcattcatttaaatgatactagattagagaatatttacatcacctgctataagagtgacagcatattagccaatggtattcatgctcgactatgcaattcagaagcaacatcaaagaatattcttcattgtgttcataaactttctcttaagtgaataataaagaaaatgtaatgcctagcaacattttctagcaattattcttctgcaatgcatgaatacatatttgtgctattgtagcattaggttcaacctaattaactcagaaaatcatttatgcacaatagcctatctttcatgtacagcagatcatgtacattttctttactttttgcaagttgtatgtaacattagcacacaaaaaaatagtggttgtggttctcggttcttagcactgctgtttatcacatccatgtccatgctagtttttccatgtgtgatttaactaccaagttaaccatttgagattagaccatctcttggatttatgactctgtgcctataatattcgagctgcctataggtctttataagcatatatagcaacacatgttgtcaacaacaacaactgcttagatattaaatagctgaaacctctggaattaggcaaactgtgtgcaaatattaaatattgcttcagaccttgagaaactttttttcaactacctgtgcacatatttcctcacctgtaaaatgaaaccaatgataaaacagaacctccttctttggactatagtaagaatttaatatttaatttttaacaaattcttatggtaaggacttaatatttaattcttgacaaattcttatggtaatgtttaattcttaccaaattcttatgataaggatttaatatttaattcttaccaagttattagggtaagaacttaatatttaaaatattcatttttcagcatatatgaagttcttagaatacctactagcatatgataaaatcttagagaaatttaacaattttattataaattagattgcttaatatataatcatgttacatgagttgagatagtcaatgcaaataaaaaataatcttcactggttatccttttatgttactcagctttcaatttctcataccatctcaaagaaaatgtagctagtagttatttttcagaatctgagaagtgttctgcaaatgtgcgtaataatttttgtcaatgttgaaaatctttaggactttctgtaaagtcgatatttaatgagttgaactattgtctttagcatttatgtcctaatttttggaaggaaacacacacacacatatatatatatataaaatgaaatcctatcttacttgacctaaaactgcacaaaaatttatatttgctgcgtttattttgcattggtaatatcaattttcttccatctgaatacaagtcatttggaaaattccttacatccaagttcttcagctcctatttgttaatcctttctttctttcttttcttttcttttctttttctttttcttttcttttttttttttttttttttgagatggagtctctctctgttacccaggctggagtgcagtggcatgatcttggctcactgcaaactctgcctcccaggttcaaggaattctcctgcctcagccttccccagtctggaaatacaggcacgtgtcaccacacctgcttaatttttttttttttttttttttttttttttttaagtagagacagggttttgctatgtggcccggctggtctcaagttcctgactttgtgatctgcccacctcggcctcccaaagtgctgggattacaggtgtgagccacctcgcctggactatttgttaatcttgatcttgttatatatcaactgctgggttgctccatgattttcacattctcttcctttagtttgtattgtgttggtttttgtttctttcataaaacactaaaaatgtttacatcattttaaaacatttcaaacataaaacaatatcctaagtagcttaacagtagagtccacacatgttgggtattaacgtaaaaacttttaagctcgttataagatcaatcagtctgttcatatcagtactcaatgagaacattaacatgttcaactctgttcagtcattagagaagcatatataaaacatattccaaaaatctaataagctgagtgaatgccaataggccagtaaatattgatataggatgttgctttgatggtaccaatttcattttatatattgtaaggacttccacctactattagagtaaatttcaagctatataatctcacattaagtgtcatttgcaatctgaacccaacaattcaaaataattatgttttaccaactctaataataataagacaaaaaataatggctattacttatcagtaagcaatctgagacctagtaaggatagatgacttatccagggtcatagtgttagctggtgagagagccaggagttgaaatgaggtggtttggcctcagaaactttgcactaagcccctaaatgtattaacaacactacgccaaagccttgccaggaagcgtttcaccatcttccagtgggaagccaagtaaacataaacttttaataaaactgtctgagtactgtcagagaggtataaacacttctaccagacagtaatttttttcaccatcctggaagaccctcaaggtcagggattatattttatttgactttgtattcccagagcctcccatgacacctaccccatagaggacctcattaaatgtgtgctgttgttttatagcaaagtgattccaaagcggtagtagggctagagaaaaaaaaaggctttacagtatgtacgagcgacatttgaactccgtcttaaaaaaataaatataggtactcaaggaagaaacacagagaagaggacatttgagacagagaaaacaacatgtgtgaacaaggcctgaagtgggagaacaatggatatatctaaataataggcgtttggatgtagggaagccagagatagtgtcgggcaagattctggacaggggtttgtggcggtttaggaaggaaaacctttatgtcaggctttcaccttcatagcttcacctgcacagccagggctctgttgcactggaatcagtagagggaatgggtacagtttcaagaagctctccaagagctgggaacaccctatttgtgcctcagcgtggttgaaatttagtctctccatttatgagcattacaaattttaataaaatgcaacaagggcacagttggggagaggttataaatgactaaaacaaaaggagattttaatattgaagagtatagaattaagttttcaaaaagttcgaaacagagtgcttatatataaatataaaataaataaatgtgattgacattaatttattaataacaaaacttgcaagaagataaatctgcttacctggttttaagcattgagaggaactaggagtttatatgcattttgggggaaatatatttaaataatatttttgtgtttacacagaataattataatagcttacagatagtaaaactatcatatttggggttattgtctcccctagacaaaatctataactaacatctatatttacaatgtctaggctctcatcaaataataaatagtgaagtcaacataggtaccttatcccatgtaattcattaatctttacacaagcctcttaaacagtgctccagtatgatagtaaaataccatgtcttccctctccggttgaccttatttccaaggttgagtatctagctagctagctattttaaacaagagcaacctaattctattgatttaaaagacagaataatgatcactgcaggagacagagaaagtgaacagttaaaaaagatgtttcactaagctaagggaggaaggagggcctaaatttagtgttggagattgaggttatgatacaaggtttacagactaaaaagcaataacatgccatgaagtagtttaaccttttatgttttcttgcctctgtacttctgcaccctctcacaccactacatttgtctgcaatatatttcccttatcctttttaaaataaagtttcacttttaataattaaaggtacataataggtatatatatttctatcttattattgatacatagcatttgtatatatttacaggggacatgtgatttttttgttacacgcgtataacatgtaatgatcatgtcatagtatttattccctagaatacttttcatctcaatgcgttaaaaatatttcaaatactctcttgtgtctatttagaaatatacagtacattgttgtttagtaactaaagtttactctcaatcactggaaattattctttctgtttaaatgtatgtttagacccattaacctactctctttatccttcccacatacatttcctagcctctggcatctagcatactagtctataccttcatgatattaccttttttagccccacatatagtgagaacatgtgataattgtttctgtgcctgatttatttcatgtaacataatgacctccattttaccccatgttgctgcaactagtgttatttcatgcatttttatggctgaatagtttttcattgtgtgccaataccatatcttctttacccatttgttggttgatggacacttaagttgattccatatctctgttattgtgaatagtactgtaataaacatgggggtgcaggtatctttttgatatactgatttcttctcttttgaatagatatctgttaatggcattgctggaacatagagcagttctatatttacatttttgagaaatcctcatactgttttccacactgactgcactgattgacattgccaccaacagtgtataagagttcttttttctccacatcctccccagcatttatatatattttttgtcattttgataatagccattctaactggggcaagatggtatctcatgattttgatttacacttccatgatgattagtgatattgaacattttttcatatatatgtaggttctctgtatgtcttattttgagaatgtctagtgcccattttaacaatgtgttgagatccttgtataatctggatattagtcccttgatgaaagagtagtctgcatatattttctcccagttctacagattgtttctttactctgttgattgtttccttagctgtgcagaaatttttctgtttttgttgcttgtgtttttttaggtctcagccataaaatctttgcctagatcaatgtcctgaagtgtttccccaaagttttcttccagtagttttataattttgggtcctaacactatgtctttaattgatcttggctgatttttctatgtagtgagaaataagggtccttttcattctttccatgtggatatctgatcttgccaacaccatttattgaagagggtgtattttccctagtgtaggttcttggtgtctttgtcaaaaatcagctggctgtaaatacacagatttatttttggacaatctatttctgttttatttgtctgtatgtctgtttttgtatcaacattatgctgttttggttgctatagccttgtaatatcttttgaagtcatgtagtgtggtgactccagttttgttcttttcactcaggattgttttgaatatttggcctctttatgggttctacataaatatttttctatttttgtaaaattgccattggcgttttgatagagattgcaatgaatttgtagattgttttggtatggtcactttaatgatgttaattcttccaatccacgagcatggaatctttccatttgtttgtgtcctcttcaattgcttttatcagagttttgtaattttccttgtagaagtatttcagctctttggattactttatttctaggtattttattgtagctgttgtaaatgggattgccttcttgattcttctttcttagctaattcattactggtatatatgaacaccgatttgtgtatgattaatattgtatcctgtaactttatttaatttatatatcaaatctaagaaattttaggtaaaatgtttagattttcctagatagaagattatatcatctgcaaagaggaaaaatttaactttttcttttccagttcgaatgccttttattttttttaatccatctgatgatgctggctaggcctttgagtactatgatgaactgcagttgggaaagtgagcatctttatttttttccagttcttagaggaatggctttccactttttccctttcagtattatgttagctatgagtttttcacatatggcctttgttatgttgaggtatgttcatcctatgcctaatttgttgagtttttatcttaaaggatgttaaattttccctatttctctgtgtctattaagatgatgataagattttgtccttcaccctctttatgtgatgtatcacatttattgattagcatatgttgagcaatctttgcatctgtggaacaaatcccatttgattatggtgcattatcttttgttactgtttgtttcaatttgatagtattttgttgaattattttgcatctttgttcatcaaggatatcaagctgtagtttttttttttttttttttttttttggttattgtttttagactcttgtctggtattggtatgagggtgatgctggcctcacaaaataaattggctgaaattccctcctccccaaatatttaaaataatgtcaggagaaatggtgttagatcttcttcgtaaatttggtcaatttgtcagtgaagcaatccagtctcaaacttttctttgttgggagactttttattgttgatgtaatcttattactcattgttgataagttcaggttttctatttcttcctaattcaatattggcagattatatttttccaggaacttgttcattttttctaggctttcaaattagttagtgtagggttattcgtaatcgtctctggtgatctcttgtatttcagtgctatcagttgtaatgtctccatttttctgatttatttgggtcctctttctttttatcttcattagtctagtgagcagtttataaattttatctttttttggaaaacaactttttgttttgttgaccctttgtattattattttcagcctgtattttgtttagttccactttgattttttattatttctttccttttgctaattttggtttggtgtgttcttgcttttaaaatttattgaggtgtatcattagattgtttatttgaaatctttctactttttaatgtaggcgtttattgctaaaaactttcctcttagtattgttttttttctgaataccatagtttttggtatgttatgtttcaattttcatttgtttcaatacattttttgattcctctcttaattatattcttgacccaatggtcatttagaagcatgttgtttaatttccaaatattaatatagttttcaaagttcttgttattttttattccactgtgttctgagaagatacttggtatattttgattattaaaaaaattgagacttgttttatgtcctacaatatggtctattcttgagaaagttctatgtgctgatcagaagaatgtgtgttctactcctgttggatgaaatgttaggtaaaagtattttatgtttattgggtttaaagtgcaatttaaaggcaatgtttcttttttgatgtttttgtcaagatgatctgtccaatgctgacaatggggtactgaagtcccccaaatattacattattgcagtctatttgtccttattgatctaataatatttgttttatatgtctgggtgctccagtgtttgctgtgcatatatttacagttgttatattcttttgctgaatttattcctttataattgtataataaccttgtctctgctgtttttgattaaaattcaactttatttgatataactgtagctactcctgctcatttttttgcttccatttgcatggaatatctttttccatccctttacattcaatctatatgtttctttacaggtgagatgtgttccttgtaggcagcatatggttgagactttgtaatttttaaaattcatgtctttttgtttgtttgttttagattcttgctctgttgcccagtttggactgcagtggcacgatctctgctcactgcaaattccacctccaaggttcaagcttttctcccacctctgcctcctgagtagctgggactacaggcacgcaccaccacatccggctaatttttgtatttttgattgagaccagattttactatgttggccaggctggttttgaactcctgacctcaagtaatctgcccgcctcagcctcccaaagtgcagggattacaggcatgagccagcatgctgcccccatccctgcctttttttaactattaagccagtctatatcattgaactacaaaatttaatcaatttacattcaactttatttttatatgtgagggcttagtcacatataattcaccacacatacatgcaggtggtggtgaagtcttgctggggacagggccatcaggtgggccagtctttggcccccattggcggcagtgcaggtcaattatgtctttccctaattttcagggctgcatacactagcactggtgtcagcaggtctatgtaagcaggtctatgcaattctgttgtccctgtgtggcttgcttgggtgttggcagtgacagtgatgaactgggtgggtgagtgggtcctctggctccaaggcagtgggtttggtggtaatagtagtggagggtcaatcctctgactctcaagccatctgtactggtgttggtggtggctgtgacaggctgcaatggccagtctctaggcttgcagttggtgcatacatgcgggtactagctgtggtggtagcataggttgagtggactcattttcaagcccctggaaatagtgctcagctgctaatagtgtaggtggggcaggatgatacacaggcccttgaagggtgtgcttgtgcactcaggagggtagagctacatcacatgggccttccctcagccccccggtagtgtttacagtcactggctgtggtatacaggggtggagtgatccccaaacccccaacagaatgtttagatgaaggtggcagaagctgcacttgcagcactgctgtggggttggggtggggaagcagaggttactttcagttttagtacacacgagcagatagctgaggaatgcaagtttcagccctaggtgacagctataaaccgggcagcctttcttcggggtgcttttaagcgtgtggcgaccctgctgctaaaggttgctgggtcactgtcagtgcctcatgctttggtcctagcaacagtagccaccagtggtgcctggctgcaggtgggggaggtcagtggcgttctaggaatctggagaggcagaagttggactctagggcaggatgcaaactggtggggactgggctctcaaaatagcactctgctgtggctgcttaggcttcagtgtgggtatggcacccattcttaactcccttcccagagcaatgctcttgccatccccatgcagcttcctatgatagtttcagtgcccatatgggttgaaggactctaccatggctaagatttcaggaatctgctgtggaaatgtggaccactggggagcatttgcttactctttctccagactaaggagcctctgcatactccttgccaattgtagccaagcgggctgcctcgctttggtctcctttcttgccttaggtgttttctgtcacatctctgttgaattccagcattttttcttaggtgatctattcaaagtgtcattatctactccttattttgtgaaggaggtgagtaccggatgctttccatcagccattttgaaggcgccccttcatctctttattcactgatcaggtacaaagacccttgaaaaatgaatgggttaagggcatcaacaccccacacaattgaaaaaccatacgtgatttttggctactccaaaaattaactaatatccttcccttaactagaagtcttactgataatatattcaattaacatataatcattctgtatgttacatgtattgtacaatatagttttacaacaaagcaagctagaaaaaatgttattaagaaaatcacaaggaaaagaaaacatatttattgtgtattaagtggaagtggatcatcataaagaacttcatcctcatcctctttaagtatgccaaggaggaggaagaagaacaggggttggtcttgctgtctcagtggtggtagaagcagaagaaaatccacatataagtggatgcacaaagcccaaacttgtgttttttaacagtcagctgtattttttctaaaaacgcttctcaggctatccaaacctaaataaacatgtatttattttaactactgtagaaactattgccatgcaatcatttagcaattactcatacaatgtcttatattagtttctgttttatgtgagcagctatttagatctacttttgtttaattttctgaaattatttaatagaagattttatactattggcatatagtaggcatttaaaaaatagctgacttattgcagaatcttctattttaaattttatttatattttttgattttttttttactatagaatatagtttcctgcatattcattacaaaaacatgaggtatgataaaagagcaaagtgttatatttaaaattaatccttcaaacaatgaatcaagtgtaacaatatttccctaggtcagaaactttaaaatacttaattttataagttaaaaagaatgttttggtaaatactgcaaaatacttttaaaattagagctgtatatttttaaacatctttttttcaaaaaagtaattatacatattttgagtaatgctcagtcatagcacagaatataaaacataatttttatatgacactctgatttatgagagcacaaattactttttagcattaagccagtgcaatcatgtgggtcaccttccaaatataaagaaatagggggaaaggaaagtgggcaacttagtaggctatgaataaggtctaaaagagtgtgttcttatatttatgttacaaaaataaagtgtgtcctttttgaaaacaaatcttaaatatattttcaggcagattctacatattgttctgctgcaaaaaatgttgttttaacatgtttcccctaaactgcatgacttagaactaaacataaaaatggtatttggttgctgttccaaatgttatgcaaaaaaaaaaaaaaatcaatttgatgggaaaactagacaaattagtcagtgggaattaggtttattaagaaatttcacctaatttttgttgcttttaatagttgcagttttaactgagtgtgaagaaaagttgccaagatgacatatgtcacatgtttcttcaattcatacatcctcaggcactagccaaaagccactgtatgtgtgtttttttcaaaacccacgtatgaaacaacagaaattcctttaataaataatgattgttatctactatgtatcagccaatgtgctaagcattggaaccctcaagaacgtcatgatctgcaaggaacatataagagacacaaatccagaaaaattaaaattaaaataaaaacgcatggcagtgatagcaacaggcacagtggattgtcgtcaggaaggacgtggggtcaaaagaagatttcagaaggaaataataactgaccacagttttagaaaatgggagcgagcctggaaaggagtggacaggtgtttatgcagacagagttgcacataggtagaggcatgggaagagaggaatgaccagatggtaaaatatatcctatatacagaggagcatgtaaattatcttcacagttgaaaagagttattttttaaaataaactcttctataaccattcttcaccatttttagagtaaaaaattgttgatttaaaaatgtgaggaaacacagacttctacataattgtgtactttgtttcacctaaatgcaggtgacagatagacctcagtgaggtggctttctttttaatacagaatttttatagatcagttttagataatggccacaggagtcattaagagccggaaaatggtaagaagagacaacactagcttaaagtgaatgcaaacacatactctttgagattttgccagatacgagtcaaaaataccttttgaggaagaagttctaagaaagtaaaacataagcaagaatatcttttttaaggggatatttggaagcatattgagcaagttattgccaactaaaacatatccaaagatactggatattgtccttgataaatgttctagaaacttttaggactgagaaatactagggtaagcaatgaagaaagagttggagagaaaaaatttaatggtcattttgtttgagatgagaatgaattttctcgtctgtctctctgtttctgagcacgctatgactgtatgcaagattttcctacttaacttcacagttttccttctattttattgttaacacttccattctcactaatgtggttggtaaaataagtactttaattatttgcttgcacattcaatattaaaataccatgctgtcttcagtttattatgagttcaattttcaagacactataaaaataatataacaatccattaaaagggtattctaaaatattttgtcattaggttattattttattatcttcaagtaaacaagaaatacatgagtaaccctcagcatattataaaaatgtgccaataaatttaaagaaaatttataaacataggaattctaataatttttctatatacatgaaggtgattattccaaattccattagattttctaaagtattatatattttgttatttttaaattctctataaacataattgtgaagccactttaatcaaataattagaaacaataatttgcaagcttgcaaaagaacacattacatatacatcttttaaacaattaaaatctaaagagtgattcctgataaagtaaatttagtgtaaacagaaatgcaaataaataaaactttcatttctatattcgaattgcaaaaaaatttgcaataatgaatatgctatttttcttgcttgtaaattatggtcaaaagatgtctgctgaatccatcacaatagtatcctaatttctcaactagaagaaattttagcaataaaaattaagtttagaatgataccaaagcttagattcttcaatacaaagaaaaaaaaatagtctcaaatcaatccttgttttacagatgaggaaaaattggatccaaaaatattaagtgatttgttcagttatccaggtaggaatttcaggatcaaaacaggaattgggtttgttatgtcaaatcctatgctaaagcctgtaaataagcttcttccaggtcattaagtcacctctatgaaagtatttatctcagtagttcatatgatgacgatcctttttaaatgtaatcaactaaggtagtactccctaaggatagggttaaacacagcaggttctcaggacaggctgctgataaatagacagagatctaagtgtgtagtaaggaagaacagtctatgactgagttagttaatggacgaagtataatccataggaattttttatatgcctttgaattacataatttattaacaaaacactaaacaaaacataaacctctctgaagctacaaatgtcacatgactgaaatcctggcatattttgctaaatagaatacagtaaacaatcaacactgattttgataaaatgtttcgaggtttttcaatgaaacaaattctttgaacagagtgaaaattaatttttacagattatatcaatacaaatgttacataaaacaatttcttaaaaggaataaaaactaagttctacagattatataaatacgtccaacctcttttacatggaaaacagtatgaaatttagcctattctgatatgttttcacaattttatataatctacaacttattctcctaaacttttttttaatgttagacttttaattgggctacttacaacaaagaacaaaatgttttatcatacatttttccaagtattttatataagtgtaattaagtttcatcatgcaggttcaagtcgcattgccacgattaagtggctgtgaactattgatttgacttatttaacatttcagtaacgactaatgccagtgattattgcactgtatggaagttgcaaaaaataattataatattcaacgtttattttacttgaaacttaaaactttatttaagaacatgaccagccatcttaatttaccttctaactaaatcattgtttgagttgtatatgtttggaaaatttatgtaacatttttaagccttaatatcactatttataaaattccgattacaattcttacttgcaagatccctatacatattacagattatgcatgtaaagcaactaataaagtgtttggcacccaaatcttaattcacttgcatttaatcatgctggacctatacagacctttaaacagtacagcaattataatcatattatatttttttctgaaatatatcttatttatacatatttattcagataagcaaaacataattagcagaaataaaaatcagtgtcatttattatcatttttgcattgcctctgagggcaagagatttctattagaaaactggtatctgtgatatttatggacatagctgcaggtaaagatgatgatgatgattgtgcaggaatgccatatgaattatttcaaaagtggtaataaacttatattgatccatttttacataaactgtcaacaaattcccccaaggccaggccttaacccattatatatatataatgaaagtgttaaagcttgtagcataggtcctggaagtgccctataaatgtaatcactatgcatattggatgtaatcactatgcatatgatatatatacatatatgcatatatatatgcatagtgattacatatatatatatatatgcatagtgattacatttatagggcacttccaggacctatgctacaagctttaacactttcattcataataagttacatggtctttttataacactatgataaggctattttctctacttaataaatgaaatacttaagtgcctgactgaagattacacacatagcataaccagattgcaaatatagggagtctgaatccacaaggcatacactcaaggcccctcatgctgcctgatgttgctgctgtagaaaggacacagataaatagaaagtaccatgactgactgttgtctagagttctttatctctgtattttgaaatcaacagattatctaatggattaagataacataatcattttctttcagatgaacagctgtgatcaatttagcaggtggtaactttttttccccagtgaaatgggaaaatgttagggtacattacaggtaataaggtaaattatttgataaaattttcatttcagttgcatatatgcatgtatgtatactggatcattatataaaaggtgtttcttttaggttataatccaaagaagttttgaaagctgagtttttttaaaagggtgatcagaaatttggaggaaagacagaattgtttgttcataacatgtactttcaattttgtggttatgtttcaactctttacactatttaccttcagacttctagaaaccttttctacactccaggttctttttgtggtcatctgttattctgtggtcatctatgaatgaacaagcatacaggcccatcatggggtcaaacctgtaatcctgattccatcatcactcttctctcctatcttcaatttgtcatcaatttctaaagatatattagatttgcattcttctttccagtatcaaattttcattaatttatttcagacaccatttctctttccttaatttctgttccaacttccttctttgcctccagcctatcttgtttaatccattctccttagtgctactgagggagcctcctaatccataaataggatcatgttacctccctgataatttatttacatctttctcattaagctgacaataaggtgaggctcttcatggttcagctgtaacttactccagccttatctctcagaactcatgacttaaatactacaaaatagttcatgcaaaaatctgaaattttctcagagtactttctgctccatttttctgaaaatgttctcccttttcctttcctcacacatactcctctttggccaattcctacatatcctttagtcctcatatgataagccattgctcaggaagccctcctggatcctttatttcttggttgggcatccctattagtgttctttttatttttattactgttcctataacaacactcatcatgatgtgctagaattgcatctctacgcatctgcgtccatcaccaaacagtaaattctttgagatcagtgagtatgtgttttgcacacagagtatggcatagggcctgttgtgtactacattcttataaagcatgtgtgttgaatgaatgaacgaatatattttttaacttttattttttcttcttgagacagagtctcactctatcacccaggctgatgtgcagggatgcaatcttggctcactgcagccttcgacttctgggttcaacaattctcacgcctgagcctccccagtagctgggattacaggcgtgtgccaacacgttcaactaatttatgtattaatatattttagtagagacaggctgttctcaaactcctgagctcaagagatctgcccaccttgtcctcccaaagtgctgggattacaggcatgagctactgcactcagccaaataaacaaataatttttctttttaaaatgaaatacttacttggcagagaccacctactgttacgcaatcattctatagtctttaaaatctaacactaatttcaggtatcaaaatttatatttttaaatgtttatatatttattgtcatgtgagattttatggtggtcaagttcaaagggcccaaatatctagtcgccctaataatattttcagtgtttttcaaaagcttacagattttgatcatttactaatgacactccactgctcactcaaagctacactgactagcacaaatatcctgcttctttgcttagagtgaggctgctagttggcgcattttgatgagaaattccaatcggcaggcatatgcagatttggatattttttaaaaaatgaaataagacattttaaaagtaacaggtttacagagaaaaagtttactaaaacaggtcctaaggaaaaagactttgaaaccagttacctagcaaactataaaagctaaatgccccaaattgtaatgatagccagttgcaccaaaattcaatgttattcatattttatttttcaagataaaaaagttactatgtattgccaagtttgaaactgaatgctctatctcattcctttaagccaaatctttacaagaaaaggatttctacttcaaaagaaagtgacacaatactcataattaacataaaaataagcatttgcctaatttcaggagagtacattaagtcattagtataagtggtgttttgctttgcactctctttacattattccatctctttccatctgggagcaaacttaacaagcaatttaaaaataattggtgaattaaattgtcattggtggcctcattttcctttttcgcgtatgtcttcaacagacttactctagcagtaccattaatacagctgcggtaaaaaaaatctgtgcaaatggcatgttataaaattaaatggtaacatattgtgttgcttgggatcacagtcaagtctagaggcaaaatagaaataacagatgcaatacaaatgtagagttattatgtgtgtcatactggaatctagcctcacaaaattagcacaatatgctctacctgaggataagctagggaaaagaaaaaaaaaaaaaagaaagaaagaaggaagattgtgccagcaacataaatggagacatagaaacattttaatcttaatatggtaatacgttttgaaaagaaattgtacatagattttttatttaaaatttcagaccaagagaaatgccttctatattaatatagttctccaaaatgttttttggatcatgaaatttctgacattccttttgaatttagtgaatttactagtttgaatggtcctaattaaattcttccctaaagctatttacagaggtacctcctgattttattagtcctttagtgatgctgcatgtctggtttggagagtaacttccagcaaatgaatagtatttatgcttaaaacttaaatgtgtgtgtgtaacatattgaatacgtaatttaatataatatctttaatactatgctttactaattatctaatttatgtgtgatacatcatatcatcatatagctgcctgggtttgttttgaattgtaatccaaaattaattatctcaattataataacttttatctttacattaaaaagtaaaagatcccttttcctcatcctcatagaaaaaaataagaatgttaaaaagaatcaaaactatgttttttggtgaaattactggctccatttatttgccctcccgctacttatgcttttttccatataactttgcagttccttctctaaaaattccctctacttacccgtttctgaacaaaaatatctcacttctcacagaaaaaaatgagggatttgaaaaaataatactgttaaattatataaacatatagtaagcattttcttacaactgtgagtgtaaatgatgtcacattgcatttactatccaccattcactacctcacttcaccgcctcagctaccacaactctcagaataagtacccatctccagaaaaaactcttgagtctgtttttagtgatttgatttagatgagtgttaaattatttgcctcgaaatataattatgactcactagagttgaaaataaaaattactattataatgagttctatgagctagatgaacaagtctacacaccatttgtaaagtacagtggttttgctagctagttggtagaatcacgatcaagtgatgccatcttggccagccatcagcaaactgtaatagctgatactgataattatgaataacagcaaacttgaaaataattacataattaaatacttatttgtgtaatgagctgcttttagaatctatgccagtgggtcaagtaagaagaagtaattggatcagtaggagacatttagtagttaagagacttgcttgtgcacacctaaaaactcaatggaggttaagtagcatatcactgccaaagagattctctagcactggtgggcctcagcaaaaccgtaagtggccttgtgagactgtgggactttagcacattactgcaatagactcataatcttatctaaatcaaagactctgaaaaaaagtgttatttgctacttaaaatgcaaaccattctacttcaaaatatatagaggagaaagaggacttgtcccaagataaaatgtgtcacatttgacaactatcaaccttatcagagtctaaaacttatatgaatacatgctgaaagtggatgctcttagttgtatttatccccattattaaacctaaatagagaagatcaaagccaaggactggaattttgaattattagtagctacaaatttctttcttaaagctttctggggcaagtgattgtcaacttcatagagtagaaaatcaaattaaaatggaataaatattattattctgaagacaagtgttccttttttcatagaaacattaaaagtatttgctaagtatgataaaacacgtatttctagaaaacagcagatataagacagtgattttcatttttttctatcgacagtataaacattagtatagaagtatgagagcccgtattgctgatgtttggagactaacattccttgcaaagagatgtctatgtcctttccaactctaataatctgtgattctataatttgatattaagcgaagattttagtaacacctaatttctgaattgaaaagaatttttaaaattctcacccacttactcaatacttgattttcttctatatgaatagcacagtcatatagttcatgcttgagccaaatttatattagcctaaatacatttttgatgaaatatttttgtttcacaaaaattcttatattacaaaattttctctaatatatatatgcttactgcattttaaatcggtctggcgctactggaaattgcttcatattaaattataagaaatttaataatcaataataagtatttggctgggttaaccatatttcttacataacaaatgctgataaatatatgtgtgtgtgtgtgtttgtgtacatactcttgtcaaattctaattaacaaaaatgtttaaaatatgttgataaatgcaaataaacattcacaatattattatgatttcatacatgttttgcatcaaaaatggcaacttgctattatattaatagctacattttaattggggtctcactaatctagaggctactctaatagcttccatgtattgaatgcttcctttgtctggaaagatagacttttatatgttaacattggtaatttctgggtgatgggactgcacatcattttatcttgtaattcttgattttgatatttctacaatgaacaaacattaaaaacacgattttaagatgttataaaatatatattatcctatttctcttttatttttatttttcaatagtttttaatttttatacaagctttggtcagtgagtaatggtacttccacagagtacataagatttcaatgtccaaagcaagtcagtctgtattgcatatattcagagctccatcaagtaaaattcaatgttaatacagaggtaagtgttaacagagaggaacaatgaaaaatcctatttaggacctgacttcaaatctcataagggatcagaaataccactgtactgctgaaagtgttttcctaggaaaaacagttttcatagcatagctcgctgagaactaactgatttttggcaattagatcacccatttttgagttaaaaaaagataacaattgaatatcatttgaacttctaatacctattaagaaaaaagttatttaaaaatgtttggaatttttggttggaaatctatgcagttttgaaattaaaatatcgattgtgagaatagtctcattcaaagttgaaatacactcttcagtaacaaaataatactgaaaagggtgagtgcaatgacaagaacatcatatgaacagatattatattctggaaaaagtataaaagcagattcaagtgatagagattgatatcccaattaaattaaaagaatgcccagaaaatcagcataattttcaataaaaatgatactttattatgagtaggtaagtagagagtgtatttatttagatgctccccactggtgtccttgtgaaaatggatgtcaattgtgtcaataataagcaatgctacttgcacctcaatttctcagaaggtgttcaggaaaagaaggtaccaggtaccttagcaggcaatgggaatgaggttgggatatttgaaaaataaaaaagggaaagattaactgaaacacttgtaaggagatttagatctccaaaattcttctttaactcacaatcaattgacttcagatttgcctatgcccatatatcacccctcacacatcaagattagaagcaagcacatatagcagtggcgaggtagtgaatagaacaaagtagccatttgtagcccagaatcagaaatgtaggaagtgatccagagaatagagcttgcatactgactgcagggggactatgcaaggagtaaaatattaatttctaggcaggtaccagaatctaaacaatgataagcaggtatatatctaccagctatcagaaacaaacatggcagagattcaaagtagagagtcaggcagactaataaaagataacagtagtcaaacagtatagaaacaatgtaatgatcacaaatgattctgtttctgccatccttcttctaaaattctatatgtgacagaaagtctaaaatgaaacaaaataatatggaaattataattaaaaattattcttgactgagttacagtcaacatgaacatagggatatggacaacagcaacattagaggggtcatatttgcagggtctttctggagtcaagtgaatttggaattacaacatggtatgtgtttaatgctcagcaattatgttatgagcaaacaacaagttatattggtgtgggattttgagcaaaattgctttatttattttatttattttatgaagggagaggaccaaattttaaatttcagttgaggctttccatttgcagaaatggtagattttcattttaggaatcttccattagataatgtcagctcctaatacttctcattctcttgtaatttctttttttattaaattgagattctcagtgaggtcatagtgtaatggagaaaaaataggtctgcgagaaaattgtgatgtctttaccaacagaaggtgataggatcgcaggtgataaaaacaaatgaaataaaagaaacagaaaacctaaagaaatcaatcctatactttgtccactccattttttttctcctttatttcttccactttttcttttgaaaggtacccttttagttccaaaaatgtagagaagagtatattcattattttagtttttgttttctttcaattgctttaaaatatttttctatttgatcctaacattcaccctatcaaaaagatattttgaatgttttgacaaataagggtgatgatgttcagatttcagtgatgcacttagtaattagcagagcctgtatccaaacttgagtttgacacatttttaatacctatgctattccttacaagctatgttaggttatagatgatttttcccactgtccaaaactaattttttatgtccttcataatcttcagaaatgtgttttgccactttaaggaggaaaaattgtctgtaaaatccaaaacagcaattttgctgttgcaatggaacccaacgagtgatgccagcccactgaattgaacagaaagacagtgatgattctttgtgaagagaaaaaatatacatacacctctataatgtgaacagagcataataagtggcatttttgcaatttggctgcttgacatcctgtgtgaagttctgaatatcctttttttgagcataaagcaaggacatggctttttttccccttcatgcactcaagggactcactcaaacacctaataatgctgttcaacctttaatacattcataatggaattccccagttagcgtgttttcacttgcctgggtagaggcaccagctacaacctcttcaaatacttaaaagaaaatactgttcacattaattgtaagaatcttcaaaagaatgctagaatacctcaaatggaaaattcacaagtagtagcagacaagaagacatagagcataggagtgaatagtagctataaatcagatacaagccacattaatgaattgagataagaagtgtgaaataaaatcgatccccgctcatcagagaaggaggagagggttatttttaatcttgggatgaatttaaaatcaataaaaaagtataatagtctcataaacagaaatcgaacgacaatgcaaggagttggaaaaaaattaaaaacaaagggaaaaaagtacaccaatttacttcaacagttacaagaagccttgtttgatagtgttaactgtattcataatgaacatgtgtatagagccttttaaaacatcccatcaagcactgcacagctgaatgtgaccactcaaataatatttggtgaacataaagaagaatgcccataaataataatcttccaagtcaaacatcttagatctaaaagttaaggctacaggaagagtgagaactctttgtgtgaagacactcataattaacaatatataagcaactacataaggctgaaataggcagggattgtgaaattccacaatatgagaacacttattttcttcttttcctctcataaattttgttcagaataccaatttggggaatcaagcagaagtaatccctgctaatagtgctgacactatgtcaaaagttttgagcaataaaaaaaaatctccgactttctatataccagaaactttcattttaccctagaaaatcaaaggacccctttaactaaaaatgtgtttctagaaaagtgttccaaaatacgtcatatggggatctagctcctcagccaagcaattgagcctcttttccttttgtaagcagcatatcaaagtaaggccaaagttggatactaagaaaagaatggagttacttatatttaatatttaggatacaaaataagagcaaagtataattgcataatgcttgctacatttcaaatttgtctccttctggaaggaccttcatctctgctccctgaaagccaaaaacaacaggctactatttttgtttttcatgaagctagatattagccagttgctagacttcaactgtgatatattcatgagaagacacaagctggagaatttcagcctagtctaagcaggacagatggagttgctttttacctttatacagatcacgagtttttagccatttatttttcaaaagtctagccttcagcagggagcatccatatgcgtgtgtgcaattcacattgagttctgaaacaagacttctggtttatccataaatctggcaaaataaattctcgaggcatagcctggcaacaaagaacttgaataaattctttaaagctcttttgtagtgaaataatattagaagttggggcaaagacaaagccatgagaggtgttgatctctaacagttttatgaaaagatgtttaagtaacttttcagtggcatcaatttaaaaatctagtcaatgatgtaacgttgaggatggagtttgctgacttttatcttccatgagcagtcagactaaccaggtgttagtaatttgaatctaagcaataaagactgtgaagccacattgatatagttaccataaatgggaatcagtgagtcccaccagcgtcacagagaacaattcagtcagtagcttgggcagggccctgctagtcattaacaactccattaagctaagacagaaactggaagcattgcccagagaggtaatcagaagcactatgctcccaagactttccttaacaggtgctcattttcatcctggtaagatttagaactaagcatatacatatttaagagaatcatattagagtatggatatttgaaatctatcaatatttactattttatattcttaaaatatttcagataatttgcctttttgaatcacatttgtacttatgatgtataattaagtaatttacatacagttatattaaacttagatctattaatttcacatagtagaggctactagttattcccaaatatgttcattcttcctttctttcttcctttcccttccttccttcctttcttttctttctttctttttaaaatactgctccttcctgtacactgattttttttcctttcttgttagcagtaaaaatcttgattttttttgtaagtctaaaagactgtaaaaccttccattctctgctcagttatttgtgatgttaggactgagttctaactacttaaatgtatttatagtgctatataaaacttccagaaagcatctttgggggaacaggggcttgcccttttcttcttctctccattctctttcttgggactctactttaatgattccagtttaagcagccattatagaccatgagattaaggattagaccgtggccatggaataatgttgatctgggaggaaggtgagttaatgaggtcttcagagagctgcagtactagctgctggtttcatatatctagacttctttcataaaacgcaaactgccattcatacttgtcattattatatatttgggaggttctatatttcaagaagctaagccatataataaatagtttgtatttaaaaagtcagagtattttaaaaggatatatgcataatggaatactattcagccataaaaaggaaggaaatgatttctttgcagcaacatggaaggaactacaggccataatcttaagtgaaacaactaaaacacagaaagacaaatatcacatgttttcacttaaaaatgggagctaaataatgtgtacacatggacgtaaagtgtggaatgattgaaaatggagactcagaagggtgaagaatgggattggggttcaccatgggaaattaattaatgtatacaagtgtgtgttattctggtgacggatacactaaaagccctgacttcaccactacccaatgtgttcatgtagcaaaattacactgttgtcacataaatttatacaaataaaaataaatcactaaaattacaacttttcccttattagctttatgaggtttatttaagtactcatgagtggtgtctttcagtcaaaataactacaaaggaaattttctatctagatttatataactgatataaaatatctctatagatctatccgtacatcaatatctatcaattacttctaaaggttattaactatacagttttctaaaaggatccacacattaatcaagtccccttctcctcttaaagtcatagtcaaaagttgttagaagttgctataaatataagtaaataatatggttttgtaggctaaacccagatagtaaaggaactaaactaatattgtaatgtcctagcctttcattttaaacaaacaataaaaatgcatatatacacaaaactgttttcttatgcaaaatgctgataagcattttttctaaaataaatcaaggtcacgtgatcaaagtgaagcttttgacaaattagactagtttgataacctgggttttaaagaaactgtatcctttttccttgattttagaagagaacagcaaaagataattataaattttattttaaaatataatgtgtatttttctcactaaaagacgagttaatatgaaattcctaaacttttcatactgttttactattgagctaacattactttcacatataagtaaaataaatttaaaactatgttttcaatcaaattagattataattttaagaaacatttttatagtaatggaatatagttttgaacttatattaaacccaaattaattggatacttggattatttttaactaaagtagaatattaaaatattggttaccagcgtaattttgacatacattcctttgattcttatttttacatgttatagagtagcaataacttagggccgtgtttgaaaatgtcttaatgtttgcctttttaaggtatggtaaaaaaaaaaatgtgtatggccgtcagatatcatactatatgtattcattagcatagctgtagtgttagacaaatctaaaccccatttcactccatgatgtagaagttaaatactaaaaattatgttaatatgggtaatttaaaatatactagaatcagtactggcagataagaagaattgtgtatgaaaagaaagataatgcacttttgtttattaagggaaaatgagagcagttttatcctaaagtgaagtatcagttattttcagatgtgaaatagaatagtaaatgataaaacctaagcaaatacaggaagtcatagtttttggaaacgagaatttaattatcttagattataatatcaaaaaataaggaatctcaaaaaatgtagtagaatatgttaaaattttcccaagagtaggttagttttcatggttggtcagttaatactgaaagcataaagaagcttgtgaatcttttactgccaaatattaacagcgcaaaattagactatttctattgaaataataaattaatcttgaattacttagtctgattttaacaatatataataattattttccttccatgtaaccttctgacatgaatggctcaccagagttgtttcctgtgtgttgtgctgaatttattatgccctggatcaatcaattctgaaggagctaagataccattaaattgggttaatactttctgtttatttaaaatattgtattttcccttgattaacttgtattcaagccatgaccttttattgttctcaaatactgatattaatattctaatcaagtgaatagatccctctgataactcttgacattttcttctcaaaattaattcctaaatttagaaaaatacaatttagtgtgccttttatacctaatactatcttcgtgatatctcagatgatcacagaaaaatcacaaatgtttgtcttttactctataaaaaagagtaatgctgaaaataattatagttgttggatatgctcctcatttcttacatagctcaacactatgatgagagctacaagaggagttgttaaacaaaagccttctctaagatagttttgttcaggaaaaacatatattgataattctctggagtgtagagtctctgaaatacatacatcatacacacatacaggcatacattagagagaagagagagatgtacatatacatattctggagactacattctggagatttataaatatccttatacttatttttaacctcagaacataattactaaatacccttatgactaaatatatattataccttaatagatcttactattctttatccttatgtgttggtcctctaataaatttgccatagccatttaattctgtctttgccaggttaagatttgcttgcttgcttgcttgcttgcttgatttcaactgtcctgtcttcaatttcaaatgaggaaaataatatccacaagtgcacctaggtaaaatgtttagttcaataactggcatgtgatcagaattaaattataaatctgatcctaaaatgaaaactcaaaatgagaaagcattaggattatatttctgcttctctgacatgaacactttataattaattgaagagaaatgttgagtggctaacagccagaggaacaagcatggctgtcaatgcatcttgactttctaattcctcatacaggaactttaaaagttagcatatggctgagcatggtggctcatgcctataatcccagcactttgggaggctgaggcgggcgaatcacgaggtcaggagatcgagaccatcctggctaacacggtgaaactctgtctctattaaaaacacaaaaaattagatgggcgtggtggcgggtgcctgtagtcccaactactcgggaggctgaggcaggagaatggcatgaacccgggaggcagagcttgcagtgagctgagatcacgccactgcactccagcctgggtgacagagcaagactatgtctcaaaaataaataaataaataataaataactaataaataaataaataatgtctcaaaaataaataattttttaataaaaaaatttttaaaaaagttatcatatgatatgtcctcaagtttatgttgaaaatgtaaatcacaggtttttaaactttgccacgtaacagaatcagctgtataactttaaaaacacacatatgccatcccacccgatccgctgaatcagaatgtctgaagtagagtattttacaaatcttcatcaaaaatatcaatgactagtaaaagtcaaaatactgatcatattaactgaatatttcatatgtagggctttttgtcaatttactattttttacctgaaataaatgattttgtgaagatataaaattaggagagaccattttacataggtgtattccaaaaatatcacctttccttaagtcagatactgaagtaatgctccaaaacccaacaattacatgttactccagatgcattagctttaatggcattgggtggtggtttaatttttagcccaccctggccagggatatttccttagtgacagcagtatggtctgcagcaaatgtgaactttaggaaatgcactaacgtataagggaaaggcagctatcagcattcagtcttctctgaaggtaagtatagcaaattaagagagatgtagtagaaatgcagtagcagttaagggatcaattcaaagttatcagaaaagggtatcttgtaggacaagttcaaagctgaagattgaattttaaatgttattgtgtgttacatgcaagtctcttctcatattttaaatttcttaacaaaatccactaacaaagtattatccctatgatgtctcaaaaaaaaaaagaaagaaaagttaaaaaaaaaaaagaaatgaaactccaagaaatatgatcaaattcacacagttaacaactggaaaattctgaatgtaaagatagctttttcaagtatctaagttctttcttcaacagtccacatagttttaagaaaccaaaactacattaccttgtaacttcccaggttaggtttatagagtagatgattagaaagtaataagttcttaagaggttaagaagagaaatttaacttattcctttgatattgctagggaagaaataaagaaagcagtggggacaatttcttgtagttggaaccccttatatcattttttatttttcatttttaagagcaatacagagaagattcatcaatctatgttcaggtagtaattgctttttactactttaagctcatctgtaaaaatcaaagtgaaactgactaggttttacgatattttctgaaaagtcaaaattctggtctttgctatcccttttaggaatatatggtaaaagtttccctatttgctcattactgattcatctgcataatgaagagttaaaatcttattgagaaatgccttgcaatcagttgagaatctaattgtacctgtttggaaaggttagttacaaaagcacccacggtgatccaaacttatattacacatcctctgattatcacatttaaagtaatatgtcatttgttattcatatttagtgttacaactctttaataaccactcaatctatttccctttaaaaggacagctgcaataacagcaaaattgtaaaccttaagtgtagcgtaagaattcaaggtgaaacacattccaagtagtagcttaaaatgtcagtatcatacatggctccctgaataaaagaggcaagacgtgtcaacctgaacagacattcatctctttgcactaaagtgagagatacaaagacctgtaccactcccagtagagagatgtgctgagacattcaagagtcaaagacgctcagctgtctgaggcaaatactgtgagtcttcaggtctctgtaaattgttctacagctgtgaaggattcaaagtaaaatttcagaatgatcataaatgaataaaatgtggtggattatagtagttactgtctttggctgtccgtaatttattatgttgctacttcttgtaactgtacagtagttctcctttattcaagtgcttgctttccatggtttcagttgcctacactcaactgtgttccaaaattattaaatggataattctagaaataaacaagtcataagtttcaaattgtgtgccattctgagtagcatgataaaatctgttacacctctccattccttttttatcacaagaataaggatgagtacagtactataaggtattttaagagacagactacattcacataacttttattacagtgtattgttataactgttcaatcttattattagggttgttaatctcttactgcctttaatttataaattaaactttatcccagtgtactagtctgttttcatgctgctgataaagacatacctgagactgggcgattcacaaaagacagaagtttaatggacttacagttccacatggctggagaggcctcacaataatggtggaaggcaaggaggagcaagacatgtcttacatagatggcagcaggcaaagagagagaatttgtgcagagaactcctctttataaaaccatcaaattttgtgagacttattcactgtcactagaacagcaccagaaagacttgccctcatgattcaattacctcccactgggtccctccctcaatacatgggaattcaagatgagatttaggtgggaacacagtcaaccatatcacacagttatataagtataggaaaaatgtagtataaatagggttcagtattatccatggtcttaggcatccactgggggtcttgggatatattgtctgtggataagaggggactaatgtattttcatttctctgggggtgggggcaaacaaaactcatagaatggatagattatggtgcctcctacacctacccaaccaagtgaaaccagcattttacatcagagtaccttattttcactgaacacagatattggcatattgtatcctgtcacccctgcatagaattttctaaattagaagagatggatacatctattttgctctttgattgtgaactttaaagtgtatgtttggagagaaccactctaaagagaaaacatctagagtgggagatgacaatcttaaacttcacccaaatccagtgaccctgaaaaaaaaaatgaaggttaagaaactcccccacccgactgtaaactagttcagccattgtggaagtcagtgtggcgattcctcagggatctagaactagaaataccatttgacccagccatcccattactgggtatatagcaaaggactagaaatcatgctgctacaaagacacatgcacacgtatttttattgcggcactattcacaatagcaaagatttggaaccaatccaaatatccaacaatgatagactggattaagaaaatgtggcacatatacaccatggaatactatacagccataaaaaatgatgagttcatgtcctttgtagggacatggatgaaatcggaaatcatcattctcagtaaactatcgcaaggacaaaaaaccaaacactgcatgttctcactcataggtgggaattgaacaatgagaacacatggacacaggaaggggaacatcacactctggggattgttgtggggtagggggaggggggagggatagcattaggagatatacctaatgctaaatgacgagttaatgggtgcagcacaccagcatggcacatgtatacatatgtaactaacctgcacattgtgcacatgtaccctaaaagtataataataaaataataataataaaaagaaactcccccacccttttgtattccagagaatggcttactgcaaagaatcaccctttcccatacaacttagataagacccacagatggatcccttttttatctatgaaaagatcagacacagatcctccaaattcacattgttgcctcataaatgattggctaaactgttttttctccactgattaactggaacaaaatagattttaaccaatttcggttaagtttctctctttctgccacatctctaaactttgacccatcttcagcctgaatcagtgtagcaattctccggagattaggtaggccgcagagtaaaactttctctgctctatgatgcagccaatcatgccaccctttcatgccacatataaccttacctacttctccctagaaaagacataccctttttgcctaacccttgtgaggctggcagatattatggtcatagtttttttctctattttaatagtccctttcttcacctcacaataattcttttgaatagggtctctctttgctaaatccagattcctctttttgactttgaaaatgaaggccacagccaaggaaagtcagaggcaaggaaggacaagaagtaaaagaggatgtcttggtggggttgaatccattgctcaattctggaggccctactttatgcagccctacagttgtctaacccacaacctttgactttagcatggagttcatgctctgatagctttcaactaaagcagccattctctcctctccccagctcttttctttctctgttgatacagataatattttgtatttgagggtctgaaacttttcaaaattcaaatgtcatggattgaaactactgtccttgcacagagtgtgagaatcaggtggtgtggggggaagtgctaataatggtctatgatccccagaaagcaacctatgttctaatgtaatttctacattcatattaaaatttagagatgattttatgttaataactcatctgcaaaagtgcaaatatatgtggctatatataatgtatatgaagcagtatgataaagtaaggagatatgtctcatgtagcaatgcaaatttgagtttaaatccctgttgtgtaatttttttctaaatagcttctgcatctataaaagaaaatatatctcctttattaagagattgttgtgataactacatgagataatactgacacgttttacatagaactcgatccataataagtactgaataaacaatatttgctactaccatttacattctaagtttaagagtagcattcagaaataagagaggatataatttccttgagaagaatgcccttgataatctctggtccttccatagagataataaaagttagagaaaggacaaatggggagcttttcttttttattcatctcatatttaaactttgtaatcacctttggattctctcttattaaccacctctaacttatcttcccccatccatgcaatatttactggatctatttcaggtctgtgtccaaaactttagttttctactctttgagttcaatgtcacattacttgtctctcaaatggatttcacaatagtctcctatttggtccttttcaagtcagattttgctttcacacactccactgaatgtgctctcttcttaataaaaaatctacaagcattcctctattactttaaaatcatttcagaaatcttaagaataggactctgtttcagataagggtaaaattctggacttcaagtaaaacatgaaaactagattaaatttcaggttattgtttctcacaggggaaatatgatgggaggattgtgctttacatatccttggaaagatgtttgccttgggatgttttttacccaaaacggtgactatagttatgttacctgcgactcaatatgcattcttcttttcttcttcactagtattacttcagtttggtcaggggctggcaattttttcaatttaaaatttcatttcctagatttacatttccatgaaactaagtttccaagtggaaacttccagtttcctggagaggaagtcctttggagagagttttgttttctttatgtagacaccaccactctttccttcttgctgcttccaccttcctcataatgtctgaaattaaggtctggggttttgagatacaggaactattttgcaaccatgaaacaagtcacacattgaagatggcacagttgaaagagagaagctgatactaggacatttgtgatagcatcaagccactgcatcacccagagctgcccactccagagttcattcaactatacaaaacaaacctttatttgataaagctaccatctctgaaggttttcttttcatgcattttatctgaataccaattgtgataggatgcccaaatagttttcaccttttctccaacatttatactaagctcaactctgaacactgcgatgatagaaatttaaaacttgagagagcttatctcagcctctcaatacttcccttattttaaaagttttaatggaaaaatttcaaacatatatttaaaaatagtaaatactatgaaatgcagtcacttatccattgcccaaactcaagattatcagcttacgaccacccttgttgtatccataactttacccgttctgtattattgtacatagagagggtaatgtatgcctaaacacattatcacattaccaaggaacacttattaacccacgcctcactgcagtgcactctcctgcagtcccctggcactggaccatagtgcttttgttggcagcacttgtgggagtgttactgccagtggacttggaatatcttggcctttccagcacatcaagcaattgacctcaaggggccagagaacaaagccacatcctggtccaagccatccagggttagagcaggaagcccaggagtgctgagcttagctttagtcccctgaaagcataaagaaagaaagccaattgactaaacccaatttgtaccacaggaaaaaaaaaaaaaccctcaagggcaccaaacaatataaaagcacaaatccccatccaaaggaaagaaacttcaaagattaaaagaacattagcccccacagctgagaaagaaccagcacaagaattctggtgactataaaacccagagtgtctttttacttctaaatgactgcactaactccccagcaatggttctcatgcagattgaaatggctaaaatgacagacatagaatttggaatctcgatgacatgtaacctcaggaagatacaggagaaggttgaaaccaaatccaaagaaagcagcaaaacaatccaatatttgaaagatggtacagctattttaagacagaaccaaactgaacctctggaaataaaaagttcactacagcaatttcagaatatgattggaaacaataataaagcattaataatagaatggaccaagctgaggaaagaacctccagggcttgaagactgtaccttctaattaatgcaggccgaaaaaaataaagaaaaaataattaagaaaatgaacaaaacttttgataaatatgagattatgtaaagagaccaagtctatgactcattggcattcctgaaagagttggagggagagcaaaaaatttggaaaatatatttgagaatattgtctatgaaaatttctccaacttgctagagggggtgacatgacaatttaggaaactcagagaaccccagacagagaatatataagatgactatcgccaagatatatagtcatcagattcttctaggttaacatgaaagaaaaaaaatattaaaggaagctatacagaggggaaggcaacataaaaagggaacccaattaggctaacagtggacatttcagcagaaactttacaggccagaacaaactgaggtcctatatacagcatacttaaagaaaagaaattccatctaaaaatttcatatccagccaaactaagcttcataagtgaaggatgaataaaatctttttcaaataaacaaatgttaagggaaattgtaaccaccagacctgccttacaaaaggtccatcagggagtggcaaacatgtaaagaaaagaatacctgctaatacaagaatgcacataagtacatactgcactgacactacaaaggaactatacaattcactctacattaataaacagctaacaacactgtgatgacataaaaccctcacatatcaatattgaccttggatgtaaatgggctaaacacagaatggcaagttggataaagaagcaagacctaatggtatgctatcttcaacagaaccatctaacatgcaatgaaacccataggctctaagtaaaggaatgaagaaatatctatcaaggaaatgaaaaacagaagaggcaaagggtcctattcttattacagacagaacagtctttaaacctacaattattaaaaaaaagatgaagaagtacattacataatgataaaagattcaattcagcaagaagacttaactatctgtaatagtctgttcttgcactgctataaagaaatacctgaaactgggtaatttataaagaaaagaggtttaattggctcatggttccacaggctatacaggaagcacggctgggagggcccaggaaactttcaatcatgatggaaggggaagtaggcacttcctcacatggccagaggaggagagagagtgaaggggtaagtactacacacttttaaacaaccagatctcatgagaacttactcactatcactagaacagcaagggagaaatccgctcccatgatccaatcaccttccaccaggcccctcctccaatattggggattacaattcaacatgaaatttgggtggggacaagaatccaaaccatatcactattctaagtatgtaagcagccaacaatggagcatctagattaataaaacaagtacttagaaacctctgaagagacttagataaacatacaatgataataggagacttcaataccccaatgacagtattagacagatcactgaggtagaaaactagcaaagatatttgggttctagagtcaacacttgaccaaatgcacctaacagacatctacagaacactccacacaataacaatggaaaatgcatccttctcatctgaacacagaatgtactctaagatcaaccacatgctcagctataaagcaattctcaacaaattcaaaaaaagcaaaattataccaactgccctctcagacaatagtgcaacaaaaatagaaatcaataccaagaacatctcttaaaaccataaaactatatggaaattaaacaacttgctcctgaatgacctttgaataaacaataaaatttaggcagaaataaaaaaaattatttgaaactaaggaaaacaaagatacaatatgccagaatctctgggacacagctaaagcattgttaagaggaaggttcataggactacatgcatcaatcaataagttagaaagatctcaaattaactatctagcattacaccaagaggaagtaggaaaaaaagatcaaaccaacctgaaagctagcagaagtaaagaaataaccaaattagagctgaccagaatgacattgagatgtgaaaattcacacaaaagaaaaactacggaaagcagtttggtgatttctcaaagaacttagaactaacatttgacccagaaatcccattactgggtatacacacaaagcaacataaatctttctaccaaaaagacacatgcgcacatatgttcattgcagcagtattcactacagcaaagaaatggaatcagcccagatgcccaacaccagtgcactggataaagaaaagatgatacatatacagcatggaatactatgcagccattaaagaaaaacaaaacaacattctttgcaacaacattaaagcagttggaggtcattatattaagcaaataaccacagaaacagaaaatcaaataccacatgttttcacttataagtgggagctaaacattgagttcacaaggacacaaagatgggaacaataaaaacaagggcctacttgaagggggagggaggagggcaaaggtcaaataactatctattgggtactgcactcactaccttggtgacaaggttatttgttcaccaaaccacagtgacatgcaatttacccatgtaataaacctgtacatgtatcccatgaacctaaaagttgagaatagaaaaaaacaaaaacatattaacccccaaatgatttactgtcacttaggagaggacaggggtctaggatatgatgattcaccaaaggttccatagtcaggcccggtggttcacaggtgtaaccccagcactttgggaggctgaggtgagcagatcacttgaggtcaggagttcaagaccagcctggccaatgtggtgaaaccctgtctctactgaaaatacaaaaattagctgggtatggtggtgcacgcctgtaattccagccattcaggaagatgaggcagaagaatcacttgaacccaggcaagagaggttgctgagatcatgccactgcactccagcctgggcaacagaagtgagactccatctcacttggaaccaactcaaatgcccatcaatgatagactggataaagaaaatgtggcacatatacaccatggaatactatgcggccataaaaaagaatgagttcatgtcctttgcagggacatagatgaagctggaaaccatcattctcaggaaactaacacaggaacagaaaaccaaacaccacatgttctcactcataagtgggagctgaacgatgagaatacatggacacagggaggggaacatcacacaatggggcctgtcagggggtgggaggcaagggaagggatagcattaggagaaatacctaatgtagatgagttgatggtacagcaaactaccatggcgcatgtatacctatgtaacaaatttgcatgttctgcacatgtatcccagaaattaaagtataataataaaaaaaaaaaaggttccacaaggtacaagcaagggtgatcataatggaacactttcacgttggatatccaaaggtataggaataaaaaagatttgagaatattgggaaataaaaaaaagatgatattcagaacagactaaattatctctctaatttggcataaacagtctgcaaaacaagggtgttttgttaattcacaacttgtaaaataaacaccacattattccatctaaagtgataattgatttccacagtgttaaaccaacaactttgaaaagaatttcatagtccagtctgatgccagaatccttatgcttctttctactttttgatcagtgtatattttgtaaacatacacaatgacaaatgacagcaaagatcactattttacattctcccttctactcttctacttctccatttttaatttgttctttaatatgaagttcttaaactcattatttaaagatatccaatgctatgaaaatttgatgtgtataattctccatgattatacatataaaagtatataattatatatgatttgttttatttgatttttaaataagtaatattctatacatattagtctatggcttggtttttaatgtgttatgataattcccccaagggtaagaaaatacttgtattttccaatttttgcatgcatgcatgcatatccatctgtaattataaatgaatcagtgtaaataacacatgctagattgctcttcttaatataatatgttagctgttcttttttccttcttttctcctgtttttccttttcctcctccttctcctcccctttcctctcttcctcctctgtctttatcttctttgatcagaccactcccttcttctggctaacaagtgtggaatgagaatgcttaaattcaaacatttggtcaagcagatatgttgcctagagcaagataacatttcctcacttgtaaaatgaggataagcataggccctacatttgaggttttggtattagaatatatattcatatacaaaaatgtttaatataatgcttggcacataaagagactataatcagtgtaagcagttattaactaccctgcttatctttccagccattctatttatatttttcacttgtttcgcagtgtttcagttataacagccttttctctcttccttaaataggccaaactttctcttgccttagggcttttgcactggttgtttcacccttaggtattttactatgaacttacttacgcatctttttctgcttctttttgccctctaaagtactatatataagttctataaaagttggaatctggtttgttgtgttctacactgtgtctctacagcctaatatcatgcatgacacagagtttatggtttaacatgtacttgttggatgactgtaaaattccatttgatatttagtatcagagtaacccataaagataggtattatttcctcaattttataaataataaaagtacaacaatgaggcttaatgctttattgatagttaagctgttgaattgggcttgaatgcagtttccttttctgtgtgttgtattctttccactgtttcctatgtgttatgcatttttaaaatacacagaaaattagctttatgagattgtaaatctcttcgaatcatgcattttactgtctctatgtaaaaattataagctcacaataagtacataatatgcattttttattactaatgattttcttcccttcatgggtttatgctttttctaaatgtaaaatatttgtctaatacatatatgtaaaatacatagtatgtgtaaaatatccttttctaagcttgctataaaatcttacttgtttatttaggtgttgatagttaaaattaatttggcaataggtatgcaggggatgtctctgaaacccttggaagacattgatggtttctgaacttcaactggtgtagcagattgaaggcaaatcccaggccaaatatacatatatatgtgtgtgtgtgtgtgtgtgtgtgtgtgtgtgtgtgtgtgattatatatatttatatataatatataaaatattatataatatatacatgttttatattatatatatataaggcataagacaacacagagagaatatgtttaatacgacagcaatttagaagtaggaaacagtcattgcttgtgaaataagggaggctatggtagttgctgtgctgagcaataatgaccaagtgaacataagtgggatattgcagccagaaataggaacaaaaacagaatagatagaatatttaaaaaaaaaacttgaaagctactgcttagaatgggcttgactcacatagctgtactgaggtgaaactaaaccaagagatctttggaaattttctcccgagacatacaagaatttacctagcaatatacagtatgcaccctttaaatcatcaggctggcaaaatcatggtttgtgtaatacttgacattgaaagttaaccccttcttttatttataattagagacaaatgaagaactatgtagaatgtgaggcaacaagaggtgtttagattgttctttcaacacttaaagacctggaatgtctggtcctttttctccacttttactgtaataaaggcagtccaaattctcatcatttaacccctgaatgaaaacaggatcccaacaacttgttcccctgatgcctgaggccaatgcacagtgtccggaattttcctcttaaatgtgaactgaccgtggtggtccaatcctaaaatctcacttcaggctcctagtgaagaactgttagttcttagctaacatcacgtttctcttggacagctcacatattcatagttgtcttctaatcttaaaatacacataaattcactcagcaagcttgtaaaaatgtacatatttggacctcaaattcaaagattctaattccatatttcttggatgtgacttggcaatttacttctaaacacatgctccagcaagtgaaataaatgactatataggcatgaagaactacttagatgccctaaacaccctgctattttacaactatttgccaagaacatcttccctgccaacttggtctttttgtcttggaaaattgctacaaattcctcacaaccctgttcaggtattgttcaggtactgatcacttctccaagctttccattattcctccttccctccactagatggttaatagattccttctctatatcaattctgtgccttgcagatacttattttactgcctattttatattttggctttattgtcatcttcacaaataaagcgtaacctcttgaagggttgaaaattacttttggtattagtggttagcaaactacttggcacatgttaatgaagaattaataattgctgaatttagcatttttacactgaccctaagagtaaggaccaagttctggttctatcacttttgttcagctaattatatgtagagatacagatatacatatacatatatacatatataaatttgaacacagggttctcctaacacacatcttaataggtacagaggagaaagatcttggatgtttgaaaaggtagagttgccattttctctctgtactctctctgtacatgatttttggattgagaatatatctagaatgtcaccaacaataaataaactatgctgggaaaatcatttataatagacagatttataatgtcaattattaacatactgcagactttttcaaataggggagttcacttggaaatttaaaaaatgccagctggtcggttctgagatcacagaaatgaagattcctttgcaataaaaagaatcactttgtttttttgtttttttcctaaatctccacttctgcttatagtgactgtacccaaatcaaggagttataaatattaatctggtaacttcaaattgagaattcatagccactaaaatgggttgccttaagaaaaatcttttttccatcatccaaggtcatatgcctcttatcaaaggaactacacatatattacaaagttattttcagtttttctcatgaatttctatgtatacacaggtctctgtatgtagctaataacatacttagggcaaaatgaaagaaaggaaggcaatatttcccatgctcctaagttaaaaaccctatttgtctgtgtgtaatatggaaatatttacatattatctgtacagatttgatcatatgccaaaacatgtcccccttcaagttctatctgctttggacatccaaatacaattcaaataactttcaacagttttacatgtaatgaattctcagcaaattaacacaagaaaataaaaccaaacaccgcatgttctcactcataagtgggagttgaacaatgagaacacatggaaacagggaggggaacatcacacactggggcctgtcggggggtcgggggctagggaagggataccgttaggagaaatacctaatgtagatgacgggtcgatgggagcagcaaaccaccatagcacgtgtatacctgtgcaacaaaactgcacgttctgcacgtgtaccccagaacttaaagtataataatgaaaaaaagaccaaagacgttttgtgtgtttaaattattcttaaagctgtataaaattagcttgtgaaagttgatctaactaagatacaacaaataaaatgatcagtgatatggtagatctctcttcctatagagtagcgatattatttaacatgatcattgtttagttataacaattacttaaaaagaaaattttgactcccatttggtataatttttctggaattcggtattaaagtgtaactcatattgttagatatttttcaccttgcattgtccatcacagtatctactgtatcaaatgcacagttcatgaatcagatcagctcttttatatatctgatatatcatagtttattaaacttgaaatttttgcgtggaaaatatcacatctgagccacttggaactttggagtatagtgaaactccaacacactgattttttttctcaatccaaataaagcatattggaaatatgtatacttgcttaaaaatcgtttctatatagtcagtatttaggtggataattcaaaagtactctacctaatataatgtgaatactaaggactaaaaaatatgattaaatttggaatctcaattttagagtttttgagatgagtttttttttgagaaattaacattaaatcattttcatgttttataaaaatggaacaaagtattctaaaatgtaaagaatgcttgtcctaatacctagtaagtaatccttaacatagagcttgaatcatgtaataaattgccattgttctgccctaaattttcaatgttaaaggttaacacttttgggtctaatagaataacaaagcagaaggactcctaagacattcttcagttgactaaactgtgagttggtactgaattgcctacaaaaactggactgaaaaaacagtgtttgcatttcagtaaggtgaatgtaagaaagccaattattaactcattagtattccgcagctttactttcaaagggtaggagacaaaaaaatgaaagaagaatgtatatataattttctgtgtttattctattgactgtgtgaaggtaccaggacagaataacatttggaaaaaaacaaatatgtattcataaattcaggagacagattctttttatgggcaaaacatgatttttttttgatcaactgattcaaaaaaataataatatgcaaagcaatggttatttccatataaccttaggctttttcttaataacaacacaattctaatttttgcctttaggattcctttaataattacatggctaataaactattgcttttcctcatgcatatataaatactgacttgttccttatgagaacattccagggtattattagaagcatttgtcttgcactttactctacgcaagcactttaatgatctcacattgtttggaaatcccaatgagcttttgaggtaagtctcctagccttatcattttacagattttcatttaaataataataatacttttattcctgcatagagtattatgtaatatatttaatacatatataatttatacaaaaatatacatgctatatatatatatgcacatctcatatgcatgctttttaatgcctttacattttttccttagtgttttattttataatcagtgctttataaaaggatgcattccttttgaaaactatgcttccttcagctactaggaacacagtatggtatatggaaagaaaaaatgaaaacctctgacaacacttgcagctaatatttattagattctttttgcttcataaagtgcataacaaatttgcatgcattttactcatatgatctctcacatcaagcggtaatggtggatatgtttgttattgctcctatttaacagatgagagtactgaaatataaaaaggtaagtaagtttcccaagcaactaagcaagtataagtcaagatctgaaacataacaatgtgtctgtggaatctgatttttaaatactgttaatcactttaacagcactaatttggcaataacttatttcaaaagctgcttcctttctctaagcctcaatttcttcatattaaaatttcagtatgaatattgcaacttttaggatactcatagcacaaatattatgtttaaattagtgattatcttagtactgagagtaatggtgccaataataatagtttccatttactaagtctctactgtataccagaagcactgtgaacattacttcctctaacctgcataacacatccccaagacgaacatttcacattttatagttagaaaaattaagaatcagagaaattaattttcccaagatcatgtaactaggacatagagtatctggagttaacatcctactgtatgtgactcaaagatatttattttcttatcaccaaacattgtaagtaatttttactgtattttacacatcaaaaaccttagccagcacactatcatacatttactgaaacagagtagatatccttatctttcacttagaggcattgcagcatggttaagggcaatgctcttgaagtcaatatagtaccatggaattaaaaacaagaaaaaaactgggcaagcctcagtcatactctactacagatgctctttgacttatgatgagattatattcaataaacccatcataagttaaaataccctaagcctaagatggatttcatctacccaacctactaaatgtcatagcataacatagcctaccttaaatgtgctcagaccacttatattggtctacatttgggcaaaatcaaatgcttatttcataattaagtgttgaatatctgatgtgattcattgaatatggcactgaagtgaaaaacagaatggttataggggtgttcatcatttatgtacataactgaaagcacagtggacataaagagtgtttgaagcattgaactaaaattaatcgccggatgatggagatgctacagcaacagagtcaccaatttctccttcttctgatgaggttcaaaaatagctggtacaggttgagtaacccttacctgaaatgcttgggaaaagaagtgtttcagatttcagatttttttgaatattggaatatttgtattacataatgagatatcatggaaaggggacccatgtcaaaatgcaaaagtcatttacatttcacgtatacacacatagcctaaaggtaattttaaatgatattttaaataattttgtgatatttttacatgaggtcgtatgttgaattttcttcctgtgacatcatgttggtgctcaaaaattttcagattttagagaatttcagatttcaaattttcagattagggatgttccacctgtagaagaaactggttattgacacttattgatggtctagagtttgatatggtttctctgtgtccccaccgaaacctcatcttgaattgtagctcccataatttccacgtgttgtgggagggacccagtgggagataattgaatcatgggggtggtttcccccatactgttctcgtggtagtgaataagtctcttgagatctgatggttttataagggtttcccctttcacttggctctcattttctctcttgtctgccaccatgaaagatgtgctttttgtcttccaccatgattgtgaggcctccccagctatgtggatctgtgagtccattaaacctctttttctgaattcacagtgttctttggaaagatagcaagtattgattgtacagcttatttcttattattacatatctttctgtaacaagcaagagcactgtgtctctgcctgtcagttctcatgagtctctcctaatcgacgtgccatttctttaacatctgtatgccactgctgaatgcagcaaaggcctccacaggtttctttgctgtacactttcttggttcctccggtttaacttcttcctctgcctcaacttctttacttctttcttcctacagtttgatcacttgaaaactcagtgccaacaaacccatgaatatcctcttcatcaatacccaattttagctgtttctcaagtgctaataacttgttacctactattcatcaacagcagagtctttgttaaagcttttgaatgtgttcacatatgtcttcgaaactttcttccacatgccgatcatgcactgctgtgtgacttcttcccatgctgttgcgatgttctggatggcacttaggatgtaaaaacttttccaaaactcttggagaagtcagccagactcagtcacttcactaatctacacaaatccttggcataaatatactttgaagggagctattgctccttgttccattggttgaatgaatgtggttttgttcagtttcaaatacacagtcaaaaaaattgcttttatttctgtttgtttattcacttttcctgattgtctttatgcagagccctaaagaagttagtggtaaagccaaacccttgacatcagcagaactttgagcagcatatttggttcttcatttctcctgaaaagagtgatagccaaagaacatatctaccctgatgccctgggaaaagttaatagtttggctgacagtacttgaacataattggagcatcggtgacagggaggactgaagaagatttatgtgattaattctctctacttgggtacagagcttaaacacatttgtgtcacatataggtgctaaccaaagagtaacttcagcagatggataagtgaaaccatttgtaggagatcaagtgggtccccttagtactcccttgtgttgtgatcaaagttattggaaaactacaatggactaacacaggaagaactactaatggccaaggctcttcaggaacaaaatttcaggtcattgtttcagacaaaaggacctgatgatctggttaaaataaaagtaataatgaaataggtagtacaagaaggaagctataaacaagctatgaccatgtgaccaattgcaaacataagaattgcgataattatgaaaagttctttcttattttggtgtgaatgtatttcaaaaagattaaccaaagtttcccttttttccacgtctcctgccatctaacataaaaatgtgataatagtaattaactttatgtcaccgtatttaactcatatgatactaaagagggagaagtgtatcagaagtggaatgaacatcgaccactggtgaacaaatgacttttgtgagtttgtatccactttcagagtgatggttagcgtgctttcagttggtagaagtatagatgcgtcaccttggaaagaagcatgattttaccgttacctttatttggaatgtaaacgtgatttaaaatggaatacattgatgtcaatttgagaggtaaactttagtgaaaccatatttttaagaataatttttttcctgttaaaattgctgcagcacccattgtacctcgtgtgggtaccctgttctgctcttgcatgctgttgctgatctgctgactttccttgtcagtatgaagtagttagtagcatacaggttaaaggtggtaacagatatgggttacaattattgtccccatggactctaatttggcttcatggatatcagtttgccctcactctcctctgattcacactaacttttccttcccagctgccagcctaggtgacctgcagattcttcacgcctaccaccagaaacagagagaatagcacttcacagattgctacaacagatcccagttttatagagtttattttttacagaaaatcttgattcatattgattattgtgttgtttgtttccatattaagtctcaactgatgtcttcagtttatgtgatatatcatacggtcactttatggataatgcatttgggtgatcacattaaatttggaaaatagtctttgaactcctggaattttaactcttagtctcaaaccaaacacatatctagtctaactttctaaaatatgactgaaatagatttatatagctactatatttttagtttcaaattttctctatacatttttaatagcattgtttaatacaagtccctggatatgttttctatgacctcaaaatgttttgaaattttgggtcaaataaggtatgtgagtgcttatttttttttctttgggggagtgttttcaaatgaactttgaagcccagttggacactaaccaaacatttaagaaaacataccataacccttgattttataaaagaactaatacctgctaatccagctcaataatgaaaacccagagatttcatctttcaaattccaagttgacatttggtgttgttatttataatgtcaaaagccagcaatttatttcttaagagaaaattcaaaacaccccttctagggttcttgacctccggatatctttctgtccaccaagatgtctaataaaacataaagtttccatgatataaatttaatatggattactgaaatttgagtaagagttcttattaaatttaaaagtacagagtattctttcttcactagtgtagatgcaggtatggtttcaggaaacctatcatagcttgaatattttaaaactctattgatttttgaacatggtatagacatttctggcattgtgtgtgtgtgtgtgtgtgtgtgtgtgtgtgtgtgtgtgtgtattattgggggatgatgcgtatatgtctaccaattaactgtacatacaataatatcttgctatcctacaaaaatggcattacatttcattttaattttttaatgaagaaagggttatcaaaatttagttactacttctgaaaatttaatcttaattttaaactagaaatgtcaaatggcaaatgggttttttcctcatttcatgaactgcaaactcacataacatattgatgtttgttaaatcatttgcagtttcttagaggttttaaataaaaatatttactcatgcagaatagttattttttaaaattactaacacgtagaatagacagcaaattattaatgaaagtataatttgactttccattattttctttaattcaaaatattatattctgtctaattatactctttaaaaatgtcatttcatgatgcacgtgtctactttatctaacttcccttaaagcctaaaagacctaagtgaagattttaccatcaaaagttaaaaactaaagcgagccattttccaagaattagacagtatttttacacagccattaaatcataccacatgacaaggctgataaacttcatctgtcatatgaaattatctaatacccctaaaataaaatataattttataaatttacctggttatctgaataatcagatttttcattttatgaaatattcttaaatgtacaaaacattttaaaaatatgaatacataaaatatgtatattttatactttaatttgtgatagtatgggttttaaaatattttagtgttagatttctttttctttgatttggccaaatattccatttcatttatttttgtttatttatttatttatttatttatttatttatttatgagacacagtctcactctgtcacctgggctggagtgcagtggtgcaatctcggctcactgcaaactctgcctcctgggtttaagtgattctcatgcctcggcctcccaagtagctgagattacaggtgcacgcccccatgcctggctaaaataatattcagtctaattttatatgtctacacacaaacacaccagtattccctcacattagaatattgttatattattttctattatttcaaaaacatcttattgaacacaaaacaaaatttttgtcatcattgtagacatgacaatgcaagcaaaaacatacttgaaattaaaaagaatcacactatgtatttttatacatgcaaggtgaattttgattaaagattaattatgttaaaaaatcttaatcatattaatactccaaactatcctaaataggcaggtaagtctcatttaagtctgatgcagctgttatttgtgaaactcatgttaatgttaatggttcactttctcaaaaaacagtatttgaaatgcctactatgtacctggagaaattcttggattacagcaatgaatcaaaaaagatagtctttgccctcacagaaattgcatgtaatataatgatccaaatattctctattctgagataaaaggtgctgacagttgtttgcagaaaaatattagccacaggcttgcatgtttaccttccatctgtcttctccctagagcatggcttcgtattcacaggcttacaaaattctgtctttttatatagggaattcttcttgttttctaaccactttgttaacatgaaaacaattatgtgctttactcatgtaataagatttacagaggatatttcttttacatattgttaaaatgttagtgctatctctgaacaactatatcacagaatgaagaaggcacatctttgtgtagtcttaattttaactaatagtcaataattgaaaaacccagaaataaattaatctctgattccttctaaagaaaacatatatataattataataatgttcacacagcttcctatcagtgttttacttgccaacaataataaagactttatacaaaatagtgatttttaatcagataaatatataaagttagcaatttaggattatgtgaaaggataataattatctgttaattttaaattgctggtattttagtcaactgaaaatctatcatgaatattagctgatttacctctcctgaaaaaaaaaatgaaagcaaggagtagcacacagttagtttttttaaaaaagtatgaacaagtatgaataaaaattatattttgtgagatttagctggaattttgaaattggctgaaataaaattgaaataattgcttttctcctgggattcaaaatagacttcaaaaaaaaaaaaaaaacagttttaactgaaacaaatctattcattgtgaaacattatttcaaatccatcagggtccaaggtgttaaaagaatattcaaataatacaaataaaacatttacttagcaaaactttcatacttgctatgcaatacagaatggaaattctaatagaggtatcaatggttcatcagtaacagaaaaacaaagaaaacatttgttataatagtgttccataaaacttactcatcgaaaagaaattttagactgattgtttctaagatttggtaaagtctcaagtgtagcatgaaaattaatcacttgggggatggagccaagatggccgagtaggaatagctctggtttacagttcccagcgtgagtgacgcagaagacaggtgatttctgcatttccatctgaggtaccgggttcatctcactagggagtgccagacagtgggtgcaggacagtgggtgcagcgcaccgtgcaccagccaaagcagggagaggcattgcttcactcaggaaactcaaggggtcagggaattccctttcctagtcaaagaaaggggtgacagatggcacctggaaaatcgggtcactcccaccttaatactgcacttttccaacgggcttaaaaaacggcacaccaggagattatatcccgcacatggctcggagggtcctatgcccatggagtctcgctgattgctagcacagcagtctgagatcaaactgtaaggcggcagacaggctgggggaggggcgctggccattgccgagttagttgtttgattaggtaaacaaagcagccaggaaactggaactcggtggagcccaccacagctcaaggaggcctgcggcctctgtaggctccacctctgggggcagggcacagacaaacaaaaagacagcagtaacctctgcagacttaaacgtccttgtctgacacctttgaagagagtagtggttctcccagcacgcagctggagatctgagaatgggcagactgcctccttaagtgggtccctgacctgcgagcagcctaactgggaggcatcccccagtaggggcagactgacacctcacacggtcgggtactcctctgagacaaaacttccagaggacccatcaggcagcagcatttgcagttcatgaaaatctgctgttctacagccaccgctgttctgcagccactgctgctgatacccaggcaaacagggtctggaggggacctctagcaaactccaacagacctgcagctgagggtcctaactgttagaaggaaaactaacaaacagaaaggacatccacaccaaaaatccatccgtacatcaccatcatcaaagaccaaaagcagacaaaaccacaaagatggggaaaaaacagagcagaaaaactggaaactctaaaaagcagagcgcctctcctcctccaaaggaatgcagttcctcaccagcaacggaacaaagctggatggagaatgctttgacgagctgagagaagaaggcttcagatgatcaaactactctgagctgacggagaatgactttgacgagttgagagaagaaggcttcagatgatcaactacgctgagctacaggaggaaattcaaaccaatggcaaacaagttaaaaactttgaaaaaaaaaattagatgaatgtataactagaataacaaatgcagagaagtgcttaaaggagctgatggagctgaaagccaaggctcgagaactacgtgaagaatgcagaagcctcaggagccgatgagatcaactggaagaaagggtatcagtgatggaagatgaaatgaatgaaatgaagcaagaagggaagtttagagaaaaaagaataaaaagaaacgaacaaagcctccaagaaatatgggactatgtgaaaagaccaaatctacgtctgactggtgtacctgaaagtgacggggagaatggaaccaagttggaaaacactctgcaggatattatccaggagaacttccccaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaagattgggttacccacaaagggaagctcatcagagtaacagcagatctctcggcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccccaaaagagctcctgaaggaagcactaaacatggaaaggaacaacaggtaccagccactgcaaaaacaggccaaattgtaaagacgatcaaggctaggaagaaactgcatgaactaacgagcaaaataaccagctaacatcataatgacatgatcaaattcacacataacaatattaactttaaatataaatgggctaaatgctccaattaaaagacacagactggcaaattggataaagagtcaagacccatcagtgtgctatattcaggaaacccatctcatgtgcagagacacacataggctcaaaataaagggatggaggaagatctaccaagcaaaaggaaaacaaaaaacggcaggagttgcaatcctagtctctgataaaacagactttaaaccaacaaacatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcatctctgcaccaagaggacctaatagacatctacagaactcttcaccccaaatcaacagaatatacatttttttcagcaccacaccacacctattccaaaattgaccacatagttggaagtaaagcactccccagcagatgtaaaagaacagaaattataacaaattgtctctcagaccacagtgcaatcaaactagaactcaagattaagaaactcactcaaaaccactcgactacatggaaactgaacaacctgctcctgaatgactactgggtacataatgaaatgaaggcagaaataaagatgttctttcaaaacaacgagaacaaagacgcaatataccagaatctctgggacacattcaaagcagtgtgtagagggaaatttatagcaccaaatgcccaaaagagaaagcaggaaagatccaaaattgacaccctaacatcacaattaaaagaactagaaaagcaagagcaaacacattcaaaagctagcagaaggcaagaaataactaaaatcagtgcagaactgaaggaaatagagacacaaaaaacccttcaaaaaattgatgaatccaagagctggttttttgaaaagatcaacaaaattgatagaccgctagcaagactaataaagaaaaaaagagagaagaatcaaatagacgcaataaaaatgataaaggggatatcaccaccgatcccacagaaatacaaactaccatcagagaatactacaaacacctctacgcaaataaactggaaaatctagaagaaatggataaattcctcaacacatacacccccccaagactaaaccaggaagaagttgaatctctgaatagaccaataacaggagctgaaattgtggcaataatcaatagcttaccaaccaaaaagagtccaggacaagacggattcacagccgaattctaccagaggtacaaggaggagctggtaccattccttctgaaattattccaatcaatagaaaaagagggaatcctccctaactcattttatgaggccagcatcatcctgataccaaagcctggcagagacgcaaccaaaaaagagaattttagaccaatatccttgatgaacattgatgcagaaatcctcaataaaatactggcaaaccaaatccagcagcacatcaaaaagcttatgcaccatgatcaagtgggcttcatccctgggatgcaaggctggttcaatatatgcaaatcaataaatgtaatccagcatataaacagatccaaagacaaaaatcacatgattatctcaatagatgcagaaaaggcctttgacaaaattcaacaatccttcatgctaaaaactctcaataaattaggtattgatgggacttatctcaaaataataagcgctatctatgacaaacccacagccaacatcatactgaatgggcaaaaactggaagcattccctttgaaaactggcacaagacagggatgccctctctcaccactcctattcaacatagtgttggaagttctggccagggcaatgaggcaggagaagaaaacaaagggtattcaattaggaaaagaggaagtcaaattgtccctgtttgcagatgacatgattgtatatttagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctagaaatctgacttacaagggacgtgaaggacctcttcaaggagaactacaaaccactgctcaatgaaataaaagaggatacaaacaaatggaagaacattccatgctcatggataggaagaatcaatattgtgaaaatggccatactgcccaaggtaatttatagattcaatgccatccccatcaagctatcaaggactttcttcacagaattggaaaaacctcctttaaagttcatatggaaccaaaaaagagcccgcatcaccaagtcaatcctaagccaaaacaacaaagctggaggcatcacgctacctgacttcaaactatgctgcaaggctacagtaaccaaaacagcatagtactggtaccaaaacagagatatagatcaatggaacagaacagagccctcagaaataaggccgcatatctacaactatctgatctttgacaaacctgacaaaaacaagtaatggggaaaggattccctatttaataaatggtgctggtacaactggctagccatatgtagaaagctgaaactggatcccttccttacaccttatacaaaaattaattcaagatggattaaagacttatatgttacacttaaagccataaaaaccctagaagaaaacctaggcaataccattcaggacatagtcatgggcaaggactttatgtctaaaacaccaaaagcaatggcaacaaaagccaaaattgacaaataggatctaattaaactaaagagcttctgcaaagcaaaagaaactaccatcagagtgaccaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatataaacagacacttctcaaaagaagacatttatgcagccaaaaaacacatgaaaaaatgctcatcatcactggccatcagagaaatgcaaatcaaaaccacaatgagataccatctcacaccagttagaatagcaatcattaaaaagtcaggaaacaacaggtgctggagaggatgtggagaaacaggaacacttttacactgttggtgggactgtcaactagttcaaccattgtggaagtcagtgtggcgattcctcagggatctagaactagatataccatttgacccagccatcccattactggatatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacacggatgaaacgaaaacatcattctcagcaaactatcgcaaggacaaaaaaacaaacaccgcatgttctcactcataggtgggaattgaacaatgagaacacatggacacaggaaggggaacatcacattctggggactgttgtggggtggggggaggggggagggatagtattaggagatatacctaatgctaaatgatgagttaatgggtgcagtacaccaacatggcacatgtatacatatgtaacaaacctgcacattgtgcacatgtaccctaaaacttaaagcataataataataaaacaaaatagaaaattaatcacttactgtttttaagtcatttataatatttactctgactgttgtcaataagatccctcatatctctaaataaacccttttaaagatactgaataaactccttagagaatactgatgggatgctatttgctattttctcacaaataatgctcactccttgcctgtcccgaagtattaagataaaaccaagcacattaatcaattttcaccaaaatatattcaataaagaagatcattttatcaagcaaagtaaatatatttgtaaggatttatctgaaatgtgaagctgctactattgaatcttccctctttattaatgattttttaaaagagaatgtaatataacaaaaatcacttattaattttgatggtaccacactatgaaattttctgacactaagtattactttccaatagaaatcatcacattcatattgacctttggtatgactgtaataatcctctactttgtgttaaatgaggcagtgataccactgagccaaattgaatgacttaatgcattttctgattttttctgagtaaaatatatttttaaataataaagttggccgggcgtggtggctcatgcctgtaatcccagcactttgggaggccgaggcgggtggatcacgaggtcaggagatcgagaccaccctggctaacacggtggaaccccatctctactaaagtacaaaaaattagccaggcatggtggtgggtgcatgtggtcctagctactcgggaggctgaggcaggagaatggcgtgaacctgggaggctgagcttgcagtgagccaagatcacgccgctgcattccagcctgagtgacagagtgagaatccatctcaaaaaaaaaaaaaaaaaaaaaaaggaataaaattatctgtgattgtgaacaaacatctacacacagttgtgaatttgaatttttaattatgcgctgctatgacattgagtgatgaaaaaagaattattctttgtaaattatatgttactagatgaggtcaccatcaactgatttgttggcaaatcaattaaaaagtcaaaaacatttttgactaatctacatacattcaatcaacatccatcttctctatttcaatcacatatgctctttctcatcttctccagctatcttcttgccatttcttaaacttatcagcatattcatcttcagagtctttgaatttattcctctgtctataatgtaaattccctggatgaatgcatggctcacatcttcagtcttaactttatgcagttttgctctaatgtaatttcctcaaagaaacaagtcgtctatctgaaacagcatcactgcctcctcagttgttaatcacaccttggtttcttgctctgtttcgtttttactccctgtctctatctccatgtggaaagtggttttgcctgttttcttctctgatgcatcgccagtaccagaacagattctcacacaatatagagtgtcaataatcataccttgaagaaataactaagcaaacaaatgattaatgaaatgactgattgaacaacaaaattatgtattgggcatgtgttcaagattgtttgtaacagggaaggagagaattgcaagcaggtggtctttacttacattctatttcagctgttttgttgtaaaaatgaagacaaatttgggagaataattttaatactaaactttgactaggaactattgtctttcttactcaaaaccaacttaagaagcaacactctcaaccacacccaggtctgacaactcaaagcactgctctgtaaaattgtaaattttcaaaagcaaacacacaaatgacagtaaaagcaatatcatagtttccaatgtgtcctgaggtacatgaaaagagcttagtgctaaccaggtcagcatttttggaatgagaaccaaggattactgtatgacaaaatggagaatctagaaagcaaaaacttggatcaataataaacaaaatcttgattcttgacatcaatggcaagttgctttggtggattttttaaaaaagcactcaatatattagtatatatctacattttgttgaataaacccatttgaatttaaccaaaagtagtgtactttaacagtgcgtagattataacaatttcataaaaattttatattgagtatacttaacagattcatttctattcatactgaaaagtaattatacattctttgcttaaactacactacctgatataaatataaaataaatgctcattttagtatatatgtcaaatttgtatgaagtagtcatagatgaagggatagcaagtactttcatgttctttaaatcacatgacatacttacatttagttgaattacataagtaattcaatttaggaatacttggcatttgaatatttgttttgaaaactgctgtaggaaatattttaagtccaaaatattttcaagatagtttttgaattactatttatatctagcaattgctaagaaactttatactgttgattactgcactctattcaaaagtgaaggtagtgatcagattttcagtgtcttaacagggaagaaactcacagtccaattgtctcagcaacacaaatccgaagtctaacagtcaatatttgatcataaggaatggaagaaatgaaataactgtttacggcaaaaggaaatttagagaagaaaggccttaaagacagggaatggtaaaatctaagacctcaagagagcccgtgtaaggaagagaggatggagaaatactgcttaggaaagttctgtacaaagaaaatcttcatgacctttatttcaaagccagtaattgaactttggtgcttcctcccctcttacatcgataaatttccacaagcaactcactccccaaataacttttaaaaaattatacaatctaaatgtaaacttcttcattgagtccatcatggcatccttggttgatgttgctttcaaattatggagacaactcagatttacctttcatttcccaaatttactgagagtgtacaatatattttaaactttaaattcatgaagctccttcagggtgggttttctaatctctcacgtagtgatatccttttgtctctgcatctgtccatttctgtacagtcacagtggtgtgttccaaccatgacttaaaatcattttctccttctctttacgtagcagtgcctgtacacttcggcagattctgagaattagtttgaatgagtggttccaaagtatgtttaatgtcaatctatagttgctgtaaagcagccaaggactctgatgtggctggcactcagtggcaggtctttaagtagtcccagagtaactgtccccacctctcttctttcagtaaggcttcaatgctataagcaacttagagtcaagagaaactagaaaatatctgttcagaaaggtattttagacattctcacttaattaaacatagataatgtgatctgtttctctaaatccattctcccctcaaaatgaaattacatactaaatacgctctacatgctagttcaagagctttctggtggtagtcaggaactaacatatctctttgtgtgtccactttgcccctttacaacgtaagcttagtattaccagcaattgtgatgaaaataatctcttgttcagcccaagatgatgtaatgaatctgtcattaaggtgctgttgaggacaaagatcaggaattgaaagcatctaacagagcccaggatgagaaagaagtttatggatctctgcctgttaaattcataattcttccaagcatgcacatatgtataaatgcacttgacatatatattcacaaagaatatttctgtcccacaaattataaaagtctttgagagatagagacatgtgtataaataagtgttctataaatgtagctcaatgacttacataaacaattagctataatttaaaaaatgagctatttagatgctttgctttagtagtgaatgtatttagatatagagattatttagcaatagacatcagttaagtgagccacaggcaatttgacttcaagtaaatttactaatttagctgattaaagatttgttaggcctttcttttcaaagaagcttcaaagcctttaaaaatgagtgctcatcattctggtaaaataggaaacccacatgttttattactaccaattaaaagatactggaaaggagaaattaagagagtatagagcaaggctaaaaataagtatttcttttctttctttttttcagacaggatctcactctgccacccatgcttcagtgcagtggaatgatctcagcttactacaacctcccctcctggcctcccaggttcaagtgattctcgtgcctcagcctcccaagtagctgggactgtgagtgtgtgccaccacacctggctaatttttgcatttttagtagaaacagggtcttgccatgttggccaggctggccttgaactcccgagctctagcaatccagctgcctcagcctcccaaaatgctgggactacaggcatgagccacccaacatggccaaaaataattgtgtcattgggaagttttgattgcctaaagaaaaatataaaaacatttgcatggattgtttcccttagatttttaagacaaaaatgattaaagcactacattataatatctggcagaggttcatttgatcaccatatttttagaaatttaatgcaaaagagaaatgcaaaacatttactctctagatcagtatttatacttcttgtgatgacttaaataactctggcagctttctgagtagttggcagtttctacaaaatatgccaagtaaggagcacaacattagtatactatatcatgtcattttcttctaaaacacaaatattgaacttttaccacctgctactgtacagcagtgctatggcaacatcttcgtagagttcctaagctcctttgaaaagtaggatctaatcagcacaaaaggaaataaactatcatcattgctgttgctataattacctagttggcaaaataagctctatctatacagaatcacacattaaaacaaatttgcttaggaaaactaaatgttttatttcagcccagcttacattttcaaatgaattggttaacaattagaaaagaaattgttgataaaccttgcattatgtttattgaatttttatttctggttaaaaaggttaactgttttcactgtggaatatttagaaaatatagatttctttctttaaaaatagttagccataaggaagccataattcatcactgtaacagagaatcttttttcatatatcttttactttatagtattttaatattttttctctactgtagacacatttgggatttatttccaacttacataaatgcatcataataactgtaactccatatgattttattatgaataaggatagattttaaaaacataatcaaaatgttcacatttttgtaattacttaatgtggcaaatattttattaatacttaaatttgtttaatcagaggccagcagtactgtagatatttctgagtgatttcacagaatgtgtgggaatatacatctgcgtcaattctttaaatgagtaaaaggagcatctgtaatgcagcaaaatcaatcatgaagaagtaactgatgcaggaattgcctatacaggtttccaaagtacatgtacgcgtgtagattgagttacaagaaaaaggtcactttctaataaggcaactgacaattattttgtaaaaaatatgaaagtgcaagcacatactttagaacaaatattaggtacaagcttaatggaagagtctatcatgtaattagcagacaaaatgagccacagaccacatttacatacttagtttaaaatagaaacagagtcccaagagataaccattttactgctgcccagttgaggagaaaacactttcaatatttctacattaacgttcagagagtcaaggtggccgatgcagaacaaaaacactaatgataaggaaaaaaagtttttccaaagaagaacttggtatgaattagatattaattgttaattacttcagaaggcccaagtgaaaattcagacttctttctctgctcttggccttatttcatgttcccgctttctaagcacattaggttttcctattaatcagtcacaatcaccatgtctaatcggctgtggatctagatccttaccagatcccagccaatagaagttagcaatgtaaggcttattttgtggaccacttctttggaggaatacgttgtgtttctgttagatgactatacacatgatagtcaacttccagcccatatctggatgcattcttgagatgactctgaatcaaataatttcttttaaaccaaaactaaatatttatattaattgaatgagacttttataaattattccaagtaaagcatgaatttccagagactggcataatttaaacccatactggaggggaattatccatggatttgggttgaaactttcattttagtacctctactcatagtagattgagaattaaaatctgaagaaaaccctcttagataagacatttgtaaaataaaaaactcacttaccattccgactttcttcatcaatagcaactatggtagctggtggtcctcccctagctagtttgcaatctaaagagagaaaataaccaaaagtaataattgactgcaggggcacacacaatgagaaaaaaattcattgagatgtatattaatatttaaaaaggaaaatcttgcaatctaattaatatgcatcactacaattaatattatttaaaaacattttataataaccacatagattccttaccacatcataatacagtcactttgtgcatcacaaaactactcaaatcttactgagaaaacaccagcagggaccactggagagcagaagtccttcaggacagagataatgggatggaaatttaacccaaagaaataacagaaagggatgattaacaaggataaattgtaattaaagcatcacaacagaaacaaacataattggactttaattgtgataaagggtctaattagagagagtgaatagaattttaataatgttctaaagagaataaaacaaagacagacaagcaatgctcatgaggttgtttggggtttttatttttgtcatcttaccctcatattgccagtctggagtcaaaagtatagagtcatcaatggaagcagatcagaaaaatggaagaaagaaaggaagagagaatatatgtatatatttagtgagagatttaaggatataaaaagcattatacaataacattatctaatgatttgtggaaatagaatatataaaatccctatcagatttcctacttctaatataatgttaacacattcactggataatacacatcattagcattttaaaagccgttacaaaaaagactagaaaataacataaagtaaattggtatttttcttacgaaaaggtaaatacgaattacttatgaacagtctgttatctgtatgctgaaaaaactttaagaatagtgcctgtcaatcagtagtgatgattaattcattatttcaaacactgctaatatccttccaggtatcacatgataatgaacataaaaaatagtatgagctataatatccatgacagttgaaatgtgaaaactttgcctgcaggatgtcaaatgtgcacctctgagacataaagtactctactaggaaatactttgtgaggcagagagggctatgtcatgcagttatacatacatggcacactcctgtacagcagtgcaaattaattttgcttgaagttttccaaatttgtgtgttatttgggaaataatttcaaggtttatttacttattaaaattctgccatttattatgtacatatacatgaataattaggccttcaggaagcactattctgtattgtaaggtatgtacgctctcatatgaagcaaagaagctgggagatctacacattttctctctttacacttgtcaatattgaaggagttccaagtcataacattttcagatctaaaatatctcacactcattacgcctcttcctctccttatgccctcctacagagcccagcactacactatttgtcatctctgctcttgatttagtttcctcgctgatctcccagaagtcttgttctcatcctgcattcatctattcctttcatgagaatgattttcatgtacccaaatcaaaagtgaaataatagcattcctctgaacaaaaaccttacatgtttcttttggagaaaatgaaaaaaaaatcagaagaacaaagtttcttcacatggccttaacatcctttattgagaattaagcaacctgtccttcaattacatgaatcctcttactgttgctggaatgtagcctgtatttttagcaaaattttgttatctaaattcattgttgcctttttttgcctagcaaatctctgcttctttttgtagaattagatatttcacatatttgcacctagtgcgaattaattttgattaaagccttccaaattttcatgttacttgaaaaatgatttcaacatttctttatttatttactgttttataaaattcctccaattattatgtacatagaaatgaataattaggctttggaaagcactgtattgtaaggtatgcactctctcatatgtacacacacacacatatacacacactcatgtcactgtgtgccaatgccataatacctactgaaaatagataaaaattatgtattttagtgtgaatgttggtagaggaataaatatttaatcaacaactttatgggcaagcagaatatagaataataaaagaaggggaaatttggatataaatatttttgaacctttttacagtttgttactattaagtttaaaagtaggctttatgaagctaagccaaataatatcttcatattccagcccttcctcactctccgcctttcccattctcaaagttaattctccattcataccaaaccaaatttatgttttttgcatcaactgttaaaatatactttccactcttcttcccctggttaattttattcctttttcaggaatctgcctacgcatcacctcttcttgaaaatccttctcgttgtcattctagattaagtccttattctctgtattcctgcagtacacactgtatcccattggactaattgccccattggcacaatactaatgtgtctttctctctcacaagagcttcttcagaccatgcctgcatcattttcaccttggtaacctcagaacatgatactggtcctgaaagaatgtttgttgactttttccacaatgtagtctgctaagctacaatcttccattaaaacctctccatgagagcagctcagaagtctctgttctcactaacccctcaatagcagaaacagcccagaagaagctgcttaactacattttctcctgctacagtacccttagataattcccactacgatttattattttagtagattcaaaattctccccaataaaacattctttatatactacatatacttctggataaatacaaaaataatttaaacttttttaagactcaaaacacaaaatgaaaagaggttaagcagacacataataaataatctattaataacattgttcataacaaagtgtttgtttttaaacgatgcattcacgacagcataattaattagttttgaagtgcacaaaagcatttttaataagaacaattatatttagaattgtcttggaaagaaagtaatttggatgtaatagccaactatatattatgtatgaaaatatccaaatgtaaatcaaagggaagactagaaagcaatttgggggatggggagattgtaccctatggtctgtggatcatctgtctgccacaggaaagtcaggtgagctgctgatacctgtaccctggaaatggacttccttaatctatttaatttcacccttgactgtcctggttaaatcacaaattcattgtttttcatgcctaaagtttctagcctgttaggcctatactcattttccatatccaatttgtggtaaagtacaggatatgaataccaataactgaatgctcagtgtggcttatttctgcaaacttgtcacaatgctaaaaataagccatatatttaaaaatattcatatgcaatagatgggatttaaaatccaaagaggagaattaaaaagacaaataatgactgatctcacagatactaagcctgtgatactctgttgtcattgtagcctgaattttaagagcatgttacagacaggtcagacaaaggcttttgaaaatctaggattttccgaatatgctcatttcgtagaaatgagagcaagcacccaggaattcaaattctattcccactttagcctattctcaaaatgttcttttaacgttgatcaatgtgttttcaataagacttcaaaactatttactttaaaaaatatattaacatagtaattgcccttatatgttaataacttgtgtattgaatttcctacccatatttatcttctgagcctgggtcccatttgcccagacaacttctgtacttgcaatttcaaagttgtcttaaatgtagccctccaaatcgcatcccagttgctatcatagccgaaaactggatattttcaatatatattatttcagtgaatggcataattctgcaccaagccacataagtcagaaaccaggaagtcacatttcattttacccatgtttctagctttccaaaatgtaccgatcgataagtcttgaatttaattcctaaagaaaaacttgtcatatccactcactgctttcaatctgcagtggtaccaggctaatcttgtctcttacctaatcaaataggttttcctaactgctttccttacaatcaatcttgcccttactctgagttaattttctgtctttaagcagagtgatctttataattaaaaccttgcttatttttaaaagaatttaccatttattttaggttataagctaaaatattttggccatctacaactcatcacaaatatgattctagaatgtaaactaacatattttatataacctacaaagtcctccacaatatgccttctccttccctctccagtctcatctatttccatgtccctcttttcccaaagcaaaatagtttttgatcccttgactaggtaaggtttcccaatatatactctcataactctgcctcataatatcaatttatgattacttgattcttcacagaaagaaaactcagtgataacattgaccttgtttctattcctcacggttgtgtccacagggcagattttcctggcacatttttgattccaagcaattatttactgaatgcaaaaacaaagggcctcaatcaaatttgtaacaataaaattaaaacaacactctgtacattaattcccttttttctttttaatttttcaaatgtctttctcaagtgcaagtacagcaggtccttgaatgacattgtttcattcaatgtcatttcattataacaatgaaaaaaaaaaacaactaattccaggcctgagccactatctgtgtggattttgcaagttctccccaaatctgtgaggactttccctgagtactccagtctcctcccacatctcaaagatgtacatgctaggttcattggcatggctacatggtaccagtgtgagtgagtgtgggtgtgtgtgtgagttgccctgagaaggaatggtatcctgtccaaggtgggttcctgccttatgccctgaggtactgggctagcaggctccctgatgggaggccctgaactggtaaataattatctcactttttttgattaatctttcttaaatgcatgtatagctcacatttacttcaatatttaatataagaaatttttggtctttatttagaagtgtggtgatgtttttgtaaccataactatgtcataggaacttgtttatattttgtttagcctaaaataaaattggtttcattttatgtcatttcattgaaagtctcaatttccaagaacctacggacaatattaactgaagacttactgtaatgaggaaaaaattgacagataatttgttgtctaaagataaggtcattggtgacaactcagcagatgtgaaaggctaccaataaagtaagaaaggtgtagataattctgcaagaatttgaggttatttggaacaagttatgaaagattagagagagctcacaataatagacaaagtaaagtgatgaaaaaaaaggagaaaatgttcacttgcttccaaatgtctataatttctattagaattccaagatgttttatgattttaccaaactgtatcttaaaggaataaaactaagaaatttcaaatactaaagtttaaattatatcaaagatcaacttaccttttttttgtcatcttagaatttttaagctatttccttacaagctgcctaaatcaccagtgaactctgtggcacctagtagagtatttgacttaacataatcatttaatttatttgctgaattaggaaatatcttcctctatggaaaattaacaaaatgaataatccatcaaatccttagctttaaccatttcaaatctttgggggagtgttttaagatgttaaagaaatgggtttctaatatattatagtggttgtgaacatgtgctttggagtcacaaaacctaacttcaaatcctaactttggtttttaatagttgtataatattggacaaattatttaacctcttgtatttcattaatggggataagagtaattacaactaactcatatatttttacaacaaggacaaaatgaggaaatctatggtaatttcttagaagagtgtctggcaaaatgtatagacagactaggcctacatttgcttttattagtatccttattttcattaggaatatattcgaataaaatgttttttctatttttttcctttcatgcaagggctgatagtaaatatagtaaataaaccctcagctctcccaaatattcagtgagggcagatcttagttatatatgggattgtgaaatatattgttattaagaataaaagtaattacatgaaatgtcactggtggtctgtagggacaaaaatttgcttgaattcctatcccagataccaagctagatatactctgatggattaaatttactagggaaaaatagactccttgaacttgaagcttaaaaaaagtaatggggttctcacagtcctctactggtcccagtatgcccctgatatgagttggtgagattccacagaaagatcaaggaagagttgcagattttgtgaaacctctattcctgccaacatttctctattatctgtttcgttattcagagtaatctagtctcttgctcatgtgtttgtatttacacagacacacacacacactgaatctattgctaagttcaaagcaatttggcacctcattcaaagaaggtactgtgttctctttaaatttcatgctacacaagcattctgttttcaatttgcatgtcacaagcagcaggagagggacttttctcatttttcctgttgatctttggtatattcattttcaggaaaatacacacaggagtgaaatcttaagacagatactacttattttacattttgactgcttcatccaaaagaaaaagtttgatcttgaatttataaaatcaatggaacaataatctaacttgtatgatctaaagttacagtcaacaaactaatggaaaaagacaatgatagaacaaaagcaaaataaactgagtaaatttaaggacagagcaagtaattcagttccaattcaagaacaggatatgctacttgtgttactctcttggcattactatttgcagatttcagatttcaccatgaagggagcaaatgatattttatgtaccttagtgtcattattaattgaattatataatttgatgaagactttaaaacaacattgtctagtaatatccaccaaattcattcatggtaattactcaacatcattgctttcatcaatacaatttactctagagaccatagctacctcaatctgtacttttaaaaaaaacaatttcttattattttattttattctaactggtctatcaacaacagcagacttgaacataaatggcatttggtcagagaccagaagcccatacttagtcttaagaagtttggccggatgcggtggctcacgcctgtaatcccagcactttgggaggccgagacaggcggatcacaaggtcaggagatcgagaccatcctggctaacatggtgaaaccccatctctactaaaaatacaaaaaattagctgggcgtggtggcgggcgcctgtagtcccagctattcgggaggctgaggcaggagaatggcatgaacccaggaggtggagcttgcagtgagctgagatggtgccactgcactccagcctggcagacagagcgagactccacctcaaaaaaaaaaaaaaaaaaaaaaaaagaagtttaaggttctaggggctttaggaaaaaggcagaatatgaaataaattgtcagtagaaggctgctccaaagatgaagtatataattttaagattgcttttgttgattgaaaatattattgtactttattttatagttttatgtaaatacattgtcaaaacatgttaatctttgtattcatacataattctcttacatataattcataccacatgagttagaaactgtttaggttttccttccattgtgggttacaactcttcttttcttgtctaagcttccagcaagcaaccatgattcaatttgaggaatttaagatgaacagaacaattcttggtccaaggtgtaatattaccactgacatcaaaagaggccatataatgttgtggttaagaacatagcctttgagacagactgcctaggttaaatactagtcacatttaacaccttgctcactcttaggacctttgaaagttaattaaattttctgtagctcagttgcattatttgtaaaatagatgttgttttagagtagtgtctggcatatggaaatgctttctatgttattgtgaggtaaatttttattctaaccaagtgagcaaatcacttaaaatatgtctgttttttaaaaagcaatgactgtcatttttttttttaatatttcagtagaagtttcttccatttttaacattcaaaggaaaaccacattttattagtagatcaaataaggaatggggcatatgttaactttttaaaaaataatttcaaattttcttttatatttaggaggtatacaatatgcaggttgttatctgggtatactgtaaggtttgggatatgattgattccatcatcaggtaatgagcacagcactcaatagttgttttttaaatacttgtccctcttccaccctctccccttttctagatgtccagtgtctattactgacatccttatgcccatggctatgcaatgtttagctgctacatataagtgagaacatgaattatttggtttttctgttcctgtgttaacttgcttaggataacagcctataactgcatccgtgtggctgcaaacaacatgatttcattctatttttatggctgcatagaattctatggtgcatgtgcagcacgtttcctttatccaattcactgttgacgggcacttacattgaatccatgtctttgttattgtgaatagtactgcaatgaacatacaagtgcatgtgactatttggtggaacaatttgtttcctttttttttttttttttttttgagacggcgtctctctctcgcccaggctggagtgcagtggtgcgatctcagctcactgcaagctccgcctcccaggttcacgccagtcttctgcctcagcctcccgagtagctgggactacaggcgcccgctaccatgcccagctaatttttttgtattttcagtagagacggggtttcaccgtgttagccaggatggtcgcgatctcctgaccttgtgatccgcccgcctcggcctcccaaaatgctgggattacaggcctgagccaacgcgaccggccgcaatttgttttcttttagatatataaccagtaataggattgtgagtctaatagaagagctggtatcaagtctgaaactactctaaaatatcaaggaggagagtctgctccctaactcattctacaataccagcatcaccctgataccaaaacctgtcgaagacacaaggaacaaagaaaactataggtcaatattcctgatgaacatagatgcaaaaatcttcaacaaaatacttccaaggcaaataaagctgcacataaaaaacttaatctaccattatcaagtaggcttcattcctaggatgcaagattggttcaatgtatgcaattcaataattgtgatttatcacatggacaaaattaaaaccaaaaaccataaggtttttgagaatctccaaatttccacattggctgaactaatttacattcccaccaagagtatacaagcattcccttctctgtgcagcattaccagcatcttttgttttttgacttcttaataatagcattttgactggtgtgaggtagtatctcattgtggttttgatttgcgtttctctgatgattagtgatgttgagcattttttcatgtttgttgtctgcttgtatgtctgtttttgagagaagtctgttcatgtcttttgccaatttttcaatgtggttatttggtttatgtttgttaaattatttaagtttcttatagattctggagattagacctttgcgggtgcatagtttgaaaatactttctaccattgtgtaggttgtatttttactctgttaatagtcttttctgtcgggcagaagctctttagtttatgtaggtcccacttgtcaatttttggttttgttgcaattgcttttgaggacttgccataaattctttgtaaatgcaaacatcaaggatagtgtttcctaggcttccttttaagattcttacagcttgaggtcttacacttaaacttttaatgcatgttgagttaatttttgtagatagtgaaagtaagggtccagtttaattctgtatgtggctagccagttaactcagcaccatttgttgaatagggggtactttccccattccttatttttgtcaattttgtcaaaaatcagatgattgtaggtatgtggctttctttttggattctcttttctgtttcattggtctatgtgtctattttgtaccaataacatgttttgttaccagtactatagccttagagtatagtttgaaaaaaagctatgttgtttttgcttaggattgtgctttggtttgaacttgtgtccccatccaaatctcatgtcaaattctaacctccaatgttggaggaggggctggtgggataaaactggatcatgggtgtaggatttgcccttgctgttcttgtgatagtgagtgaattcacacaagatctggttgttttgaagtatgtagtaccttccccttcattctcttcctcctactttggccatgtccccagccatgcttcctgtacagcctgtggaaccaagggccaattaaacctcttttctttataaattacccagtctcaggtagttctttataatgatgcaacaatgaactactacagattgctttgtctatttgggttctttttggttccatatgaatttcagaattttttctaattctgtgtaaaatggcattgaaagttcagtagcaatagcattgaatctcttgattgctttagagattatggcaattttaacaatattgattcttccagtcaatgagtatgaaatgctttttccatttgtttatgttatctatgatttctttcagcagtgtgcagttctccttacagaggtctttcagcttcttggttagacgtactatctaaaagccctacttaaaaggcacagagtgatgggttggataaagtaacacccattcatctggtatcttcaagagacgcttctcacatgtaatgatccccataggctcaaagtaaagggctggagaaagatctatcatgcaaacagaataccaaatggaacaagggtcactattgttatatcaaataaaacagcttttaaaccaacaacaataaaaaagaacaaagaagggcattacataatgataaagggttcaattcaaagacaagacttagttatgctaactatatacatatgcaatattagagcatccaaattcatgaaacaaggacttctaaacctacaaaaagactgacatagcacacaatgatagtgggggtcttcaacaccccactgacaacattagacaaatcattgagtcagaaaacttccgcagaaattctggaattaaatttgacacttgacaaattgagcataattgatgtttacaggacactccatatatcaaccacagaatatacattcctctcatctgcacacagaatatactctaagatcaaccacatggttagccataaagcaagttggaaaaaatccaaaagaaggtctttccataaaacaagtctcaaagaaatcaaagttataccaatcacataccaaccacagtggaattaaaatagaaacctataacaagaatatctctcaaaaacacacaaatatatagaaattaagcaactttgctcctgaatgagttttggattgtaaggcagaaattttaaaaaattcttttaaataaatgaagaaagacacgcaaaataccaacatctctgggatgtgggaagagatatgttaagaggaaagtgtatggtgctaaatgcctaccttaaaaagttagaaaaatctctgattaacgatctaacaccacatctagagtaactagaaaaacaagaacaaactaactcaaaagctacctgaagaaaataaataactaaaatcagggcaggactaaataaaattgaggcataaaaatccataaaagcatcagcaaaaccaaaagttggttgtttgaaaggacgaataagatctatagaccactgactatatgactatataaacaaagaacaaaacagagaagatccagataagcacaacataaatgacaaagatgacattacaactggtccaacagaaacacaaaaaaatcctcagagactattatcaacacctgtgttcacacaaactagaaaatatacaggaaatggatatattcctggaaacacacaatctcccaaaatttaatcaggaagaaattaaaaccctgaacagaccaacattgagttccatattgactcagtaataagaaacctaccaacgaacaaaagccccacaccagatgaactcacagccgaattctaccagatgtacaaagaagagctggtaccaaatctactaaaactattccaaaatatcaaggaggagagactcctccctaactcattctacaatgccagcattaccctgataccaaaacctgttaaagacacaaggaacaaagaaaactataggtcaatattcctgatgaacatagatgcaaaaatcttcaacaaaatactttcaaaccaaataaagctgcacataaaaaacttaatctaccattatcaagtaggcttcattcctaggatgcaagattggttcaatatatgcaattcaataaatgtgattcatcacataaacaaaattaaaaccaaaaactatacgataatcccagtagatgcagaaaaagctttcaataaaatccaacatctcttcatgataaaaatcctcaacaaactctgtatcaagggaacatatctcaaaataataggagccatatatgacacaatacagctaacattaaactaaatgtcgcaaaagctggaaccattccccttaagcactggaacaagacaaggataccattctccattctcaccacttctatttgacatagtactagaagtcctaactacagcattcaggcaagagaaagaaagaaaatgtacccaaacacgaaactaaagaagtcaaactatctcttctataaccaggaaacctcgatgacatcaccaaaaagctcctgaaactgataaatggcttcagtatagtttgaggatacaaattcaatctataaaaatatattaacatttttgatgtgcatttaacatactaaaatcatgacttaatatatttcagtatataaccaccgattgtttaaattacatagtgataatggaactatactttctttttaaaaattatctgaggaatgtttataaataaactaaaaataaacaactcttttttgatacatacagtagacagtatacagcttctaaaagctctttacatggtgaaataagatctgttattccaaaatctttccaaaagaacttttctgttattagcttgtttttcaacattatccaacttgtctctgtgttttgtaattgaaatataaaggagaaaggaaaaggataatatttgtgtccatgtggaaaacaaaattattcatcaaacactttatgaaaagcagcttttatttccatcttgtttctgaaagctaatttgttattttttctaattattcttaatgaggaggctcagaggaaattcttaatcatgattcttactaagacactcaacaaggtcaaaagataaaagctgcagaatcaatgtcactgtttaaaattacactcttccaacagagagattcttaataagtctttgtttgcagagtactttgactactaaataaaattctttgccacaagacagttatgtgtacttaagctgcattaaaaaaagcaaactgtatggattaatttttgaaacaaaaattataagcatttaattacttattaaagaacatatccatgtaaatatgtccttagctgtccagttgtgacagatgttagcatgaaatagatgtgccacatttacaaggtacgggatgttgaagcaattttcctacttaagtgaagtaatataggcttatatttctggaacttcagaagactgtgctaatatttacctttctgtttcatcatctaggatataactatttttcacttatgtgtgaagcaggaaagttgttagacatagcaggaaaaagtacttcgtatcactggctggcagagaaagtttatatatttgagtttatacaggtaactggaaatttagaagtatttttcattgccttattttcttattccttgtcatgaagagtgtttggactgaggttctactatgaaaggtgaatatccaagggtggaatgagtagggactgtggctgagagttatgaaagaagatgattctgaaaaaaataacagaaagcataaagcaaatatttcctactttttccatacatcacatcttgctttctcagaaatttctctgctacaaacccacctgataacaccttccttagagccatagagccaaagtcattacagaggaatgtttcatatagaacaggaagttccaaatgaacctatgttctttttgatacgggagtactgggaagggaagagcgtggtccctttaaatgacatggaagggggaaagggaagtgctgagtggagaagggcgtggtccctggctagggctccataggtgaagactggcgctcctgcttttgtgcccaaatgttgcattttccaagaccaccctggcctgccatgcccccatcctgggcctataaaaagccaagaccctagcaggcagatacaaatacaggtggatgtggtgaggaacacattggcagaagacataagcggctcctagactccaaaaggatgtcgagggagcacaccagcggaagagcacaccgacagacactggcacgcgtgcaggccacccactggtggaaggaggcggagtttggtccggggaagttggaggagagccgtggccccccaaaactccgaatggcccactccaagggaaaaccatctcccttctggctcccccattggctgagagctacttccactcaataaaactttgcagttgttctccaagcccacgtgtgatccgattcttccagtacaccaaggcaagaaaccccgggatacagaaatccctctgtccttgtgataaggaagggggtctaattaagctggttaacacaaatcgcctatagatggcaaactaaaacacatgccctgtaacacatgcctactgggccttcatccctagacactggggtcagagccccacatcctgcccatttgcatgctcccctagaggtttgagcagcggggcactgaagaagcgatccacacccccaacgcatgccctgcgaggaggacaagggaacctttcccatttcgttttcattgtttcacaataaagaagtgacaagggatggatgtctacctatgtcaactgtttttaaaaataatatttcatgtaatgaactggcctatgaaatttgatcatatgatttggatcattcttgtcacacccaattaaaagaaagttgactagccaggggaaaaaaaatcaggacatgtagcatcgctctagaaacgtaattttctgcaagtctggctgttgaaactgcctattctaacccgagacagttttatttataactgctgagacaacttgcaactccagggctaattttccccaccgctgttgctcaccaaacagagtttgccagctccccagaaacttactagtcccaatgcactttctctaagagcaatacataacatttctcatttttataaaatcaccaaccttctctttgttcttcagacataccgaagaacacctgacccgtgtgtatgctccaaattgtgattctttattctcaaagaaaacattgaatttagagatccatctccacatttctattttgacttcaacaatcccattctgcatcataaaccttgagagaataatatccaaaccaagtcagatcagtaatttgatctgacatttcttggggtgaaagaaaacttttgttggcaagtttagcaaaagggactttggccacatgctgaagtatgcatatgtacaaatgaattacttcaaggaaaatgagctaggataacagtttttatattggccataaggataaaaacacattattgattaactgcattttttggagcttggaagttttcttaagaattctctaaaactgaatataataaagtgctaagacaagtattttaccacccttgacatttagaaatgaagtttttgatagtttgttatccacatgtataacatatgatgtggaaagttttatgtcctgctgagcttagttctcataggctcaattttagacaatttctatacagacgcctgcaattttgaatatctgctgctatttatgaggccttcccaagggtggtactccatatttaatttaattgtgtttgcatatatcatacattttgccaacagtaagctctaagagcactttatagttgataacaacttccttcattgctttccaagctatatgatttcttactataaaaccagccttccaccttcagtattgttagttctaacggcatacacgcaatggttttctctactatgttcaaaaagagggtaaaactactaagagtggaaattaatctgttaaaaatttctgttacattaacagcattttattatatctctcctcaaattaatttacttgagtacagtgctagaattgttattctgttgttagactttatgccataaattttggtaatatgtctatcatcaggaggttgggattttcaaaatttttcaattatcataatcagagacaagacctaggaaatgagatcaatttagtccctctaatcacaaatgtctgtactctaaagttcatgaacttgacactaagggaaagccccagaatggattagaaaatgctaataaaagtggagaatgtgtgggaaaaaaagacacctggctaaaggaaggcatgtttccaattttagagcaaggacagagaaatttttacagtagatataagaattcacaaagcatagctgtctggagcaaataatgtctttctctactaaaatagcttcaatactactttgttgcagattgtactaattaacagttatgttaatgatggtaactcatcatcacaatttttattttatgcaaactctttaaataatagaaaagtatgcaatgtattttagaaagatttgtatccatggaacttataaccaaaacaaatgttaattaaaataaagtaatatttttcttctgtcaaattgtcaaaattttattaaaaataatagccactattggttcaagtaaggaattaaaattattttataattttggtgtagctataagttgtttctatataaagaaagaaaggagagaaagcaaggaaggagggaaggaaggaaggaagagaaagaagacaaaatggaaagccaatataccaagaacttttaaaaactgtcctttgaatgaaaaattttactttgggatctatagcaatatagagataattaaagaagtatatattgctgctaaaagtacttataatagtaaaacattatatatgtttattaaatcattatgatttaaacacactctgtaattgtgacagatactgtatattggaccacccactctaacacctcttcttgtatttttctttttgtgcactattgaggcagataaacttaaaactgcacttgccagactcatttgcggatagggtctaccttggaatctgcgaagcagaagacactctcatgacacaagaacataaaggaacaagtgagccaaagggaagtcagttaatcactgggcaggaagtgtatggttctttgggggcagctgtggtagagaaattagtgcaacaccaggttatgatagttgccatgatggggattgtacctatgaggtttccactagaaagttcagattcgtggttaggtatctatttggctctcatgatcttgccgctgtggcatccaagcttagttttctgatgcttctaagtcactagaccacattagtaaattcattacagatgaaagaggctacctggattctatgaaattggatgaatgaataagccattaaaatatatattcatgttgttaaataaattttgatgggatgagtaattctcatggaaagtcaaaaaattataaagcaggttttagaactgtctgtacattcttagttttgagtgtgaatatataaagtctttttaatattaaagactaaataaatgaaacattattattgttattagtgatttcttattgaattcctaaattgcttttaggaatttattataagaaaatagtgtcctttgcatttttataagaaataaatgcattgcatttattataagaaaacatgacaaacacaatttggaagcaaaaataaggaacttcatttgtttagaatacttatagtaaatatcacaaagattctaaatagaataataaccttatcacaatataacgtaagaaacactgtaatgtgaaatctgttttgttaaaacacatttagatttaaaatttcttaagccattggatatgccttgttatcagtgtcacacactgaaaacttctagaagttgtcatttcatctgatacatgaagagcaacagttattccttaacacctccttcaacaccgcatgattctcctcaattcatattttgaaatttgacatatggcactgatggtgatatgacagagagaatctcaatgtgtcaatgacttcatcatattcatttgggcaactgagctagagtcttctgctccatgaagtctgtaatgacattgtgggaaagctgtaggcaggagcttcatattcagatcaaaggcaaatacaaaccagggaagagctatcttccagtcaatatttgttggcatttgctatattataaaacttcaagcactctcccatttttctgctcaatttttcttccattcattgcacggtgagatatgttccaccatgaacaaaggaagttaataagagttttcaaagatacaataaaatagatgaagtttaatatgacatttaaccctattgcttctcaaacaaaatgctttatatacatagcaagctggcttgctatccatcttctgtcactattctctttgtttactattattttgttttaccttttctaaaatgtcaaatatatcagacacacaatagagtatctgatatatttgtagagcttaaaaatcaataatactacaataaaatgaatatttatgtcaccaccacctacaatcagaaataaaatcctgccactatcttataaatcttctgtgtgcactttgatagacttttgcaagttttagggctgtataaaatagatttacacagcacaaattctgcaacttggctatttctctgcattattatgtttttaggttaatccatactgatgtatatacctttagggaaataatgctgtaaagtattccattatataactggatcacactatttacctgttctttattggagagattactgttgcaataatttttatttgtattatgaacaaagaccagatgcatattctggcatatctctcttggtgcacaatttgaggaatattttaggacatacccttaggaacgaacaaaagtgctgtgtcatgggtatagtatatatttatatttacttagttaaaatcaaattattttccaaattggctatgccattttctcagttaccagcaatttcagaattcctctttctccccatcttctataagatttgatatgatattaaacttttgtcattttgattgttgagacttgatattttatgtttttaaatttacatttttttctgactacttggcaacttctcatgtgtttaatgaaaacatgcgccactgcactccagcctgggcgacagagcgagactctgtctcaaaaaaaaaaaaccaaaaaaaccaaaaaaaacccatatatatatatgttttatatatatatttatatatttacattttatatttatattttatatgtatatacttatatattttatacatatataaaatactcacatgttttttaatgtggcttatttaaggaaactttactgatcatagagacataaaaatatttttcttaagtttcctttaacagttttagatttttgtctttcatatatgtcatccatatatgtgaaattatctattgtaattatttattaagtgttgaagaaccattttaattttccacatgagaaataaattatttgaaaaactaaggaaagttaattatatccattttcacctctaaatatcacctatttatacttctattttccatggtatattatggatccatttctgtacctttatatatatatgtatatgtgccttatataaattattatataatatatattattgtatatatttatattatatatttaatatatagtatatattatatataaatatataatacttatataaatatatatacatatgtttgtttcacatatatatacaacattgcttggttcaatttgttaataatttcttaggaaaatttttatccctcctgactttctatggtttttggtgacaacattttcctgtgtctttgaaggctgaagaacattgtaattttgttgcctagatgtttcttggatttcttccataaaactttttgagcctggggtttattgtgtagggaaaacataattgctagtgctagaatttaggttttctatcatgtcagatgtcgctatgtatagttaatgtttttctagaaatgtgtctattttgtacttttttcaatttattaacatatatatttcatatcatctttatctaaaaatctcagtctcttctgcagctataatttcggcaataccagttttaatattatttatttggcttctttctttaatttctatttttcctgttcattttaattataaattaaataatccttggctttgttaagtctgcattattttgatactttatgttttttattatttatttttatcttctttgtccttattctcttttctttacacacacacacacacaatatttcagatagatgcttattttgttgattttcagcctttcttcttttcaaccatgagaagttaaggctataaattgccccctcaatgcttttagaatcacatttcaaaaatgttgaaaatttatattagtggtaatttagctacaattgtcttctaattatgatttcttttttacccataggttatttaaaagatagttttaataaatacaaatgtatttattttacatatttttattactgaattactaatttatgtagatgtcagagaatgtgggtatactaatagattcttttgtaaaatttatcgaaaccttctttaatgcctagtatatggcccatttttaaagtttcatttgttattaaaaataatgtatgttctacaacttaacagtagtagtagtatcaaacctatacctttggtataggtttttatatatgtccactggaaagtttaagtatattttgatatattcagtatcttattgagataggatattgtgtctgctaatctatcaattgttgacaataatgtgtttaaatcttctacagtgatgtttgttaaattatttttgtacgtctgcgattttttaatttatattttaaactatgtagctaggtacatgcatatttagaattgctacatcttcttagtaaattgaacctttataattactgtatagtggccttctttatagctagtgtatttttgccttaatgctttatgatctggtcaggcaccagattttatctcctaactcctatagactctttaaaactcttaaaatcttaaaatataggatccagaccacaagcaatttacagacgctccaaaacaaatgtggattttaaagctttcttacatcaatagactcatgctttcttatcttatctgattgttgaatgattctatttctttttccatgttatcaccacattttaaaaagagtttgttttgttttgttttgtttttgttatccgtgtttttagggagtagttttctgaaattccagtcagctaaaatcctgaaataggaaaccaactgttattcttacaacttccactatgcaacctctctctcgctagaaaaatagtatttgcaaatatcaaaatataatcccctttcctgttaggtgagctgcatgcaattaaactaaacataatttatattttaaaaattattttttgccattattttcttgagccagtgagttctcttatttttgcccctgtgccttagtgtatgtgtctgtgtgtgtgtgtgtgtgtgtcacatgtgcgtgcacacacatatacaatgtttgttgtatttttttctggttaactgagactaaacttgaaatttaaagctggccttccatgaaaattatttaatgatgcaatgcaaagacaaattgctttctacatcaattttctatgcaagtacctataaatgttagataactaaattatcccagagttttcttcaggaaatatcagccttttattcaagtatatgattttctataaagtattgctattataatcttttaatgctaggtgaatccacatcaagcattcaatatttgttggatgatacaattaaatttctctctgcttaggttgagtttacattgtctttaaaaatgtcttttaggcagggtgtagtggctcacacctgtaatcccaaaacttgatgaggctgaggtgggaggatcacttgaggccaggagttcatgaccaacctggcaaacatggcaaaaccccacctctactaaaaatacaaacattagccaggcatagtggcacacatctgtaatctcaggactagagtggacgaggcaggagaatctcctgtacctgggaggcagaggttgcagtgagctgagatcacaacactgcactacagcctgggctacaggctgagactctgtctcaaaaaaaaaaaaaaaaaaaaaaaattaatatcacaaacatggtaaacataaaaattatcacagtgtaaaggaaaaagtaatatatactcacaaatataaacagacagtgggagtggggacaaatttgcattcatattgaatcaagacatttatatcgcctctatacaaaaacaagatgaactaaactaaattaaagggatgttaatctagaaattaaatgtatcatgtcagctagttttaatatatggatgctttgggcattgtaagattaaactttctgaatcataacagaatgaagctcattaaaataaaataaacttacccaaatggaagatgacctaaaagaataatttttgggcaaaatattataaaaatagctacacagatattagaaaatataacaagcaaaatttgatttttactttggtgtacaatgtcccaacattctgaataatacatacccttttctcttgaaaaatatgtatatactgaatgactttaaaacaaatctagaaattaaatgtatcatattttccatactgtttttgtttcaatcagattttttaaaagaactttcatctctaaatttaggaatctctttttacaattttttcatttacagctacctcaaaaaatagtatgtattcctaaaataatatagtataaatttattttgaacatcaaaaagaatctgagctcacctatagcccacaaatggaaatgagaaactcatgtgttttcatatttataaacacatattacatcttatacaacacattatgaaaaagaaaataaataaaagcatgctaatataatttgaatgaacaagaaatgctggaaatatttgaattctacctttcaaccacattaattagagcttccactaaatcatttccagactcatataactgtaataatttcacacctataattatctctccatgttccctgctatgtttattttacttaaattagacatatttcagtatgttctgaagattttgccttatattcaacattacatatttgtttaaactcctcccttcatgaatgtactctcctctgattctataggaccacccctcatctatttttatgcactagctccattatgaaacctttcaaaatcataaaaagtagaaaattttattcatagttcacagttgaagaaaaggcagctcataaccttgaagcctatatcctactgtgatactctttgtaaatgatagtatgagaattaagcctttatttaaaactttttcatgtcaatgtcagttctgtctccaaaacttaaatggcattattaatgaatgtgttacaggcattacaatgcagtgattaagaatacagccgctaataccagcttccttgagtttgaaacctagctcatggctccctcctcctttgttttgggaaaattacttacactttatgtctcagcttccttattggtaaaaaatgtataatatgcaagtctaccttatagaattggtggaagcattaaataatgcagttgtgaaacatacaaaagagtatctagtggatggtaagtgtaaaagtagtattaactattagtatctactatatggggttgtgggttgaagtccactaataatttgtgtcaacattactctggtaagagttcatggcaatgacttgttgattctaggaaatttctgttcatcaatgtattgtaaaaaataaagaacttcactgttttttatttttccatgaaatgcctacagatcaatttactgaagacaatagtctgcttatttgtgcaaacagttcacttatgaaacaagtttatttcttcactatacctaccaattctaaattattatgtcatggattttttccattcctaatcagttccttctcttgaaagatctgcattacacaacttgagaccagactccaaagctccataaatatcccattctgacctcttttaaacacttctaagattctgtcagggtggtgtgctttttgattacaatgtattccaataaattcaggtgtactttacttacagattatctggtgatatattgaggagagcaatgaactgtaagcaccactgtgttctagctgagatcccctctctgatgtgtcttaagatccttgacttgcaaaatgaatgctctactggggaagccttgagagactctgcaactgtgatggtggggtctaggtattgatattgtgtctcaactttggtcactgtcaagttcccaaatgttagttttattttgtctaatgggaaatagaatctattttaggactttttctgtgatctgtttagattggaaaatgttaatgtttgatttaaatctgctttattgctaaattactcaattgtgtccttctgtcctcatttttgtgagtctctaagaggaggtttatacaaaaatggccagacatggatcctgataagttgattcctagagccagctctggaattaataacttcagaaggttcctcctcggactggtatccctcacataaattttccctggagtcaactcttcaaaaccttaggcaaatgtttcttattcttatcctgttcagtctttgagagtcaggttctgtataaaatctcccattaaaaaagtttatgttatccaagaacctcagattatcgaggctgggattaaaaaaaaaatcattaacttggaggcctgaaaacactatgcaaaagcaacactttctactgcttgttgctagattctcatggctttgaatcacactaagtgtatgccttctgtaggctgaacccttgcctcatatatgtatctacattataaatctaatttccatgactgtctttcaaaaaggcataatttctttacaaataatttacagttaagaggctacttggtgaaatttttatattaacagaagttgttaatttgagaggagtcttaaaatggaaaggaggtaaaattcctattacaatgtgaacttaatggccttttccctactttttattttcccctgtctttgtttactcaatacccttttgccttactccattttctcacctggccccttacctcctggattacacaacctgagtttcacaaatctcaattgcctcttaaagttaagtcctctttagacatcaacaagcttcttatagtttatttttagccttcattctcagtctgaactaagaatcaatgtaaaagtctggacaaagtacagaggaatttagaatcattctaacaacatatatcgtaggtttcccagatctacgtaagtgattcttatgttagtaagaaaattaatgtaaaaaaattggattaaaaaatgaagacttaggataatctaaggtgaatgaaagaccctgaatattagagaaaaccagaagtatttaggaaagctatacacagtggagaaaatattttggaggctaccccaagactttcctgaaaataggttggacttccatctcattataaaaagagaaagaatgaatcaatttgaaactttaggaacaggacctccaacacctttagaaaatattcaggagtagatcttgagacagacaggacctaaaccctctcatcatttttgcaaagagccctaaaccaaaattagggaatgtaaaatggaaaaagtacatcggaaaatgacttcattgacaaacagaactccaattcctaactgaacattttgaaaaagtcatggaataaaaacagaataagcctctgaataagttaacagccttacagatgaaacaactggctatttctcctcaatttatcaagtatcagaggaggaagcttcctgaatacaaacattgatagataactgtaagcagaaaggacattggaaaaagattcataaaggacattggaaaatagctattctgcactaactgtgaaactaaaagaaaatttttaaaaaggaaggatgtgataagggaagttgatgctgatctgtggggtcattaattccctgatgtcccatttctctaaacattaacagacagtatcaaggtttctgattgattcaggcacagtaatatagtttacagaccctgccacacatgcattcagtcactcccctagagtcaataaagtatttaggagatgagtatttgcaaaaatctacagattattgtgtatcactctatagcttttgccctcagatctttaacatcgtttgctcatttgagacagcacttcccctcatttaataggtagggatttcctatgtaaacagaattgctaatttaagtgctctcttgatgggctttctcttgagatctctaaagaatcacctattcagcagggcacggtggctcacgcctgtaatcccaacactgtgggaggccgaggcgggcagatcacgagctcaggagtttgagaccagcctgaccaacacggtgaaaccccctctctactaaaaatacaaaaaaaaaaaattggccgggtgtggtggcaggcacctgtaatcccagctactcaggaggctgaggcaggagaatagcttgaacccaggaggcagaggttgcattgaactgagatcatgccactgcactccagcctgggtgacagagcgagactctgtctcaaaaaaaaaaaaaaaaaagaaaagaaaagaaaaaagaaaaaggaaaaaaaagaatcacccattcataatcatatcacacctaatttggactatggagtacaaggagcctggtatcgacatcaaactcaaattgaagatctactgatattggctgaattattggggaagaacacctcacatttctcactgacccatttaagcctccatctacacttgccctctacaaccaaagggaaaggacaaaagccagcagttgtgtctaacagaaaaataattacgaatactatgcactagtccttggaacactcctattcttctgatcaagagatcccagtgggctggggtacccatttatttcagaccttgcaactataaataaaatatttagccctgttttcctgtggtgccaaaattctatattattttaatttccatgctacctgagattatgtattttagcattctaaatccatgttctgctgtttgtattgtcccttttagatcataatagaaaatactcattagtctttctctagaaaaatcaatgatgtacctggacagttttactgcagaagtgtactgaggcacccaggtaccttatacaagtcttctgctagacactgaaggaccttgaatctctctataattctactcttatccaacatgcagacaatttttgctatgttgtcaagatgagataatttttcaggttgattccaactactacttatagctcagaaagtatataatgtgttcaaagaaaaattagaattttgtaagaagaaaatgcactatttagaacatgatttataatccatcactctggagagattacaaaacactttttttttttctaaaactgttaagaaaatatacttattttaagagactttttttttttcggctgtagggggtgaattttttttttttttcagtgagagcaggttaattaggaaagtaaaggaataaagaatggccactccatagagatttcataggttattacatgcaatgggttcccaatattactgaaattactgtacctctaaattttaacttagttgttagtaactcaatctctttgttgtattataagcataattagctgtaggggtgtgtctctgtgtgccctgggagtggcagggttggggttgggggtgggaggagtaggaggctgtgtgatttaaaattaattatttggccttcctaattatcttagatctttttaccaatttgtgcatgatcaatttggacaagccattggtgttttgactttactttatcagaatctttaaagactattcatctttaaagttatccataaatttttcatagactcagtggcaaaaggctactcaccttgtctaagggcaacagccagactagtgggtaattacagtgggtaatcttctgatgtttctgcattatattctctactcttcacctaattacctctgaatgtcaccaaaactgtacagtaaattttaatcacacaaggaaggtattttggacaatgataagtctttgggtagattctaaagaccagtgttaggtttgcaaaacaaaagtctattgggtgtggccaacaaattataccaaaaaattgttatctttgtaaatttagacactatactttcagaatggtgcctaatattactcatggatgatttgggcacatttccccctcaaaccctagaaaaagagaactctagataatttcattcaagaaagagaaaaacagggcctcattttgagatatacaacattactcatgtctaattctgaatagttttctcctgtctttaaatcatactatctgtgcttcagatattatcaggaacactgaacaatttcagtgaggccatagaaatcatcacctggagatttcataatactgaggaggtggtacttcttcaaaacatagcagtacgagaaataatattggcctgtcaggatgaaacatgaggcattttacaggaggaaagtttactcatattcctatagttctttctgtttttattttattaagaaaatatgggaaattttttaaaaattacaagacaaggtgataaatctagtattcccacatctgaccattaaaactttttggtttggtcatgggttccattgtattgctttaatttaggcatttttggctcttggcttagaatgtaaaatacttctgttagtatctgtctgtgattcagcattcaaatatcaggttttcataatcaaaaatatttctatgtagccactctgatatgacaataaatgatcatgcagccaaaacaaaaacaaacaaacaaacaaacataaaaacctaatgtatatgatagttgaaatgatcccaccagaaatctgatatgcaatcaggaccctgaagacagtggtattgattttgattgattatttgtgcagatgattattatttatcctccagcttaggttgaaaaatgactacaagagagttctgagaaataagaaaccacctatgttaacaaaactttttattgtttgcttcaaaaatattttctatgaaaggataaaatcataagccaactaattttattattttcttcaggaaatttccacagatcaatttattagagacaacactctgctcatctgaataaataatttatcaaacaacagtttacttattgaggctgcttgtttccacatgcatctcgctctgcccaccagtcttaaattactatatcataaactctgtataatctcagttaattccataccttaaatgactcagtttaaatcactttaccacaatccccacacacgttaagtacctcagttttgacttccctcttctgaaacattgctatatcattgtcaaggtgatgtttactcttacctattgtagtaacttctataacatttaaattttattactacattatcattcttggactaaacagttaaattgtagttattgttctttcttctattactattaatactactattttggtatttctccatcatttactgttgtgggaaaatgtgagaaatatgactgtatatattttattttattcacccaaactagaatatttgtctcttttatacctctccaaagaccccacttctatttttaaaaattagttgatatactattttgtatacatgtttgtttctatctgcttatttagtttacatgtttccttttattctttaccatctaagtactcaattcaaataagatacagagataaggtcagtttctgatagccaaagaatagcaataggtttggcacaagaattgcgcaggttcctcatgaatttgactctaagaaattgtgaaatctcggggaagacacacgaaggcctctgcatcccagttttcccttatctcacttttctcttctcttttcttttatcatatgtatgctatgtgagaattacaataattaaaatatgtaacatatgagaattaaaatatataataaggatagagcttactacaacacctagcacatcctaagtgctcaataataatccttattactttgtaatgctcctgtgagtctgaaaaataatgtatttaaggctcctagtagatactcttttaacaggaactactaatcttgttattgatattaatatagcttggctatattaatccaggtggatcaacatcctctgtataaatgaaaccacctatttacaaggtattccacaataattcaatgttgcatcttcagcaagaacaagccataggtctgaaaatgtaagtgcaaggcattgagtatgcatttgtgtatgtggtctgattattgctctgaagataaacaactactgagaccatatattctgaatcctcttacaggaatacagtatatgattgaattttttttctatctacagcttgcaatgactaaaaaaatgttggtttgttcccacaataaattccctccaagaccacaaatgagaaataccactttacatgtgcataccttaatgatgacctcttcttgaaaacaaaacaagcatgctttagacagaattagcttctcactgtagagatgactggcttaaatgagaattctgtctttgctctaataagtttatttgacatcttggtttgtcttatagtaaaaaaaaaaaaaaaaaaaaaaaagaaaagaaaaggtggtttgctccctttccccatggtgttaaattaattccatgagcagttttgttactctacacaataatacagtgtgtccccttatttatgtcataatgtgtcataatgtctattgggaaaagagatcaatttatgtaactcaatttgttgtctttaaaggagtttaacattgtatttgagctggacattggttgccttgagctttgagaatttaggctgattcatcatgtgaacctgttgtagaaatgaccttctctaggcttctgctttagtttttacatgaatggtcctaatgtccgcctatagaagattttgtgcacatgatgaccttagggttaatctacatcgggaaacacttaaattaccataataatgttctctcgaaattcttaagtatgattaatgttggttatgtatcggcctagatagagatttctaaaagtgagtgttcctgagtgctttggatgatactttgtaagcatatagacatgaaactatttaaaatcattgcataatgttgcaatatatcaaattattttcctcttgacgtatatttagattgttttttgtcactcattaaaagaatgctacaaggagttttttttatgtacaacactttgtgaccatataaaggcagttgcctagatttggaatttgtatataaaaaatatagatacacacttttgttaaaagcttaaaatttgccctttcaaaagaatgtacatatttaatttttcaataatcatgtataaaggtgtcagctgtattttcataagtttaaatgaaaataactgcttgcgttatagatttttcttttttatgttataaaataaaacttgctctaatttatgggtagaaagaatatgccttacaaatttaattaaaagttttaaatgttaggatataatgaaaatcaccccattcttttttatttccgaaacaagaaagggatgttaagtttttcaaaattgattcacatgagctaacattaaaaccattggatgggttgtgtttgtgtccttgccagttagtaactttattataaaatctctaaatctattaccttctgtaaaatgattttgaataagcatctgtgtaaaaattgttttctttttcactggattagaaactctgttaatgtgaacacagtaaatgaacttaaagaaatagtcaagagtaagaaaatatgagaaaataacttttaaaaataagttggcaagtcaagttctatggaaaaattaaaagacgcttaaacatcttaagtaaaatttcaacatgcctgttacgacacatccccaggaagtttattttcataatatttgatgtgattttaaggtcatcatttaagagaaaataaaaaaggtcatgaaagggattttccacatgagggcttccaattgaaaatatttacatataaaatgttaattgtagaaatacaatccaataatgaacaaagttcaaaagtgagtaaaccctgaagcaagacaaggcaagatatgtaatatctatcaataaaactaaaacattttcaaacatttggtgggaaagactatcttagttaatcagggacttctggcttaaggaaagaaagcaacttgtcagatttaatcaaattcatgggaatcaatagaattgttttcttttgttggttttcccagatatatgtaccaatcagcagtggtgataacttagatgaaaggaattggtggaaggagaaaggtctcttcaaaataggatattatctcacttcctaggtttcataatctctaataaagcactcctaatttaaattgaaaaacatcactgtttatttcatgcaataaattaaatcaaaatatataactggtttgatatttgtttccaagtatttgtcagtctttagtcaacaattcattaaaatgaaaaaaaccttaattctgatttacaaaatgaaaactatcaatggtaattattattattattattatttctatttttagtagcgacagggtttcaccatgtcagccaggatggtttcgatctcctgacctcattatctgcccaccttggcctcccaaagtgctgggattacaggcatgagccaccgcacccagctttttttttttttttttttttttttcctgagattgtatctccctctattgcccaggctggaatgcagtggtgtgatcttggttcactgcaacctctgcctcccaagttcaagggattctcctgcctcaacctcccaagtagctgtgaatacaggcgcctaccaccacacccagctaatttttgtgtttttagtagaaatgaggtttcaccatgtttgccaggctggtctcaaactcttgacctcaagtgattcacctgccttggactcccaaagtgctgggattacaggcatgagccactgtgcctggcctatcaatggtaataccttattgtagtatgtaaggattgtataattctattggatcttgaaaggttggtaagaaatcactgaaatgagtaagaatggaattcagtaactcaatattgatatcaagaaattagaagagaaaacaatacattgtgcataatgaagccaaagataagttaattattccttttatgaaaggtctctcatggcatacaaagtcatgtgatacacagtagcacacctcatctcttacatatgaaattaactaggaaagtgtgtttttcaaaatgggcatgaagacattagtttcacaacatacttatatataatacctagatatacatacatgtaacatatacaagtatacatagcacatgcttcatatatatgtacatatatgaaatctcactctcagtctctctctcttgatatacagacagaaagacagagaggtagagtttcatgtatagagagctatatattataactctttatatatagcacggaatgattgaaaccaaatcatttcaggtccaaaaacatacaagtaagggccccttttgtcagtttagttaggtcaatattatacccacctctctatttgaacttgtctacatgaactgtctctatgaatttcagtaaagtggtaacatgaactctaatgtttgttggacttaaccttttaggagcaatacggaacactattaaatgtttatttactcatgtataggagataaaagatagtgaattcttagcaggcttcaaactaacttttgagcttgaaggtacttatcaaaacttataaatgataaaggaaataaaaaaagtgctatcaaggtggatttttaaaacaatttacattttgcttatcattttgatcttcctcttatgatctatacatttgaaaaataaatacgtctatattattgcccaggttttgaaataagcccagttactaataatgccacaagctaagactgagtctactgttaccataaagccagattagcaatccaagggcctggggaacttccgcttttttagcgcttttcctctggtgggtttgttcttgcatttgaacaaagctatgggtttacatgagtaattgcctaagtatctggacttgccgggtatcactgacaacaggcccaaattataattaactcaaagtaccgtgttaactttttcagccaaaaatacatagaccataagatattaggctttctggaagagtctaagttattggctctggcagcaaaagagtaacatattaactgaagagtaaagacaaagcttcagacaaaggttctctataaataattgtgtcaagatgtcattacatcagtggaatgtagctcaattaacaatatcttttaaaggacatcaccttgccctaccaagagaaggtagctgttaaattgtggctccagcttgaggtttgataatgtggcagctataggatccatttcctgttctagttgtgtatattgtggtaataagaaaagcaacagagccccaccataaccaaatacttttaaaaatacaaccttaccctaagaaattaagtaaaaacaaatcttattcctctggtcagtgttgaagaaaaaaacaaacattcgacttcgactggttgcctcacagggggagaaaaataatagtgcataaaagcaaagcaaaacaaacaaaaaaccttagtgagcctagctgacttgttctcaagaacacagaggaacatggaggagaggcaaggctgttgcctagttctaaattaattaattataaagaattacccccaattaaacactaactcactgcactttttttgtagattccttgtttttcccccccacatcatactgaatccaccaaaattatcatcaaaattttaaagcttgataaattattttgtctatccacttcaaatgattatacatcagacaagatccctaacgacatatcagaatgaattacatatctggatatgaaagaactaggatgtctaatttaaggcaaaggtggagtttgcaatattttagtgagaggattgagaagtatggctaaataggaattaaagtcagcataatccttacattaacggaattttattaaaattgtaccatgttatgagtagcagaaagtatttggaaagctgtttccatgtttacctttagtgtagtagataaaggctatctcaaataaaatgttcagtctaaaatgacggcacattttttcttacaatgattaattttagaaaaatctataatccaatttactgcttgaatttacatggttgcatataaatgatgtgactcctggtgtgaattaggtggcaaattagaaaagggctttttatttttattgttttttagtgagaaagcaggtatcaatataactcagagaaatattccctacatcttagagtgagattaataaatatgtctttgttatcaataaaatgggaatataattctatctctttgtattgttataaagattaagttgaaaaaattatgggaagtccatagtataaaactgagtaccctcaaaaaattactctacaaattattgtttatttctatattattttatcatgtatcaatacatattacattttcaaaaatataaaaatacctcattcttggaaaaaaatgaacatttaagagagacaatatgtcactttctcttcagcaatgtcaagagaaaggaaattttaaacagaaaactgcagatgtctattcctgtaacacaagtggatgcattgatctagcaaaatgagatgaacccaaaccattataagcaataaactcacttcattcacttggattctaatcacatctttagaattgaaatttggcttccaacttccatgttcctacaaggagaaaatgtaccacctaatattcaaacattccaacacctttcctttgtcaattatatttcttttattataaatcaacaaatttgcatgttgtcacatagttgtcttgcatgggtttggttactgtgatcccttctcctgactccaatcacatccagctatggagacaaatataaatttcttgatctgtgaatcaacctctggtccttgatttccccagacaagtatttctacccactgaggcctgaccttaacagccagccagtctctttagacagcaattatagccagtctgtttctaactattgcactgtatttataggttgaaactttttaagtagaaactagatatcaacagggctgcctagggtatttctgaatgatgaagacaatgaggatgatgatgatgtcaacaatgggagagaaaattgtctggaaagagcatgctgttactttctggaattatgaaaatattttattccttgtttggggtggtatttacctagctgtttgcaattgtgaaaactcatgaaattaaaaacttaatttctcgtgttttcttttatgcagattatatctcaatatgttcaggcagtagaaataactatgagatttcttcttcttaaataaaatggaaggccaggcgcggtggctcatgcctgtaatcccagcactttgggaggccaaggcaggtggatcacttgaggttgggagtttgagaccagcctgaccaacctggagaaaccccatctctactaaaagtacaaaattagccaggtgtggtgatgcatgcctgtaatcccagctacttgggaggctgaggcagtagaatcgtttgaaactgggaagcggagtttgcagcgagctgagatcgtgccatttcactccagcctgggcaacaagagtgaaatttcatctcaataaataaatacatacatacatacataaaatggattgtgaagatttgaatatggactattcaatttgtggtataattttttgtcatatttgaagaattttcttcacagagaagctttaggtttacaaaaaaaatgggaggaaggtatagatattttccatatactcctgtccccacccatgcataacttgtattatcagcatcccccaccaacgtggtacacttgttacagttgatgaaacttcatttacacatcattatcactcaaatactagtttatattagggtttattctttgtgttttacactctgtggctttgactaaatgtataatgagatgtttctatcattatagtatcatacagacttattttcactgaccaaaaaatcctctgttctctgccgattcatttttccctgaccacaaccccctgacaatcactggtgttttcactttctctatagttctgcctttcacagaatgtcaaataggtgaaatcatagcgtatacagccttgtcatattgcctttttccatttggtattttgaatttacagtttgttcatgtcttttcaaggcttgatagtacacttacttttagcactgaataatagtccattgtctgaaggtaccacagtttatttatccattcacttactgtagaccctcttggttgttccctcccaagttttgaaaattgtgaataaagatgctgtaaacatctatgtgcagatggatgttttcagcttctttgggtaaataccaaggagaatgaccgctggattttatagtaaaagcatctttagttttgtaagaaactttcagattgtcttccaaaggcactgtgtcattttgcagtccccagcaatggatgggacttcttcttgctccacatgttcaacagcatttggtgtcatcagggtttagaattttggtcattctaataggtgtgtagtgttatctcattattatttaaatttatatccccttgataacatctgatgtgggacatcttttcatgtgcttatttgctctctgtatatcttctttggttaggtgactgttacggtttttggcccatttttaaaatgagtggtttgttttcttattgttaacttttaacagatctttgtatattttgcatagcagtccttaatcagatgtgtcttttgtgagtattttctcccagtttgtagcttgtcttctcattcatttgacactgtctttctcagggaagaagtttttaatttcaatgaaggtcagattatcaatctttaaatgaatcctacttttgatgttgtatccaaaaagtcattgccatactcaaggtcacctaagtataattgtttttaatagaaatcatatttttgaaaaagaaatatagttaaattatatcatttcacattttttatcaatgcttttagctcttccaaaccattatgaaatagttgtatttttattgtgttataaaatcaaatcataattaagcttttcaaatgcaaagctaaaaaatgaaatagcataaccttttgaatcgaattgaatagttcaagatctctatgctctatgttcaagcattatgttaaaactgctgtcttactatctacagaattttctaattagcctaaagagatttttataatttacctataaatatattttgagagggagtgataataaaatcaaaataggtcaagatatccaagtaactttattgagatgtcaagtggcatccagcagaaggtgaagaagtcacagagttacatcatagaaggccttcctgctgtgctatttccttcaacagaaaaagaagctttcatcctctaaggcttccagcatctgctgaaactactttgagtaattcaatcttgtaaaaattatttctgctacgtatacttatctaacacataagtatacttataaaaaaataaaaccttgggcccacttgagaaactaaattatatttagtaaggagatcaattttgcacaccttggcttattgtgctctatttaaaaacatattttcaaaacgtagctcttttttttccctgtcatacacttggcttcagtcattttgctgtaattaaacatgataagtacttccccatgttagtaaggcctgtgaatttccttctgcttgaaatggctcatcttccagatgcctacatggcacaaggcctcctttagttcctgtctctactcatgcactgcatcactttctccaagaaatctacttcaccactgtctaaaatagcccaccacgcattccctcacatcttatcccctccctttttgtacataatacatatcactacctgatatattacatcttcatttgtttattcaaaaaatggactttgtagacttttaaaaaactgtaaaatatagtcttcaacaaatagtatgctttgtttctattttattgtggtataatttacattcagtgaattgcactgatcttaaatattactgttcaacagttttgatgaatggctacaccagtgaaacctgctatactgagaggacaaagagcacatatacttctcttccccaaccactatctaccccaccctttccataaaggaatacaggtagcctgatttatttcactattgtttacctgttacagaacttcatataaatgaaataatacagtatatcaagtttatgctacatgtatattatctaatggtacctttttctattttaaatatatagaatagcaaatatgagaatatttttaaactcatcatcatcattctaaattgtaaactcaatcatcaataaaaattaagatcttagtaaacctcacaaaccattttgtaaaaaatttttgattgccattttgtagtctgtaatatatgatttatttttgaaatgtgggaaacagattcaaaacctagtttcaaggaataatctataaaaattgctctaatataattttaaattatttattttggaacaatcataatgttttcagagaccatagaattttagcacaatatcctgatatttaaaaaataaaagaaaaaaagcaaaacccaagaaattaaaaaactacatatgctaatacagagtcaatatatacttggatagtttgttattactattgaactttttataaaattaaagtatatatatgaaaacagagaatttactaaaaactatactgtgaagaaaatatgtaaagcaatattcttgcacaataggccattcaattatcggtgggttttaatctcattttttatttgatcatgcttattgcttaatggtcatagaaatgttcctttatcaattttcatgggaaagttttgcagcagagaagttccctagaatcaacatgtcttagatgtttgtaaaataagtgatttctttttccaaaatgttaaaatcattagtacacaaaagtcattactacgttaatttattttaaagtgttccatttcagtaagcaggtattaaggaagttggtgttgggataagataattgtgccaaagtaaattcttaatggagttcataagagaggaaatacagtaactgttctactccaaggttggctttgggggatttttcaaaccaacttaaaagtcttggatgttatatctgactggaaattatttctactccctgagaatgaacaacatgctggcaacagtgaaataaggaagcttgaaaaagggaatgagttattctatgaaacagtctgtcctatacatcaagattcttttagtttctcactcaagactttaagatacacaaaaatcttgccgcaagatttctcgtaggtggtgtgacctcagtatacgttgaagtcagagattacattgggttctaacaactcagggtttttagataagatctaaagttaaaagctataaatcagacctctagaggagggctacattggtccaaattttcatgaggaatagactctctttgccaatacaattaggggtgtgtgtgtgtgtgtgtctgtgtgtgtgtgtgtttgtgtgaatgcgtttatctcactgtctcgggagtatgtaattgtgtgataggtggaaattcataaggagaatggatcaactacaagtggtcatgggtagtgccatgtggaaccatactggagcctaaggcaaaaggaaagtgtctggctatatacgtgacttcctgtgctttttaatggttatttttctcagaacacaaaaatagttttaaaaaataatgaaaacctggaaagtagagtattgaaacatacaatctagtttttaggtttaaatatctcatttatacctaaacctgaatatattataatattttcaaaatgtactcttttgcttactcatttttaattgagagaattgctatgtttgacaatttctcttgacaaatgtcttgattaacttttacttaatttcaacttactgatcctttcttttagattttgataaactatttcttgtgggattttcacattggatttctattttttaaatattgcattggaatatatttattctattattaagttgtgttggcattccttaaattctgcacccgaagaaagtgcttcacttgtgtccattttttttcctttcttttttgagatggagtctctctctgttgccaggctggagtgcagtggcgtgatctcctctcactgcaacctcggcctccaggattcaagcaattctcctgcctcagcctcctgagtagctgggatgcaggcatgtgccaccacgcctggctatttttttttttcttttttttttgtatttttagtagagacggagtttcaccctgttgctcaggctggtcttgagctcctggcctcacgattcacctgcctccgcctcccaaagtgctgggattacaggtgtgagccactgtgcccggcctcacttgcatcattctagttgcagccctgatgatgaattcttaggtttgaccttggattgtgtgtatccaaagtgaggcaaaagccaccagaaatgagatcaaagaactgagagcccaatgccctaaaacagactttccatgtagacagcaaatgcacaacgattataagaggaactgatgtagagtggagggcctcgagccagaaatttgaacgaggagaaactactggcaagacaggagatgcaagcaacaacaaagttttggggtacctggggcttaaaagagcagagatcttggcaaatgagaagataccagtcccaccctcttgctctgaggtgctgaagtacgagacaatagacaaaatttgaaaaaaaaaaaaaaaaaaaaaaaaagctgcaaagaaatggtttcctggaggaaagcatgaatgtcttaaatataatgggctttctgttcagtatttcagtatctggtaaatctcatcattagaagcaatgcagaaaattaatatattaccttcacaataccctcattagaacacaattataacaaccgaaaaggcaatgtactaacccatgaggactcacttaactcattacaatggtttagtgagctatattgagcttaaaacatatgctggaatggaaataaaaaaatgaaaaccctgaaaaataagctcttcagaggtttagaaatgaaatgggagtgatgaatagctaggagcaaggacatgggagtatacatggtgccaagagagaaggtatcattttactaaacacatacttcacctttttcacatttcatctaattttagcagcttaaaaaaagcttttgtttttagcttagacagaaactcttaggctttggacccatgttccaattctatacatcaaaaattgtgaaaatttctagagggaatgatggcaggacttctcagaaggttggaaaatggagggtgtgagttgaagaacagtggttaatgacaaaaattgtagatgaggtccacctgatcacaaatcatttctaaaaccatatttggggatttggataatttatttgcactcctaaacctctgtttcttcatcaataactgggcataatgatactactcaggtttcttatgagaattagatgacgaaataccgtgtttgtcatgtaggaaggtataataaattttacacctgcctacatgacatatatggtataattaatttataattaataacttgacttttataactaatttactgacaattacttattgagtacctgctatgtgttagggtaaagcaattcaagaacctaactgaactcctgatatttgtggcttttacattctagcaggtgtgccataatgagtgatattatttataacatcaaacgctaggagaatcacaaagagctgactccaccttgagtttgccttctagaaacagaaaaatagcatgaatcctaattttcacaaagtagatgaagatattcaatttgatactttaagaactttccaaatgaactaatttgaaaggaaaacgaaaagagaggattgaaagaattgtcattccctgttcaaatatttaatcttgtcaagttctctttaaatttgagtggaggcaaattcctgaagatcaagcacctggcctatgaaaatgtattaaatatgttttgatgataatttcagtgatcatagaaggcatttccaaatggaatccattacactgcttcaagtattattacaatgagttctagttctttcactaggttaatagattaataagttttattatcttgcttgtagaaagcattgaaaattcccaaggaagaaaaaataagttcaaacaagtaaccagaaaaataaaagagaaaaaggataattcacttctctattgtaatttatgtgtttcttgtatgtgggattagacccagcaaagctaaaagaggcaactaaaagctcagccccagtgctaattttgtatccttgaggaaatcacataccctttcaagttttaattattcatctgcaaatccaagattataaaatgacctcatattctagttgacaatgtttttatatcaatattttatttctttactttttcctcatactgtgccttgcttctcctttatatgtaaagtttacatatcaatttatacatgcgtatatataatttttctatcaatttcaggagtggataaaggatgtctttgacccaaattcttgccaaatctccttccaagagaagtattgcctattatactccaaatgtacaataccatagcattagtttagtaaaaaacaatatgtcttgtttctcctttatttttcttgatgttttcataattttaataaaaaacacttaaccaaagtgctgaggctgtgtttacaataaggtatttttaaattttatctctcctctaccaacacatacacataaatttaggaggaaaataagattaggtagcatcaatttggtgctaatgaaaatgaaaccagcattgatattttctaaatctaataatgcatgcattttgaatagttttctttgactcatttcccctgaaggtgaattcagattctttaggcattttcccaaaaataatttttaactctctgccttgtagtgaaattttccaaattgaaaagccatgtagaatacactgcgaacaattttacagccttcattaatatataagtcaatgtctaggtcacagcttctattaggtagccttatctttatcgatagttttccccaacttcagattctggtaattgcatgacttaccctaccctctctgtgtttaaatcctagattaaaggaggaaaacagcgtcctgtgaacactagcctcaggtgctgacagcatcatcctttgtagcagtccctgcaccttatccttacttagtaaataatcctttatttaaaaaaaatttgtttgagttcattgtagattctggatattagccctttgtcagatgagtaggttgtgaaaattttctcccattgtgtaggttgcctgttcactctgatggtagtttcttttgctttgcagaagctctttagtttaattagatctcatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttgtttttctcaggtttgtcaaagatcagatagttgtagatatgtggcgttatttctgagggctctgttctgttccattgatctatatctctgttttggtaccggtaccatgctgttttggttactgtagccttgtattatagtttgaagtcaggtagtgtgatgcctccagctttgttcttttggcttaggacatgaacagacacttctcaaaagaagacatttatgcagccaaaaaacacgtgaaaaaatgctcatcatcactggccatcagagaaatgcaaatcaaaaccacaatgagataccatctcacaccatttagaatggcaatcattaaaaagtcaggaaactacaggtgctggagaggatgtggagaaataggaacacttttacactgttggtgggactgtaaactagttcaaccattgtggaagtcagtgtggcgattcctcaggggtctagaactagaaataccatttgactcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaactgtggcacatatacaccatggaatactatgcagccataaaaaatgatgagttcatgtcctttgtagggacatggatgatattggaaaacatcattctcagtaaactatcgcaagaacaaaaaaccaagcaccacatattctcactcataggtgggaattgaacaatgagatcacatgcacacaggaaagggaatatcacactctggggactgttgtggggtggggggaggggggagggatagcattgggagatatacctaatgctagatgacgagttagtgggtgcagtgcaccagcatggcacgtgtatacatatgtaactaacctgcacaatgtacacatgtaccctaaaacttaaagtataataaaaaaaaaaactgaaattggcctgttttattatttctcgtcagttctttgatttaataaaccagataaaatctcattataactaattcctaatattagccaagttattttattaaaaataactaagacagaaaaaaattggcttcaatatttggttataattttagaatatgagattacaaagaaattgtattgtactcatgatgttggtagcagggtttaacaatatatcttgggaaataaaatatttccatctatatcagaatgatatctagatgcttgtgtttctcttaatcttttaaagcttctttttaaatgtcttgttctactgggcttactctacagtgcaggtagatatattgaaaattcctaatttttcaatatatgaaagaaaaaagcaaagaaaagaaatatcagaacaaaacaggtatttagtaataaacaagtcaactgctttcttaaaactagagttgtaaattagttctcagacacttccacataagagtcacatgacacttactaattttaacagaaggctagccctgaagcagtgacacatgtttttgtgccatatttaattccacacaacattgattttaatgggaattgctagggagtaactacagttttgcccatggtcatcaaagtcactacaacatgtcttcaggaactatatagtcaattcatcgccctggccaatggccaatttgtaagttagatacatatcttttaccttgttattaaacaaacaaacaaacaaacaaacaagctctattcttctaagtgagttggttacatttaaattatcatttatctatgtatgtacgtatgtatccatctatctatctatctacctacctatctatctatatcttttgctgatgtagaactgctgcttttccagttgtatccaagtaaagttccatatcaatgcaatgatcccttttgtacagttattaagtataagttttctataaaaattagcattggatatgtagactactcatgtagttagcgatttaagttaagaccagacttggagaaataaatattaagtcagaatgaaaatcactgatcagctgacatcctcctttaaaagtgagaatatttcccacagaatactaatcatttaaagacaacttgctgtaaatgaaagacaaagatgaataaagccaaacactggtatgctgcagggcaagatctttgtatatattctatccggtatttgtttttgaaaattatctttattcatgtcatgaaattatcaaagaaaagagtgataaaggatctctgggttatgacagcacttctcctgcgatttttttaaatgtaaggaattcagtcagactcagtcagtctaaaaagatgcaaattcttgggaattgtatccagatcagataaaacgttggacactggttaacacagtatggtccacgtcactgactctcacagttacagtgtagtaatacatcagattatttgccaaaaatgtccagtgatgtttgttccattagtactcaaagtaaaagagtgcatctattctctcaagtaatattgaatgtacagtgtgtttcagacatttgtgaaaaaaatacattggtagttccgctcttgaggagtacgcaatctgttaaagaccaccaagttatttttttttactggaagtctttatgcaaagatagagaaaaatgtctacattgatggctgaacacctaggggattgaggtgtagtgaagataaaagaagagcacagaatgtatacctgaaagacctgaagaaaattttaatttcttttttttttttgagacagtctcactctgtccccaggctggagtgcagtgacgcgatctcggctcactgcaacctctgcctactgggttcaagtgattctcctgcctcagccccctgagtagcagggactataggcgtgcaccaccacgcccagctaatttttttttttttttgtaatttttagtagagacggggtttcaccatattggccaggatagtctcgatctcctgaccttacaatacacccgcctcggcctcccaaagtgctgggattacaggcgtgagccaccgctcccggctgaaaattttaatttcttgacccatattcttcagttccctctaaactatgctttcaagaataatgtaaatgcaagttaaaaatgtagtgtccaactgttctcacattaagaaatcagggttacatttggtgagaatacaaaaaaggaaaaaaaaataagtcaagattaattgatcatattaatttcatggtatcactccacgaaaatccagaataattaaattaaaaacaaaagttcaaggcaaagcattgctacaaaaatttcttataataattaatttactggttatgccccttacaggagtcaggaaacaggttagattccttacccagtgtgcccactaatagtccctttataaaaccatctcctggaggcactagtcctccctcagaagaacagtaggtgaaggagttctctggtttctggccttgaggccagttcctgtttaagcctaaataaatgaataaataaataaataaataaataaataaataaataaataaatattcctcttccaagaggcatctggcagttccccttatccctgatgagtccttcttaagaccatgtcgaattaagttaaatgaatcgaaagtaaattaggattaaattgtataacattgattcatacattgccttggatgatttatatacatttggaaagtttaatactttatcacaatggttaagttttaatgcaaaataaaattatctatgtagtgttttaaaatgttgattagcctactccttagcctttttgaagtactttttaaatttctggtgtaaattctggcatgtagttctttaaaaaaatcctgcaggaagtttttgtgcctttcaaagtttgagggcccctaatcttgggcatacaaatcagtctttcttctgattaatgtggcattgtccatcatttttataaatatgagtctcaaacccttgattgataaagaaaatgctcattataacattgtgacatttggaaaaatttaatattttgtatttttaatataaattaattctttcagaactattaaccttataggaaaacactagagagaatgattttagcagatttttgtaagaactcatctcctaaggtttaagaaatacctacatggtttaaaatagtaattataaacatagtaattttaaaataagatactattttgtttaggtcttccaagtcagttagctggtgtcagttttatggtcagaatgacaaaaatatataataaaaatgtgcagctcatttagctgttgaaggctaatgaacaattaaagcattccataagaacttaatctcacccattttttagtcctatttaaatctgctcctcctttccacaaagttcgaatggcataaattatttaagtcatatacaaagggaacccaatcaggctggcagaagacttctcagtagaaatcttgcaagccagaagggattaggggcttattttcaacactctaaaagaacttaaactaataatttcatattcctccaaacttagctttgtaaggaagggataaataaagtattttctagacaagcaactgacaagggaatttgtaatcactagaccagctttacaaggcaacctcagcggagtcctaaacatggaaaaaaaggacaatttctgccaccacgagaacacaattaaatacatagtctgcagaccctataaagcaaccatataatagaaactacaaagcaaccagctagcaatttcacaatgggatcaaaacctcacatataaatattaaccttgaatttacatggtccaaacaccccacttagaaggcacagacttgcaagttgtataaaacacaaagactcatccatctgctgtcttcaagagacagaactcccatgtaacaacacccatagttcaaggtaaagggttggagaaagatgtatcatgcaaatgaaaaacaaaaaagaacaacagtcacttgtgttagataagacagaatttaaaccaataataataaaaaaggataaagaatgtcattaaataatgacaaagggttcaactcaacaagtagacttaactatcttaaatatgcacacactcaatattggagcacccaattcataaaacaaatacttcaaaacctataaaaagacttaggcacaaaacaataatgggagacctcaacacatcaatgacagcattagagagatcatcaatgcaaaataacaaaataatcctggacttaaatttgacacttcaccagttggacctagtagacgttacagagcactctacccatcaaccacagaatatacattcctctcatctgcacacagaacatactctaagggtgaccacatgctcagccataaagcaagtctcaataaacacaaaaaattaaaatcatatcaaccatactcttgaaccacagtagattaaaaccagaaaccaatactaagaacatctcccaaaaccacacaatgacatgcaaattaaacaacttgctcctgaaggactttcagataaacaacgatattaaggaaatttataaaattatttaaaatgaagacacacaacatttcaaaatctctgagatgcagcctatacaatgttaagaggaacatttacagcactaagtgtctacatcaagaagttagaaagatctcaaattaatgatctaacattacacctatgggaaccggaggaaaaggaacaatctaaacctaaagctaatgagaggaaagaaataactaaaatcagagcagaactgaatgaagtagagacccaataatccatacaaaagatcaacaagaccaaaagttgggactttgaaagcataaacaagagagataaacctccagctagatgaacaaaacaaaaaagagaagatccaaataagcccattcagaaacaaggatgacattacagccaaacacatggaaaccgaaaagatcctgagaatattatgaacactggatgcacacgaactaaaaaatctagaggaaattgatacattcatgaaaacatacaacctccccaaattgaatcacaaagaaattgcaactctgaacaaatgaatcagtcataaaaaaccctatgaatcaactaatgtccctgaccaggtggacataattcacagccaaattatagcagaaatacaaagaagtcctactaccaattctactgacactattacaaaaaattaaggaggaactcctctgtaactcattctatgaagccagcatcaccctgataccaaaacctggcagataaacaatgaaaaaaagaaaaactacaggctaatatccatgatgaacataaacacaaaaatctccaaccaaacactagcaaacctgatccaacagcacatcaaatagctataccatgatcaagtagcctttatttctgggatgcaagagtagttcaacatgtgcaaatcaataatgtgattcaccacataaacaaaattaaaaacaaaaaccatgtaattatgatcatctccatagatgcagagaaagcttttgataaaatctaacatctcttcatgataaaaatacttaaaaaatgagtcaccaaaggaacatacctaaaaataataagagtcatctatgacaaacctatagccaacatcatactgaatgggcaaaagcgggatcaatcccttgagaactggaacaaagcaaggatgctcactttcactacttctattcaatgcagtactggaaatcttagagcaatcaaagaagagaaagtaataaaagacatccagatatgaaaagcagtcaaactatttctctttgctgactatatgtttctacactaaggaaacctcaaagactctgctgaaaggctcctgaaatggataaatgacttcagtaaagtttcagaataaaaattcaacatacaaaaatcagtagcatttctataatgttcaagtggagagtcaaatcaagaacacaatcacatttacaatacccacaataaaaattaaatgtctatgaatacatccaacaaagaggtgaaagatctctgtaataactacacaatattgctgaaagaaataatagatgacacacacaattataaattcattccacactcatggaaggtaagaatgagtattactcatggtcatactgcccaaagcaatttacagattcaatgctattcctgtaaaactaccaatgccatttttaacagaaatagaaaaataggattctaaaatatagaacaaaaaatagcctgaatagctaaaggaaggtaaacaaaaagaaaaaagccagaggcatcatattatccgacttcagctatacaataagtctacaatatccaaaataggacggtattaatacaaaaacagacacatagacgtatggaacagaaaagagaacccagaaggaaagctgcacacctataatcatacgatctgtgacaaagttgacaaaagtgaacgctgggtaatgttcaatatatggtactcaaaaactggctagccatatgcagaagaatgaaactggactcctacctttcaccatataataaattcactcaattcactcaagatggattaaagatttaaatgtaatacttcaaactataaaaaccctagaaaaaaacccaagcaacatcatttttgacattaggctaggaaaacaatttatggctaaatcctcaaaatcaattgcaacaaaagcaaaaattgacaattgggacctatttaaattaaagagtttgcacagcaatataaaaaaattttaaaaagatcaacagagtaaatagataacctgcagaatgggagaaaatatttgtgaattctgcatctgacagaggtctaatacccagaatctataaaaaacttaaacaaatttacaagaaaaaaataaccctattaaaaagtgggcaaaggacatgaagaggtacttctcaaaagaagacatacaaacagccaacaaacaaatgacaaaatattccataaagattgttaagttccattggatcgcatgataatttcattgaatctgtgactggtaaaatttacagcttcagtaacaccagatgtaaaatgaagaatctatatgttggtcaggttataatcaagacattatttttcttgtcataattacacatactcttttatcatgtattttcttgaggaaatacatatatgcaaacaaaacggtaggtgctcttattttctttttaaacaatacaatatgaaatataaatgtacactagatgccacccaatttaagaaatagaacattactggcaaggtgtggtgtctcactcccgtaatcacaacactttgggaggctaaggctggaggattgcttgaggccaagagttcaactagcatgggcaatgtagggaggccctgtctctacgaagaaaattaaaaaatatagctgggaatggtggtgcacacctctcggcaggaggatcacatgagcccagaagttcaaggttacagtaagctatgattttgccactgcactctaggcaatagagcaagaacctgtttccaaaaaaataaaaataatgaaaatatttgatctaaagaaaggaatataccatgttttcctttatttagcatattaataaaaacaataaagatacacatatttcagttactggtatcttagaatatcttgcatatatacaatctgagctttttgatcaggaaaaaaatttaaaagaatctcttgcataccttttcttacactatcctgaattttgcgttattacttgccatagttgatagacagactataatgtatgcacccctaaacagtatatagtttttccttttttaactttatgaaaataaaattatacccttgaatttatacccaaaaattctcatatgaaatattttatccatgcaattaacaaatttaatccaatggctataaaatatagactattataccaaacaattgaggaattagaatgattctataatgtcttttatttacttgtgctacttggataattgttattttcctccattttattttactaagtggagggctggtttatgttaccttttcatggagaggacaaaattaaaggtatctcaaggcaagactaggtgtgggcctgtagacaacactaaaatgaatataaggagagagatatgctagtaagggataccacaatgggcaaatgcttttatttttgacctatggatgggaagggatacacagacctgtagggttaatggtatccaaacacatagaaattctaacatacaagcattcagtagataagattatcaactcccaatttctactaaaaaaaagttcatatgctaatcaaccatatcagttgcttcaattataaacctcatttacaagtcttaatagaaaaggaattgatttttttctgctttcaaagagaaaatgagtgaaaatagacaccctctaaagcatattcaacacctacccaacaaactttcaaaggtagatctatttagctaccaccatttacttgaagttaaaatggtacacaaaaatctattgcctaaatggtagtcttcattttatcatttaaaattaagattcgactaaaagatcaatagaaaaatatttgatctaaagaaagaaatataccatgttttcttttatttagtatattaataaaaacaataaagatacacatgcttcagaatggaaagaaaggtgtttacttttaacggcagaacatatcaatcacctcattattacataatatattatttaaggtcaagtgtagatgctcaagcttgtaatcccaaagctttgggaagctgaggagaatgacttgagctcaggaatttgagaccactctgggcaacataacaagaccccatctctataaaaaggaaaacaatgaaaataaaattagtcatgtgtggtagtgcccacctgtagtcctagacccttgagagactgaggcagaaggatcacttggatgcagggttttgagtctgcaaggctgcagtgagctataatcatgccactgtactcaggcctaggtgacagagcaagaccctgactttttaaaggaactgtatttgcttctattaaacaggtcacaaacactctcaatagttttttttctcaaagttgagatatatggaacaagtttttaaaatttcaccatattgataaaattatcccctaaatctatccagggtaatatattatccacaataacatattttcatatcttctttcttttactccttactggttttctactgcttcaataatttgtttttctctttattctatcttgattcatgtctagttcttgtttcctatgatatcctccttgtaattttaacccagttcatccctctaatcttccattcagtatctctctgctgtgtaggaagcataactgtgctgagttcttggctggaccactgaaatcaagtaatgactgaatataaatcagaatcatggctgtaaataaaaagaatgtgaccaaatgtccattagcaatgatagtctagtcatataaaaatgtggctattttcaattaataaaacaaaacaaggaagaaaaagtaaagacaatgtcaggaacgatgataagaataagcatgtaacaagcaaatggtaggtttgcttcaaccaaatggtaggtttgctttcattacatgaaaattttaccaaattgtacatataaagtcttctaagaacaatatacaaataacattttagtatataaattggctcaagaaagtcatttttcagggactctagatttataggctctttaagtctctttaaaactgtaaatgacccacagaagttggctgccctaaaggtttagattaaataaaccatccagtgcacaattcaaatataagctgaacaaccttaattggaatatctatcctgtgcggttttccagtttctgatttggtactccccaagtagcaatttcctatgaattaccgtttcccaactaagaggtacagaaattcccagtttctttaggaggctgaatattttaaaacttcggctttattaaggttttcaacaaagttctaattaaactacacttcattaatggcttacccccctaccttagaataaggagagctttcttacaattattaaagctaaccttcagaactgttgttaataacaagactaagaacaatttttaattttttttaacttcatagctgtaggctaaccaatagttaacaaataattcattcatttcattggcatcatcagtcctcctagcaatatgtgttttttttttttttaatttaagacttggtgggggaggcggtgaggactgtgcaattactagtcactgttttcccactcattggtactattagcttaacagataaaaccacagataacagccgcaatcaacttcagcaggttcccagaggcaagctcttgctttttgctgattagcttcattcaattatgtcttcttaattgttcatgtgctacagctcattaaatgaaaaataatattcctttcctgtgggtagggcacttgagatttgaaaaatagccacttcatctctgcctcagaggcacaagtaagttgatctgatggtgtctgaaaaagctcaacagatttgtgcagatagccctgcccgagaagggacaataaaattaataaaattgattgttaaatcaagtcaaaaataaaattactcccagtattttcctttaagattaattttcaggaaaattagacccagttttgtagcatttgattatgttcacctctgtaatataattttctttgtaaaaagatcagttattgctgttccattacagatgggatttagggaaagtggagtaaatttttaaatttttctgaaaatagattttgacagattaaaaagtgtgtcacacaatttatttatgaaatattctagaaatggagaaggtaagtttcattcattaaaatagattcattgagtacctactatgttccaggccttttgctacacaatgaggatacaaaaggtcttaacttcaagaggtttattagtctggtggagtagaaataataattcaataataatccattagctaatatatactggctatttactaaggacctataaagtacttggtcgatatgtgtcaccttacttaatctttttaacgatcttataacatagaccatatcatattttttattatagatgaactaaggcttagaaaaattatattgcttcctgatatcacataactagcaaatgctaaagtttagtttgggacaagatatgtatgaccttgtagcattcctatttacaggtactcctcaatttacagttcctatatgcatacatttcagtcaccatgtttagttaagttagaccagttacccagctcaagcgattctcccacctcatccttctaaagtgctgggattacaggcatgagccaccacacctggacggatgtgccatagtttgtaaaagagttgagaatggctgctagctagtagaaaaaaatggtgatattagaaacatgggtatattttcaaatgaattccaaaagtttgagaaagtaatagaatttttgtctgttttgttctctgttatttcgcaaacacagatactcagtacatatttttgcttttttttaaggagatgaaaaagtctgacatgattttataaaaaataaaatttcaaatttcagctaccacagtgtattaactgtaagtaattacataagtacaaattttgctccttgctctttggtccaaaatcattatgtaaataacaggtgtgcttcatgatcagtgaccattggcatcatctttttaaatgtctgtcagtgattgatcactacacatctattattcatcacatgcagacagaaaagtgtgcagttatgttgtctctgtttcccattgataaacacaagtgccatttcttaaaaataaataattgaaagaattggccagaaaagataaaagtacaacataaagtaaaacgttgagtccagtgaaaatggagctacagcaaaatccctgtgggaatattgacactgctgccatctgaggaacttaagctttgcagccagaacaacttagtgcagaggagcttattgacataaatgaagaaagtggatgtgatgaaaaggatgaagatgtatcaggctaagtgacgccagcaaaaacccaaacacacaataaaaaaaaaaaagacttacattaaaggaacttacagagatacttaacaatattgaaagcatcaaagcataaagtgatgaaagctgatccaaatttaagattatgacaatttgccaaggcataaaacattgcccccttcattgtaagccatgtaagaagaaatcaatcactattcaaactattagtaaacattttttaacaaacaagtaaactttaagtctttaacatcaatgtaattaagagggaattggccagcatatgtgaaagtatagcaaacaaatgaaaataatgatgcaaaaaataataatgtaagatatgagttgaatataaacagagttatagaaagaaagaactgactttaattcttttattcccagtgtaaattccaggatgttaaatgaatatgttttataatttatttattttcctacacatttgtaagtgacagtaaaagagtttctaatattttgaaaagaaattaaaggttatggaataatatttattcttgattattaagataaacttgcatgatttcagctgagattatcatgtttatcatccttcactaccatgtaaagcgagaagtgtgggtattaacttattatctgtttgtttaaagtgaatgacacacagcttagtgttacatcaacagaaaaatatttaagaggaaatgacactaaatcaattttaagataatgcttctattatgtatgtttctgtatcgtctttctaaacataattatggaaaaggcatcccaactggtgacataattattgccaataatataatagtaatgacaatatatttgttggtcaattaaaagtaactacattagctttggtaaaactacatttttcacttacatgattaaagacacttatcagtgctcttgtgatcctactttaagatatacatcttcatattaatttgtaaatgaaatgtgggagtttttcataaccaacaggtttaaagctgtgtgaagatatgtgagggaaatatatagttatgtctgtaagaatcagtgatgtgccatactttgtgttttgttgttattgttttcttgagacaggatctcactctgttgcccagcctggagtgcagtggcatgatcacagctccatgcagcctctacttcccactcaagcgattttcccacttcagcctcccaagcagctgtgactacagttgcatgtgaccacacccagctaatttctattttttgtaaagacacggtctgactatgtggccggggctagtcttgaactcttgggctcaagcgattctcccacctcatccttcttaagtgctggtattataggcataagccaccacacctggactgatgtgccataatttgtaaaagagttgagaatggctgctagctagtggaaaaaaatggtgatattaaaaacatgggtatattttcaaatgaattccaaaagtttgagaaagtaatagaatttgtgtctgtcttgttctctgttatttcccaaacacagatactcagtacatatttttgcttttttttaaggagatgaaaaagtctgacatgattttataaaaaataattttgatgttagtaatcattactcaacatatttttgaagagtctaaaggaaatttccactgtttcaaaagatcccaccttccatttctctctatctcatctcctagcaatctacccttcatttattgtactctagttgtgcttatctttttggtctttatcaaacacaacaaatattctgagaccttaatatttctgttccctctccctggaacactattcctcaagaaataaaattaggtaattatttcaatcaagctggtatttaaacatcttctgctcaaggaggcctagctgataatctgtatttaatgttccagttttcctatactctctctgaacccccattggccattctattttgttttatccatagtgcctatcacctgttggcatattatatgaactctttgtttattaacttatttgttaattttattgtttatcatttatgtctatcaatggcatgtagactctaagagagcaggcatatttgtgtgtgttattcattgatatttcaagattaccaaacagtgtctgtcatatagcaaccattctttttttatttttttctgagacagagtcttgctcccgggttcacaccattctcccacctcagcctcccgagtagctgggactacaggtgcccaccacacccggctaatttttctatttttagtagagacgggctttcactatgttaaccagggtgatctcgatctcctgaccttgtgatctgcctgcctcagtctcccaaagtgctgggattacaggcatgagccactgtgcccggcccgttcattacgtaagaataaagaaatatccccttgacatgaaattctgtgtattggaataatatatataccatggcaatgagcatttgtcattatcttagtcagcagtatatattttcctagacaatgaaaagactcccaactggccttttgtatgacaaaaagaactgctaatcactttcccagtttggcttttatttatctccagattaaagtgttattaaggattaatttaatgttattttattccatttagtgaacttttaaacaataaaacacttttatctatgttgttttgcacccatatgacaataaagtgttatcatgcccatactataagtagaaaaacacaggtagaaagaacataactgatttgctcaaagtcatataactcagaagtgaccgaatacatttgcctgactccaaaacttggtctgattttatcatcccttgctggctgtcagatctgatatatcagtccaaaaattacctcttgcttaaaccgatgttttggatgacttttgtaattttctgcgttccatcatttattagcgccaatatataaatggttatttagaatacagaggtttacacatattcgggaccaacattccaaaaatggcttaaatatttctggcagcctaatattatctacggagaattattttcctcaagaacattagtgagatgtgctataataatggttgagcaaagtagcacaacactagatgctgtgtaactctgggaacaccttatttcctgctctgatagaaatctgttaaagaccctcatctgttacaggcagagagaagagcagagtaaaagtgctttgcctacctaaagggattgttgtaagaatctgatgagttaaactgtgtgaaagcattttgcaccctctaaatccatacatttacatgtgacttccctgtatgacacaagctaacaaacaaactagaaacaagcaaacaaaaaaaaaccgagacacaaaaataaaatatctttctgttacctcatttgggaaggggtctaaaaacccagaaataatagtatttacatgtacatgtagttggtaaacattcaatggagtaaaaagtaaattaaaaataataccattagcagaggggaatgtatttttacttatgcatatatacccacatattggatttgtctctatttcatctgtaggacctagccactagccaaatgcccgaagcccctagaaccccagtgcctagtgtggtatgcagaaaataatgccctgttatatgtccattacctaattccaagagccttggaatatgttaccttacctggtaaaaaggactttgtagatgtgtttaaagttaagaacctccatatggaaaaactgtcccaaattatctggatagacccaatctcatcacattagttttaaaaatattaaaccttccttggctgtggtcagggagagaaatgtgattgtagaagaatggcaggcaaatgtaacattgctagttttgaaaacaaaaggagtccagaagtcaagggacgtgggtggccactataagctagaaagatcgagaaaactgattctcccctagagcctccagaaagtagcattaccttgccaatttaacctgattttaatcgtcagacctgtgtcaagcatgtgacttagagaagtataagatattacatttgtgttgttttaaggcactaattttgtgataaattgctaagacagcagtagataactaatacagctagaaaacaattttaaaatacattttaaaaagaacttcaacatgccaatatctaatgaataaaaccaaaaataggatgaaaaattaaaatgaaacttagaatttttctatattacatatttgggaaatttgaattatttcataatattctgatctcaaaaatatgaaaaaagtagcttgtctagttatcattcacctgaaagcaactgttttaaacctgtcattacaatctgataaaaagtaatatgtctcattcagtcccaactacgctcaacatgacccaatcttgtcagaacccaatgtgaagcttcaagtgtacaggaatttacaatgacaatgctccatggaattttcaatgacaatcaatgttccaaaaaagctatgacctacacttgaggctatcccaaggagaagcaaatatcatagcagcatcttacatttgtgaacacagtggtaaatatagagcatacaaaaccatgcatgggtattttcttctgtttttaacaatggataatgaatgtcaaaagtgatattcaaactagcaatatgcaagttaaaattaaatccataaagcacagcaaaataagcatttgttccattgtagagctcacgtttccttgagcacttattttctttcttttccctcctctctgctcctgtcccctcccctccctccttcccttccttcctcctttcctttcttccttcgacttccttcctgacttccatttttcttttttcagctttattgaggtatagctgacaagtaaaaatgaacatatttaaggtgtgcaacttgatttttgtatatgcatacattgtgaaatgatcatcataatcaagctaattaacatatccatcacatccataatgtaaaacatatctaatgttgtacattagatatactgttaccatgctgtacaataggtatatgccacattttccttattcatttatctgtccatggacacttaagttgtatccataccatagctattgtatataaagctgaaatgaaaactaaagcaaatatcgattcaaaattattttatttcctttgaataaagactcagaagtgggattgctgaagcatttggtagttccatttttaattgttaaaggaatcttcatattgttttccataatggccacaccaatttacattcccatcaatatgtcttcctttttctccacttccttcacaaaatttatattttgaagtttgataatagccattcaaacaggaatgtggtgatacatttttgtggttttgatttgtatttcctgataattaatgtcattaatctttcatctttcatctacctattgacctgtcgtctttcatctagctgtttgccatttgtacatctttggattaatgtccatttttgtaaatttatttttctattgagttttgtgaactccttatatattttgaatattaccttttatcagatatacagttgcaaatattttctgtagtttgtcttttcagtctgttgattgtttcttttactgtgcagaagctttttagtttgatgcaattccacttctatacttttgtttttgttgcctgtgcttttgctctcatatccaaaaaaatcattgccagaaccaatgacaagaatctttttcctgatggctttttgctattagttttacagtttcaagtcttatgtttatgtctttaatccattttaagttaatttttatttttgtatgtggtaagagcttatcttcatttttctacatgtggatatccagttttctcagcaccatttattgaagaaaataccttttccccagtgtgtattcttggtgcccttattgtaggctggtttactctaagtgcatggatttatttctgggctctctgttttcttgcattaatctatatgtctgtttttatgcaaattccacactgttttgattagatttgtaaattattttgaaatcagaaagtgtgatgcctctagcttgcttttcttgctcataattggtttagctatttgctatttggagtttattgtggttccatataaattttagaattttttttcctatttctgtaaagaatgccattggaattttgacagggattgcatgaacctgttgattccttttggctagcatggctactaaaacaatattaattatttcaattcataaacatttattttccatggatgaatgttttttcatttatctatgctttaacatttttccttgattcctcctccaagatggccaactagatgcagccaggagaaacatctcccacagagggaccacgacatcaggaagacgggtgtacccctagtaaatcttcagagggaaggcattgagagcagatagagagaagatacagaaggtgggataaagggagatgaagctgggaatgctgcatgtggctaccacacaccaggactcattcctggctcccagcaactcctgtggaaggggtgagttgaacagaaatgagcaactcactctcaccatgagcctctggaatcatagcaggaggagtcttgtcagccaccatggacacttgagttggcagagaaagctacttagtgaagtggtagggacagaactccagctgcagcagagcccatggggtttggtgcaggagcatctatagtggagaacagccagggatgcccatccccctaggcttgatttgctcctatagtagacattagccctaaggaaaggggtgaacgtagactctgtagagcagtcttgcccatgagatgagccaggccccctgagcaccctttggtgtgctgtcttctctttgggccccagcctgcctgtacctgctagcagtgtacccccccaggcacctcaagggggcctgcctcattgctcctgcactggtggactgcagctgactgggagagtgctccagaagagcaaaccctgtgtatacatataagactgcccatgtcctccccacactacagcctcctccatactgctttgctggcaggcactcgctgccagcgatccccatacatctctttgcctgtacatgtgtttgcagacagacctagcctttccttctctgacagtgcatgtgtacacatgtaccatgccatgccatgccactattgctggcttgagtgtgccccatcccttctccccctgttgcactgccatttttgttggagcattggagggcatatagtttgacagctctgccaccaccagtgctccactcctgtgccaaaactgctggcatgaaactaagcacagaaaacagtgtatctactcccatccctgagaggtcactgctgtaagcaagaatgctcacagagggtgcacacagtcctgcgaccactagcgccccatccctgtgctaacaccagcaccagtacaaatgtgcacaccattgccagcagggccctccaccttcccaaaccataccgccacagccactactacaaacacccacatggaggctgtcatcttccatgtggatggaggatgccgctggtacatgcaaatgtggacacatcccactacgactgtcctacaaaatgctttggctgggagtagccattagagtgttgtgaccagcagtctgagatcacattgacccctccagtgcagcaggttcctaaacttgatccacaggtaatagctggtgtatgataccagtctcccagagttagagcacacaatgcagagtgctgagctgagccttggccacctgaagtcttccactaacaaagccaggtgactgaacacagcttataccataatcaaaccctcaaggtcataaaatagaataaaagaaaaaaaatccaaaggacagcaacttcaaagattgaaggaacaccagcccacaaagatgagaaagaaccagtgcaggaactctgacaactcaaaaagccagagtgccttctttcctccaaatgagcacactagccctccagcaagaattcctaatgaggcagaggtagctgaaatgacagaaatagcattcagattatggataggaataaaaatcattgagttttgggagaatgttgaaaccacatctaaggaagctaagaatcacaatattaagatacagaaggtaacagacaaaatagccagtacagaaaaacaaacaaacaaacaaacaaaaaacataaatgacaggatagagctgaaaaacactctacaagaatttcataatgcaattgtattaagagaagaataccaagctaaggaaagaatctcagagctcaaagactgtttttcttaaataagatggtcagacaagaataaagaaaaaagaataaaaaggaatgaagcaaacctccaggaaatataggaatatataaagagaccaatattatgactcattggtgtccccgaaagagatgagaagaaagaaagcaacttggaaaacataagtcaggatatcatccatgagaacttccccaacctaaccaccaatattcaaattcagaaaatgaagagaactcccacaaagtacttcacaagaagatcatccccaagatacataattatcaggttctgtaaggtcaaaatgaaagaaaaaaatgttaaaagtagctagagagaaaggacagatcacctacaaaaggaagcccatcagactaacagcagacctctcagtacaaatcctacaagtcagaagagatttgggacctatattcaataacctaaagagaagaaattccagccaaagaaatttatatttggctaaacaaagcttcctaagtgaagggaaatatgatccttttcagaaaagcaaatgctgagggattttattaccaccagacctgccttacaagagcttctggaagcattaatatggatgggaaagaccataaccagcaaccacacaaactcacttaaggacacagaccagtaacactataaagcaaccaaacaagtcagcataataagtcgacagcaacaggataacaagatcaaatacacattaatactaaccttgaatgtaaatgaactaattttcccaattaaaaggcacagaatgtaagctggataaagaaccaaaacacaattgtatgctgtctgcaagagacccatctgacatgcagtgatgcccacagaatcaaataaaggaatggaaaaaaatctgccatgcaaagagaacacagaaaaaaagcaattattgcaatcctaatttcagacaaaaaagattttaaaccaataaaaataagaaatggcaaagaagggcattatataatagaaaagggttcaattcaacaagacctaactagcctatatatacatgcacctaacacagaaacattcagatttataaaccaagttcttagggaccttcaaggagacttaggctactacacaataatacggggaaattttgacacccccactgacagtattagacagaccatttaagcagaaaattaacaaaaataatcagaacatgaacttaacactggaccaaattgagctgtgaaacagctacataactgttcatcaaaaaacaacataatgtacattcttctcatgtacacacaacacatattctaacaatgaccacacaatcaaacataaagcaatcctcagcaaatgcaaaagaaacgagatcataccaaccactctcttggacaacagcacaataaacatagaattgaagaacaagaaaatcagtcaaaaccatacaatcacatggaatttaacaacctgttcctgaatgacttttgggtaaataatgaaattaaggcagaaatcaagaagtattttgaaattagtgagaacaaagatataatataccagaatctctgggacacaattaaggcagtgttgagagggaaattcatagcactaaacacccccatcaaaaagttagaaagacctcaaattaacaacctaatatcatagttaaaaagctacagaagcaagagaaaaacaacaacaacaacaaaataacaacaaaaacaaacaaacaaaaaaacccaaagctagcagaagataaaaaatacaccaaatcagagctgaacagagactgagacataatacaaccattcaaaagatcaacgaagccaggagttgactttttgaaaacattaatacaatagatagaccactggttaaactaagaaagaagaaaacagagaagatccaaataaacagaatcataaatgagaaagggaatattaccactgaccccacaaaactacaaataaccatcagagactactatgaaatcctctatgaacacaaactagaaaatctagaataaatggataaattcctacacacatacagtcttccaagctgaaccaggaagaaattaaatccctgaagataactataacaaatgctgaaattgaatcagtaataaacagcctgcaaaccaaaaacagccctagaccagatgaattcacttctgaattctaccagatgtacaaagaagagttggtgcattcctactgaaacggttcccccacaattgagaagggacttctcctcaactcattctatgaggccagtatcatcctgataacaaaacctggcagagacacaacaaaaaagagaactttaggccaatatacttgatgaactttgatgcaaatatccttaacaaaatactacccagctgaatccagcactatatcacgaatccaccacaatcaatattctttatccctgggatgcaaggtttgttcaatatacaaaaaccaataaatatgatttataaaataaagagaactaaagacaaaagccacatgaacatctcaatagatgcagaaagacttttgaaaaaattctgcttcccttcatgttaaaaactctttacaaattaggtattgaaggaatatacctcaaaataataagagccatatattgcaaacccacagccaacatcagactgaatgggcaaaagctggaagcactgtccttgaaaaccagcaccaaaaaaatgatttctccacttgctatttctattcaacacagtattggaaattctgaccagagcaatcaggcaagagaaagaaataaaaggcatccaaataggaggagaggaagtcaaactaatcctgtttgcagatgaaatgattctatatctagaaaagcccagtttcagctcgaaagctctgtaagctgacaaacaacttcagcaaagtatcaaggtataaaaatcaatgtacaaaaatgactaccattgctatacatcaacaacagccaagctgagagccaaatcaggaatacaatcccattcacaattgccacaaaaagaataaaatacctaggaatacagctaaccagaaaggtgaaagatctctacaatgagaactataaaacactgctaaaagaaatcagagataacagaaataaatttaaaaaaaaattctatgctcatggataggaagattcaatatggttaaaatgaccatattgcccaaagcaatttgtacataaaatgttattcctatctaattagcaactacattattcctatccaattagcaattacattcttcacagaactagaaaaaaaatcaattttaaaattcatatggaaccaaaaacatagcccaaataatcaagggaatcttaagcacaaagaacaaagccggaggcatcatgctacctgacttcaaactatcctacagggctacagtaaccaaaacaacatggtattggtacaagaacatatgcatagaccaaaaaaacaaaacagagagtcaagaaataagtctgtacagctacaaccatctgctctttgagaaaactgacaaaaaataagtaatggggaaacaactccctattcaataaattgtgctgggataactggctagccatatgcagagattgaaactggaccctttccttacatcatatacaaaaatcaattcaaaatgtattaaatacttaaatgtaaaacccaaaactataaaagcactggaagacaacataggcaatactattctgaacataagatctgacaaagatttcatggaaaatatgccaaaagcaatcacagcaaaagcaaaaattgacaaactaattgaaaaactggtacactagtctccagtgaaagcaactgcacctgaagttaatggaaagaaagaaggggaaaaggaagaagaagaggaggtaaaagatgagggtgataagttagaccaagctgaagagggaggatctgagaaggaagcctctagtgaaaaagaggaaggtgagcagaaagaaggagaaacagaggctgaaggtgaagtagaggaagccaaagctaaagaggaaaagaaagttgaggaaaagagtgaggaagtggccactaaggaggagttggtggcagacaccaaggtggaaaagccagaaaaagccaagtctactgtgccaaaatcaccaaaggaagaggcaaagtcaaaagcagaagtggggaaaggtgaacagaaagaggaagaaaaggaaatcgaggaagctcccaaggaatagaaggtagagaaaaaggaagagaaaccaatggatgtgccagagaagaagaaagctgagtccctggtaaaggaggaagccatggaggaggcagtcaccattaccaaattggtaaaggtgcacttggagaaagagaccaaagaagagggaagccacagcaacaggagaaagaggagaaagtgggaggaaatggggaatgagaaggaagggagtgataaagattccaaggaatccaggaagaaagacatagctgtcaatggagaggtagaaggaaaagagaagggagagcaggagaccaaggcaaaaggcagtgggagggaagaggagtaagacattgtcaccaatgacctagacttaagcccagcagatgaaaagaagggggatgataaaaatgaagataaagtggtggtgaccaaaatagtagaaaaaatcaccagtgagagggagatggtgctaccaaatacatcactaaaactgtaaccatcactcaaatggtcgaagagcatgaagagacctttgaggagaaaccagtgtctactaaaaaggtagaaaatgtcacttcacatgccgtaataaaggaagtcacccagagtgactaagatttgagtccactgcaaaagtttaagccatacgacaatttcaaaatgcatgtgattgacagcttcaaaacagaacagattctcccataggggctccagacattgtattttactttgtgcaatatgaggagactgcatgcaagctcagtgtgctcccccctcagtctttgggggattcaaatgcatgatactgtatgtacctgggaaatttaccaatttcctgcactgttggaagggggtcactcagaaggggagatgtcttgagatgtattatgtaaagtaccaactgagccaaaaacaataaatgaaacacagaactctcttagccttaagaaagctatatatgaataattatgtttaccacactggtgcatttaaaatggacttttcttcatgggagaacctcgttgacacggacagtttgcaatcttatgttgatcgatgtgaaatgtcatagcagtacttgctcaataaaggtcatattggaaacatagtcaaaaaataaataaatgaaagagcttctgcacagcaaaggaaactatcaacaaagttaccagacaaccaatagaatgggagaaattatttgcagattatgtagctgacaaaggtcgattatctagcatctataaggaatttaaacaaatttacaggaaaaaaacaaacagccccactaaaaagggtgaaaagtatatgaacagacacttttcaaacacaaaaacaaaaaaatacttgcagccaaaaaaaagtattttaaaaaagctcaacatcactgatcattagagacacgcaaataaaaaccacaatagaaaacatctcacaccagtcagaaagctttttattaaaaagtcagaaagtagcatatgttggcctggttgtggagaagagggctcacttttacactgttggtgggagtataatttagttcgtccattgtaagaagcagtgtggtaactcctcaaagaaccaaaaacagaactgccatttgacccagcaatcccattactgggtatatagccaaaggaatatgattgatgtattataaagacacatgcccacatatgttcatttcagtaaatgtggtacatatgcaccacggaattctatgcagtcataaaaagaatgagaccatgtcctttgcggtaacatggatggagcaagagaccattattctatgcaaactaatacagggacagaaaaacagaaaacagaaatactgcatgttctcacttataagtgggagctaaatgatgaaaacacatggacacaaagacagcaacaaccagacagtgaggccaaccagaaggtggagggtaagagggagaggatctgaaaaaagtagttattagctactttgcttagtacacaggtgattaaacattctgaatatcaaacccccatgacataattttacctatataacaaacctgcacatatacccctaaacctaaaagttttctaaaaaagaaaaatgttgtattttgcaaaaagtaaacattttcctttattaatactttataattttcagtgtatgtattttcctgtttgattaaatatatttcaaagtatttattcttattattatataaataggatttttaaaatttcctttcagataatctatttttagcctctacaaatgccacttacttttatttagagcaactttactaaattcatgtattaattgtagcatttttggttgtcattgagacttttagacttttctgcctatacacctatatgtcaactgtaaacagagataatattactgtttcttgtctagtttgaatgtctttcatttctttttattgtatcattgttcttgactagaagtggcaagagcaggaaatcttgtacaggattttagaggagaggcttttgggttttccccattgattattatgttatcagtgggcttttcttatatggctattattgtgatgaggtaggttttctctacacctattgtattgagagttttttaaattagaaataggtattaaatttgacaaatatttttccagaacttattgagatgatcatatggtttttgtgtttcattctgtttatgtagtgtatcacattgaatgacttatgcatgttcaaccatccttgcaccccagggataagtcctagttggtcattgtgtacaattttttcaatgtgttgttgcattcagtttgcttgtattttattgagcatttctgagtctacattcatcaaggttactggcctgtagtttacttttcttgtggatgtctttggttatcaggtcgatgctggctacatgaaatgagtttgtaagtgttccatcatctagattttcaaatagtttaagaaatattattaattctttgaatgtttgctggaattctcccacaaagccatgcagtgctggactattctatttcttcttcaatcttggtaggatgtatctttctaggaatttatgtattacttcgcatttatctaatttgttggtgtatatttattcataacagtcccttaagggctctttttatttctgagacatctgttgtaatgtttcctctttcatatacagttttatttatttcagtcttctctctctctttggttactctaggaaaggatgtgtcagttttatttgtctttttcaaaacacaactcagttttgttgacttttgaaatagcttttttgtcctttttaaaatttattttttgccttaattagcattatttccttctttctgataatatttgggttagtatgtatttttttctgtctttggctagttatttttttaggttgtttatttgagatgtttctttttttttttcttcctcagaaacatttaataggtattaacaaacagaagccatgtctctcgaggctgtgagacaagatggtggatccccatgccattaacccccagaacccagggcttatatactataggtaaggagaattgaagtaatttggtcagaatttatggtaagtgtgtgctcttaacagtagtagagtaaaaatcttagaggcattcccagaaccgaggttaatgaaaagccaacatgttggattagcatttaagacagaattggtttagcctgtacactccacctatctgacccagattttacaatttcacattctctcttcttccaagatggtccctgagcctagagagaggttgtttgatattgcacagctttagcagtagtgcattggcaatggaaaacagattgggcccagttgctataatgttccttctcagaaatacttttgctatatctcacaactgttggtatgttttcttttcatttttgtcaggaggtaatttttaattttttaaatttaatcttggacccaatgattgttcaagagtgtattgtttagcttccatgtatttgtgaatcatatggtttcttgtttctttaccattaactgatttacactttcactctattgtgacctgaaaagatacttgatacagtttctatcatcttaaagttgagttgttttgttatctaataggtgatctattgtgaagagtgttccatatgtgcttgaaaagaatgtacaatcttctgttgttgggtaaaaagttctgtagatgtctgttaggttaatttggtctctcctattgttcaagtaagctgttttccattgatttctctgtggatgttctgtccattattaaaagtggaatattaaaatcttctagtattattgtgctgctataaatttctccagttctgtcagtgtttgctttaaatatttagatctgatattgagtgcatatacatttacaatagttatatcttcctattgaattaacctttttatctttatgtaatgaccttctttgcccctggagacagtttttgacataaagtctattttgtctaatgtaagtatagccattctgctttcttttcattaccatttgcataaaatatatatttttccatcctatcatgtttaactatgtgtgtccttaaatagttggtgccaagtttttattctttcagccagttaatatcgtgtgattgggcagtttaatccttttacatttaaagtaactattgatagggaaggatttactattgaaattttactgactgctgtttttcttgttcctttttttctttcttgatgtcttattttgtgtttctttttttgttattgttgtttgacaggctttaattcctttctccttttcttttataactagttttttaactactgtaggtagtagattttcttttttaagtactatggctattttctgtgtgaatgacatgagtcttacataaaatataattataataatctaaaactgataacttctcttccacacaaaaacttcacatttttaccttgttcccattatagattattgatatcagaatttacatatcttaacatgtgtatctattaatgtaattttagttatacctatatttaatacttttttaaattttagattagaattaaaagtgatttacctaccacaaccacaataatatagtattttttatttgcctctataaatttaccattaccgatgagttttatacttttgtatgctcttatattgttatttagcatcctttgatttcaacttaaagtactccctttagcattttttatatgacaagtctagtggcaataaactccctcagctttcgatttttttaattttgtcttaagttttaaaggataattttctgggtatactgttttgattggcagttgtgtatttgtttgtttgtttccgcattttaaatgtatcatccaactcccttctggcctccaaagtttctgctgaaaatccaccaatgatcataggagggttccctaacacataacaagttgtttttcttttgctgctttcagtggtctctgggtgtccagagtatgccagctctcatcattgccctgaaacaggtgagatactgatcctttttagtagtaaccataaatgttggggcactaactggattttccaatttcttctctcctcagggaaaagctgggtgtataatctgctcatgctgaactgagctggggaaaagaactatggcaaatgtttgcaagctcattcaaaccacagactttttcaaactgttgctttgatctctgtagcctccatgggcctaatggatgctgatctccattagttctcatagacacgtcagttgaaagctagttcctcaggtagcagctggaaaagttaaggggatagatatgtagataaattccttccagactgaagctagaggcttgcttttatcattagagtgagcaagtgggagaatttgtggaaatatccacatgcctgtttaaaatggctgctttgttttctatagcccacatgtaaatagtgaatggcaacaccaatagctctcatagacagtgagttagaagccagacctcaggtaggagctagaaaacttagaatgcttgatttgtagtctaacttctttcatagagaatctgggaactgggctttgttgttgtagctagttggtgaatgaggaggtgaagtggaggagatatgggaagaacccatttgtttgggcattttttctcaatgtaccttagtttgtctgtagtagctggccacagtagtgatgattctatttcctgagaggtgagaattgctgccaaagaatgtctgccatggatgagaatacaaagaaaggaaactaagaactctcaaagcagctactagaaacccttcatagaggacaagaattatcttcagttttgagatatatgagaatgattacaactcctttgagcaggcttcacatactgcccaaagatgcttctctagtttgtgtccttcttgctatcagaaagagagaaggaaactaaataaaacaaaataaaaattttagaattttgtgctgtcttggacatggaagcaatgggtcaggatcaagattgtggaaagatgccagttcggatgcaggctagaaaaattagtattgtcctcaactggaatcagcaaccaaaagactaagtgtatgtgtctctgtaggctgaagggttttcagatatcataaaagataagaagtcaagctacacttgtttggaagcatgtggcagagaacacagattaattgtttaaaggatggcccaaacttaaggccaagtcacatcaaacccatcagaaaccaaaagtgtggcagaattcctaacagaaggatgagagaggaagagccttatatagatctgtcttctgtttcacattctgactattctaaagcttttaatgaagaattccctagagtcataaaacaaaggctaaatggtgagtggctgcaaatacacataaaaatatagtgaattttttgaaaagatatactaatttcaggtggctagaaagatttattaacataagtaataaaggtcttttagttgtcaaagtaacttatacttaatatttattgcaattttaaaaaattaaaatgctaaaaattatttgtgaaaatgagttgttttatatgtttacatttaataacaatactttttacataaagaaaatacaataattaaatatatctgaactagtcaaaagataattataagatttaaaattgagtttatgtgcaataaatgtggtaaacaataatgtgatataaaatcttctaaatttaataatattcttggtagaggattctggggcaaaaatatgattttctccatatccctgcccactacccaatatatgataacatgtggcattattaaatatggaaaaatattaaagaatggcagtagactagagagaagagaaggaaaggcatacaggaaatccaggtccctgccctcagagacctctcaattcctggcatatgtttatgttttgaacattatgcaaatttgtctgcatgacaaatttattcttgtttcaggttaagagtagaaatcaacccatagtccttacgattagaattgccttagcataacgattcaatcagtaagaaaatataatagactagagggtaatggagattttaaaatttatattatcttaatatatttattagaaaaaatattagattgctcaataaatcaatggtaactttaaggcttttactgtctactacaaagaatttttatagatatatgaagaatgatggtaaggaagagatatgatgccatgaggcctactgtgagcaagacactgctaatcaggctattaggttggtccaaaagtaattacagtttttgtctttgaaagtaatgtcaaaaactgtgattacttttgcaccaacctaatacttccgcactttggaaaggctttgcctacatcattttggttattgtgagaagacttgcacacataaggaatttttcaaaataatattttaacttgaaatacttttctttgacaaatacagtaaaagtgatagagccaaaaagaggactaggcatagccctgaggggatttccgagcaaaaaaatcccaggggatttgtatgcaaacacttcgctcaataaaaggagaggccaggtgtggtggctcacaactgtaatcccagcactgtgggaggccgaggtggctggattgcttgagcccaggagtttaggacgagcatgggcaacatgacaaaaacttatctctaccaaaaaaaaaaaagaaaaaatagcggacatggtggggtacacctatagtccagccacttagagaggctgatgtgggagaaacgcttcaactcgggagtttgagacccgcctgggcagtttagtgaaacctcatcactacagataataataataataattatctgggtgtggtgacacacgcctatagtttcagctactctggaggctgaggtgggcggatagattgaacccaggatatctaggctgcagtgatctgtgatcatgccactgcactccagcctgggtgacagagaccctctcttaacaaaataaaaaatacaaaaaggagaaagtcatcaaacaaaatgatgtgacttagtctggtaatattcgtcaagaagtcaagatttatgctctcttacaattctgactttcacattgaattaaattaagggtgtcttggcttgtttagtgtagtttagtaaaatacagtcatttgttttccacagctattatattattctccattaaaaaaagaagaagaagaagaaatgagaaaaaaaaatcagtccctagctagaaattttaagagtcaataacatttgggaaatgaaaatatattctgaagtagtataatcatacccaaatttttagactctgtactcaatctataagatgtatgtgagcaaaatattattagaagcaacatgaatgataatcacgcactacaagcgcacgaataatgtttccctgaaaggtacaataaaaaattattcaatgtgaaacaaaacgttgactgcaacaattattaaaatttgactattgaattgtcagtatactcaattatgaagacatttggaaaatataaatgagcactactgtttttgctcattttttaaaaatgaaaatttttggtaatgtctgacctgaaggcagatattcattataatagtcaaatatcataaatacatttcaaatgttatgtattctacataaattactcaggagaggaacatgtaggctcataaacttgcacacaagtaaaggaatgtttcttaggaaaaaattctgtgttaaagatattccacaccaatgtctcaggaaaaggcatttgtagtatactgctccattacctatgcttcataaaaaatgcagctatctaatttaatttagctctgaacagatttcttagcagcataatttatgttttgagaatatctcttaagaatcatagcttgcaatctatggtgcttcaatgaagaataatctgtaaacaaaatctccatctatcaacaaaggccattaaagaccataaaataacccatccttgactgattaatgctgctactgaaagggatttcaggctattaacatccagaaaatatactgccactgtggttgcatttattataaatcacatagttatatgtactggtgtaaagcaatgttttcttaaccacctccctctcccaaattaatttaataacaaagatactttgaagaacactaaatatctatagaaagtaaatgattctatttttttccctagaggaaatgtatgtgaaggcagggctatttataatacattagatagctaaatattggtttaacactttatatgcagttcaattatgttcatatatttatgtcattaaaatagtttctctaatgtaaaataaaacattaaattcatttgtatttcttgatacttttattaacaatactgatggtttttcatgggtaaaatagccatcaaaaattgttagttgttacctttaggttcatcctattctgtcaatttgattgtcactaactcttcctcttaggggatgtgaatatagctgttgagctcatactcttggaaggtaaagaggctttgtttactggtgcagatctcgattttttcaaatatagtatttcacctcagaaatactatctattagctcttatgccttacaaaactactggcttggatttgtccaatggttttaacccttgatcttacctttaacatgcttggaatctcacaaatattttcttatattgtttagtacaaggcactgtctaaatagtttagccacattatctcattccatttacaccaatcccatgagataggtacgttttaaccattttataacataagcaaaactcaatttcaagaggttaactaatatttccaagatcacatagctagtttatggcagaggaggattcaaacacaggactgtgttgattcaaaaatctatagagttaaatgtgtacttgtccttccgtaatatctgaggctagacaaaacaatccctggcttttctctcctgctttctatgaatattctgtcttagactacttagtcattatatatttttgtcttttcagtagagttctgttttgctgtgctagttcttttgggtttctataataataaaaataataataaaaggagaatagaagaataagagtagatcagggagaagatattctgaagataagttggtttaaagagaatgagttaatggatcagcttttgtctctgaagtcaacaaatgacaaagaaatgaaaaaggtgtaccctggaacaatgcatctatctgctggtagtacttgagaaatacatacaaaattcatatttttattttcttttgtttcattttattgcttattttggtcagtgttatttgcttcttatactagtaacattcctccagcacagaacaacatatctttgcaaatatttcattaaatatataaatgtcttaaataccacaaatgaaagacatgagtaacacaatatagtccacaaaactcaaaaggaaataaacacagtttagcatttttttcttacaattgaaaagattttaataactgttgagtatttataattatctatgctaactcccattttcttgccaagttatgtgtctttaaacactatggagtccccttgcaaaatttaacagagaagcaaagatatgtatcagtaatattgatgtttttatttttttaaaaaaaacctccctgataatttaagtgaattggattagaataattaaaacagaaatgaaggacacagaagcacatattctcaatatcgtcacctctgattactttagaattctgttagcatgtgctgtaaaaatcctttttaaaataaatattcccactataagcttaagtttattcatatctagggagaattgttttgttcggataattagatcaacagctgactctttaagctgagataatggcccactagccaataggaatcacacatgttaaggagaacagaattcaaagagtctggtcccttttgcacagtgacagaacatatgaggcagctacatatctagagagacaagaagataaatataagagagcaaccaaatcaagatgtaattactctgcatttaatcaaggcaccttagggttagtccagaccttttatccaaaacagctctgtaaacagcctactaaaccagcatcatcagctttctgtatttctcatctgtctaagtcagtcttccttgtttcaccatattcctacttgttttgtcttcaacactttctgagagaatgaagaaaaatgacaaaaaacaaattgtatgattgtatgaatgattaatatctcctctttcatgttgttcctcttctattgttcaaagagtatagagtgaataaatacaaaaacaaacacaacactgaagttaataaataataaggtccatctcatttgttaaatttcgtttcttaaggtatatgtgtctttgaaccttctggttatttctacaaaatagttctagtggctttggcagagtggtagcataacacatcactttttaaacagagttgaataattgtataaccctaaaagtaaaagaggcaaacaataaaatgaaatgaacaaatgaaataaaatcagaaattctcagcttaacaaaaccacctttcttgtgagcacattttgtgcatagtgaaataagggacatatctctaaagctctgtacacatatatttattaaaataaattgaattaacaattggcactacacagagtggcatgaaaaggttcagtatcttaacctcagctattcactaagataaaaggatcaccaacataaaatcttttttctttgcattgttaaacttaaataagtgttttttctctaaataaaatgattaatttttaattatgtagataaattttggatctaggtggactggaggcataaatgacacttacttagagatataaccagcaaagtcaagatggcaactttacagaaaaacataatctaaaagtttgaaaaacaaactgcagaatatattgtgtgtggctctttttatattctaaactatgttataaaaattttgcctcgacttacttatataagaaaaataaaactggttgcagaaatataatttagtattatgtcttgtgtgacctaacaattgggtaacaattatactaaaatgggacataatttattaatttacacagtataaaacctattggaatagactttgtaagttccaagtaagtttcttatcgtacctggtcagatttactttgcaatgtccatcttaatatttatgtttttaatatttttaaaataaattttaaggcaatagcatgaatagatgaatacataagataataaatgaaactctagctctttataacttaaaagagggtaggataaagaggcatggcataattttacattttaacttcagtagatgacaatatttgggaaaactaaggaaatatggaaggttagacaaaaataccgattcagggctagaaacaatatttatattttacaatgcccattttagggaaacacggcattgctatgtttttaaagcacgctttagagagtgaaagagttcactttagaaagtacaatttagaaggacttcactttctaaagtatgccttagaaacacagcaatgctatgtttttctaaaatgaagagaaagaaactttatcactctcaaacagcaaggcttaaaatttgtagagaatgtgaatgaggaaaagaaagacaattgttcaggaagttcaataaatcatatttgctgagtcattgagttattaaattcagcaaatatgattcactttgtggcataagtaacagggaaacatgttccatcacaatttcaagatgaaatataaaaagcttcagtctctcttttgtctctctctcacacacacatacacacacacacacacacactcacacacatacacatatgcacaaggtaattgaggctagggaggtgaaagaaatgtagagtagggtctctgacaaatgtggtgaagggtctctgtgtacataatgattttttgaacaatctgaagacaattaagcaaattcagaataattttaacatttcagcagattaactggtattaaaaggggaaaagattggcagaagctttattctaatcatgcaccagaacaacaacaacaacaaaaacacacacaaaaaatcaaagtggcaaatggtttcattgattattgtgaactatccggcacccacgagaaaacaataatccaaatttgttagctcctcaaccttggatgagttttcatgagtattttataaattagtgctataatggcaggagacaacgaactcccagaccacttccaaatttaaaattatatagttttccattgaatagtttattattttcttaataaagataactgtttcttaataaaactaatgctatataaagacaaagtggataaaaaatcattagcaagagaattagtaaacaatgcatagcaacatacatgcatatgagcatatatatacacccatatatgcatatacactagacctatatgcacataattgtaattatatattagtataacaataaaaatcctaaaatatctcaaatgtggaaataaaaatgctgagccaacactagcctagagggctgagaggccagaagagattttgagtttcaccatctgttggatcattcaagcatttcacaacttcctgccagtatcaaatctccgctattttatttgttccaagaaattttaaaacaaatgagagaggtaaaagcagttgaaaatgctgaaagttttgttcactttaaggggttattgttgaggcaatattgctcattaaaggaattttaatggcttaaaaattaaagcttttcaaagtcaagtactttatccctttggaagttttagcaatttaaacttgaataattttcatgaccaaagtaactgcaaaactataattttatattacaattgtatttgtaccatctgacctaattattaaatgtttaaacataataaacactaatgaagtgctctgtcactacaaataagcttctggtcagggtgctattgtcattctactttcttcttgtagttttgttacttttctcgtgcttgtccacagaaattcccaccaagagtcaaagttccacttgcatactcctgtgtgtggaacaagggtttgggatcaaagagtctgccttttcattctgggctctgctacttattacctcttccttgaatctatatttttaatctagagtttctaatagttgtgatgaggatcagatgagatataaggcagaattgcatttgtcaaatggctaatatatgatatgtataagatatgctaagtactcagtaaatggtaattgtttttgctatttctgatttgggcttggattttaatttattttttattgaatgttggataggtatttacccattcacacaatgttgtctaaatgttcatcatactttctaaagttaagggataaagtacgctgaaaggtagctattacctaaaataataactatacctcaggcgagataatacatattatgaattgagaataaacacgcattaaataagtggtaaagcgatacaaattgagtttatacagtagaaaatagaagggggttatttctattggcagccataaggctagagtatgttgggcataattcttctttaccagatacaatgttttgtatagaagtatactcagtagattttttaattctgtgtttctggaactaaacagaaatgtgtggaaattgtagaattgggcaagaaatggaattagaagattcaagagttaatccaacggatgtgcatagattgaagaaataagtccaagaaaataataaatggattagaattttgcaatctctagtactcatagttttttaaaagcaatattaatcaatgaaatacatatatgtgcatccattctatgccaagaacatcacagttaccttggtacttgagacacggagacaaataagacactgtctatctctataaaaacatcatagactttcattctagtgagagagaaaaacacacataaactaggaatgacaaaataagacacatacaaataacaacgtgtgaagcatttcatatttacaaaataaacataaaatactgttcattttctgaaaaactttctccatttatcttgaaatatgtagtatttctgtcaaattttataatctattattaggtatagaaacataaatacagagataagtttttcaataataaaaatattcccagtggaaaatggcgatggatacttagtcttaatgtcagtggcatcacagggattggtacagacactggtgaactaaaaatatcacacggtttaaaggcagtggactatacttggaaattgttgctgtagacaacagcaggctcagcattaccaaattatctcatttttttgagtagaaataaattttgatattttaatgtgcaaagcctttaaaaatgtgttcaattcaaaaaagtggctaagaaaaaaattaaaaataaagtttaaaaaaccctcaaaactatatctgtgggtggaatcaacattcaggtttctgctgtttgatcctgaactcaaggacttataaaagggaggcatgaagaagagctctgcaaaaactatagaaaattggaagatacagaaagaacactgaagaaaaagctactgtccttagattttctatggaaaattaggtcaggtataaagaacatattcctaatcagatgaggaacttttaaatcagtgaaatcatagaactgcttctttggaggccttaatttttcatctgtttggggttatttaaatgaagccattgcaagtgtgtcctattttttcaaagtatattttgtggactccccaactgtaatcacaggatgtgcttgttaaaatgcagattcccagacacctttccagatacagaatcaaatatttttggttgggtacagaattctgatttttttaaaaaattaactctagttaactttgatacaaagtacatgttgagaattataccactggactcacagccaccaaagacacttgtttagttggcgactttgagacccagtcagacttatgagtacctcggaactggaacccaagagacgtatttataacaagtttaactaggtgacattaatgtgtcttcagctacatggaggctatattttattgcattatatattcttccttcttgttactaatttctttggatgcccgcttttacaataaaattaataatttagaagcttataacttctttgtaaaatggcatttctagcccaaatacttgtttaaattcagcataaaaaagaaaacctagttcataagtgatatgtcattaaggatcactgttgtttatcatgaatttcattgtatctttaaaaacatgacgtttttatttttattttttaatttttatttatttatttttttaagtagagactggatttcaccatgttggccagcctgtctcgaactcctgacctcagatgatccaccagccttggcctcccaaatgctgggattacaggcatgagccactgcacctggcctaaaaatatgactatttggtaaacatcaccagggtcctaagaatattgtgtagattatttccagtgggatggtagccattgagcaaccaactgatcaaattttaagatcttgtaagatcttgtaagatgtaaaatgtagcactttcgtaattacctaacttatttgtgaatctgcttttgaataatagtaaaattgtgttttcaaagccatcttactcagaagtaaattatgttaatatacaataaagagaacatacacttttactatatgtatatggaaaattactatatcataaggtcttctatacagctaaaatttttgtgacctgggtacctggacttcaattgagtgagaaaatgaaactaagaaagttacagcattgatgaatagcatagtatatactatattaacagtcattactatatattaaaaagtagcttaaaagaaaagaaaaggccaggcacggtggctcatgcctgtaattcgaggtgggaggatcacaaggtcaggagttcaagaccaacctggccaagatggtgaaaccccaactctaaaaatacaaaaaaaaaaaaaaaaaaaaattagtcaggcatagtggcgggcacctataatctcagctacttgggaggctgaggcagagaatttcttgaacccgggaggcagagatcgcactgagctgagatcgccactgcagtccatcctgggagacagagtgagactccatttcaaaaaaaaaaaaaaagaagaagagtaagagtaagaataggagaaagaggaggatatagaatggaataagagtcacagaatgagagtattcagcccaactgtaactttgttttcaagatatattagaagcctggggaattcttctataaattctacttcccatttagcatgttctaaagttcttctgtcatgtcagtataatatgagaagaggtaatgtattttgatacctcctgttttctatagacaaagtatgtagattaagtacatgagtatttgaggttcaaatgcacctattaaaatgacagtataagtatctatttaactggagcaataaacatacatatctttcctaaagtgatacttaggttattacaaatgccctattaggtttagttatcttcctcatttaaaacactttccacatacagatagtagtagactactaaccttatgctggaacatacattatgatgtaaaaccggggaaatatttcaggtaaactcattctcagcagtggtacatgattatgaagctgtgttttatcaacatgattgctgtgagcaccaaataagaacatgcaagtagcttggttagcataatgtatagcacagagtaagaatataacaaatgtgagttactaggattgtaaagattatcattattattgtttgaatagtaatctctgtatgtaaatagacatacatattctactaacagatttgtgttatctacttgagtgtgtgtatatatgcgtgtgtggctatgtgggcaccagtggagcaataatgagtttgctacatgttatatatttctagaatcactaattatgttgaaatattattacaaaagtatgtgccttaacaaactaataaatactttggtgtctaaataagctcaccatagagcaaaatatatgaagacacacagagatagctatatatagagacaacggcagcatgttattccatatggaaaaaaaaatttgtatctgcagataaaatggcactccaggaggatatcaaagcatcaaatggatgttttcattaaaagaaaatttgtacatgaatttttaaaatttcagttcatgatgttactcattagctctatttttaacaaaatgttcccttttgcatagagaaaggaaagtcaaacactgatcttcaatattaatagttaagaacctgaaaacatcttacattttattttataggtttaatctaacttaaaaaaaatgttaaataaaagacaatgaaattgaagacccctcctggagaaactagtgaggatactaatatagactctacctcctcaaaaacctaacttcaaagagattttaaagaagtcatcaattctctcacatggcagactgggataacatctgttaatagagacttaaaaaaagtaagtaatttaaggaagaagggttgataattcattgattgggataagagaggaaatggcaagagaaacaggtatggtttcataatgacattgagataagtctcaaaggctgaaggaagaatttaatataattattacatctagtgatactgatgagaaacacatcctttctccctcagttttctttttgtgcgtaatcttgtaacagattgttcatgttttcagtaaatactgggagtgaggaatggtggaatgcagagatgttaagcagagggatttggtcccaccaaaggtactctaaattaaataagatgtgctcactttgcaaaagtgacttcaagataagtgcctagcttccaccattactgctatactccacttctaacaaaattatcatctttaattttctagactgccgcactagaaccatcatagtgtggaccaaatttacactatttttctacttcctatttctattcttctaaagttcttaatctgtgttctaaatctgggactgggcttctaagagtaggttcactgattgtgttatccaagacaggggttggcaaattatagctcaccggacaaatccaacccacacctgatttttgtaaggctgaaagggtaagaatggttttgacatttttaaacagttggggaaaaaatcaaaaaaacagatatttcttaacatgggaaaattatataaaatttaaatgtccacaatcttgttccccttttaaagatatattgttgattattttaacactacaacaaccagagttaaatcgttgcagcagagatgacgcggcccacaaaagccctaaagatttactttgttctttacagaaaaagtttgctgacccccaactcaataacttattttatataaacataaatttttcaggaaaataatactgtgaacccataatatgattgtagcataatgggaaaattaggcaaagattgataaaataccaatcttattattatacagtcacatatcatataggaaaaatctgatacaatggatttaatatatcagatgggaatttgagataaaaaagattctaatatttctagtcttataaatgaaactgagcctaaatgaagctttcaggggaaatgatcatgtaagacaaattacaggggttggtttctaaaaccgattctttttactctttactgaaggtcaaggatactgaatgtgccagtgcaccttcagaaagcagcctgcatcagcacatttaaaccactgaatggtctcaccacctagtttcttgcgaaagctgagcaatacattttgtgatagataccactgagaaagttaggcagaaattgttattagtagtatatgacaatcataatagtctaacttttactgtaaaactctattatttatatgttttctgtacatcctgtaggattgtctgtattttgcaatagaattgcaatgtgtaagagaaaaagaggcagtctatgtttccattgtcattctaagggacatattatccatacaacacctcctttttcccctttactgaaaagctgtgtataaaacactctaccatgctttcctgaaacataaaagaagatttattactattttaataaagaagtaagaacaaaaatatccaatctcctaatattcaatggagaagaatatatattcttttttaggaggacacaaaaatagcaagcttaagtatattctgttccctaaggtactgtgtaggtggagaaaattatttttcatttaaaattatatacttgtagttcattttaagtaagcccagtggacataaagctgattcattcacaaatgcaaaattttgttgtaattatttgcttaaccaaagcaatattcatcaaaaatggattaatgctaggattattttatttcaagtaaatgaacatatattgattagtgaccttccaaaccccatgctagcaacagtaattactattattaataaaatacatcctctagtgcatattaaatggttcaatttattaaatatgctgatctctgcatacctcctcaagattattttttaagaaaagtttactttgcctgagaaagaaaagatgaaatatgcaaacactaagtttactaaaaccaccaaatacaagctgccttggagtcccgttgttctgaattgtcttaccctcttaaaatcagatgttttaagcagataactcaatttttcatacaatataaaatgtccaaaatccgtgtaattctctgcctctgaatacatagtctctatctatttttctcattgttttaatctaaaaggaacattatgttttctctttttaaaagtaccctccttcagcattgtttttacttctaaactccttagattttctcctcaaatcccatttttctccgcacaatctcatcctcctttagctagaatcactcactggtgattaaacagagtcacgcagaaaataatgaatgcaaaaatgtgggcaggaagaaagataagggaagaaatattcttcaggaaagaaaatgaaacggtatttgtcagcgatgttgtaaaggggaagaaacattagagaaagggtgattggttgatagtgtcaaacgctgtaaagaaaggaaagaagaggtattttttaaattagcaaagtggagaatcatttttaaactttgagttagagttattactgaggaatgagaatttaagtttcctttgtggttttctgtgcttactaaatcaccagctcttcttataaggtgagtgatatatagtaagaatgagagtctgtggggaaggctggtgaacatactttgatgaaaaaatggactgtaaaggagtaccatccctgtcataggaagagatattttagtgtctgaatctgtgagggggtgtgtggaggtcaatgttgatgctctatgtatctaccggaggaaatttatgtgtgtgtgtgtgtttatctattgtaaggggaagccgtgagatatcagacttccctggcttttcctatctctgataagaaacactgtagttctagggaagctgagcgctggaaaggaccttgactttgataaatacaataattggtgacaagatttaaattttgttttccatgagttctggtgatagggcattctggcttgttttatgtcatttgtcctaatcctcttaacctcttaacctattctacaaaccactttaaatatttcttctcattattccaaacccttgctgtcaaacatcattgtaacctgtgtgtatatatatatataatatatataatatataatatatataattatatataatatatataatatatattatataattatatatatactatataatatatattatatataatatatattatataatatatattttctatatattatatataatatatattatataattatatatatattatatataattatattatatatatatttttcccactacagtgggaaaaaccattaatccagtggctatttcctgtacactatctctcgtgtctgtgagctcctttctgtttctattgccatcagtgtctttcacaacctcctctttctttatgatgtgtttcaaagcagattctttattttcattctcccaagacctgctgcaccttgcctactaatgtcagatacgttttcttcaaatgtcacacttcaggttagttatttgattgaatgcctatgtgattcccactacttccatataaagtccaatccaatcaacttaattattcacagttttgttcaattgattttactttccctgcctgactttccatttgtctattcaaggtagactagtttccaccattgcgctgacttcttgccctgaaatcactacttacagccttactcatcaaagcaaacgacatcaattaatgaagtaaaactcttgtcctaggctgtctattggtcttctctgatcctttggcggcagaagctctgcatacatccatcttgcctagacagtgttatgcaaattaacacaaccaaaaacaaaagtcaaattgtggttccttttatatattttataagtactattattaataatgaaaagacttttttttaaaatttgactaacttttttacataatactatctacttcataacatgaaaggattaagtggatttttataaataatgtgcatagaaccatgctgagaaaaatatgaatgttctaacattggtactgattgttattgttatttttactgctaattcttaattagtagagacaaatgttgactgaactatttctttggcgagaaataaataatgccatattttgggctcttcaagccgagtctcttctggcttggaacactaaactatataaattgacccttattatttaaaatgtaaaccacattaaaaattcattttcttaatcaagatgaagctaagatatttggtttccaaaccattaaaatttttatgagcaattctctgtaaaagcatttacctctggtatagtcgactactagttatgtactaataactattactaggatccattagctactcgctttgatctgtgttgtcatgaacaggaagatttggaaactgttgatggtttatacattgactatacaaaatactatattttaaaatgaaatcatatgaaattaatttatcaagattaactgtagtgattacaaggaaagaacagagagtacatgtttgatacattaaaaaatcttttcaaaaaccaaagaaaatcatgggtttagattataaagtcataaggtgataaggcaacttttgctcatgcggaaatatgttaattagttttataatattgtttctccatcgaagtacttatacacgtgtttggctacttaaaatagggtaaagaaataaataaataaattataatgctctaaatgaaatttggcatataccatctctcaaatttgcagtttatagtgcaggaacaaaaaagaaaagggaagtgtgatgaaaatatttagaaccacttgtctagagtttaaaagaattagtagcaaaaatattacaaaatataaaactactgattgccttgaatttgttacctgatcccaagttatgaacattaaaagtgtcataaagaaacaaagtcagacacttgttaaaaatagcaagacagatcttagtaagatactgcagtagggaagagagacttcagtggaaactgggttcagctctgatgaaacaaaaggcagaaggctgtttaaatgctggaatatgctaaagtaggggttcccaatccctgggccatggaccagtatgggtctgtggcccgttaggaactgggctgcatagcaggaggcgaatggtgagtgagcaagtctaagtaacactttgtatttacagtggctccccatcactggcattattgcctgagctctacctcctgtcagataagccacagtattagattctcatagtagtgcaaaccttattgtgaactgtgcatatgaggggtctaggttgcgtgctcctaatgagaatctaatgcctggtgatctgtcaatgttcccatcacccaggtgggattgtctagttgcaggaaaacaagctcaggactcccattgattctacattatggtgagttatataattatttcattacatattacaatgtgataataaagtacacaatacacgtaatgcacttgaattgtcctaaaatcatccccccaccccactgggtccgtagaaaaattgtcttcagtgaaactggtccctggtgccaaaaagactggggaccactgtgctaaagcaaaagtaccaaagcactttgaggtggatgcttaatgtgattagcccagttgtgtttgctaactggcacttacagaaataaagtccctactttaccacagagactgggaaatagaggccctatctttctcaatggttacatttcaaaaggaggtctcccaggtccttgagaaagacattcctgagttgcagatacatttcacaacgacaaggaaaggactacaagtttcctaatgtaaattctctaagaaaagggaagtctgggacccatagccaatgatatggtttggttctgtgtccccacccaaatctcatcttgtagcttccataattcccatgtgttgtgggagggacccagtgggagatgactgagttatgagggggagacttttcctgctgttctcatgatggtgaatgggtctcctgagatctgatggttttaaaaatgggagtttgcctgcacaagctctctctttgcctgctgccatccatgtaagatgtcacttgctcctccttgccttccaccatgattgtgaggcttccccagccacatggaactgcgagttctctattaaacttttttcctttgtaaattgctcagtctcaggtatgtctttatcagcagcttgaaaacagactaatacagtaaattggtaccagtagagtgaagctttgctgaaaagatacctgaaaatgtggaaacaactttggaactggctaacaggcagaggttggaacagtttagagggctcagaagaagagaggaaaatgtaggaaattttggaactccctagagacttgttgaatagctttgacaaaaatgctgatagtgatatgaacaataacatccaggctgaggtggtctcagttggagatgaggaacttgttggaaactggagcaaaggtgacttctgttatgttttagcaaagagactggcagcattttgcccctgccttagagatttgtggaactttgaacttgagagagatgatttagggatatgtggcaaaataaatttctaagcagcaaagcatttaagaggtgatttgggtgctgttaaaggcattcagctttacaaaggaggcagaacatgaatattcagaaattttgcagcctaatgatgtgatagaaaagaaaatcccattttctgagaagaaattcaagcgggcggcagaaatttgcagtagtaacaaggaacacaataggggaaatgtctccagggcctgtcagaggtcttcacagcaggcccttataccacaggcctggaagactaggagaaaatggtttcatgggcagggctcaaagtccccctgctgtgtgcagccagggacctgatgccctgcttccaagccactccagccatgggtgaaaggggccaatttagagcttgagctgtggcttcagagggtgcaggccctgagccttggcagtttccacgtggtgttgagcctgcaagtgtacagaagtcaagaattgagttttgggaacctctgcctagatttcagaaaatatatggaaatgcctggatgtccaggcagaagtttgctgcaggggcctggccctcatggagaacctctcctagggcagtgcagaagggaaatgtggggttgaagtccctacacagagtccctattggggcactgcctagtagagctgtgagaaaagggccactgtcctccagaccccagaatggtagatccactgacagcttgcacagttcacctggaaaagctgcagacactcaataccagcccatgaaagcagctgggaatgagactgtagcctgcaaagccacagggatggagcttcccaagaccatgggaactcacctcttccatcagtgtgacctggatgtgagacatggatttaaaggagatgattttggagctttaaggtttgactgccccctggatttccaacttacatggggcctgtagcccctttgcttcggcaaatttctcccatttggaatggctgtattttcccaacgactgtatctgcattgtatctaggaagtaagtaacttgcttttgattttacaggctcataggcagaaggcccttgccttgtctaggataagactctggactgtggacttttgagttaatgctgaaatgagactctgggggactctcgggaaggcatatttggttttgaaatgtggaaatatgagatttgggaagtggaatggtatgatttggctgtgtccccacccaaatctcatcttgaagctcccatagttcccacgtgttttgggagggagctggtgggagatgattgaatcatgggggcagatctttcccgtactgttctcatgatagtgaatgggtctcacgagatctgatggttttaaaaatggaagtttgcctgcacaaactctctctttgcctgctgccatccacataagatgtgacgtgctcctccttgccttccaccacaattatgagacttcctcagccatgtggaactgtgagttttccattaaacttctttcgtttgttaattgtccagtcttgggtatgtctttatcagcagtgtgaaaatggactaatacagccaggttttggcagaaacaaacattaacttattttagcaatgttgatgtttgtcaggtagacatttaagtgggctgggattgttaacctgggacacagccttgaactgttaaaaagctgtgctagaatttgttcaagtctcttagtgtgggacatgcacaaaatcatttatgctgagaatctgcagttctcacaggccaaggttaagtcccagtcaataaaaatgctcggaggagcctgactaaagtctggtcaaggagagagtctttgccataagaaacttaataataactaatatctctaggctactatttgtcatgcaatgagctagtatttgcagctttttcttatttaattctcatatttcctcttgaggaatatactaggattactgcctttatttgaaatgtgtaacaggctaagtaattttttcatgaattaatgctgtcctcatttatttaaactgtattttcataagttagcactagatacaggaaccaagggaacaggtgtagaagtcccaagaaactgaatgtgtgggcaaagcaaagaatggctaaacacacaacatccactgagttaccatgcacgagaagaagcaggaagatgtaggtcccctgttggccttatattcttcccacataaattatagattaacatatttcctgattttttgaagtttccagagatttaccaacttgatctttcatgtgactttctcttattctggattttcagtgacttttcctctcactttattgtctctaaaatcacagaaaccctgtttaccacaattattttcttaaatttatttctacaggtctttagttaaaaggtacagggaagcagacaaaccttaaacttgataatacgtgggaaataatgttactggtatcttagaagtcatgccagtaattcgtctaaatttaagcatcaattgaaatacggatgcaaaattattatacgtgattaattactttaggtctttcatcagtttatggtagagtaaccaaattgcccttgatgcctctcatgtgtcaagtattgttttgggtgcaaaggatagatcaataatatgacatggttcttgagtcagtttggttatgactggagttggtgagaatgttagactcacattcatgagtggatttgataaatacaatgtggctgacatgatgtctgctctcaccaagacttccatttcagttctttgatttctcctttgctttcgttaggaatggcctatatttggtacaccaaaaatttacactaattagtgagcacttctcctactttaaaagagaagctcaaacaggaaagaatacacacacacacacaatttttttggtatgagattcaaaattcctagaaagcttatgacaaaattatcaaatttgttgaattctcaaaattgctaaatttctgaataatgttcatctagctacagtacttattattccaccggaagaaagcatatgcttcaacacaaaaaaaaaatttgagtgcaaaactattaagtaaaactctgagaaaacatcatttttgtacttggcaataaggcaattacttaaaaaaagttagctaatatttgtgagtgttacatttaattaaacattaaagaactttatagaagtatttttaaaaaggaagaaaggaagaaatgtaataacccagaattcaagagaagataagcaaaatgttatttgacagaatccagaagcacatgaaaaagttaattcaccatgatcaagaaggctatattcctgggaagcaaagttggttcaacatacgcaaatcaataaatttgattcacctcatacacaaaacaaaactgaataaccatatcattatttcaacagactcagataaatcttttcataaaattcgacatctctttatgataaaaacctacaacaaactaggcattaaacatacctcaaaatgataggaaccatgtgtgacaaacctagagcaaaatcatactgaatggacaaaatctggaagcataccccttgggaactggagcaagacaataatgcccactttcaccattcctattcaacatagtactggaagtcctagacagagcaatcaggcaaaagaaaaaaatacaaggcatctaaataggaaaaaaggcagtcaaattaactctctttggtgctgatataattctgtacctagaaaactgtaaagactctttgaaaaggcccctagaattgattagcaactgcagtaaagtttcaggatccaaaatccacatacaaaaatcagtagcatttctatacaccaataatgttcaagttgggagccaaattaagatcaaaaacccatttacaatagccacaaaaaaaattaagtaggaatgcatccaacaaaggagatgaaagatttctagaaggagaattacaaaatactgctgaatgaaatcatagatgaaacaaatgggaaaatgttccatgctcatgaactggatctaccgactacgtttttcccagaactagaagaaagtcttctaaaattcatatggaactagaaaagagcttgaatagctaaagcaatactaagtgaagagaagaaagctggaggcatcacattacctgttttcaaattgtatataaggctactttaactaaaacagcatggtattgtcacaaaaacaaacacatagaacaatgaaacagaatagaaaacagaaataaggctgcttacttacaaccatttgatcttcaacagactcgacaaaaattagcaatggagaaaggactttctattcaataaatggtgctagtttaactggctagccatatgcagaagaatgaaactgcacccttgcctttcatcgcaggcaaaaattgtcttaagatgaatataagacctaaaactataaaagtgctagaagaaaacctaggacatggcattctggacatcagccttggctaagaatttatgagtaagtcctcaaaagtaattgcaaaaacaaaaattacaaaaaataaaaattgacagttgggaccctaaagagcttctgtacctcaaaataaactatcaacagagtaaacagataacctatggaatggaaggaaatattcataaattatgcaacttacagaagtctaatatccggagcctctaaggaacttaaacaattcaaaagtgaaaaaacaaataagctcattgaaaagtgagcagaggacatgaagagacagttctcaaaggaagacttacaagcagccaacaaacaaatgacaaaccctctacatcactaagtatcagagaaatacaaatcaaagcaaatatgagatactgtctcacaccaatcggaatgctattattaaaaagtcaaaaaataacagatgttgatgatatactttgaatatatgtccctacaatatctcatgtaaaattgtaatccccgatgttggaggtgggacctgcttggaggtgtgtttgggttatggaggctgattcctcatggcttggtgctgtcctcatgacagtgagtgagttctcatgagatctgatcatttatcatttaaaatgtgtggcacttccccacctctctcttgcttccactctgccacgtgagagccttgctccagctttacctttcacctgaggcctccctagaagctgagtagatgctggtgctgtgcttcctgtacagcctgcagaacaattagccaattcaatctcttttttaaaaaaattacccaatgtcaggtatttatttatagtaatacaagaacagcctaacacagttgctgaggctgtggagaaaagggaatggttatacactctaggtttgaatgtaaattagttcagcctctgtggaaagcagtttggagatttcccaaagaactcagaactaccgttagacccagcatttacgtgactagggatacacactaaggaaaataaatcatcctacaaaaaagggacacattactttgtgtgttccatcatagcactatgcacaaaagccaagtgtattagtctgttttcacactgctataaagtactgcctgagactgggtaatttataaatgaaaaaggtttaattaactcacaattcagcatagctggggaggcttcaggaaacttacaattatggtagaagacaaatgggaagcgaggcacctttttcataaggaggcaggaaggagaatgaactcaggaggaaccaccatacacttataaaaccatcaggtctcatgagaactcacacacttcgcgagaacagcataggggaaaccgcccccgtgattcaactaccttcacctggtctctcccttgacacgtggggattaaaaggattacaattcaaaatgagattttggatggggacacagccaaaccttatcatcaagacatggaatcaacctaagtgtccatagattggataaagaaaatgtagtacatatacaccatggaatactacacagccataaaacaagaatgaaatcatgtcccttacagcaacatggatgcagctggagaccattatcctaagaaaattaacacaggaagagaaaaaccaaatactacatgttctcacttataagtgggagttaattattgggtacacatggacataaatatgggaacactagcactgggaactactacagagggaagagtaggagtgggtcaaggtctgaaaaaatacctgctaggtactatgctcactatctaagtgatgggatcaatcataccccaaaactcagtgtcacacaatataccatgcacatgtgccccctgaatctaaaataacagttgaaagcataaaacataaaataaaataaatcttcgattggcatgataaatgttaaaaattaaacatcaagggaaactgtgtgagaaacatatggggatactctgtattaccttggcaacatttcagcaaatttaaatttatttcaaaataaaaattcatattaaaattacccctgctaaaattttaattaacaatatttataactttaaaaaggaaattaaatgtgtttcaagaataaggggacactgacatcctccttcttccattctgaagaagatcataaaacataagcacctgcacctgccccaagactggatcaaaaggtgaacacacagatctattaatcactcatctaaaattctcaaacgctaagatattccatagactctaaagtcagacctgaatactacctcaaaggacttgaacaagaagttccaagaaaaaaatagcaacagtagttttaggaggaaatgtgcataattaataggtcaacaaggataggtaagagacagatagcctgaattcccactaatgggaatattaaaaagaaacaatgaaagaaaagtatatacttacctgtacaaatgaaattgtaaactaaagagaattccagtttagcagattaaagctgaagtcttgactcaaatttccatttggtctaaaaccataatggaatacggagactgaaaaaaagcccaagtaaatgagacacatttctgtggaaggagttaaatgattttatttttttcaacagagtaacctgaagaagggagcctgcataatcctgaaggtcagggagcaaattaaagagtaaaggggcatccactggagattttcttctgaatgccttgggttttaagcatatccttttgtgagatgcaagggatgttgggttgtaggcagagctagaaatctttcccttcttattttctagttcttttcagaagttgccctaatcatttagaaaggagatttgcatgaacctgaaagttgcagagtttgctttgtaaagaataagaaacactagtgtcaaagatcaaataaagaaggctggttgctttacccgttattcaggcagagaaggaaaatagtgaactgtgtggaccatgtctaggttcaaggaggagacaggtgaaagcccagagtacctaacagtggagaatttctggacactggaggaaaaaaggtttgatgtgaagaagattcaaaaagtaaaatgaaaaagaaacagtgtaaatatgtcctccccacacaaacactggctcactgagggaaatgggagtcttcgtaatctccaaggtttcagaaaatataaagtatctacctgtaaatcaattacgccccaacccaatgctaatgaatgtactttctatggagagatctctctgcaataaccatggagaactgaaaaactaaacctaaatcataagaagagtttaggcacatattaggagtgttttagagaaaatgtcttctgacagcatggttgtacacaaatcagccagaacttttcatgaccccatgcattagctgatatgccaagatgcccatgcaccagccatgaatctccttctggccactggagccaatccttatcttcataaataccttccattactttcaggtttcttgtgtccatagccaaatgactgaattaaactctgaaaaacttgtattaggagcaaccttgattcttaccaaaaacaatactgcatttcaagaagatgaaactttttatatggtaaattataaaatcttgcactgctttctatacttgtatcaggagcacccttgattcttaccaaaaacaatactgcatttcaagaggatgaaactttttataaggtaaattataaaatattgcactgctttctatacttataaatattttgcatatgtcattatagcaaataacaatttttagaaataattaaagtctcaaagtgttcctttcttgaagtcagcagcagttacaatttgttgtaactagaaaaactgaataatattttattcattttaattattggaggtcatataagtctctggacttactgtattttatctaaaacatgtattttcattttggaaatggagaattatttctttattaatctaagcatgtctatgcttttagaatatgaggcaggctctgcaattttcttacaagacgctaaaggaatggaaagcaaaatcaacaaaaggaaaagagactgagaaaaaaattatacatattgtttataagtttggtgataacaagagttacttttaaagatgcttgcgcgtatacactatcttccaactgtttcagatgtaaatatattaaaacaagcattttaacctcagataaataaaaaagacacatagttaggcatcttcacaattataaactgctgcttattcttatccatgctcctaaaatgccttataatatctgctgtcactgccttggattataagcccaaaacagaattttctttttttaatagataatattataaaggtgattttctaagtgtacacggcctctttaggaagatagcagtaaggctcagatgtatgatttatagagcagagcttttaagccataaactcatcattgatgtcttacagccagatttaattaccttcctgaattttgattattttttccttgctttaaacagatcacacataaaagtatgcctacgtgatatatagtttttcttgtttttgaaatgtatacaaatagtctcctataaataaataaataaataaataaataaataatttattcattcctggacttgctttcttgactcagtcaagtcaaagctaaaatgaaagcaattattttagagacctatgtaaaatacatgcttatttagctgagatttgcttcaaaaactcgagtaaaacaaagagctccatgtaaaaatggtgacattcgtgtttaattttccttaattcatctcatatatgtatatatatatatgcacacacataatttcatacactgtgtaattttacaatctgtactgtcaccaaaatttacctattttatcttgtattctaccagagttctattacatggaaattgtgaagttcacagtaatataactactctaagttgttaatcacatataatacattaagcattgtgttgggtaattggcattcttttatctcttttaatttaatgaaaattgtattagttaggataggcaataatgtgttatggtaacaaatataaaacatcagaagcctaaaataagaaaaattatatattgttattcactctcaatgtccaaattgttctgctattatactcactcaaggatgtaggttgacagagctaataatgacacactcaaaagagggaagaaaaacatcataaatgatacactggatcttatatttatcattcagaggtgacctccacgagttcacttttaatcacaaatattatggtcatatatcacttgaaaaacaaaaacacagaagtataatcctgtcatgtgtctgcaaagaaaacgagaaatatttggtaacaggaataatgactaacctctctcaaaaaaaaattacaagacagccactatcatcatttgtgaagtaaagaaacagaagctcaaaaaagtaagtaacgttaataattgacatgaagtcattaatccagtaatactaaaaactgaatactaatccatttctaaaacctttattttttcctagtattaatattttaattggaacttaaaggtaaaacattagactaatcatcaacagtttatgatgcaccatcaccattagcaaataaatggcgcttttcttaatggtatttatttgtacagtgcaatgaatattaaaaatttgcttaaaccaagaattagagtattaccaactatattcatctgcatgtctctattctcccattcccctgtctctttaccctcagagataatcactttcccataggccagacaagagccaatcttgtaagcagatgtttctaagtgcagcagtctcaggtctcttttctgcatactgtaaaactaaattgtatttaatttgcatatatcacattttccttcctaatatgaatttataaatgtcatgaatgatgttgacaaaccatgaaacaatttcatataaatacattttctagaagccacatataatagcaaatgaagtggatttaagattttaggttaggtctctgaaatgtacaaacagaaagaaggggaaagagcagaattgaaagaagaacatgggcaggaggtcacgtcaccagcatagcattcccagtcagctttctagagctaatgactgatatgacagaagaggcaaacaatcccaaatctataaaatataacattgttaaattctttatttttataacttataaataagaacattaatttccaatataccattgccctattattttccagtactagaaaacacaacaaaattttcaaatgatttacacaacgtcatatcaaggcaaactatagccatattgagacatactcatgatgtaatataagtaaacaagatgtcagtaagttgtgattctcccaagtatataaaagcctttcaaacttttatggcatagcgtaccttctttccttttttgagctaaaattttctactctgtatcactatatctattcctctgtctgtcctactcctagtcaagactcaactaagaatcaatcttcaaaaaaaaaaaaaaaacaattcagggaggctagctgaagaatgatttagttacctattttgagctcccatcatcttcttggaacactattttgatagatatatgagttttcttgtcagtatccctcactatgctgtaaaatctataagagaggtgttagttttctatcactatggtaacaatcaccacagacttaaaataacactaatttgttaccttatagttctgtgagtcatcagtctcattagcctaaaatcgaggtgtggacaggactatatcccttctgtaggtcaaaaggaaaatccatttatttgtctgctccggcttctggagacagccctgttccttgactcatggttcttcttcaattttatcagttaataacagttaattgagtaccactcacaacacgcacttattccatagtcacatttccctcagactttgagcttatctgctttactctttcattttcaaggactctaattattgtattgagctttcctgtatattccaaaataatcttttcaggtcagctgactggtgaattttatcttcaataaattctcatttgctatgtaatgtaacatatttgcgagttccagaaattaggacatagaaataattggggagttattattctgtttatcccaaggggcataaaaattatccagtgtttttaatgagctcaataaatatggtatttatcaatctgaaacaatcaagtttcagaacatgtctgaatctatttggtactgtggacagcatgagcaatattaaatgttagaacatctgaaacagatgaagaccttttatgtggacaatactcagatctacttgactaattagtacagtctcttaaaataattcctttagattaattccttcagataacagatgaggaaattgtatcccagacagacaccgtgattttctctatgtccttcatggaaacagggagactccccctccaccctgtgtcacattttgtaactcgcacaacataaaagatctgcttgaaccctgatgactgatggtctcatgaaaaaaaagatctttattttcagctttttgtaactatgtattttagacatatacattatgagactggattggggtaccaatctcagagagaaagtatgtattttacctttacatttttttatttgattacaatctagtaaacaagttaaagaaagaaacccatggcctcccaaataattgacagacatttacaattaagattattctttcaaaattcaagttttgaatttgaggtaagaaatatcccttcagaaatctcccacatttttgctgtatctacagtatatctcattatactcagttaagtcattcagtaataactaaaatcctaaagtacttcgccaaaaatttaaccagataaaaacaattttaaaaagtagctaatgaatttaagatagtgcctggcttccattttttacacttgtcaactagcctatcttttattatttaatttttatttatttctcaaagaactaaagtagatctaccatttgatccagcaattccactactaggtatctactcaaagaaaaagaaatcattatataaaaaagacacatacacatgcgcatttatttgcaacacaattcacgactgcaaagatatggaatcaatctaagtgtccaccaaccaatgagcggataaagaaaacatggtatatagacaccacggaacaccgctcagctataaaaaataacgaaattatgtttttttttgcagcaacttggatggaactggaggccattattctaagtgaagtaagtcaggaatataaaactaaatacttcaagttctcacttgtaagtggaagctaaactatgggtacacaatgatatacagagtgatataataaacaatatcctaccttaacaagccactgtccctttaattttatctcctgtatcccgtaaaaaggacgtaaaattcacaggtgagtactattcttaatgtctccaaaattaatagctgtgcttgatgttttcttatagaattgaaattccaaatatatgcttataaataaacgataaatccaaatttgttacattgtacacatgttgccactttgaaagttaatattattttcaacttccaaagtttgtaataatattttaagagattcagacaaacatgacctcagaagaatctatgaggaggcatacatattctttagccctagatatataaaatcttatttggtcagagagttaagagttataaagtatttcttggagccgagtctaaatttcttcattttgttacattaaaaggcaaaaaaaaaggtctcagaagtttaagtttttgagagaaaactacattctaaaattcatgtttgaggattatttctccataatttgacttaaaatggttattttaataaattaaatacaagatactaatgccaaatgataaggcaatagaacagttacatatttgacatcactacaaagatattcaatacattgagttgtttataatagtgaataaagtagccaaaaactaataaataggagtattcctctgagagtctggtaacatatactgtaaaatccgcaaaatgtatatgggaacaccaccaaaagaaacatgattaatgttgatgattctgaggttttcaaatagattcgtgtgtatctgcagccacccaaccacacattaaccctgtcacctgaaactatcactatttaacaaaaaagactaatgaaacaatgtactttcctgatatatggcactgaataaaatatacctagtgattatagatagatttttaaaagctggtcatggtggtgcatgcctgtagtccagctgatctggaggctgaggaaggaagatcacttgagcccaggaggtcaaagctgtagtgcatcacggtcatacctgtgaatagcactgcactccagcctggcaacatagcaagaccctgtctctaaataaataaataaaaaccagttagaaaacaaaatgagaaaattgagaaaaataatttatagttaatgttgcttccatctgaatgtgtaatttgataataaagttattttgcatatttaaacataatttctttaacaggaaaacagaaataaaatcagaaaaaatgtaaaaattggaaattttctgccttcctgataatttttttttttttagaaaatcagggcaaaacatttaggaatacttactattattgcaaaaatttaatatcatgggttcaaagacacttgagatatataagtatgtacctttaatacttttctatttgttaaatatagcttagtaaaataaatgaactaataaaattcctaaatgttttactgaacaatgatttttttccttgatgtttagatgaaataatataatacctacaaaaagatactaagtgatgtcaccctgcgtagcttgaataaggacatttactgaaacatttttatgaaaaataaacatatttgattacataatttatataccttttccctccagatgtttccttttttccttccttattcttgaaattacttataaatgacaggaattttatatgagttctaaaatcagaataagaggaagagtggaagaattagaaaaagaaaaaaaaaatgccagttgtgcacttcttcacgatgcctttttaagagtcttagtgacatattaaaaagtacaaacaggccaggctcagtggctcaagcctgtaaccccagcactttgggaggctgaggtaggtggatcacttgaggtcaggagttggagaccagcctggctgacatggtgaaatctcatctctactaaaaatacaaaaattagccgagcatggtgatgtgtgcctgtaatcccagctactcaggaggctgaggcaggagaataacttgaacccaggaggcggaggttgtggtaagccgagatggtgccactgcactccagcctgggcgatagagccatttctgtctcaacaaaatgaatataataaaaattaaaatttttttaaaagtacaaacataatttagaaataaagttttgtgtgtgtgtacgtgtaaataaagcttttctaagaacatcatcataaaacaattgcatttgttttcatgaagaatccaagaaatgcacaaaataatcacttctataaatgcttatcttgaccacaatcaccacttattcagttatcttgatcacaatcaccacttattcaggaacagataagagatacaaatttttaagatctagatccagtagttattgaattaactactttctttctcaaagttttcctacaactaaactgatgatctcccttctaaatgtagcccctttaggatgtttatattagtgaatggccctattctaccttattacataccacttttcctccctttattccacttccactccccatttgcaataaatcatacacaggtacacatatgcaaacaccacacacacacacacacacacacactgctgtgtgtatctgtgtgcatgcacatttttctttatctatttttcaatctcttcacttgtctctagctccacttccacctgcttaaactactattatctctccgttggactatattgctaactgtttatttcacctctgatgttagttttcttcagtctttacacaaatccactctcttcactatagcgagtgatctgttttagaataaattgaatcatgatgttactatttctgcccccttcccctgcccccactggtcctgttccagctttaaaaactttaatggtttcacttagaatgaagactaaaattattatcattggctaacaaaccttggtctctacatacctcctcagtttcatcagcatttgatttacattggcctttattcatattgctatagtctgaatattttaactccccccacccataattcatatgttaaaatataaccccccaacgtgatggtataaggaggtgggctctttgggagataattaggtcatgagaccacagcccttatgagtgggattaatgccttataagaggccccgagagctgtctgtgccttctgtcatgtgagagcacagagaaaagaccactgtcaatgaatcaggaagtaggccatcaccaaacatcaaatttgctagcacctcgaacttagatttaccagcctccagaactatgaacaataattttttgttccttataagcagtttaaagtgttatgtttatagcaactgtctatatcaatttatagtgctatgttatagcaacctaaatggactaagacaagacacttgatctcacctcgcttacttctggtcatggaggcttatatattattccctccatttagaataaactccttgccccattatctttcatagtatctagcagatagtagagaccttaaaaaatacgttgaaagactaaataattaaatgaactgtcaccaaaagcaatgaatatatcagcatattatatgtgcattatcagctatgcaatgaattacagaaaattctgtttctcttactaaagacattatgactattccataccccaaatgatctattaggtcagtttagaggttacagtttattttacattgttttttataccttatatagttattgaaaatttattgaatataaataaaaggacaaaagttttacatttggtaataaatgcccaaaatataatttatataaaaagtatcagtctttattaaaatgactttgacccaagtttattctttataaacgtctgttgtaactctccaatgtaaagaaggcaaattggtgataaaattagttttgttttattttttgggacagaatctcgctctctgtcccaggctggagtgcaatggcacagtcttggcttcctgaaacctccgcctcctgggctcaagcgattctcctgcctcagcctcccgagtagctgggattacaggtgcctgccagcacgcccagctaatttttttgtacttttagtagagatggggtttcaccatgttggccaggctggtctcaaactcctgacctcaggtaatctgcccaccttggcctcccaaagtgctgggattacaggtgtgagccaccacacccagccataaagtttgatgaacctactctgacatatgttttttcatttattttagaagagtctcctcaaatgactttttatattaaacctgttcaaaacgatttctaaacctcaactctgaaaggatgctcaccaaatacttaaatgcacttcagaagtgaaagcaaagatatgttttcttcctacttgcatataatgaaagttaataatagaatcttattgataagtataatttgctaatacattcaaacacatgtgttgtcaaagttggtatacatatagtactgtgaaaggagagtctattttgatattttcccaggatagattatcattttgccttttgtacacacttttctgttgctctcatatgaccttaattgtttaaaaagtgttacttttttaaaaaatacatacttttgttctctgttagagcaatatgtatttggtatagattcagaaaaatatttgatatagattcagaaaaatattccatttgaaatctgggcttttaaatcacataaacatataatactagatgggtttcagttattttcttttttttttttttggcttagctctggttcattttttttaaaattttattttattattattatactttaagttttagggtacatgtgcacaatgtgcaggttagttacatatgtatacatgtgccatgctggtgtgctgcacccattaactcgtcacttagcattaggtatatctcctaatgctaaccctcccccctccccccaccccacaacagtccccagagtgtgatgttccccttcctgtgtccatgtgttctcattgttcaattcccacctatgagtgagaacatgtggtgtttggttttttgtccttgcgaaagtttactgggaatgatgatttccaatttcatccatgtccctacaaaggacatgaactcatcatttttttatggctgcatagtattccacggtgtatatgtgccacattttcttaatcctaacatacttttatatagtcaacaaatagatgaatttttaaaaattaatgccttagaagatgtaaagcatattcagtaagctttgaaaataactgaaacccaaatgtcctacaatcatagactgggttccagttattttcaaagcttactgaatatgcttttcatcttctaaggcattaatttttaaaaattcatctatttgttgactgtataaaagtatgttaggaatctttaacttgcaacatgtcatattacaatatattcactcaaggtcaacaaagagtatttattcttagttgactccttctggtattaagaacatggttgaacattttctgttttcaaagtactttatcttaagcttccagttacttgtcttagcaattccatcattggccagtcattcattctattgaacgtctctaatgacgggataaggctagaaaaaaagattcagaataacagtttctttgcaaagatttttcataatgtatcttttaacattgtattatggtttcaatatttgcatctcactccaaaatttatgttgaaacttaaacatcaatgcaacaacattaagaggttgggcccttaggaggtgattatgtcatgagggctgtgcactctgtaccttatagaagggctgaagggaactaactaggcccttttgcccttctgctatgtgagaacacagcattcgtcttctccaaaggatgcggcaacaggcaccatctttgaaacagaggccaggtcctcaccagacaatgaacttaccagtgccttgatctttgacttccagcctccagaacagtgagaaatacattatgttatctataaattacccagtttctgtttttgttgtggcaggatgactagggcatgtaaatattggtattatactcagaaaactcttagatacaaaattttcagtaaatgaaagatgcatttcttgctattttaaaatttgtaggttggcatgtctgtgtatttttcctttatacctaggaatgaagcagttgatatgcaaaaattattgggatttttggaatttaaattagctagccggtggtagagagatgacaagagtttagcaactgctgagagagacagagagagagagagaaatggtaaatagaaaagtgagaatagaagagacttgaatgaaacctattacaagaaaatgaagaatggagatagaataacacccacacacgaatgaaaaatagtaaaagcatttataagaaggaatttaagaaaatagacaaaaagttgtaggagatagagaaaattaaaaaaaataaaagtacagataccaagtggttgctgagttcctattatttgccagatactttaataaaatgcaacagagaaaatcaaagacaagatggacagaaatttgtaagaagaattgtagcacacagaatgaagtatgtagaaagtattatgagtgttctaagaaagaagtggccaatatattgtgcaggtttgtgtatgtttgcatgtgtgtgtaaatgtttttagacaaagaaaacattaaggaatattgattaatgatgaagaaacattaaatatgctttaaattgaaaatattattataacatactaacatatatttatcatttcttatatgccagaaatatactacacaattttcttgcataacattagttaatcctaacagtaatctaatgagaaagttactattattcttgattatggatagagatcagagccttagagaccactcatcaaaaatcatacattaatattttcaggatttgaaaatgttttatctgatttctaagctcatgctcttaactactatgccttaaatatttattttatattcacacactacatgttttatcgcatgttaatcctctgtttctcttttctttgtttatatgaaactataagatttgaatcatagttcctcaaaactatttcattcttaaaatctttttgtaatctattgcaggtgacacagactattactacactcccactttcgcagtataaataacattctttcaactgcagcctggactcagtgtaaaacactgtattcagaatacaaaactcacgtaaatgaaaggctgactttcacagaaccaactgcaggacttgagtatatatggattttggtacctatggtaggtcctggaaccaagccccaaggatattgagggacaactgtatttttatccccagaacttagcacaaaactgtcatatggtaaatttaatgaatatattttggagaaatagacatataataatattttatcacaacttccatcattttcctaaagttccagggggcggggcccacatcattgtacttttgtgattcctacaccacttattactaaggtattaaaatacaatgattaagagtgtggcagcatgatagggattgtattggatcagtagggcagtattaacaatattgagtcttccagtctgtgaacataggatgtctttccacttgttttcattaatttctttcagaaattatttttaatttttaatgcactaatcatcagaggaatgctgatacaaatgcaaaaatgatatatcacctcatgcttactaggatgaccattataaaaaacaaagcaaaaacaaaagacaagtgttggcaaggatgtggagaaactggaactcctatacatgatgggaatacaatatggtgcagctgctatggaaaactgaaaaacaagttctttaataaactgaaaatagaactacaatatgatccatgaatcctacttctaggtattcatccaaaataactgaaatcaggatcttaaagaaatattagcactaccatgttactgcagcactattcacaacaaccaaggtgcggagacaacctaacttttcattgacagatgaatacataaagagaatgcagtatatacatacagtggaatagtattcagtcttaaagggcggaaagaaaatcctgcaatatttgacaacatggataaactttgaagacattatgctaaggaaaataagccagtcacagagaacaaatactgcatactgcatgataccaatcctacaaagtatctaaagtagtgaaactcacagaagcaaagaatagactggtgccaggggaaagaatagaatggtgccaggggttggagagtgggagaagtgagaatatgctaaacaacatgtgtagatatttagttatgaaagataaaaattctagaaacctgatgaataacattatggtataaagataacaaatacagtattgttaaaaactttaaaatatttttaaaaggtagaacctctacttgactcttcttgcaaaaataaaaaaaggatttggcagcatgagccaggtgcctgagccatctttatggctgttagatgtaggatttgtgtgaaattaagcaagatagcttgaaattttaaccttctgtttccacatctgaaaaacaggaataataataaaattcagcttgtgaaatttttgtaatgattaaatagattaaataagatagtatatacttgattgaccattgatttcttcttcctttgccagaaatctggctcaccccagaaaatgctatttttctgtagccctctcactagtggtgaatgtttttatcatattcttccacaactaggacctgagttgggataggtcctgtttcttactccttcttccctattaccactgccctcttgcttaaaaacaaacaaaacaaataaaaaacacttggtatcatatcatcaaactgcctatatttcctcttcctccattctctcttgagccctctccaaactcagtttccttttcaaggttaggaaagtttggaaagagtttcaattattctttaaatttccaatattttaattcaaactggtatttttgtcaaactatatttattacatattaattccaaggggttcctctgataatctaaagtaaaatgtattctaagaaagagaaaattagaaggaatgttgtccagtgaactattgacactgcacccaacccagtacatgaaatgtgtattcatcactgacaacttgtggaattcattaaacaggacagcagcagtgcctttctccagtcagtgtaaatgtagtttttgagaggaggacaccaaaaatgtgacatttgaagacagccatgatttgattatgtgttttcttgttgctttggattgttatctgtctctatccaacataaaacaaaatccgcaaagatgagattttcatctgttttgttgtctgctatatacacaacaggtagaacagggttgggcacctagtagccccttaaaaataaagctatgcaattttgtataaagctatgtaattttgtgtaacttaaatgtaataatacattattaagtgtgttatctataaaatacaatgtgtgtggatgaaggtatatggtataaatacagagaagagtatttctaaggtgtttggcacttacaaataccacaaacgctagttgttattagaaacctgatgttagcataacaggtattacataatgcttgctatacttgaatgaatgaatgaaaatactcagcataaagcattattaatatttgtttataatgatatatatttttttcctggggagatatcatcagaattgcattccatgaatccagcagatcatgtgtggacaaatctttgatacaaccacataaaatattgatgactgtgttaacaatgttcttttaaaacattatctaagtctaagccttaacagatctcatcagtattccaattgttcaatgaagaaacatattaaatgcaaactagctgaacagtcttcactgagcatttagcggggcagcccttaggggcagtataggatcttacaagagtagggaacattaacagcatgaactgggccactgatgtcaggaacagccactgcattatgatccactagcgttataaacaaatactcagaaaggcagctaataatccgacatgagcaaagaagagaggaaatacctgaagaaagcatgaattcatagtttgagttttctacaaatacttttctaaataatacacaatcatgggataaatactaatttgatctgtaataaattacatatatgaaatataacaaaaatactcaacataaagcgtaaagaattattaatatttgcttataatgctctaatttttcctggggagatatcatcagaattgcattccgtgaatccagaagaccatgtgtggacaaatcttgcatacaaccacataaaatattgatgactgtattaacaatgttctttttaaacattatctatgcctaagctgaagagctctcatcagtattccaatttttcaatgaagaacaatatatatgtaatctataattacacatatatgagagattcagttagtgataacccatgatgtgataaattacacatatacatgtgtgtgtatgtgtgtgtgtgagtaaatttttagagattcacttagtattttgtctacacatataatttacctagatttcttgttttcctaacaggatgcaaaaaaggtacactgtggggtgggtaatatctccttactaaatatttattgactgattttgtccccacgtcattgaccagtgtcatataaatcaaactctcattacctatttttgaattgttgtttgaactccagctactatcctcaaagctcaccaacttgcccttctagctgacgcattttatgtctcaatctactttttattcaatgcttatttatttcattaatcacaaattgggtcattctgccaagtcctgaggaaaatataagtaactgagactgtctctgttcaggattttataatctaaccatgaaaacaagcattacatgacatattataaagggaaagatggacattaattttgattgggtgtcatcagtactaacattggagaacaataaataaattagtatcagtaataagtagaattttagtaaaatctagaacaataaacttttgttaaaattttacattataaaatcacaggacagcatgtggctatcgcatttcaagctgagataacagatttgctctcagatttcccacataatagttgaaccacaatgagaaagcaacttgagttccctgtttctttatagttccctgatctctaaactaggcataataatagtaaaatactaataattattgttataatcacaaggaccctatggagtacttgtgaacattaaagaatataatctatataaatggcttaattaataaattctaaataaatgttggtggttactattagtgactgatgcttacacataaaatgactattgatatgattcataatttcaagagacttcttgagtggtgtattagtctgttctcacactgctaataaagacatacctgagactaggtaaaatatgaggaaagaagtttaatggacttacggttccacatggctggggaggcctcacaatcgtggtggaagagcaagtgacatcttccatggcagcagacaagggagagaatgactaccaagcaaaaggggtttccccttacaaaaccatcagatctcatgagacttattaactactgtgagaacagtactggggaaacagccaccatgattcaattatttcccaccagttccctcctagagcacatgggaattatgggagctaaaattcaagatgatatttgggtgaggacacagccaaaccatatcaagtaggtaggaattatgtgtatgaaataagtaggaacattacttaatgttatatgagaaggcactaaatacaatcagtggcaaaaaagtgaaccctacaagcaatcaatcaagaataacttctaggaaggagggagaaagagagagagaatgagtattgttgtaaactggagttccacaaaggaaattgagcttataaatgagccctggatagatggattacgagaaagaaaagggcaaagagagaggatacagtaagaaaagcaaaaagactttaaaacaatatagacagaaggaaataaaatttaacattccaataatggaaaagaatacaatgtgagtaaacaattggtgtatgttgagaaattctgggaaataatatgagtaggcaaagcaagaatatatcacaaagggccaagaaagcttagatgtggacacaatccagtagatagtggaagaaatgttaggagatacttgagaaaagtactgttttaggaaatagagattagcggttcactgttttattaaaaatagctgaaagacagaagctgagtcacttcaacttctgcagtaagcaaagccatagtatgcaaactggcctttaaatccatgggggaatgtattatctcactttcatggtgcacatctatcatgggtaggtgaaagcaagggaaggagagatccactccacctagtcactcaaagataagggctgactgaggcattaccttttacagctgaaccatctgtgatacatatcttcttaagttgttctggcagaagagcgagaaaatgaagaatttcacatagatttttgttgcatcagcccaacaataatacgtcatacttacttatatttcactgcccagagatagttatacagttctgcctaataggtgaatatttaaacaactcatcagaacaaactgaatatttgcaaaatataactgtttcctacaaatgcaatgtgacaaaggtgtaaaattatttatttatttcacaaatgcacatggaacaccaaatgtgaactaagatttcaatgacaaaaaaaaaaaaccacacctaccttcccagttcttatatgcaaggaatttaatgtctaattccaattttcattgaataatctagactaagctgtcctaggaaaagggagtaaatgtagatagaaaatgacatattcccttgtactgccccatttatctcatcagtcattctgctttaaaggaattatctggtcacattttatcttctattcacatctgctactttcaggacctttctttccctcctctttctttgagattttcagttgctgctctgccttgtcttctgtgtccattcttagctccaatcctgagactcagctggagtctcagaggcttgcatctgagcactctgcattgctcagtgactaaggcaactgaattagggcagggacacctggaatagctcagtcctccacagcaggtggggtctgataaaagccatatgcctaagaccctgcagtatcaaagaactaagactcgcaggcattcctaactggaatctatctctatttcagtgttatgggctagattgtgttccccaaaattcatatattcaacctctatcccctagtaactcagaatgtaactatatttggatatagggcttttgaagagataattaagttaaaatgaggctcttaaggtgaaacctgtaagaagatactaggacacaaggagagacatcacgggtgtgcctgtacagaagggcaacaatgtgaagaggcagcaagagggtagatatctgaaagccaaggagagaggactgaggcaaccagctcaactagtaccttgatcttggataattccagtctccagaagtgcttaaatttctgttgtttaagccacctagtctgtggtatttaattacggcattcctagtaaaaggacaacttttatctctgtttccaataaacatttcaatcccatggtaggaaaatgacaatctgcctaatctctgccacctcctaacaaaaatcttgttttattaagaatacaaacaaaacatattttatataattttcttataattttattaatgtctgatgtaccagaaaatgacacataggtattgtatgctttgccttatttgaactcatgataaccctatgagagaggtagtaccattttcctcattttataaacaagaacagatgacttagatcaagtaacttgactctgataacatataggttaagtaggagagctcattcatctaacacggttacctttcatgacaatgatgatgaaaacagctaacagagtatccacgtgaccattattcatctaaaccccttacattaaataattggacattcataatattcctataatgtaagtattcctactagccgtgtgttatagacaaggaaatttaagcaaagagatattgagtaatttactatagccacagagctacagagttttggagccaggattcagatctaggcagtccaaactgaaggtgtgtatttttaaccaccacattctactgcttctcaaagtttggagtaggtatattagcatctggtaatggctgttgaggatattttaaaacttaggtaatgacttctgctattgtatacttttagaaaactggattgggatcaaaactgtccagtacatgctattttgttacctttggattcttttaatacctaaccttgtgcgattggggtcatagcacagcatgtatgatcatcattgctgcaaacggatacacatcttaaaagtgccaactcagtgttattcaaatttttcctgaaatttccatatgcttctcaagttccttaacttgaaaactcaaaattcttcctgcaaacattttctgattatctctactccaaaatgttttaacagttagtcaattagttaattaaaattttaattggcaaataattgtgcacattacatattttggggtacaatgtgatgttctgatatacatttactttgtgattaaatatgctaatgcacaaatttatcacctcataaacttgtcattttatggtgaaaacattcagaatctattcttttagtaatgttgaaacacacaatgcaatattatttattattgtcaccattgtgtgcaatagatcactgaagcttattcctcctctaactgaaatgttataacttttgatcaacatctcctctttcccatttcattgctcactccacccaccagcttctggtaaccaccaaccacatccagtggacagcaagttaaataataggaagttagagaaagctgacagttacaaaggatatgatgttatttaattgttcagaatatacaaaatgtgtttattataggatacagccccttatggaaaaataaatgagagtggggaaatttcaaaatcagacaaaagtaaaaagtactatgttcaccagaagatggagaagtctgataggaagacactcagaaaaggtcagtaaaaaacctctgagaaaaagaaagttgcaggaaaggtaaatcaataatgctgtttgctgaaatgctacaaaattatagtacttgtctaaggaagtagttactggaagccatagagagtgcactttcagtatagttacaagaaaaaccaaattgcagagcttaagggaattggtgaagaactggtagcaacagatacaaagatttgacagaacatctaactaaagaaaaactctattatgaattgtataagtcattgatgactcagagccaagcaagtttataattacatttttgctcaacttcgatttctatgaagaacatttaaaatgagttctgctttttcatacaattagaatgtgggcatttttcaatcgttctaaaattttcagattattagaaccacaaagacaagcatccaccttaccggatattattgattttatatgcattgcctggactctgaattagaccttttctttcttttccctgtctcagcaggacaaataagaacatctaggccaggagcggtggctcacgcctgaaatcccagtactttgggaggctgaggcgggcggatcacgaggtcaggagatcgagaccatcctagttaacacggtgaaaccccatctctactaaaaatacaaaaaattagccgggcgcggtggcgggagcctgtggtcctagctactcgggagcccgaggcaggagaatggcgtgaaccagggaggcggagcttgcagtgagccgagatcgcgccactgcactccagcctgggcacagagcgagactccgtcaaaaaaaaggaagggaggaagggaggaagggaaagaaagaaagaaagaaagagagagagagagagagagagagagagagagagagagagagagagacagagagagagacagagaaagagagaaagagagaaagaaagaaagaacatctgagcaccaatactgggatattgtaagttacctcagaaataacatccttgggtaaggggtgtgtgtgtggtggggtgtgtgtgtgtgtgtgtgtgtgtgtgtgtgtgtgtgtgtgtgttttagcagaaagagaatcttctaagtacaatgaaatgggcttctatttatcagtaccttttttcttctctctcttttagttctgttgctttccaggatatacacatggctttaacagagtctattactggaatacggagaagctattgaagtaatccttcaaggcataaggtcagaacttagagaagtcacagagtttgtatttctgaacctgattaccagaaaattcttctaaagcaggaaaagatatatgctttcaaactgttatcctacaaccaaatccattttggagacacaaggatccacaagattactcaccttcaggaaaacatgaagacaagaaatgctagtcttggtacaacctaatgaaaagacatagctgagatttcatatgaagataacattgagattgcttagaaaaaaattattggagttaacattgaaagtaacaatggtatttcttgtcatccctttctaaatggcatatatggtatgtaatctagaaatatgtacatatacatgtaatagcttacaaagcttccaataaaaaagacaaaatctctggattttgccatctaacgaaaacaatgtagttactattaaaacttgaatttaacttctcagaataaacatacagtcaaggtttttgtttatttctttgtttttccaacatggttgactgacttgggatgctagttctcggaaagatcaaagttacaggtgaatggtaatgatctgaatgaaacacagtcagatgagagccaggacctgtcagagaacccacaagaagaagctagggtacagaaaaagaaagcaggaagagtctggcagagattgacccccaaggaacttagagaccccaaaaaagtataggtgggggtgcttctctgttcccctcaccctggcaacaacctgctaaccatcgaattattagagagtccttctaccctcacaatcctgggcaatgatgtccgtggcaatttggaaaattcccaaagacagaaatccatgttgttaactcacacaggggtgcccacactcttctcaggcctgaactgagatgtcaagtgccgtactagttgtgtacacatagtgggccactgctgtgcctgtagaacctcagtcattgagtcaccacatcacaagatcccctgcaaacataccccataacctgctctgacatccacaatcaaagggaaacagagaggatccctgaggaactgtggatccctggtaatctagccctcagtgtgacctacccctggggaatgggggtgcacagacagccctccaaagcctgccttgagagaaaggaaatgtagtgtgacacagatcactgaagggagtggcaccggcagccgggaatggatatggagaggtagtcatcttctgctcctcccatctactcttgcagacacagcagaggctctaccagttaaaggccagcccttgtgaaattggtgtaaacttttccagtggttttcacaacagctacacctccattcaaagtaagcccctgccacagaggcttccatgaagagtaagacccatctctccccttctatacaaagaaatagcatcccagcaactgaaggcagacaagctacaaagttgtctgtcatgaacttggggaagaggatttgccctgagcccattttgttggtagctgccggaggggcatacccatggtctccagctgcactatggccaggagtcaaaggacaatgtatatttaaactgaaggtcatgagcaaaatgcaacagcggcatgatagggaagcagatcacattcctgtctgcccaggatgaggacctggtataggcctccaacgctcttccattgaaacattgccacagcccaacaggatctccaccagctacacctgtcagggtgggtgcctccagtcattactgagctaccagagaatgagcaggctcttatgcttaagtgccatcactggactggagagtaaaatagaatacctgttctcagaaaggcacagggctagtgaataagataagcttcctgagacctctgtactctcagcctcgcaggagatagtgtcagctgacacatctaacacatcaaaacaacaggcaacattcaagaaaaccaccatacaaagattacccacaatcaaggaacccataaagaactttggcacactgaaagcaccccaaaacaaagcatatcatacacatcataacataaatcacagtaatcctctaaaggaaaaataaatgatagaaaattcaaaaataagaagtgatatctcctttagatgagaaagaatcaatgcatgaactctagcagtacaaaaaggtagtagagtgttttgacatctctaaaggattgtacttgcactctaaccatagattctaaccaaaatgaaaatcctgaaatgacagataaagaattcaaaatacagagtgcaaggaatttcaatcagaaaaatgatgaaggatataaaaggcaaaatagctatattagaaaatagaacttcatgtattgaaaaagtaactaaaggaatttcaaaacatagttgaaagctttaacaatacactagaccattcagaagcctggtttttttgaattaaccctgtcacacaaatataaagaaaaaataatttttaaaaatgaacaaatccttcaagaaatattggataatggaaagcaaccaaacctatacttagaggaattcttgaggaaggagagaaagaaagaaacatgaaaaatataattgaggaaataattgaggaaaattttcctcatcttgtcagagaggaggacatccagatacaaacaatttagagaatatctgtaagatattatacaaatgaacattactaagtcataaatttatcagactatccaaggtcaatactaaagaaaaaaatcttaaacagtaagtatcaaactatctataaaatgtagtcccattagactaacagtggacttctcagcagcaaccttacaagccagaaggaattagaggtctattttgagccttcttaaagaaaataattttataataaatggcatccaaaatttttataacctactaaacttaatttcataaacaaagtagaaaaaaagtcattcccagacaagcaagtggtaagggaaattttcacccatagactggtccttcaaaaaatccttaaaggacttctaaacatgcaaatgaaaggacaatacttgctaccagaaaagcatatataagtacaaagttcacagatcccataaagcaattacacaattgaatatacaaagtatctagctaacaacaatatgacaggaataaaacctcacatgtcaatattaatcttgaatgaaaatggcctaaatgctccacataaaagatatcattttgcaaattggatgaaaaagcaagaccctaccatttgctgccttcaagggactgacctactgtgtaatgatatccacagccccaaagtaaagggtggagaatgatgtactacacaaatagaaaacaacaaagatcaggggtgctattcttgtatcagatgaaacagatattaaatcaagaaaggtaaaaaaaaagacaaagaaagatacaattcaacaagatttaactgtcctaaatatatgcacccaacaccatagcacccagattaataaaaacaactagacctaagaaaagaaacaagtcatacaataacagctgaagtatttaacaactattagttatataatctgtctggtgacagcaccagatagattatcaaggcaaaagaaaaccaacaaagtaactccagacttaaatggaactcttgatcaaatggatgtaatagacatctacagaacataccatgcaacaaccacagagtatacatttttcacatctgtgcatggaacgttctctaaaattaaccaaatacttggacttaaggcaagtctcaataatttcaaaaaaatcaaaattatgccagttatcttctcagatgacagaggaaataacattagaaatatatatcagccgggtgcagtggctcatgctggtaatcctagcagtttgggaggctgaggtgggtggatcatttgaggtcaggagttcaagacccacaaggccaacatggtaaaaccccatctctattaaaaatacaaaaattagctgggtgttagtggggcatgcctgtaatcccagctactcaggaaactgaggcaggaaaatcgcttgaatctgggaggcagaggttgcagtgagctgagatagcaccactacacttcagtctgggtgacagagtaagaccctgtctcaaaaaaaaaaaaaaatacatatcaggagaaactctcaaaaccacacaagtacatggaatctgaacaacttgctactgaatgattttaggctaaacaagaaaattaaggcagacataagaaaaagttgaaataaataaaaatagaaatataactcaccaaaactctgggatacaatgaaagcagtgttaagaggaaagtttaaagcactaaatgcctacataaaaagataaaaatatcttaaattaataatccaatatcatacatcaaggaactaggaacataagaacaaaccaaatgtaaagctagaagaagaaataacaaaaatcagagcagaactaaatggagttgagactgtaaaaaccaaacaagagattaacaaagcaaaagttgtgtctttgaaaggataaataaaattgataagactgctatttaagttaattaaggaacaaaaagagaagattctaatacgcacaatcagaaataataaaaatgtggcattacaaccgataccacagaaatacaaaatatattcagagtagtctatgtaaattctcagagagtaatcatggtagactatgaatatctctgtgatcaaaaacgagaaaacctagaagaaatgaataaatccctggaaacatataaccagccaagattgaaccaggaggaaattgaaatcctgaagagacatataatgagttatgaaattgaattagtaataaaaaatccattttccaaaaaaagccaggaccaaacagattaacagccaaactttaccagacatagaaagagctagtacccatcttgtataaactaataaaaatattaaggaggaatgactcctctctaactcattctatgaaaccagtatcatcctgataccaaaacctagcactgaacacatacacacaaagaaaactacaggccaatatccctgatgaatagacacaaaaatctgcaacaaaatgctagtgaaccaaatccagcagttcatcagaaagataatttgtcacagtcaagtggattttattccagggatgcacaaatagttaaacatatgcaaatcaataaatgtgattcaccacagaaacaattttaaaaacagtagccatatgatcatctcaatacctgcagaaaaaacattcaataatatccaatatgtctgtatgataaaaaccctcaacaaactaggcattgaaaaaaacatactgcaaaataataagagccgtctatgacaaacccacaactaatatcatactgaatgggaactgtaacaagacaaggatggccactctcagcaatcaggcaaggaaaataaataaatgtcttccatattgaaaaagaggaagtcaaattatctctgtttgctaatgacaatcttacacctagacaaccttgatatttcctccaaaagattcttttacctgataaactacttcagtaagatttcaggatacaaaataaatgcttgaaaatcagtttcatttacatagatcgacaacactcaaactgagaaccaaataaaaatctcaatttcatttataatagacacaaaaaataaaatatctagaaatatatttaacaaaggagaccaatgaggtaaaagatgtccacaacaagaactataaaacactgctgaaagaaatactacatgacagaagcaagtggaaaaatatcccatgatcattgtttggaagaatcaacatcattaaaatgactgtactgcccaaagcgagctacatagtcaatataatttctatcatagtaccaaatttattactcataaaattataaaaaaaaattctaaaatacatatggaaccaaaaaaagagccttaatagccaaagcaatcctaagaagaaagatgaagttgggggcatcacattatctgactttatactataaggctataataaaaaacaaacaaaactcagcatggcattggcataaagatggacacatagatctatggacacaatagggaaactagaaaataaaatcacatgtgtataaccacggttcttcaacaaagctgacaaaattaaacattggggaaaggtcaccctattcaataaatggtgctaggaaaacttgcttgctaaatgcagaagaaagaaacttcactcctatctctcaccatatgcaaaaattaactcgatgaattgaaaatttaaatttaagacctaaaactatagagatcatagaataaaacctaggaaaacctctttagacattggcctaggcaaataatttataaataatacctcaaaagcaaatgcaacataaacaaaagtagacaaatgggacttaattaagccaaagagtttctgcacagcaaaagaaacaattattagaataaacagacaacctatagtatgggagaaaatatttgcaagtaatatatctgacaaaagatttatgtccgaaatctataagaaaaacaaatcaacaagaacaaaacatataactccattaataagtgaggaaagaatgtaaacagacacttcccaaaagaagaaatggaagtgaccaacaaacatatgaaaaaacattcaacctcactaatcattagagaaatgcaagttacaacaaaaatgagacaccatttcatcccagtccatttgtactttttattatcatatatatcctcaaattcaaaacaaaataaaccacaacataaactgtgttagtatagtacattaaagtcagctccactgtgctgtatcacttggcaagtctgaaattccaatgggcttcagaaagttgactatgcaatgcccaataatgacctgataatctcatattagaggcaatgcaaatatatttataagactaagagctacaacaagcttacgaagaaaaccaatttatagcattacaggttaaaccagaagtgatttcctctgttaactaaaattacattactaaaaagtgcatggttcgtggatgtctaatgtgaaaaaagacagacagtgaatactttcctgctcagtgtgaacacttaataagaatgaaaatagaatgccttattatataaagtaataccaatacattgatttccaatctactcctctggcacaatttaaaatgagctcttgaactatagagtcacaactctttttcatttcaatgtgttttccttcaaaatagcagttatttatacatactgcttttaaaaatcatttttaggctgcagattcacaatctccataaatatcaaagatgtgaagttaagttcagatgcacttgaagtaaacaccatgctaactagcagcagtgttcaagagatcatgctgccgatcttatgaaagggaatatactattgtgaattattttgcaaatcccaaaagaagtttatctctcacattattgaagactgagaatgtcttaatatatgcacaacttgaacattgtttgtgaaaaagccagactaattcatctatcttctgatcaatcagtttagccaagcaaagcacaaaataaatgcacatcctttgctgccgttaagagcaaccagtttgcttgtctgtgcatcatgaatgccaaacaaatcttgaataagaacgaggaaaagttaaaagaaaagaaagacaggaaagaaataaaactcaattttcttgaataggaaatttctagggaggaaacattttccatttttgtcttctatcaaatttatatatatataaatatatatataacatattatatatatcctaactgtcattataggctattctaagacagattctgccaatattgaaatatctaagacaggcacaattgggccattgcaaacatcatgtactaaatggattctaaggaacctgaaaattaatgaatctttctaaaatgactgacttactgttaggggaaagcttaagaaatcaaataccaaatcaaataccaaaataccaaatcttttttcatttttctattcttcccaaaaaaaaaaaatagtgggggataaaataacgcaatgcccagttaaagtgccaacaccaaaacaacttatggctgctacttctgaccctttcagggggtcaaattttgttgtcttttgtatttctagctttgtttgagacctttgtttgcatatattcaaaggttagtaaatacaatttaatattgtttccacagaaattaagcatttacctagttagaataagcattcaaacagaggtcttgcattaaattttgtactaaactgtattccttctaccatgctgcaatctttattaagaaacaaaggacatctgatttcacttttctaagcttattttagttaaggttaattattacacagagatactaacctttcaatcataaactacaaattagcattattcatctctgtggtatattttcaatgtaataataaaaatcctggctcgctctaaaggtcaagctaaaagcaaccttaccatcatcatactggcccaagcagatttcaaagagagagcccaggatgatccctgaagctaaacatgtccagagataaaactgtcgaaacatcttctgtcaaagttcactcaaagctgatctgaaataagaaaaggtagaaagaaacatttgacatgttcattaatctgttataggtaaacacaattgtcacagcacagaaaagccttaatgacttcatagttaattacctgtgccacattatccattaacaaagtaacacactggtttaatgcactggaactgtttatcaacataaatttgcagacaagtaatctctaaggaaagacatcttttctgttatttaatttgccagcaagtaggttgagaagttaacatactaataatatcagaagcacactctttaaaatttaagacattatgggtaagtccaatgttaatcagtttaagttactaaacttatgttgtctacagcataattttacaacaaagtgtaagatagtaagccagttgttagtatcctacatgagcatttcaatgaaaatttgtcttatacaattaagtagaaaagcccatcattaaaatgttaattcctttctagtagagtgatcagagattgacttaactatgccaggaaagactaaggaaaatctgtcaattttcactacatctgctttatgaagcatttggatgcatttcattttaattctcttgttttacttttcaatccccagcaagttaaaaaaaaaaaaaaaagaaagaaaacaactgattgagaaattagtggcctgtgagcacatgagaatgtcttattgaaagaatgacatcctcagtttctttgtaaatttaggaaattatccacacagaattgttcaaaatgctcttgattataaattgtggcagactagggattggaacactgtttctctaattcagaggttccaaactcaaatgcctacagaggacaagcagacaaaggaaaagaatgaattagccaaaggggacaatagtgatggtagaggctgtgataaactgtgcaatgcaaggttttctaaagagaccagctggtgctcaacttctgtcagtggttgtgatgtggcaatgcaagccagtgtttctgggtcttctgattttcaaagagaaggcagaaatccaaattttcatgtgatttccaagtgtttacatgattgtgcaatcttctttataagactaaatgcttctagcaggtaatattgatgtctcaagttctccagttttctatttctgcccaggattctctctactagactagctgaggataaggtttatcagagggtacaaaggcacgattttaattctgcttttgtctacattttatttttgatttattgccaagtatttaataatgtttatttgtccagcagcatgtataaatatatatattgcattgtaaaattgtattaaaggtgtaagctctttttttaaactaatgggatacacagttcttgactttaaaagatcactgctctagatcacacacattttaatatgaagtctattcttctttgtttctttatctaagatataaaaggagctgccttctttttaactgggccttccacattttttcctaactggcaaagtgcttggcgcgtgcatttataatttctagggacagaaagcccaaagaagagctcattattagatgccaagagatcatcacaatccacactaacctgtagaaaaaagaaaaataaaattgaccaatgctactggttgtgtagagcagcggataagaatgtggctttttttttaaattcaagcttttcagcttactagttatatgactttgaagaaattaaatagcatctttgtctcacatttctcattatcataatggatataaaatagtatttacctcataagattgtcttaaacattaaatacgtaagggaatataaatacgtgcttaatgcagtgtacttacagaatgagtaccccctaaagcttaatatgagtaccccctaaagcttaatataaaagactcagcatctatggaacctccaaagtcttaaatacagatttactcaatctatctttagcaagggctggaaagtagatattattatccccattttgtggaggaaaggtcaggctcagagagaataagtgactggctcaaggttataaactggtgagtgtctgaagagaccataaagtctgtgagtaagacacttctgctcattccattagagaaaagtattggaaaaattcccagaaaacacagggctcagaagttttcaaggcatatggaggcccaggagagcctgctgtattgcttcccttaaactctgagagagacattctaacccccttcacaaaggattagagctctactaagatttctatatacaatggcttcaaatctttttttatttggaaaaacaaacatgacattaagaaataaaacaatgttatttaaattttaaaaatataaagagaaaccatatacaaatacaaaccagaaaggatatatattggaaaacaaaattaatacaaaccagaaaagatatgtattagaaaacaaaattaaagagacggtaatatcttagcaaaggacaaaaggacatagttgtgttcctgtgtgggtccttgatctgccagcttgacttcctttatagtagtttatagtattatgcattcacaaattatggcatattcttttattcctaactgaagctaatttggtttcatggaacagtctccaatataaaaacaacatgatggatcattattttaaaatcattaatgtcactgccattattatgcctccagaaacaaaacctcttgatctatggctctgcaagtttttagaggattatatgcatatttctgaaagcatcacagacaaaactcataaaaaatctatttagaatagatatagcatttactgcccagaggaaggagataattttaggggaaatattatacttatttgtctttgaataatgataataataacaatttctatagtttttttactctttcatctatatctgcctgatttccaaagaaattttcatcacttcaatgggctcaatatttacagagacctgaaagaaagctatgactcatcacatcaacccgataccccaaaacacagaacacatattgacttagtgagaaaacccagtttctaaacaaagatataatgaaaaggtacctcccacaaagagattgtgtaaatgactacaggaccaagatgtttagtacaatattgtgccaatcaactgacagcctatagtggcacttctgtgattgtgatcaaattaattggaagagatcaaatgctttagacaaaagactgtttttgttactagctttttaatctctagaattaaaagagaaagtcctataggagatgaattccataatcttgctaagtgactgtaggtaaatgaaaagcctgtcaaacaacacctctatggtggtactttacttttactacaaatcccacatcaaactctttccatgttccccgagtatatatttttcctacagaatttattggctaataatgttatgttctaaaaatccaaagcatgttcaattctaaaaagaattgtaggtgacctataaataaatatgttatacttgttttttaagagataattaaattggtgtattcagtactctaatatagctaataaagttatcattttgcaatcgtgacttagaaatagtattctgttgtcaaaatactggggaaaagtgtttttttcctattacagtataatattacacgtaagtggtttgcattccatgtgcattttatgacacaatttccttaggcttaagaatattttactgcaattattcaagacaaacatactaattttgaatttcacatcatttgtatttcctgcaagataaatctcatatttatttatctggcattcaatgttctcaaaaattaatttattcaacaagtacttatggagggtctactagataccactcactcttctaggcagttggaaaatatcagtgaacaaagctgacacatttcttttctcccatggatgttatattccagcaaaataaagatagaccaataacaaacataaataagttatataaaatgttaaaatgtaataagtgacatgaaaatagcagctagcatttcaaaactgtatattgtcactttacaataattttcattcagtaaatgaagtgagattacacaaagcaaccaaaatgctatccgataaaataactgaatgagaactttacaatgaaagtataactattccgacaaccctgacagcatccttgatggtatctactattctgagtacagatttctgtccatctcttggaaggagaataaaggtctttcactgcctttcactttcaaatataaatccaaagtctggaaatacacaaaggtctgtcctttttctgtttatccctgctccctgagtcttgggtgtttgcagtgacacatggcaaaagcagccaaggttgacaccacagcagttttctcttaaatacaattttgacaatgttaactattttttagcctatgtctctgactgctatgtgaataaacactaactttcttgagataccaaaacttggaacacaccgtcattactttgatgagaaaccccataccaatacacaaccatgaagcaagctggagtctcacagtgaagtgagctgtatgtatgcagtctgcccttcaacagttggttcagccaaattactgttattcttgatctgtaacaatatctagataaagctacaaaactaaaacttgtcactgctttgtattccttgtgagaaacgtatgctatctacctgctggaataaagcaaacttcccttcaaagcaacctcagcttcaaactaaaaacatgaggttttccaaagtcactgtatcttaccatactaaatatcaatttgcttaaatgactagagagaaacctgtcttctacctcagcatggtggtaaatattaataatgtcttcatcagtacagagggtacttatcacccttcagcattaccagatgaatcagctgttccttttttaaaatgtgtaatatgaagtttaggaaaataaaatttcagagagcctttcagatatattccttccttctagatcatattatatttttctttactaaatatacatatgtataagtttatatcatatattcatctataaaaatatattgatatttattgacaattttatagtacatttatacatatttatatataaaattatgttacatagtcacatatacaatttatataaagaagtatatattttatttaaatttacattaatgataggtaatatcaatgatattgatattatcgcccacttttttaaagtttgcaatttaaattcaaggggttccgttgtagctaatttgaggtaagtttggaaagtaactaatgtttttataggacactgtgaggtccaacctacctctcccacccggtcctgctaaattcggcttactagatctttgctcgggcttacagttttttttaacatgctactacatctgaatgtgtcttgactaccaaatttaaaatatgtgctaatttggccaggcgcggtggatcacacctgcaatcctagcactttgggaggttggggagcatagataactcgagatcaggagttccagaccagcctggcaaacttggtgaaaccccatctctactaaaaatataaaatattagctgggtgtggtggtgcacacctgtaatctcagttactcaggaggctgaggtagaagaatcgcttgaacccaggaagcagaggttgcagtgggttgagattgcaccactgcacttcagcctgagcgacagagcaagacagattccatttcaaataaaaagaaaatgttaatttgctttttgggtgcactctgtctcaacatatagattcatcctaaacattgtgggataaaataaaattgatgaaaatcatttttaaaattaagaatataaattattaagaactaatcttgctatcacttcaatcatttacaaggtctttcatttcagttttaaacattttaaatatataatcaacagttgtaaacattagatgagactaatttaacccaaaatatatttcccgaaaccacatgaaacacataaggtaagtccaagctctggcattcttatactacagctatggtgaattcttggagaattcaaatcagtgtcttaacatgtctgttgagtctattcattattaaattctggttttaataatagaactttaaataaaagagggaagaacactggttttctttttggggaatactacttctcaagaaaataaatgactgaccaatataattaatctgcttatgtttaaagattgtgtcttcatggaaaaaaactaatattcagtttagtctataatagatacatgccaaatgttataataatgtagtcatactagttggtttaataaaatataaatacaccaaaaatgtttttaaatgagtggaaatttaatctccatgtttactattgctattatattggatattttcttagtgtttatacatacatttactcaattagtatttattttatatttagtgcatatcagacactaagcttctactatagaaataaattattccatttcctcacaatgactttgctattgagcatgcactacatttcatatttttttacctaatatacatttcaaggtactttagtaaaataactccaaattaggagataaataagttttaattgccaatttttttgaggtttccattccatctatgttttcagaaccttcatctaaatctcagtcttttagataaatacatttctcactatttgttagaaaagtcatgggaaaaagcttagtttgaaaggagcaagcaaagggaaatataaaaagagaagcccaaacattatttcatcagtggagtgtttagcttaaaaatataaccaagtaaatttaaaatggagttttaatgctcaagcaaacgcatgcatcattttaaaaaagaagcttgaaagagagttctgtgcagtgttattacctggcacagaaaaatgattctgattaatattcttgtttgatgaatattatagattctaagaaacacaaataaattaatgagtaaatgagtattttcctaaggcaaatccatcagcaaaaaaaatccaaaagtattaagtcagtcaacagagactaaacgtaaaagtatgaaaatgtcagtgacttgtataatgtaatataataaaagtcctggctctggcatgagagagtcttgcattgcattcctagttatgttgcttttggagggctatataagggtaaactagttaaaacttgtgagaatcagtttaaaattaggacaataaaatccattttattcttctgtaattgacagatgaaaatttgaacaaaaaataaaagttaagaatattcatttgttcatttatagcataagtgtttactgagcactgattctggataatgcactttataagatgcagtggctacagctttatgagaaaaactaaatgaattaataataaatacataatagtccatatagagttttcagtctaacagagtgtgacagtcacacctaaagtagctcataatgaatcaaatcctcgtataatactattctatagatcaggggttcagtactggtccatggcctgttaggaaccaggccacagagcaggaggtgagtggtgggtgagcaagcaaagtttcatctgtatttacagcccctccccatcattcgcattaccgcctgagctccgcctcctgtcagatcagcagcagcattggattctcataggagggcaatctctattgtgaactgcacatacaagggttccaggttgcatgttccttacgagaatctaatgtctgatgattgatctgtcattgtctctcattattcccagatgggatcatctagttgcaagaaaacaagttcagagctcccactgattttacattatggtgagttgtatgattatatcattatatattataatataataataatagaaatagagtgtataataaatggaatgcacctaaatcatcccaaaccactctcctgctcccagccccaggtcggtggaaatttatttttcatgaaaccagtccctggtgccacaaacttggggaccattgccatagatagtggaatctatgacttgcttctaatgtgtagaatatgataaaggtaacaagatatcactttattgtttcaattaagttatataagattcagtcttagcacattggagaaagataaatcttcctgctctgtgtaaagaagcaaacgtattgtaaactgcctttggagaaggacatatgccagggaactccaggtgacttcttggaccagaggatggcctccagacaacagccctcagtcatataaccaaaaagaaatgaattctgccaacaatctaaatgagctttgtaaaacaattgcattccatattgttaattatattttgaaaagaaatgtaatttaaatactaaataatgagattttattttatatatgatcaattatatacaataaattattttcttataaatctagttacaacttttctgtttcttatattgaacaaattttgagctataactcagtcatattactttacttgcttttgccattaccatagcttggtaggaaataaggttttaaataatagtcttttaagtaggtgacagatttagaataaaagattcataacagttctaattttaaaaaatgacttcacatgtttaatgacatagcaaacaggtagtatctacattcctaattttttttcttaaatctgcttgcatttaaacaatgtaaaattaattggtaaagcatgtcatttaaaaaaaaaattaaattaaagttctgggatacatgtccagaatgtgtaggtttgttacgtgggtatacacgtgccatggtggtttgctgcaccgaccaacccgtcatctacattaggtatttctcctaatgctatccctcccctaacctccccacccccgcgacaggccccagtgtgtgatgttcccctctctgtgtccatgtgttttcattgttcagctcccacttacgagtgagaatatgcggtgcttggtttttctgttcttgtgttagtttgctgaaaatgatggtttccagcttcatccaagcatgtcatttttattagatatagttggtaatagaaggaaacatataacttttttttgttgtttgtttgttttgagatggagttttgctcttgttgcccaggctggagtgcaatggcatgatctcggctcactgcgacctcctcctcctgggttcaagcgattttcctgcctcagcctcccgagtagctgggattataggcatgtgccaccacgcacggctaattttgtatttttaatagagacagggtttctccgtgttggtcaggctggtctggaactcccgacctcagatgatctgccctccttggcctcccaaagtgctaggattacaggtgtgagccactgtgcccggccaacatataacttttaatagttatttaaatattaatatgtatgtaatggatactagagtaaatactgattgggaaatacaaactgtcattaataaaatatttgttttctatatagctttaatatgtactttttaacatgtacttacaacatttatttaacacgaatagagtagaaaatgtgtactttaatactttgccaggtgacatgtttaagtagaatgaataaaactaggtttatcctccattgcccctcttcttatcagaggggtcatatttcatatgtcatatcttttctacactttattttctacttcacattatatgaagtctaaccagagatcataaagtttcatactatatcaatgcagaggcagaatcaacattctatacatataactttttactttctttgcaggattttttaggtaaggtcttcggccaactgaactgcaactgtttcatttacaataattttaaaacagtaaaattctctcaagaactaagtttgtacatttgatgttgataaaaataatgctaatggtgaatattttttgagtatgatagatgttgatattattgaaatcattagatatgctttaataactttaaaaccaaatggtagactgttccatttcatttctctttgtactttaccaatttatactatgaaaatcatgtatgaaatgtatagtctagaacgtttgcagaaatatcatctcaaaaacagtaactcaaagtctaatacagaaagacatccatataaggaagcatttcacaaatatttctaagctttgatttgatatatattaagcttttaccatttatcttataaatctacatggttaaagaaatgatcaaccttctcaactggcacaatgtgaagatggataatttgacttagaaaaataactaattgtgtagtcatgtaagcccttcatttatgacacaaatccataaaggtcactgtcatatttcttagagactggattttaatgtaaagctgagttttatttttctaggaaactgtaacttttattgaaaatagttcatgtataagcagatttatggaattcaaactcatgttgtccaagggtcaattgtgtgtaattttataattgtaaaactctgtcttatctgtaaatgataagatattacaattagttggttctttatgtttgaggggcaaataaaatttgaataagttgtcttactcacaaagactatgcttcacgaataatacactaagaactttagtctcttcctacaaatacctaattttatagtgtatcctggcatttcaaaattaccaaactgaaaagtagtcgttctctctcttagtgtcaatgctaattgtatggtacgttcattactagagtacattttttctaacttaaatttttaaatttattacattaaatattagattatgctattatatagtaaattcaaactgcctgtataatattgtatcctattaaaatgatacagacattaaattttatgggcattctaatgattgttttccatttttccatacttttaaaataagttgttatatgtcccttggggatggggattattttaggaatactttactacttattaattttccaaaagtcaataatgaaaaatatttacttcccaacacaccctggcaagatattttataagtgaaagacataatttcattctgacctttttaattctaaggccttttcatgttgttttttttttttttttcaatctgatctaatttttaactctctctatttattaccataaccaaatttcattttactttatttttagctagttatttctgcctaggcattttctcctttttcatatttcgacctaagaatttgttcctcatgtaagacttctctgacaagtcacttcctcccccaagtataggtcaaatattttgcgataatccttagcctttcctttgtattcagcgaacacatctcagtttataattacattgcttgtcagtgggtactttggcaatatttgtgtttcactttatgcccctgagaagaggaatcattattagccaagctcctatcccagctttttatcccggagcccagcaaatagcttagcccagattagcattgatgttttgaatgaatgaattttaaaaagaaacgtatcattttcacaaaatgtcctgttatttacattaaagctaatttgttcttgtcaaatctgtattatatatgaaatttagttttaacacttattcctgcagcatttgctgaatatgcaaggatcgataattgataaattctaaggaagttctatttcctttaagacacatttaaggtattgttggagaaagggctatgaatattgtaaattctcacagagagtatggagatgtttgtacataaatatatacttattataaaataatattttaaatcgtcgaacttagataaaatatatgcttataaaatataagaataaaattctaatatacttggaaaataagaaccaaatctcagcctgtaagttaaaacttatggtttatatacaacaaaaactactggggctgtttttatttctgtgacccaattaaactaatcttttctcaaatttcatccctatgtctgagtatactaatattggcaaagccctctctatcctaaaataatgtctattttaatatgtcttcatagaaaagtcattaaaaagcagtgaacatagccactaagtatgattttaatatttttgttgaaatgactaaattaatagaaagtgacaaaaagtaccttaagaagaattttaaaaaacaaaaacaaaagattgaacaaagcatatgtggaaatataaattataattttcttccactttattaacactcttgtctaattagacaataattactttaaaaactaacactttccccttagaattactgctgaagttgaaaggttcaagtttttaattactgctcataaagcatgcagtgaaactttctaaactatgaaaagtctactatcttacgattcagcaagatatttatcttataaaaacatcattaataagtacaaaatctcatttaaattaacagcaagaaactttcattttcctttccagtgtcagagatgggtgaaataaatcaaaatcaaggatcttttgtggatgaaaggaagtagaaatcttaagactagaaactcactaatgtgatgcccatgggcaaagatgaaatcagatattacagatgattttgaagttgcagttttaataatgataaaggtatagtgaaagggagaattgaagcagaaatgaatttcatactgttgcccacaccaatcaactcatcatgcatttcaaaagtatattccggcacaacatggtggctcacacatgtaatcctagcactttgggaggtcaacataaaagaatggattgaggtcaggagttcaaagccagcctgggcaaagtagcaagacccagtctctgcagaatagacaaaataaaaaaattagccgggagtaagggcacacacctgaagtcctaccactctccagaggctgatgggggaggatggtttgagcccaggagttcaaggttacagtgagatatgatcgtgttactgcagggacagattgagagcccaaaaacaaacaaaacaaataaacaaaaaagtatattccactaataccttgtaaatgggggtgtatgaagtttttttaaatcagatataatgataatagcgtgtgtgcatggcagtgtgtgtgtgcgtgcgtgtcaggttgcatatattaagtgtaaacaccacagttatttcaggaagggatcataaatgcataagaatctaagtgtccataaaataccgtaaataaataattaaagctgattgagaaataatgggggctctggagactgtgcagaatttaaacttagcaactttgcagaagtctacgtctattttttccatcttccaattttttaggtaacattgagtgtctggattttcatatgcaattatgcaatttattttaattaaactattttctagtgtatagtgtggccaaggaaacgcagctttatgtgccatccagaccatgttgcaatagtttaaagccttgggcttaaggatctgttagtaacatgacatttgtatgatcagagctatctctccatacgcatttaggaccactgtactatcatcacgtccaaaacttcctttcataatcacaatctttgaaaattctcacactttagagtatcttcctgcctagaaaaatctatcacagtaatatatgcactcaccataaagataatgtaccaggatgctgaggatatactaggtggaaattttagaactgctgttgttcaggattttctcaaaagagaaatattcagaaatatcaggtagttactttacaaagtaacatatataaatatatgtatatacacacacacatatatttatatatgcacaaagggtttcttaaatgcacatgtacctttaaagtaagaatgcattttgggcatagtcatcaccaacacaaagttcattcttgcctcatgtattgatttatgctttaaattttgtaatcatgtgagcaatctttaaaatgataccagattcccaggttaaagtcatttggatgacatttatttatgttttttgtactattttgagtttgagggatggtgttagaaaatcttgtaaactagcttttggtattttctgattattattttttattttttggtgagcaacactaagactggcatttcaacttccaatgagggtccttatataatactcagttaagcatattactgctaaattcaaacaaattttaaaaacaaaaaaagatataaatgattgaaagcatgacaaacgttccctgtagatgttttctaatttttaatacattgaattaaaaatatgcctttccaagtgaattttagatattggttaccaccttcaagatcatcatttatgtatttgtgaaggtgaaagtaggaggcatacataatattatatctgtaataaatgtaactttttaaagtaacataacatctatatatggcaggaaataataatgatacaacattaaatagatatagacctgatgatatagttggaattctccaaactcttgcataacacttatgtaatcaatgtgaatttaaaaacatacaattggccgggcgcggtggctcacgcctgtaatcccagcactttgggaggccgaggcgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcgtgaacccaggaggcggagcttgcagtgagccgagattgcgccaccgcactccaacctgggagacacagcgagactccgtctcaaaaaaaaaaaaaaaaaaaaaacatacaattgacaataatatatgtgatatagtagattgtccaatattttgttggtctaaactacaaaatttgccctgatgattggtgtattgaagagaaaaacaattatttgtatctcatgatacttatcgaaagagtttgtagacaaataaaaaacacactagcaaaacacactctgtttcatgttaattaaagggagaaatactgttcacagaaattagcttccaaaaatcattcttcgtgaaaacacataagtaaactaattttaatactctcagttataactaaaatggtatcatccactatcttccactaactaagtattaaatacagagcataagctattccaactgacatattaaacaactttaagtatggcttatgtctataattttcttgtaatctcattctgaatggagctttcttgagcaacagtaattacagaggagttaagagtctggaaatagttatttgtttatagaaagaaaaactaataagagaatgaacatacttagtctaattagaaaagttttgtttaaactaccattagaagtaaaataatgccacaaactgaaatgaatccctggatattcttaaaacattattgttactttagtttcttaaaaacaaattaagcagacactcattttttccaatagcttgtaaacttttgaatcttgggtataattttaattcttgagagtgtcacatatttgataaagaatgtttgtctaagatttctatgcatatgtgtatttgagtatatgctatattaacatatgtgtattagactgccaagataaaatataactaatcaaagcatttattatttaactttgattaaatctattagcttctttacagattttgctcatttgtaagaggaggttaggtttcttcccccaggataaaagggatgagttatctgtttctcttgggacagatgtactgtggtaaatgcagtgataagagataaatgaaaataaagagaagcccctaaccaaacagaaatgaaaagaacaataatagaaaagagtgtctggggacagtgttcgaggttactttttcttttttctaaaatgattttttgcaattcatgaaaacaagcctgaagcgtaaacttgtcatctcattttaagatgcatttctcctaatattaggtattaaaatataatgatcaggcatatttttaagactcttttcaccttgtttgaaatgtattgcttcacaaagtctttgtggagctttctttttttttaagaaaagaagaaataatacaaatatagtttaggttgtgttaatgcttgaagaaaggtgtaaagggagtgatatgctttggttgtgtccccacccaaatctcaccttgaattgtaataatccccatgtgtcaagggtggggccaggtgaagataattgaatcacggggcattttcccccatactgttcttgtgatagtgaataagtctcatgagatctggttctataaatgggagttcccctgcacaagctctcttgcctgctgccatgtaagacatcactttgctgctccttcaccttctgccatgattgtgaggcctccccagccatgtggaactgtgagtcaattaaacctctttcctttatacattatccagtcttgggtatgtctttattagcagcctgagaacaactaatacagagagagaaagaaggttggagtagggagaagattgctagggtattaaaggaaagccctctgaaaatgacacttgagctgagacctgaataaactaagggatattttagagaatcccataacagggaagcaggcataccactttcaatggctctgagtggggagcatgccagccatggatgagaaacagcaaataggccagattaataagagggagggagtagtactagagatgagagacgtagccaacaagaaactgagagaatggaggtgccacttactggaatgtgatcctccctattggggagcggcaggtttggagtagaaatcaagagtttggctttgattgctcaaataaagtttgaaatatctattaaactaccaaatacagatgtcccatagattgatatgaatgaatctgaaagtcagggtagacaaaaaattgccagtcatgaaatgaacatggcactaacataggctatctacggaggatgtacaaagagagaaaaaatcaggacttgcaaatatttagaggtcagaaaaataaagggtatgtggctaaagagataagaaggagtgagagggaatgcctgaagccaaatgaagaaaggatttcaaacaggagagaatgctaatatgttgagtgccactaataggttgaggaagataaggattgaggattaactcttgtgtatttgcaaaacagaagtcactgatgcccttgagaagagtggttttagtggaggagtgggaacaaaagcctgactagaggttttcaagaaaatagagttcatataatttgttagtgtttttttttactgtgcaagtgagcaaccaaatgcggagataggaagacagtggggacaatgagtccatgaacttggcacatgtgtgcacttgtgttaaagatagagctattaccaatgaaaataatctattaaaaagtacagtgcagacaaaacaggagagagaatggacacacctgcacagtaagagaaaagtcctttcttaggttggtagaggaaattagatcctccagacagtggtaattaaccagagagaaggtccaggataggtggaagtttgcggatgagaaagatgtatcggagctttgaggataaagagaatgtatgaaggattcctttgaaaagtaatagtgtgaattaagtggcaaaatggcatacagttatacagttattgcatagggatgatggaccacttgatgtttgttttttcttttattttccagccacatgaagctgttggcatgtaggattagagtagacaaactactatttttattttttttatgtttagttttctttataatacacttcttcaagtttaccaattaaaatattttgaatctcataattaagtcttaaatatacgtgttcatgggtggtaattacttaaaacacttggatagtagcaagcaatgaaacttctctttctcttctgttgtattcaccaccactttagcctgaataactgagcaaataccaggttcttggaacactggcataaactatgtatctaggactatggctctgtccatcagcacaagccactagtaattcagaaattggtcatttatataatggcatttattgcatctttaccacgaacaatatgattttttaaacatggtttaaactatattatacaaataattcagctgtgtttgatacttcttatatgtaagaatcactttcctttttataggttacttttcctctttttataatatctgaaatttaaggatgctgtctcagagagccctttatttatgcaggcaagataagaatctatctgagatactctcacattcttaaaaactaaatagctacccatgtgtgtgtgcatagtgatgtcagaagttcttaactgagtcgtaaattccaaagaatcttagctaaaatgaagctcatatcttgctaattcttctctgttaacccataagaaaacagaagcccagagaaattaaaagatttgttcaagatttgcttgatagcatactaaggtggatttaggactttgggctctgaattgcttaatatggaagtgttgctcagggaaaagcccaaaccccagcattacacaataaatccatgcaacaaatttatacatgcagcctctgaatctataatttaaaaatgtgcaaaaccaagcatctttgaggaacaaaattctgagatattataagactttgaaagtcatattaggctttgctattgttcagattttttaaatatttttaatttttttcatttaaattttaagattttgttgtggtaaaatgtacataacatataatgtaccattttagccattttaagtttacagtttagtggctttaaggacattcacattgttgtgtagccatcaccaccatccatcttcagaacttttcatcgttacaaactggaactctatccattaaataggtgctccccattaagccctgctccccgcccctggtaaccattattctatgttatttctctattaatttgactattctgggtatggtatatttgtgaaatgatatgaaatttgtgctttcaatggacaagcatttgaggggattcaaaattgaattattttatcacgtttcagatggaactacaattattgagcatcaccattttagacattttactaggaaccttaaatacatgttttattttaaattctggatcaaaattctgaactaattgatttcatttctttataaattggacagaagctgagcatgagaggttaggtagccctctcaaagtcaaacattagaggcaagactagaagtggaatcttcaaacccatgtccattaacatttcacagaactttgaagtacattatgcttgcagtgattaaagcttgcgatcaagtgtctgactaacctgagttgcaatcctgactctgcctcttacatgctacaatattttgggcagttttctgaacttttcaaaccctcagtttttcctttgcaaaatgttaaaatgatagtttgaaaatcatctagaaagggtgttgattatagcatagcacaagacagaaacttttccatatcataaagaaaaaaatataggctttttgagatactaagaagattatcatttatatctgaaagggaattcagattgcttagggaaattatacctaagatgagactcacaatggcagataataataaaatagcgatatttttcacatattaaaatgcatgtgttattgtatataacaattatatatttaaaaattgtccttcagatatactcaaacacgtcttcaaataccttcatataaggatatttactgaagtatgatttgtaatacgaagaggttgtaaacaattagaatgtacagcaataaaggatacaataggttaaagaaaaaatgtattgtaggtatagaatatttgctatgtacctaattttttaaaatcatatttataaactaaaatagatactctaggatatgtcaaggagctaaggaaatcatttagtttactatttggatgtttacactgaatcttcaaagtgttacattttcttaaaagaaaatgttaaagcatatgtggcatttagtcaaatgtatatgaatatgtatttatggcctctttatgtaaatgcatatatgagatgttcttgaagtaaaaaataattctgtgtttttttctcttgacacaagttgaagctattacaaaagctaattatttaattaaaataacactggaaaaaatgttttaaatttcatttgttaagctagaaaatatttaagaagggaggaaataatttagatcaataccatgtgtatatttaaatcagattttcaaagtttgacctttttacagaaaatctaacagcaacaatcatttccagcgttactccaggtcaaatcatttgatagtgttatttcctatagtagtgtgtattagaatagaatgtctgaaaacttaggctacactaaatttataaaatgcattttttaaatagtaaactaactttagcttactgttgtttttaataaaatttttaatttttaacttttttagctttttgactcttgaacacatggtatagccatacaacatagtttctttctttatatttttattctataacctttttctattttaaaaattattaatttaatttttacttttaaagcattttttaaacctagacccaaaaatacacattagcctaggcctacaccgggtcaagataatcaatatccctgtcttcctcctccatatcttgtcccagtacaagactctgagaggcaataacatgcacggagctgtcatctcctatgataataatgccttcttctggaatatctcttgaagaacctgtctgagggtggtttacagttaatttttttataaggagatgaagtacactctaaaataacaataaaacttacagtattgtaaatacataaattagtaatataatcatttgctatcgttttcaagtactatatactaagtgtatgtgctattatttttatcactggcagcacagtaggtttgtttataccagaatcaccacaaacgtgtgagtaatgctttctgagatgatgttacaagggctatatcaccaggaaatagaaatagaaatttttcagctatgttatagccttatgggaccaccattgtatatgttgtacattgttgaccaaaatgccattatgcagagcatgaccatacaaatgtacagatgctcatcaaattacaatgaggatacatcctgttaaaatcattgaagtcaaaaatattgtaagttaaaatgcatttaataaactctgtctactgaacatcatagcttagcttagcctaccttaaccatgctcagaacacttgcattagcttacagttgggcaaaatcatctaatacaaagttaatttttataatagtgttgaatatagtatgtgactgattgaactgcactgaagtaaagtttccactgaatgcatatcacttggcaccatcataaatccaaaaaattgtaaattgaaccactgtaagttggcgactctctgtatataaaatatgtgtgtgtgtgtttatgtattttaaatcatcactgcctctacttttctaatttttgcatggaaatccaaatccaagggagcaagacagccaattttttttttttttttttgtatttttagtagagacggagtttcaccatgttggtcaggctagtcttgtactcctgacctcgtgatcagcctccccaagtgctgggattacaggtgtgagccaccgcactcggccaagatagccaattttaattataacccagagctaaaaatgtctagaaaattaaaatcatcagctaataaccaaactattatataaatatagattattttctagaaaagaaaagttcaaaggccatttaatagttgaaattttatgatgggtgcaaattttgatgcactatgttttgctttagatcctttttaaagaaagcattaaataaggaatgctttacagagttattgagattttttagcaaaaagaagtcctcattatttttgttttggtttcctgtgcttttggtgtcatatccataaaatcattgctgagacgaacatcatgaagcttttccctcatatttctttttgcactttaatgatttgagtcttacatttacgtcaataacctattttgaattttttgtgtgtatggtgtaaaattgtgtccaataccattcttttttatattcttatctatttttccaccaccatgtgttgattaggtcattgtgactttttggcacccttagtgaagatcagttgactatatatacatagatttatttctgagttctgtatcatattccagtattctatatgtctgttgtacaagtggtactatatcaaactaaaaaggctctgtacagcaaaggaaacaacagagtgaagaggcattttgccttaacagaatgggagaaaatatttgcaaaatgtatatttgataaaggtttgatctccaaaatactttatttttgaaactcctgtaactcaataaagcatgtgacttgattttaaaaatgggctaaagacttggaaagacaattttccccaaaagaactataaatagccaatagatatatttaaaaatgttcaatgtccctaatgataagaagaatgcaaatcaaagtcaacaagagatatctcctcacacctgtcagtatggctattacaaaacaaaaacaaagaaatcaaaacaataaaaccccaaagacagtatgtttttagtaagaatgtggagaaagtggaactcttgaaaactgttggtgggaatgcaaaatggtgcagccactatagaaatcactacggaggtttctaaaaaaatttaaaaatggaactaccatatgattcagtaatcaaaattcttggcatttatccaaaagaatcaaaattacactctcagatacaatcatatactagtactcttatgctcattgcgactctatttacaatatccaagatgtggaaacaacctaaatgtccatcaacaagtacatgaataaaaaaatgtgctacatatataatatatactgactaaaactctctcctttgaccaaaactttatttggactcttttgaatcttatgcttggctaggtctaaccttgggcttctctttctgtccttgttgaatccagtttgagcaagattcctgttaagtcagcttaggaaaaaagcttcaatatcttatgacactggactccattcagcaataattccatcaagttgatgtagctagaaacctcgtttttctgtatgtttcctcttagtaattttccattcactgaaccccaccctgctttttggtataagtctccacttgtcatggtggaagtcagaattgagtccaatctctctctgctcctttaagaccactttgctggggtccctatacctattaccatgcccatccttgaacaatatctgccttaacatctttaagaaaattctgcaatatataatacaatgttgtatggcagaaagtttcagtcaagccaggtaaaaaagccctagagatctgccaaacaacattatgtctatagtcaaagattatacacttaaaaattggttaagaggataggtctcacgttaagcattctaaccacaataaaataaaattaaaaaaatttaaaaaagtcttcactagcattaaaaattattaattataaatttattacagagctgtcctcaattaaattaaaaaataaaattgtcagcccaatgaaggcattatcttaaaaattagaattaatgtgcaaagagtagaataatgggagtggtaaaaattgaagttataaaagttatgttctaccctcaaccatcccattagttaggtaggctgggtaagtcatttttttttctctaagcctcaattgtacttctttagacttgggctaatcatactaaacaaatgggattgctattatgttaaaacacagacattaacaaacagcagttcaatctgactctggctaactatatactgaatagaatgcttaatgtattttaaccattctcacagaagtagaataaacaatataaacaataaatttccgaatccaaagtttaagagatgttaaggcaaatactgtattgtctgaaaagtatacacttttgaaaaatacataggattaatattgaaaatatcagaatatgcttaaacaagtatgcttacataggttttctcctttcatctcagtttgaaaatctagccatgtaaaatcagtttctagttaccagtgattcacagataagcttcacccattaaaatttccattcctacttaagaatcacaaagaagttaaaccccaaaagcagcatctcaaaatcaactctgaaaggcaattactttttcaataagtaaaattcatgaggaaaatttgtcactgcattagcaagttgtctctccatagaataaagaaccaaagctttacttgttcattgtgtatgagaagatcaggatcagtcagttaatgcttgtgttgagaacatttataatgtcaaaataaggttaataatcctaaaaattagataacttaataaagcaacattagactacctaaaaattccaatgctcaaaaagtaattcaatatttttagatatgctaaattgggtatctgctttctcagtaacgtttccaaaatacctatcttctcttcacattcaatttttctttcttactacaactctttagccacaactacataaaccttaaaataaaattttctgatattattattaatatatatgtccacataggtagataaaatggctataaaataggtaatttttaaagtttatgagctaagtgatgctaacagaagcaattctacaaatacatatgcaaagtgtattattcatttaaaacaattaacacaaagcactcttttttggatatggtaactaccaaagtcaaaaaaacaaagagctgaaatattatgtaaattgttcacagaaactgttgatctccaaaccagtcaattattatcacggcttgaatgttatataaaatggtagaaaaattcttgatcaacacttacattttgcctctgactactttcctcattaacttaccagccatgaaaagcactgtgcaaaagtcagcaattagggactgaataaagttttaagtggatcaatataacatatttggcatatctatgacacttctattaacattcatcaatttatgaaataacgacattaagtaattgtgttcatcccaaaaacccaaatatcaaatactatttgcatgactgtgttatacatagagcagaaggcagtgaagacatgatctttgcttttgtcacctatgaagacaaatatattgagtcacctatgaatacaatatattggagtgtgctctataagacaagtagatgccaactcctactggtcttggagaaaatgtaaataattctattggatgggagcagcaaagtaggtagcaatttcacagaatgggtggtattggggcatgttcttgaaggaatgagaggtcatcaaacagacaaaaacgttttgaacataggttataagcaataaagaaactgtggagttgcaaaaaatacagcatgatcaagaaattgtatagtcatgtgccacttaacaatgtttctgttaataatggaccacatatatgaggtgatcccttaagattggaatggagctgaaaaatgtctatcttctgttgacactgtagctgtcataacattataacacaacgcattactcatgtgtttgtggtaatgctggtgttaacctactgcactgccagtgtataaaaatacagcatatgcaattatatatagtacataatactcaataatgttaataaacaccatattactggtttgtgtatttacaagactaccttttttttttttttttttgagatggagtcttgctctgttgccaggctgggctggagtgcagtggcaccatctcggctcactgtaacgtctgcctcctgagttcaagtgattctcctgcctcagtctcccgagtagctgggactacaggagcacgccaccacttccagctaatttttgtatttttagtagagatggggtttcaccatgttggccaggcttgtctcgatctcctgaccttgtgatccacccacctcaacttcccaaagtgctgggattacaggcatgagccaccatggccagccacaagactatattttttatagttattttagagtatacttctcctacttattaaccagagtatttgaattttgcattttaagctgtggggagttgctaaaccagtaataactataataagaatatcaactaacgtttgtcagtactgttaatatcattcaccaacttttaaaatcacctattatatttgaaactgtttattatctcagtgtccctagaaaagcaagtactgcattaggtgcataagaagatgaccatcattgaaggtcaatgagcaaaatgtccaatttttttctcaacttggctgaatatgagacagaggagttcctctgagcaggtgagttatgtagcttatgacttacaaatgatccctaaaaacttcttatatggtatggtgtaaatgaaagtacaaaataatttatgacagtacgtagcagaacaaaagaggaaaatatgttttaattatcaattaaaaattacctccaaacttcaaatatgaaaacccacaaataaattgcatctctattgaaatagcacaggcacttcatggtttagatttgtagaaatgtctctgaaaactctgtatttcctacttttatgtttgtttatatttaggagcagcctacacataatttggctcacttaaaagactttcttaatgagtagtaatctacatagttccttgctgctttattttttagattgggctggggaagtcaataaccactagaaactctcaaaccaagaaattctcctgaagcaatctttcagctgtaaaccacctcagctaggaacccattgtattcctataaatttccttcagtattcctaagactaaactaatctgaacctcatgactgacaatgagttgagaatgaccttttgcaccagtgcattaattgtgaaagctttctgcagcaggagctaggaaattactcttctgagtacagcagccagagcactgaaatggctctggctgctgtactcagaggagtattttgaatggcaatgcttaactcttcagccacacatcgtctacatttttatattttacagacattttagatgtgtccatcatcctccaaggaaattggatttctgaataagaaatttcttttcaccctgtgatttctacatgatacttatagaaacagtttgacagctttggagaggatatcctatgcttcatgtagactttctgcttacggagtttaacacactcataaatttagctttactgactttacaatcttttatatgagaacagaaaagtcagcaaatttggaaatagaaagtttatgttccgccacatataaagtatgccaagtaatactttggccacttcacaaggaagaaaaggatatatatccaaatttatataacattcaagaaaatctttaattatattccagagctgataatttaaaatttatcttcaataattttatttgtttccaaactacctgctgctgagaggaaaataagaatatgcaatttgaaggcatggcttgtagtgtatcatagctctatttattatattattatattcatctacatacactgaactgaaattgtagagttcatttatcatttagatcaacttttaagaagatatatttccaattcttacctgtccatctcaaattgagctcactatattcactttatgtataaatggtatgtatacataagcaaaatataaatacaagcagtgatatatttattgcactttgtatcttaaactagtatacgtttgcttccagcagtattttgattttactgcaattcagatattctgattatcttttacctaaactttaacaatcaaaacaacttatcagtcatctaactttaaacttcctctgaaatcatagtctttgtacacgaaatctaactggggttaaatgttcttcttgttctctctgattgagccttccctgggacatctcatgcatagaaaagagttcacaaataaaaatcggttagagctgtgattcagtttacataagatctagaaatataagttccataacttctaaacgaagtcatatccttaagccattcttaaacttaaaagcgaataactccaaacatccctgattgaataactcaaaataataagctcatcaatctgataggaatgtcaatctcagatacattgccaagaaaatgaaaatgatgtagtaaagattaaatgagaaaatgatgccacatacttagcataaatgcaaacacaaaataaatactcaagtaaataaaaccattctttttttaaatgtattctaaaacaacaacaataacaacaacaaccacaacaacaaaacaggatacaggtgcagaacgtgcaggttcgttacataggtatacgtgtgccatggtggattgctgcacctatgacctgtcctccaagttccctcccctcataccctaccccgcaacaggccctcgtgtgtattgttcccctctctctgtctatgtgttctcattgtagagtaactcccacttatgagtgagaacatgtggtatttggttttctgttcctgtgtcagccataaaaagaaataaaaccattcttaggatgatatttctccttacccttctctttttacaccgagaagaattatcactttgacaactgacgctctctttctttctttcctgaaagtaagttacactgtaacttatatgagtaaatgagccctttatatgaagcttaacatttaaattctaaaggattcttaaacacatgtgtaacaacaccatgtgttagttaatcctatcataatatatcatgttcatatattagattaatacaattaatcacattctaaattgacaacattttctgagatcttggtttcttaatatttgcagtagaaacaaatattttttctcacccttgagaattaaaagtgaagcagaaactttagagtcatgttaagttgctgactatctaacttggtttctgaatgataaagtagactctaatggtgattgctttttcagtaacaactttcagtaatatttgtatttttctatcacacctttccctgaagaagaaatgctttcagatgaatagggaaagactctctaagtataggtttgagttttagaattggctagattggagagttttagatggaagagggaggtatcaatcaagtacagaagttaatgctacaataattacttgggaaaattctcacacttcagtgattgccaatcagcctgcactacttactgagtgaaatgtctatggttatcagaaatcgtacaagaaaaaaccaaaccgaaacaaaaaatagtgtagttctttttttctcaacgaagtatatttaagagcattaatttagatccaactaggcctaggtttgagcacaggattttccactgtgattaacttaaactctcttgtttgaagttgtctcacctataaaatttgggacaattgtggtaattccagaatgaaaataaaatgatgtacatacatcatttagtatattaaaaattctcaataagaattgatttttctgttaatacgattataatataatttgaggctacaactaaagaatgaaatgaatagaaatgtaaacagaatggtcacttttgaaagggcttattctgtttagaagaatgtatagacatgatcaaataaatgttcagataaatttatagagatgtcaaataataactgcaaattgtgcaattcaactaaaatgtcgagagacaatgagacaaataccttttttattcaagttttaagaaaaattactgaagtttagaaaatctatggaataaatagaacaatacaggcataccttgttttgctgctctttgctttatttcactccacaaatattccaatttttacaaattgaagttttgtggcaacctggtgtccaacaaatctatcggcattgtttttccaatagcatgtgctcacttcatgtctctgtgtctatgttttggaaattatcataatatttcaaactttattattattattatttgttatagagatcagcggtctttgagatcaactactattgtagttgatttgggccaccacaaaccaggtccatagaagatgataaacttaactgatacatgttgaatgtgttatgactgctccacccacttcagcttccctgtttccagaggcacacaatattcaaattaggccaactaataattgtacagtggtctctaagtgttcaaatgaaaggaggagtcccaggcctctcatttttaatcacaagctaaaaataaataagcttagtgagaaaggcatgttgaaagcccagaggccaaaagctaggcctcaagcaccaaacagccaacttgtgaatgcaaaggaaaagttcttgagggaaactcaaaaagtgctacttcagtgagcacatgaatgataagaaaacaaaacagtcacacaccagggcctgttgtggggtagggggagggggagggggaagggataacattaggagatataactaatgttaaatgatgagttaatgggtgcagcacaccaacatggcacacgtatacatatgtaacaaacctgcacgttgtgcacatgtaccctaaaacttaaagtataaacaaaacaaaacaaaacagtctgattgtggatatagagaaagtgttactggtttggatagaaaatcaaaccaaccacaacattcccttaaaccaaagcctaatccagaacaaggccttaactctcttaaattctgtgaaaactgagagaggacaggaagctgcagatgtttgaagttagcagaggttgtttataacatttaatgaaagaagtcatctccataacataaaagtgtaagatgaagtagcaagtgttaatgggtaagctatagcaacttatctggaaaatttagctaagatcattgttgaaggtggctacactgaacaagagatttttaatatagatgaaaataccttctatggaaggatgccgtgtaaaactttcataactagagagaagtcaatgcctggcttcaaagcatcaaagtacaggctgactatcttgttatggatgaatgtaggtggtgactttaagttgaggctgatacttactgaccattctgaaaatcggagggttgttaagattatgccaagtctactataactgtgctctatgaatggaataacaaagcctggataacagcccatatatttacaagatagatatgaatattaattttttccattggggcttcaaatgaatatttaagccccaatggaaaaaaaaagattattttcaaagtatcactgctcattgacaatgcacctagtcacccataagctctgatggagatgtacagggagatcagtgttgctgtgatgcctgccagcacaacatccattctacagcccatggatcaaggagtaattttgacattcaagttttattatttaagaaatacatttcacaagactatagctggcataggtagcaattcttcttatgtatctgggcaaagtaaattgaagaccttccattctagatgccattaagaacatttataaattataggaggagatcaaataacaactttatcaggagtttggaagaagttgattccaacactcatgaatgacttcgagaggttaagacttcagtgtagataatacctacagatgtggtagaaattgcaagggaactagaattagaagtggagcctaaatatatgactgaattgctgcaatctcatgataaaatatacacaaatgagcaactgttttgtgtggatgaatacaaaaaaagtggtttcttgagataaaatctattcctggtgaagatgccatgaactccattgaaatgacaacaaagaatttagaatattacataagtttagttgacaaagcagtggcaggttttgagaggactgactcccattttgaaaacatttctactgagggttaaatgctatcaaacagcactgaaatctatggggaaatctttcatgaaagaagaaaagtagcactggcagttgaaagttaaaagcttcccatttctgatcaaaaagattctttcaaatcagaaaataaatgaaaaaaaaaaccgccctatttttgtattttaatttccaccctaaatttctacttcgagctttattttagcatgcccattccttaggtttccttttgttttgaataatacttccatagctatcctgaaaacttttaacaagttaaagtaaaatgatgtgattataagttaagtcattgcagggatggatgtttttatctatgtatgtgtatttttccccaacatctcccctgaccatcaggctgtcatcttataggatacagtggaaatttacgtttcttttagagatggtgtatcactatgttgcccagactggactcagattcctggggatcaagcactccttggcctcctgtgtagctgggattacaaatgcacatcactgaacccagctagtgccaatttttgaagatattattgttattatgtctttgcagaaataaagttattttatttatttgtagttactacagaagaaatgactttgatagataaaaaatagtaacaaatttcaaatagaatggaaagagtaaattatctaaaatatcagaaataacttgttttagcttatatatacttgatagtttaaaaaatatttttctctcaaagtagcatactatatttctgttgtgaaattatttagttcacatatcatgatcttttaaacttattttatttacaggtatatctgcatataaatttaaatcttcatgttgaaaatacatgattacctgagaacacagtttaatttatttaaaacagttacattatgttagacttatattttgtttttattttttcattatgtatatcgctatgcttattgaaatgtgtgtatatatatatatatatatacctctttacatgcttgcaatagttaacctctgcagaaatgtttatgcttatttttgcttattccatttatggtcagagagagagagagaaaaggaaggaaggaaggaaggaaggaaggaaggaaggggaagggggaaggggaagggaggaagggaggaagggaggaagggagggaggaagggaggaaggaagtaaggaagaggcaaggaaggcaaggaaggccggcaggaaggaagaaaagcaggaagggatggagggagagtgaaaaaaagaaaaagaaaagaaaaaatagccaggaagactgttcttacataaaaacgttctcacctattggttatttcttactctaacaggcacttacgatactatttaggccacctgctaagttctgtatacagtggcatctgtacattcccttcttatcattggtagagagactcctaaatcaatactcatcctgagagtgagctttaatatagtatgggtggtatttataagtaatgaagcagtcaagaggagaaacaagtccatgtttatctgaaatgactatcttctcattcaatgcagttacagccacctacagaaagggaaaatcatccaaacagaatttaagaaagaaagtttacattcgcttgactggaaatcacaggcaaattgctttgttggcatgggataaatgaaagttaaacacgtttggatattaggagagacaagctaatttgaagtattggaattaaaaaattaagtacatagatttcttgaaacaatcactcacagatacagtgacatgggtttgctcaaagaatagagaagactggcacattttgacagaatgttgccttgggtttattatttgcatcagatctgctcaatagtttagtgctgtatagattctgtgtttagaaggattccgagggtgtctgttgctgagcagagaaaaagctacacactatttgctatatcagccaggggaaatggaatgagatgagatatttgtcattcatgtggtagtgcaaagatctgcagctgtgctgccttacagaacctggttttccaccctctacatcatttcaaaactatataaatttgatcaattacttaacctttttaattctctattttcaattttatcacttgtaaaatgaagataataacagctaccctgattacctacagtgaatttagaggtcatagataaatgttctaacattatgcctggcacatgatagccaacatttacctagtgccttctattatcatgatttcttccctgacaactgagccactttttatctttagaaggcaccattttttaactattgccagtgtcatttgtgtaaaagtttcttagtaaagcagtctttgataatgattatgacttttctgtgtcctcaagaagggttccttgacttatataataaattcttctttgtctttcacatttaaaagggaaagtcaatattaatcaaatgagtgtgttcataaaagtaatgtcctcctcttcggaagaggaaaaacagcattggtttacccaaaatctgtttctgtgcttagaataaagatctagtgtctgaaatcataatggcattctaacaaaggattaaacaaataacttcagaaaacataatacaccttaatgatatttcaaagtatttatcaatgttattgtcaactttgaaaggtgagaattttgtaacatgatttgacaatgcttaactacaggttttatgtaaaaaaaaaactagtcacttacatgttcctcaaattattagttcatatgttacggaagaaaatgtttgccacatttctgaataaaagtcatcaaaatattgtgatctagatgtcatgtaaactgaattaccaagaccctatcttaagtgactctatcaagacccataaccagaagtaacaaaatctctgaaggaaaggatttctgcatgttttcaatatgacagaaaattattttttattgttctatgatgataatgatggcaatgcagtcccacctcacttttgaaaccagacttcagtgtttctctgaatacttttaagtgtggccaacagcaaagtggctgaagtagtaggattgaagactgttagccttaaggacaaaaatggtaatataattttcatcatactataattttacctaatattccttatattgaatgtcaggagaaatatattcatatatattatttccattaatgcattttaataacatatttagaatgttacattatttagcatctcagtagcaataaatagttttttatttctttatctttttaacactttgtaaagaaaatacattttactggtaagttatgcattgcataggggaaaacaaatggacaaaatgaacatatgaaaatcagctatgccttaatgattatattttatgtattttaaatatagtattcctaaatctattttacaaatgatgctcagtaaaatccttaacctctccattgcagcaggttcccagcatgaaggggctaaactaacaaagctaggggcctggcattagccccccagagttactgcaagcaggcctggagtactaaactaatctttggccccctgagatcttccagagacaaagtcaatcgactgaacccaccatattcctctatcaaactcccaagggaatcaaagaagataaaagcaaataccttatccaaagggcagcaacttccaagattgaaggaacatctgcccacacagattagaatgtaccagcatgagaactctggacgctaaaaaatccagggtgatcatcctccagatgatcatgctagttccccagcaatggttcttaaccaggctgaaatgaccgaaatgccagaaacagaattaagaatattgatagggatgaagattactgagattcaagagaaactcaaaacccaatccaaggagtctaaggaatacaatacaacaatacaagaactgaaagacaaaatagccattttaagaaaaaacaaagctgatctgatagagctgaaaaactcacttcaataatttcaaaatacaattgcaagtatcaacgcaaaatcaaccaagtggagcaaagaatctcagaggttaagtctggtactacaaattaattgtcatacaaaaataaagaaaaaagaataaagaatggacaaaacctttgagaactatgggattatgtaaaaagaccaaatctctggctccttggcatccctataggagaaagagtaagaaagaaagcaagttggaaaccatattttgggatataggccatgaaaattctccaacctcacccaagggccaacacttaaattcagaaaatacagagaacccctgtgagatactatacaaggtggccatccccaagaaatgtagccggaagattctcctaggtcaaaatgaaagaaaaaatgttaaatgctgctagaaagaggcagcaagtcacctacaaaggcaactacatcaggcaaacagtggatcttttagaagaaaccctaaaagcctgaagagattaggggcctatattcagtatattttttaagtgataatgcttcagatttcttcctacataattagaaaaaataatcacaacaaattggagaggaaatacaataaccttaaagataatctgggtcttatctaattccaaccaaaaatttcatatctagccaaactaagtttcataagtgaaagagattaagattcttttcagataagcaaatgttaaggaaatttgttagcacgtgacctgccttaaaagaggtccttaaaggagtgttaaatatggaaaggaaagactgttacaagacattataaaaacacactttagtacataaatcgacattctaaagcaactacacaatcaagtctgcataatggccagctaaaaacatgattaaaggatcatatctgcacatatcagtattaaccttgaatgtaaatgagctaaataacctaattaaaaggcatagagtggcatgctgaataaagaagaaagacccaactgtatgctgtcttcaagagaactatttcacaagcaatgacacacagaatctcaaattaaagggatggagaaaaatcaatcagacaaacagaaaagagaaaaaagcatgggttgctattttaatttaagaaaaaacagagtttaaacacacaagcaattaaaaagacaaagaagagcattacataattgtaaaagtttcaattcaacaagaaatcccagctatcctaaatatatacatgcccaacacaggggcatccagatttataaaacaagctcttagagacctacaaagagacttagataaccacacaccagtagtgggagacttccaacagcccactgacagtattagacagataatcaaggcagaaaattaacaaatatatttggaacctgaacttgacacttagccaaatggacctaacagacatagacagaactttccaccaaaaaacaacataatatacattcttctcatctgtacatgacacatactatataatcaaccacacaatcacccataagacaatcctcagcatatgcaacaaaattgaaatcataccaactgcactgtcagaccacagcacaataaaaatgtaaatcaatactaagaagatcactcaaaatcatacaaatacatcaaaatgaaaaaagctactcctggattacaatgtgggtaaacaatgagattaaggcagaaatcaaggaattatttgaaatgaataacaaagatacaacacatcagaatctctaggacacagctaaagcagtgttaaacaaaaataaacaaaccctaaagctagcagaagacaacaaaaaaccagagtcagatctgaactgaatgaaataaattaagacctgaaaaccatacaaaagatcaacaaatttagtggttgtttctttgaaaaaataaataagattgataagtaggctactgaaaaataaaggtctgaatatccacaatcagaaatgacaaaggggacattacttccaattccacagaaatacaaaaaaaaaaaaaaaccttcaagtaatattacaaacatgtctatgcacacaaactagaaaacctagaaaaactgataaattcctggaaatacaaccttgcaagattgaactaggaagaaattgcaaccctgaacagagaaataatgagttccaaaattaaataagtaatacaacgcctaccaaccagcaaaaggcttggaccagatatatccacagctgaattctaccagatgtataaagaagagctgcatcatttctgctgaaactattccaaaaacattgagaaggagcaactcctcctcactgattctatgagtcatgcatcattctgatatcaaaacctggcagaacacaacaacaataacaacaaaagaaaacttcaagccagtattcttgatggacataaatccaaaaatcctcagaaacaaacaaacaaacaaaaactagcaaaccaaatccagcagcattctaaaagctcattcaccatgatcaagtaggctttatccctgtgatgcaaggttggttcaacatatgcaaagttagtaaatatgattcaccacatcaacataattcacaacaaatccacatgatcatctcaatagatgcagaaaagtctgttgataaaattcagcagcccttgaggttaaaaacctccaccaaataaggcattgagtaaacataccacaaaatagtaagagccgtctatgacaaacccaccggaaatatcatactgaatgagcaaaagcaggaagtgtcccctgctgagaaccagaggaagaaaagaatgcccactcctaccattcctatttaacatagtacttcaagtcctagccagagcaataaggcaagggaaaaaaaataaaaatatacaaataggaagagaggaagtcaaactgtctctatgtgcagattatatgattctatatgtaggaaaccccatagtctctgcccaaaagcacctagatctgataaacaaattcagaaaagttttagaatacaaaatcaatgtacaaaaatcagtagcatttctatacactaacaacatccaagatgagagccaaatcaagaaggtaattgctttcacaatagtcacaaaaacgtaaaatacctaaaaatatagttaaccagggaggcaaaaggtacctataatgagaattacaaaacattgaggaaataaatcagaaataacataacgggaaaaacattccatactcatatatagcaagaatcaatactgtaaaaagtgcaatacttcccaaagcaatttaaaagaacaaagctggaggcatcacattacctaacttcaaactacagtgtaaggctgcaataaccaaaacagcatggtattggtaaaaaagcagacacatagaccaatgggacagaatagacaacccagaaataaagccacacacccctacaaccatctgctcttagacaaaattgacaaacaagcaatggtgaaacaattcagtgttcaacaaatggagctggggtaactggctagccatgtgcagaagattgaaattggactcattctattcaccacatacaaaaatcaactcaagatgaattaaatacttcaatataaaactcaaaactttagaaaccctagaagataacccaagaaataccattctggacataggcaaaattttacaatgaagatgccaaaagcaattgcaaccaaaacaaaaattgacaaccgggacataatttaactaaagaacttctgcatagtacatgaaactatcaagtgtaaacagactttgatagtttgaacttctgcatagtacatgaaactatcaagtgtaaacagactttgatagtgtaaacctacagaatgggagagaatatttgcaaattgtgcctctgacaaaggtctaatatccggaatttctaaggaacttaaattaagaagcaaaacaaacaaacaaaaaccacacaaataaacaacccattaaaaactgggcaaaagacatgcagagacactttcagaaagaagacatacatgcagctaacaagcatgtgaaaaacgctcattatcactaattattagagaaatgtgaataaaaatcacaatgagataccatcttacatcaatcagaatggttattattaaaaagtcaaaataacagatgcctgcatggttgcaaagaaaaggaacacttataccttgctggtgggaatgtaagttgattaagccattgtggaaagcagtttggagatttctcaaaaaacttaaaacagaactaccatttggttcaacaatcccattaattgagcacattcccaaagaaatataaatcattctaccataaaggcacatgcatgagtatgttcattgtagcactattcacaatatcaaagacatggaatcaatcaaaatgcccatcagtagtggactggataaagaaaatgcagcacttatgcagcatgtcatattacacagccataaaaacagaacaagattatgtcctttgcaacaacattgatgaatgtcattgttctaagtgaactaatgaaggaacagaaaaccaaacactgcatgttctcacttataagtaggagctaaactttgagtactcatggacacaaataagggattcagagacactgatgcctacttgagagtttagggtaaggattgaaaaactacttatcagctactataattattaccttgggtatgaaataatctgtacattgcacccccatgacacctaatttacttatataacaaacctgcatgtgtacctatgaacctaaaataattaaaaaaaatacatgctaagattaatccatatcagttatttccagaactgtcatttgaatgtggtagagatataattaatataattgaaagaatagttagaatgcctgggttcaaattatggctccatcacttgttagatatgcaattttgtgcagtttatctcatctccccaaacctcaatttcatcacatataaaatattttaagcgtaatatttcataggttgtacttcttgatctataatcagtttttacaaccttttgaatttgtttatgacataagtgaccatagcaccactattatccataccatgagttgttctacaaaaagtgcatagagaccattttcttctagaacagtgatttgactataatagattatcatgaacattttaagctttatctgatttgaagaatatttactttctcaaatattacttaatatttactggctcttggtcaggtggcatggattcacattttgattctatcattcactactgcataagtctgatagttttactcaaattataggtgattatagacaggtatctgatgatggatttttttcaaaaatttctgaacagtattgatagatgtggtatcaacggtacagtgaaacttgccatttctctttctcagagagtggagattaggcatcttaaaaagagaagagcatattgagaggtaaacagcataattactcttaacagtgagccagatattttgaatgctcagatgtataaagctgagtctcatccaactaaatatgaatggttgtctgccttagcagagtattttaatcacattcatcacctccagagtaatgctgattacaaggaactccattaaaataaaatgcatttgatattccaaatagttttcatgatagtatggctgaaatatgtacatttaaattatctttaatatagaaaacaaactgatctttctaacttccaagtcaatacacaacttaccatccccacttttagctataactcaaccctagaaaagtactgttagaaatcaaatataaagtaaaaatgagtgtattgggtttcatgttatttagtcaattatagggctaataggcctataagaatttaaattgcattgaaaacttgaagaaatatgacatgcagagattatcctagtagataaaattccttagatggtatgggatagtaatataaatttttagaattatttccatgtttcctactttaagttttacacctaccatacctggagaataggatatgtaggtatttgaagacttaaccacaggaaatgggggcgaggaagacatattttaatttattttttcaatacggtgtctcgctctgttgcccaggctgtagtgcagtggcgcgatctcggctcattgcaacgtccgcctcccaggttcaaacgatcctcgtgcctcaacctcctgagtagctgggactaccagtgcatgccaccatgcccggctattttttgtatttttactagagacgggtttcaccatgtgggccaagctggtctcacactcctgaccttagtgatcttcccaccttggcctcccaaagtgctgggattacaggcatgagccatggcgcccagccagaaagacacattttaaatcttagaaaataagatgcaggaaatcctgttgagaacatagaagcaatcttcatgatgttatacagacctacttctctaatataattctaatagggtttacacatgttaatagtaagagatgtggaacactgtagctgtacttggtatactcctagaggctgacctctataggtaataaatgaaactggaccatggactacttacctaagctacagaacctagagtaaattgaggtggtaggcttgcctgatcagccccaaagaagggtcagagaaattaagtaagactcaactgacaaaatttgttgcaaactccagggacagtaaagtttcttaggaaaaatgagtagtacatcatgcaacagtaacttagtactatagataccactgttcttgcccaggtccatataaaattgagaggaaaggagtctaaataaatcatattttgatatattttccattggaagtaacttgctggtatagaaacttgaaatttgaaacaactacttctgtccagtttgccatttgcaacagctaccaagactttattctcagaagttacaaaaataacaaatggagactaaataaatacacaaataataaaataattaaaatagtaaaaataaagcagcatgtagatttaagattcctgaaaatacacagcctatctgactttttgaagcctgcatttatttcaaaataatacaaggtctttcaccagtaccaaaactgttttgggacagtattctgtgattctcacttcatgaaaaactggctatttcatttcaacaaacacacattacatgtttaccagacataatgcttagggttgagtatacaaagataaaaaaaaccacatgctggctgtttcatcaaatacatagaaacctaaaagaataaagaaacccataaagagatcattttaagaaggggaataaaggacatgatataaactcagagcaggactgcttagccccaatcactagattggtcatcacttttgggatggcataatttctaacataatctttaaatgcaggtaatgagttaagtaagtaaataagtcagagtttatcatgttttagcaacaggaaaagcatgagaaaatatatgcaattataaaataacatgcatatgttgtaggaactatattctatataattgtaacataaacatcaagttatgcatattagtggaaaaggctgtagaagcaggccaagaccacgacacagaggacatgttgtatgccatatggataatcacaatagagccagagacttgctaaatagaagtggaataaggccagttttttcttgtggataaatcactatggcaacattgcggatggtgaatttcaagagtgcaagataaaaagcaaaaggtcatggctcatatttggtattatatttgcatcaagtaaaatagactaacccaagttggactgtgacaaatatgctgaatcttacagagttgaatattttttatccagatgataaaacatataatgtattgaatggcaaaaattccatctatgtagatatatagaaaatgaagaaaatttttgattagacattatattacatagatcggacattagatctgacattctattacagcagccatgtgaattttgcagttacatggttttactgtttctctttgttttctctctttatagtcaggattttacctgagtatctagattatttctcagcttttattttacttaatctatagtgttggcctcctcttaggcctaaactgaactatttcaaatatctgactcctaattgtgcaaccttaaggctgtcagaatcaccccaatgcaggccagaataacgtgtgtgtgtgtgtgtgtgtgtgcgcgcgcgtgcgtgtggtcatctttattcttggcatgcttaaatagattttcataactgttccctcagataacgagcaataatagctctaatgatctctgaaaaaaaggaaacaaaatatcagaagcaaacatttgttttcattattttctcagaggagttttacaatttttatcgcttgagttagacatcatgttgtaaagtgagtgccttagttttagggaagaataattcaagattgactatcaaaacctgaccgtggatatttgctttaaattcttaccaccactgattatcttctttcattccaaagaaaaagaagagaaaaccaaacaattcattactatatggaacttacacctccctctgataagaaatcagttgctcaagcactgaaacaagatctttgcaaatgcattctttttagtatttgaaacttaatcacatcgtatagaaacagaattttatacgtaagtaaagaatactatgatcggttccaagattctccacttattcttggattgattgaagagagaaggaaatacacctactccatacattattatacattaatgaagaaatacacatttccttcaaaagttatactgcacaatctatttaagcctcagttttattttctgtaaatgaatatgaggataataatatcaataacaattgtaataatatctacttccattgttgttgtgaggatcaaatgacagggggtctttagtatatgcctggcacaaggaaacaaggaaacacacaagtcttagcaattacaaataattcatatatatatatatatacatatatatatatatataaaatcactttaaaacaattctaatacatattaatgtatagttatgggagtaatgtgtgtgtgtgtgtatatatatattatttatgcaggacatatctaaaatatatatattcataaatatatgtgcaggacatatcttaatatgtatataaaataaggcttacattgaatgagtcaataaacacagaatgaaagattgctgaacttatggttttactttaaccagatttttaggaattttccactcatgcaattgactaggataatgtatatgaatgtgtatatgtgtgtaagtgttttttaacacctttatgtatatatatattacatatttatatgtaatatatgtaataaatatgtactagacatgtaataaatatgtatatattacatatttagatgtgtcctgcatatatacttaaataaaaatataaatctgcatctatatacacatttaaatgtgtcctgcataaatgtagcaattcacaatgctactgacgtgatcctaccaagcaaacgtttgagtaatccttcttcctctaattgtattcattcagatcaatgcaatcagtcccactcaagtggacgatcatgcaatgattctttacaaaattggtaaatgaaacatcagttttcctagtgacaaaagcttgtatctaagggttttacaaacactgagaaatcaataaatagtgctggaaaagtattgtgaaggatattgttagtttcaaaattaatcatatttagtttaatattgtttaataatactgattagatttttactgtaggttaaatttctgagcgaagcatttctctctcaagactatgttgcccaccacacagttttagaatagcagtatattatgttattattagcctatttattttctactggctgctgcagaaaataaacacctctataatgaccacagtctagatttcagcctgtgtcaaaaggattttgaattatacttcatttttagcttttgctcccaccctttgcacaaagtagaagagacagaacagaaatgttttcctaattgctgttgcaagaaatacttcatctagaaaaaaatgaggaattaatttattttagcaggaaaaaatgaacaataaaaaatacatagagtgaaaagttgtagtcttctaatacctcttttttacttgatgactcaactttttgggaggtttctgggtctaccacctaattatttttactcaaattttattcctggaaggaagatggccatatgcagtaatttatggttcaaaccagaatacttttgagggtgagagcggtattgttaataataatgcagcaggcataaaccggattgctttgggaaaaccagtatatatgatcacctgtatataagggactacaatttcagtacttgacagcatggcaacactctatttagcaatgttttaggtttatttaatggtcacttcccttgccatgtggtaattacatctgctaaaagggtaagaggctgcttgctgtcacaactcaggctattcacatacttaatagacctgaacaaatactcagaagagtttcattgaatagctgtgtgtaccattgagataatctatcatttaacgtttcaaacaaaaatgatatctttcctctgatacttcaagtcattgcaacatatcagtaaaacagcattaaggaagtgttgataacatatcttttgaatgctgataatgtgactaggtctagtgacatctttcatatatttaatctgacaaacatgaacatacaacacttgaaaataagaggacttcttgatttatagggagtatattgtcactatgagttttttcatgccatagatatccattcctagggcaaaacaataaggacaacgtacaaaatcaaatctgctcatgtatcacatggatgaaaactaaggaatcatagaattctgagtaggtatagaccttaaagttcattctattttccaacattttattaaaaataatcacctttataatatccataatttatgagtatatttttctgactataaatgtccaaaaatgtcgataaattcctcaaaagaaagcccagttgaaaatatacaggagtttattcattcaaccttaatttgaaaaactaataaaagttattatttttttaaaccttacttctaatgtcttgaacaatgctgtagagtttactcagattttaaaattataatccttaagtagtgggactaagcaaacctgtattaaaccattttgcaatgtataatatcttctatttctataattatcatggattaacttccagatatgtcataagtaattgtattgagatttgtataatgtttaattgcttctgagttttctgcctttgattatacaaatgaatattacacatccttaaattctgaaatacttacaggtatttctcgtatatacgtagtagtgtaatttgttccctgaggcactcctaaatttgaatgtaaagagtatagaaattactttttccctttacaaggtacaatttaattatcaattcttttcctttacttaatcttcaaagtttcaaaaagggagagacaaagaaaatctattgtcagtagaaaaatgaatatttaaaaaagcagaaaacatcattgggtagttaggctaaaagaaataatctgttctccaagttcaaacaaagcatttcgaaattcattgttttaagcattaatttatattgctaaattttaaaagagatttaaaaaatcataacagctaagacacaacaagcagtagaagagacatatgaagaaatactacactgatggaagagacaatgatgaaaagaacatgtcatttgaagcaggattgtgataaggagagttttgaaaaagtttgagtgctatagaaaatgtctcatatttatagcagaggttagaaagaactcagatgtcaatgcaaataatggaattataggttgatgggtgcaccctgttctccagctggaaaaagtgtagttggggctttgggtgtacaaaactaagggggcagtaatttagttcatatagccacggaaaataacattctaaactagaattggaggctacatttagcaccccctaagatgatgagaagagctaaccaactgggttgaagattggtaccagtttaaactgaaacactagaaagaattaatcatcttatgagttatagcaagattcatgtcctaaattttaattatcataataattttaaacagatggatagtttggataaactttgaacttcactatgcagtaaaacagattttagtattccatgttttaaatagacctgtaagagatgtatgatagaaaacgttggcacagatgaaaattacgaagatagcttttaatttctacctcaaatttttaaaagattatctctttatgccataggtaatgggcatcataaatcactagctgcaaaagcaggtaagtgtgaacattccttcaatgccttggcataaatctagaacagttatttctttagactttatttcatagaattcattcaatttggcatgtgttcatagatgtggctgtttgtaactgaatgaagttaaaacacacacacacacacatacacacacacatacacacacagggcctgatttcaagtttttttacatttaatagtccacattaaagaaaatattcttcaacaaaattaaatttcaaaactccttacatgagtcattgtacaacttaatactgtgaacagacgcacgagaggaatatatttaggtaaataaaacttgtacaggttggagaacaatattctacctttcatagtagcaccgtagtgttgttcaaattgcagctttatgctaattagtgttgttctggctttttaaaacgtttaagaagtaacagtttaaataaattccgaattgattaagtagtcagtattccacagatcatggaagattttagaattctggatatatttccattcatctgtataatcagtgtctgggcaaataatcaatatgtctaaaatcttcatgacgaaacacttaaatatttcctgacaaagctctaagaacattttaatatatctggccatatgcctgtaaggttgtattacattttacaggtatcttatttatttaaaatttgaaaattgcgttttctaaatttactgaatttctttccctagacctgaaaaggcaaaacatgttttatcaaaaaggttaaatcctttcaccacaaactccattttgacttttcccttgataaacattgaagtaatattttattttgctttcacagaagaaccaaatggctcacattaattctgtgtcttatgtttatcaatgaaccaatagattgtgatgaacagaatcaaggctttgaagttgaaagtgtctctgactgatgctacttcacctctgtgagactcagttttcacatcagaaacactggccacgtagcagcccctttattcttcggttatattttctttcacaacttcacagttatacaggacttagaaagaacaatgtcagacagactaaagtgggacactgaactgtaatcagagaaggagatctctttttgagaaaggtgtcagatatcctgtgaagtgaactgtctatcgcaaacatcactggtgtctctaaacagctccaccagtcgcaactaaaagttagcctttttcagcagtgtagagatgagaagagagactgataggtaatatgaaataatagaacttacagcacgtattcagattgtatttgtgtccagtcgcaatgtataggttcatacatgtaaacttcaaacacatatgtacagtttaagcttcactctttatcctcattaggattcaacaaaactgttttgtaaaaaggccttaaacattcaattaatagcagtataatctaattccaatataggaatcataactttcaaaaagatccatttgattcaatttttctaaagtacataataaaagtcatcttataggcttcttacatatcttaggatatcttttagagtcatagtgaattggcttcattaactggtcttgaggtttgggaagttaagttcttcaagcccatggctaatagatttaacattcaagaccatccatttgatatattttcaaacttcacaggactcctgtttttattcccaaactataaccttttgaggtcaaaaataaaactttttaaatcttcatgtattctattcacttaatgttataatttttataacttctatctttgtggtataaacaaatatattcaagtgtgaaaaattttaacatcatgttgtgtggtaaatttatttacattcagttttggggtagaaagtgtattcttaaaaagtttaaaaccaactgttttcatgattaagctaatagaaattattaagcacatatttgtttgccaagagaaatattgagattgctgatactcatttttttttctccaagagtaaactatagtgagttccacaaatgcagtaaatatatctgttttagttcaccactatatttcaagtgcaatgctcggtttagacttaaaataattttccttatgcaaggtaactgactatatagaaattatttgaatagagtttgatttttctatccattaagaaattaccaatatggaaaataaatttccttaagggaaggtggaggcataggcagattgattctgctcaccctccatcttattcccccaagtgtagattggtcttgttaaatcgcccatgcacttgttgcagaaacagtcaaaatggcgggttagaggctgttagcatgcctcagccactcggaaatagcaaaacagtgcataaagattgacactgtgagctttaattcacgaaggaaagtgggaattcaccagaataacaaaggacactccagatccaagggagaagatagtgggcaagccaccccctgatggcgtttggctggtaaaacgatatgggtgcagtggaacattttctttcatggccagacatatctccaggcttttgatgcaccatatctcctgggataggagcttcagttgccattcttttcccacacagacaatttagtacagcagcactccctccacgtcacactcagacatacctccagtcatttggcacacacacgtccacagattagtagtttgagccattcatcccttcccatgcaaagaccttattacagcagcagtttctctgcttttggccagggtatatttgcaggcatttgacacacacattctcttggcttaggaatctgtgctgcccctcccttcaggtgcagagattgtggtacattggtgctctctcttcttgatgcccagacatatctctggaatttggagcactcactcttctaggttatgatttaggccacctcactcttcccatgcagagaacctgaggcagcagaagtttctagaattcatgcctaggcacatctcctggttctcacaggctgcccactgggacccttttcaaagctgatgcatgtgcatgccattgggaaacctgtgggtgggcctgctcagtctggtcccacacatcttggatctttcctaaggaggaaggtgataccactgtgcattccacagatcaacccatggtctgaggcaacagagagcttctcccattaaaaaaggattaggtatatacccacctattttgaccacaggtggctcatacccataagtgacacctactggcctagagtttgaaatgcaaaacacaatagaaaatgatattgattcttcctatccatgagcatggaatgttcttccatttgtttgtatcctctttaatttcattgagcagtggtttgtagttctccttgaagaggtccttcgcgtcccttgtaaggtggattcctagctattttattctctttgaagcaattgtgaatgggagttcactcatgatttggctctctgtttgtctgttattgatatataagaatgcttgtgatttttgtacattgattttgtatcctgagactttgctgaagttgcttatcagcttaaggagattttgggctgagtgaaaatggccataccacccaaggtaaatcatagattcaatgccatccccatcaagctaccaatgactttcttcacagaactggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatataaatcaatggaacagaacagagccctcagaaataaggccgcatatctacaactatctgatctttgacaaacctgagaagaacaagcaatggggaaaggattccctatttaaaaaatggtgctgggaaaactggctagctatatgtagaaagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttcccaaaagaagatatttatgcagccaaaaaacgcatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggaccataaatcatgctgctataaagacacatgcacacgtatgtttactgcggcactattcataatagcgaagacttggaaccaacccaaatgtccaacaatgataaactggattaagaaaatgtggcacatatacaccatggaatactatgcagccataaaaaatgatgagttcatgtcctttgtagggacacggatgaaattggaaatcatcattctcagtaaaatatcacaaggacaaaaaaccaaacaccgcacagtctcactcatagatgggaattgaacaatgggaacacgtggacacaggagggtgaacatcacactctggggactgttgtggggtgcggggagaggggagggatagcattgggagatatacctaatgctaggtgacgagttagtgggtgcagcgcaccagcatgtcacatgtatacataggtaactaacctgcacattgtgcacatgtaccctaaaacttgaagtataataataataataataaaaagaaaatgagctgacacaagtcaacagacaagtcaacagcagtggggaatgagataggcttcctgagatctccatgattccagtccaataggaagcattgagcctgctcacatgcacagtgcattgctactaaaaataacattcaggaaagccatcatacaaaggctatatgtaaccaaagaacttatacagactctttagccctgaaagcacccagaaccaaagccagaaggaccctacaaatcatacattatagacacctcctgaaggagaaaaattccatccaaattaaaacaaattcaaaaaataaggagagatagcttatctagatgataaagaaccagagaaacaactatgaaagtatgaaaaacagagtgccacaacacttcgaaagatcacactgattcttttttttttttttttttttcttttgagatgaagtctcactctgttgcccaagctggaatgcagtggtacaatctcggctcactgcaacctccacctcctgggttcaagcaattcgattctcctgcctcagcctcccaagtagctggcactacaggcatgcaccaccatgtccagctaatttttgtatttttagtagagacggggtttcactatgttggccaggctggtcttgaactcctgacgtcctgatccacccgcctcagtctcccaaagtgctaggattacaggcatgagccactgcacccggtccacactgattctttaccaatgaatctaaactaaatgaaatctttgaaataccccatgaaaaattaaaaatattgattttaaagaagctcaatgaaatccaagacaaagctgaaaaaaacacaaagaaatcagaagaacaattcagaatattaaaaaagggtagatatcattaaaaaacaaacagaatttctagaaataaaaaattcattaaaataattacaaaatacagttgaaagttttaacagtaggctataccaactggaagaaataacttcagagctggaagacagatcttttcaattaatccagtaagataaaaattaacaaagagtttttttaaaaacttaacaaagcctttgagaaacataggattatgtagtgtccaaacctacaaactgtaagtattccagaggaagatgaagaaaaagtaaaatgtaaggaaaatgaagaaataattcagcaaaactcccatgggattgtcttttttgtgcaaatggtagctatttttattatttccttttttttttaaattttactttaagttctgggatacgagtgcagaatgtgtaggtggttacacagatatatgtgtgccatggtgatttgctgcacttatcaacctgttatctaggttttaagccccacatgcattagctatttgtcctaatgctctccctcacctcagccgccaccccccgactggccccggtgtgtttttttccccttcgtgtgtccatgtgttctcattgttcaattcccacttatgagtgagaatatccagtgtttggttttttgttcctttgttagtttgctgaggatgatggcttccagcatcatccatgttcctccaaatgacatgatctcattctttttatggctgcatagtattccatggtgtgtatgtaccatattttctttatccagtctactattgatgggtatttgggttggttccatgtctttgatattgtaaatagtgtaaatcaaaaccacaatgagataccatctcacaccagtcagagtgatgattattaacaagtcaagaaacaatagatgctggtgaggctgtggagaaataggaaagcttttacactcttggtgggtatgtaaattagttcaaccattgtggaagatagtatggtgattattcaaggatatagaaccagaaatgccatttgaccaagtaatcccattactgggtatatacccaaaggaatataaatcattccactataaagatacatgcacaagcatgtttattgcagcacttggattgtcttgggagaaatttggacatctagatacaaaaggctcagagaattcctagtagataaattggaaaagcctcactaatgcatatagtcatcagaattttcaaagtcaaagtggaaaaaaaaatcctaaaatcagcaagagagaagcatctaatcacctataaagaaaatcgcatcaaactaacaaaagacttttcagcagaaaatctacaagccaaaagagattggaagactatttttagtctcttccaaaaaaaaataccagctaacaattttatatcctgccaaatgaagattcacaaatgaagatgaaatagtctttccaagacaaacgaaaggaattcattactaccagatcaccttacaagaaactttcagtacaactttcttcacaacaaagtttcaatgcaacaaggtttaactatctatcctaaatatatgtgcatccaacaccagaacactctgattcataaaacaaatactactggtcctatgaatagagatagacagttatacaataatagtggaggacttcaacaccctattgacaccactagactgatcactgaagcagaaaatcagcaaagaaacttaacttaaactggactatagaccaagtagacataataggtatttacattacatttcatcctaaaccacagaaaatacattattttatctttggatagagcattctcctaaaccgaccatatgcttagccatccagcaagtctccataattttttaacaataaatcatatcaagtatcttcttggatcacagtggaataaaattagaaattaataccaagagtaattctcaaaactacacaagtaaatggactaaacaacttgcttctgaatgacatttgtgtaagcaacaaaattaaggcagaaatcaggaaagtttttgaagcaattgaaaatacagacacaatatttcaaaagctctgggatacaacaaagaaaagtactaaaggcaaagtttatagtgttaaatgtctacatcaaaaagaatgatctcaaagtaacatccaaattttgcacctcaagcaactagaaaaaggacaaaccagacccaaatctagcagaagaaaaaaaataacaaagattatagtaaaactaaatgagatcaagaccaaataaataacaaaaaggaccaattaacagctagttctttgaaaggataaacaaaattgacagactgctagttaaattaaccaaggaaagaaagagattcaaagaagtacaatgagaagtggtaaaagtgacattaaaactgatactacagaaatacaaaagattataagagactactatgaacacctttatgtgcataatctagaaagcttagagaaaatgcatttctagaaaaacagacaacttcccaagattgaagtaggataaaacagaaatcctaaatagacccataatgactaacaaagttgaatcatcaacaaacatctaccaacaacaaaaagtccaagaacagaaagattcaaagccaaatttcatgagatatacaaagaagagccaatactcattttactgacactatttcaagccatcaaggaggaaagactcctccttctctcttttaacaaaagtggtatcatcttgataacaaaatcgagcgaggcgacaatgtaaaagaaagctactggccaatatccttgatgtgcctaatgcaaaaatcttcaacaaaatactagcaaaccaaatccaacagcacatcaaatatacaatacaccatgatccagtgggtttatccaaatgatgtaaggatggttcaacatacggtaatcaataaatacggtttaccacataaagagaactaaaatagaaaaaacatatgattatctcaagagatgcagaaaattcatctgataaaatcaacacccctttatgatgaaaaccctcaacaaattaaacattgagaaacatacctcaatataataagagccatgtatgacaagtcaacaaccaaaattatgctgaataagggaaagttgaaaacaatctccataagaactggaacaagacaggatgtcaactcttattcttattcaacatagtagtggaagtcacttgtaatgtcatttttaccatttatcattattcttctgggaatttctcttatctcttggttaatttaactagcagtcaattctgtttatccactcaaataactaattgcttgtttagttgatcctttgtgttgtttatttggtcttgatcttatatagttctgctatgatctttgcctgatctttcttcaggcaaaataaagaaaaggcattgcaattgggaccaaaaaaaaaaaaaaatgtcaaattatctctgttaaatgatggcataattgtgtatcagaaaaccctaatgactcccccagaagacctctccacttgataaatgacttcagtaaaatttgaagacacaaaatctgtgtacaaaaatcagtagcatttctatacaccaataacattcaagctgagaaccaaatcaagaatcaatctcatttaaaatagctgcaaaaaataaaataaaatacctagagatacaattaagcaaaatagttaaatatctgtacaagaagaatgacaaacactgatgaaagaaattatacatgacaaaaacaaatggaaaaccatcctatgctcatggattggaagaatcaacatcattaaagtaaacatactgcacaaatcaatctacagattcaatgcaatgcctatcaatttagcaatgttatttcttacataattataaaaaaaaaatcttaatgtttagatggaagcaaaatagatcccaaatagccaaagcaatcctaagcaaaaaggacgaatctagaggaatcacattgtgtgatttcaaattatataatactataagtctatagtaattaagatagcatgctactagtacaaaaatggagacatagatcaatggaacagaaaagataactcagaattaaagcacacacttacaatcagtcgatcttcaaaatgttaacaaaagtaaatagggaggaaagatgctctattcaataaatgatgctgggaaaattggctagccacgtgcagaataatgaaactggaaccatatctctcactgtgtacaaaaatcaagtcaaagtggattaaagacttaaacataagaccagaaactataaaatcctacaagaaaacctagaaaaatctcttctggacatttgccttagcaaataatttataatgatgaccctgaaagtaaatgcaacaaaaacaaaatagacaaatgggtcttaattaaactaaacagcttttgcacaacaaaataaataattaacagattaaacagataacctaaacaatgggagaaaatattttcaaatcatgcttctgacagaagactaatatccagaatctacaagaaactcgaacaactcaacaagaaaaaaaataattccactgaagagtgggcaaaaacacggacatttcttaaaagaagaaatacatacagccaacaaacacataaaaaattgctaaacatcagtaatcatcagagaaatgcaagttaaaatcacaatgagatataatctcacccagtcagaatggttaatattaaaagtcaaaaaacaagagatgttggtgtggatgtcaagaaacggcaattgtttatacactgttggtgagaatgttaatcagttcatcttctattaaaaacagtatgtagatttctcaaagaagtaaaagtagaactaccgttcaacccagcaatctcatccctgagtatctacacaaaggtaaagaaatcactgtaggaaaaaggcatctgcatttgtatgttcaacacaatactactcataataggaaagtaatggaatcaacctaagtgtccaacagcagttgactgaataaggaaaatgtggtgtatacatcatgacaaactgtgcagccattaaaaagaataaaattatgtcctttacagcaacttggatggaactagaggtcattatcctaagtgaactcagaaaataaaatattccatgttctcattcataagtggaaactaaacaagaggtacatatagatgcaaagatggaaataacacacctcagagactcaaaaatgagcgagggtagaaaaagtttgagggttgaaaattacctattggttacaaagctcactatttggctaatggatagagtagaagcccagtccctaaccaatatacaatataattatgtaacaaatatgcatatatacccccgaatctaaaataaaattaaaattaaaaaaagaaattaatattagctgtagagagtagtatatcttcactgaaaagttatatgttaattttgtatggtgcaccagaatatataaaagtatatttacagtacataaaaattgtaacaaaatatatatttccttttaaaatggtttctggaataaacgactcaacagaaaagcaagactaaaggtaaacaagaaagctatatacatataggtttcttatatatgtgtgttagtatacatatatacatatatataattttagattcaggtggcacatatacatatttgttacattattatattgcatagtggtggggattgggcttctactctacccattagccaaatagtacatatatatatagatatagatatagatatagatatataaatagatacacacatgcacacctatgcacacatacatacatatatttaaaaacacagctaatgtataccttacatatatattacatacacatatattttaaaagcatgttcccattagtccgaaacacagaaatggattttatgaatttgtatgccagaataagacatcacattgagttgtagaatattccaacactgtgggttcatgagccattctgaaaaataaattacaccaataatggattccaatactttaaccatttcttgcgaaattttctatatattaatattactaatttgtaaaaatatttacattatagtcacagacactaaaaaccttaaaatcattgaagaaaatgtccattttcttagtaaatgaatgaatatttaaattatacagtaatgagcgaaatttagtaatgaactgaagtttaattcaaaattacaaattagcagcttagatcaggcatgattcctcatgccagtaatcccagcaatttgggagaccaaggtggaaggatcacttgaactcagaagtctgagacgagtctgtgcaacacagtaagacctcatctctacaattgtttatgtttatataaatataattatatatataattatatatatatataattggaaactcatttctctgattaaacaaaggaatgtaattaataaaacactgcaacctcattattcataaagaaatagtctacaatttgtatttcactctaagcaactcatttaggagcttgaaaattttatttttacagttttttaaagcacaaaatgagcacattcaagctaaaactgataaaatgggaataataccatccatgtgagtggctgagcctagtaataatttgcagtaaatattatcacaaaaagttggaactggaattcttgggaaactgttttctgctgaataatttcaagttggaattcagttctggtaaaaaaaaattactgctgatatgcactaacttgattgtcacaggttagcatgtaaatgaagaaagatttaagcaggtacctgtctaaattaatgtaggcagctgttacaagtacatgcattcaaacctcagggcatagctctgcctctctaaaaaggacttgcccaagatcagaatatagaataagagctttacattttatctttatttaaattctccctcccctttttgtggaattgtgagtgagcagcaatactacatgccttttataaccctttctaaaaatatattgaccacagttttactaacagttagaaaattggagtatgatctcaaatatacttaatgaagacacacattccacagaaaaaaattagtttaaatttagtttcctaagaaaataattattattatagagaaactattttgaaaaaggagataagaatttaaaatatttgtaaaataataaagttgattctccagtcatacctcaaaatcagtttcatctttagcacatttctacccatcaggggtgtgtgtgtgtgtgtgtgtgtgtgtgtgtgtgtgtgtgtgtgtatttgaattgacagtgaatagctataaaataaagtggtatgaaacaggaccgaaaatgctagagaaagagaatgatgagagggcacaggtcaaataataaaatgagagatatggaattcagaacttggttttcaatgaagatcatcgagattcacaacaaagtataaatgcaatccaagtaatctaaggaatctagcaaaatgacataagagctgaaagacaaaatattcatttataaaaggaacaaactgatctgatgaagctaaaaagctgactacaaaaattttgaaaaacaatcaaaagcactacacagcagaataggccaagctgaagaaaatctcagagctctaagactggttcttcaggtcaactcattcggattaaaaagaagaaaaaaaaaacagagtaaacaaaataaacaaaatctctgagaaatatgggattatgtaatgagaccaaacctgaaattaatttgcatctctgaaagaaagagagagattgcaagaaacttggaaaatatttttgtgggtattaacattaaccatggaaatgtctccaatattgctagagaggttgacatgaaaactcaggaaagacatttgagaactatactcaaacacttgactagatgagcctaacagatatctatagatttctccaacaaaaaacagcagaatatacattcttcttacctgcacatggtacactaaaatcaaccagatgattttccatgaagcaattctcaacaaattaaaaaaaacacatgcacacaaaatcatatcaaccacattgagaccacagcacaataaaaatagaaatcaatacacgggagatctctcaaaactataccattacatagaaatgaaacaatctgttcttgaatcacttttgggtaaacaatgaaattaaagcagaaaacaagaaattatttgaaactaatgaaacaaagatacaacataccagactctgggacacagctaaagcagtgttaagaggaaagtttctagcactaactgcccacatcaaaaagacagatttcacactaacaacctaacaccacactgacaggaactagaataacaagagcaaaccaatcccatagatagaagaagacaagaaataaccaaaatcagacctgaactgaacaaaactgagatgcatcaaaccatactgaagaccaacaaaaatatgttggttctttgaaacaataagattaatagactggtagctagactagaaaacatgacagaagatccaactaaatacaatgagacgtgacaaaggggatattaccactgatttcaaagaaataaaacaaaccctcagagaatctggtgcagatttctagtcacataaactagaaaaccttgaaggaataaataagttcctggaatcacacaacctcctaagattgaaccagaaagaaattgcaaccctgaatacagcattaatgagttacaaaattgaattagcagtaacaaaccaaccaaccagaataagccctataccagatatatttacagctgaattctacaaagtggcttaacaaaatctggtaccaatcctactgaaactattccaaaaaactgaggagggacttctccctaacttactctatgaggccagcattattctgataccaaaacctggcagaaacatgaaggtaaaagagaacttcaggctaattactgtggtgaatgtagatgcaaaaatcctcaacaaaatactagcaaactgaatccagcagcatatcaaaaagttaatcaaccaaaattatgaaggctttattcctgggatgcaaggttagttccacatttgcaacacaataaaatgattcagcgatccatcgtataaacagaactataaaccaaaccacgtgattatctcaatagacacagaaaagacttttgataaaattcagtgtccctttatggtacacatcctgaacaaagaagacatcattttgaatatacctcaaaatataatagccttctattgactgacccacagagaacatcatactgaatcggcacatgctggaagaattcttcttgagaactggaacaagacaaggatgcccagtttcaccaatcctgttcaacatgatattggaagtcctaaacagaggcataatgcaagaggaagaaataaaatgcatccaaatagagaggtattcaaactatctctgtagacaatgggattctatgcctagaaaaccccatagtccctgcccaaacactcctagaattgataacgtcagcaaagtttcaggatacaaaattaatgcacaaaaattgtagcatttctatacatcaatagtgtccaaggtgagagccaatcaagagcacaattgcattcataatagctgcaaataaataaaatacctagaaaaacagctaactagggaggtgaaaatatttacaattagaattataaaacactgctgaaagaaatcagaaatgaaacaaacaaatggaaatacataccatgctcatggataacaagaatcattatagtaaaaagggcatactgtccaaagctactacaaattcaatgctattccattcaaactaccaatgtcatttttcacataattacaaaaaactattcaaaatttacatgaaaccaaaaagagcctgaatagccaaagcaatcctaaacaaaaacaacaaagttgaaagcatcacactacctgactttaaattatacgacaaggcaataataaccagaacagcatgatactggtacaaaaagaaacatataaatcaatggaacaggttaaagaacacagaaataaagctacacatttataaccatctaatctgggacaaagtcaactaaaacaaccaatgggaaacaactccctattcaataaatgaagctgcagcaactggctagccctatgcagaagactgacactggatcctttcctttcaccacatataaaaatggatttaagacttaaatgaaaaacttaaaactatgaaaattcttgaagaaaatctagaaaatactagacattgtccctggcaaggattttatgactacgactacaaaagcaattgcaataaaaacaaaaattgacaagtgggacctaattataccaaatggcttctgcacagcaaaagaaactatcaacagtgtaaatagagaacctacaaaatgggataaaatatttgtaaactagacttctaacaatggtctaatatccagaacctataaggaattcaaacaattgaacaaccataaaacaaacaaccccattagaaaataagcaaaagaaatgaacagacatttctcaaaagaagacatatatgcagtaaacaacctataaaaacattctcatcatcaataataagagaaatgcatatcaaaaccacaatgagatagtatcttacaacgctcagaatgactattattaaaaagtcaaaaacaaagatcctggcaaggttgcagagaaaagggaatgcttaaacaccgctggtaggagtgcaaatttgttcggccactgtggaaatcagtttggagatttgtcaaagaacttaaaatagaacaatcattcaacccagcaatcttattcctgggtatatatccaaaggaatataaatcattctaccatgaagacacatgcatgcatatgttcactgcagcactacttatagtaacgaagacatggaatcaacctaaatgattatcaatagtggactggataaagaaaatgtcatacatatataccatggaatactacacagccttaaataagaatgaaatcatgtacttttcagcaacgtggatggaactggaggctattatcttcaacaaattaatgcagaaacagaaaaccaaatgccatatattctcacctatacatgggagctaaacattgagtacacatggatacagacaaaggaacaatagacacagggcctacctgagggtagagggtgggagttgaggatcaaaaagctacctattgagtactatgctcattacccaagtgatgaaataatctgtacaccaagcccccatggcatgcaatttaccttgtagaaaacatgcacatgtaccccaaacttaaaataaaagttggaaagaacaaatcataagaaagtaatcaaagtagaacccagatataaatccatgcattcacagccaactattttttgaaaaaggcaccaagaacaggaaatggggaaatgagattttcttcaataaatgatgctgagaaaactggataaccatatgtaaaagaatgaaaatggactcctatttctcaccatatacaaaaatcaaataaaaataaagacttaaatttaaacctgaaactatgaaactattagaagaaaatattgaaaaaatacttaacgacactggtctatgtaaagagttttctttgtgtgtgtaatatctcaaaagcacaggcaaccaaagcaaaatatagacatatgaaattacattaggctaaaaaccttctgcacagaaaagaaaacaatctagaaagtaaagagacagccagagaatggaagaaaatatttgcaaactatccacctggcaagagattaacaaccagaatatataaggagctcaagcaactcaatggcaaaaatagatgaaattaaaaatgggtagaagatctgaaaagacatttttctaaagagacatacaaatggcccacagttgtatgttgaacaatgaaaaattgttcaacatcactagtcttcagtgaaatacaactcaaaagtgcaatgagctattatcttaccatagcttaaattgattttatcaagaagacaaggaataacagatgctggcaaagacgtgaagaaaggagaactttgtacaccgttggtaggaatgcaaattagtgcaaccactatgaaaaaaagtatgacagtttctcaaaaaaattaaaaataaaactactatatgatccagcatttccactattaggtatacattcacaaaaaggcagtatattgaagagatatcttcactcccatgtttattgcagcactatttgctatacccaaattatggaatcaaccaaagtgcccatcaatgaataaagaaaatgtgagatagatatatatatatatatatacacacacacacacacacacacacacacacatatatatatagttgaatattgttaagtcatacaagagaatgaaatcctgtcatttgtagcaacatgatggaacaggaggtcattataagtgaaattagccaggcacagaaagacaaattgcatgttctcactcatatgtgggaactgaacaagtgactatcatgaagataggaatttgattattgggtaccagtggccaggaaaggtagatgggaagggagggtgaagagagtttgaataataggcacaaatatacagtttgagagaagaaataatatctagtgtttgatagatcaatagggtgattatagtttgcaatgattgatagtatatttcaaaatactaagaataatttgaatgtttctagcataaacaataaatatttaatggatatctcaattacactgatttgatatttacaaattatatacatatatgacattatcacatgtaacctgaaaatatgtacatctattatgaatcaatgcaaaaattggaaaaaaaaattaaaaataaaaataaatataccaacaatgctgtgaataaaggtaatcaaagcagcacagtagaatacagagagcatggaatgagaagcagacaaacttaaattcaaattcatattaggagacttctagctaaatgatcgggggcatatcacattaataaaaattattaacctccagagagccagagccagagacagagcaagtcagacacagagaatgaaaaaacatccaaactaccaatatccttatgaaagacgggacatcactatagaacttaaaaataacaaaaatataataaggaaatactgtaacaactctacatttgcaaattcaccaacaaatataaaatggaccagtttccttgaaagacacaagactcactcaagaaaataatggataacctaagacatgtcatatatttagtcaagcaattagatttagacttaaaaattcttccaacaaagaaaaattttgtctggatggactcactggggaattccactaaatgctgaagaaggaattttaacaattctgaacaatcccttccaaaaaatagaagaggaagtaacaactctcacctgattttacaagggagcattgtcctgatactaaagtcagacaaaaacatgatcaagtaaaacaatgaactaatctctctcatgagcatagatgcagaatttcttaacaaattattaacaaattgaatatggcaatatatacaaaacatactacatcacagtcaggtggagcagattccagtaatgagagcctgtttcaacatcagaaattgagtctacataattcttaatattatcagaataaaaagaaaaatcaatagattcagaagaaaagcatttgataaaattcaagatttgtttatgatatacactttcagtaaactataagtacttccttaacctgatagagtttgtctacgaaaacgtacagctaacattataatggcgaaagactgacaaagcaagtatatctcttcctcatcactactatagaacattgttttggaacctagacagtaaaataagacaaagaaaattaataaaatcctccagattggaaagaaagctctctctattaaaaagagaacatgattatctatgtagaaaatatctgaaatctcaaaaatgaaaagaaaataaactttcaagaatagcaaaagaatttagtaagtcacaggatacaaaaatcaactgcatctctgaatgttaacaatgaacatctttaagtcaaaaactgtaaccataccatgtacaatatcataaaacaattagatatttaggttaaattctaacaaagtatatgcatgatctatattcagaaaaatacaaaacacaaaagaaatgaaagaaggcctaagtgatgggtatacatattctgtgttcatgtatttgatgacttattaatgagataaattattcccaaattgattctatacatttccaattgaattcttagcaggatatttttagataccaaaaaactgattataagtttacatagaaaaggaaaataattataatatccaaaacattttgaaaaagaatttatttcaagatctcccactacctgatattcaaacttttttaaagttatagtaatcaggacagtattttattggcaaatgggtagatacacatatgaaaggaataaaataaatagaatataaatagaaccacacaaatgtttattttctgacaaagttgctttaaagacaataataaaaagacttaattttaaataaatagtgccagaaaaattagacctccaaacgtaaaaacaaaaatggaccttcacctgtacttcacattttttatcaaaatcaacagtaaaggatatagatataatatagaatgtaaaatgttaaaactttacaaaaaaaaacaaagaaaatttggaacataagtttaagcagccattttatagaaagaatatcaagagaaaaaacattattaattggactttaacacacttaaaaaaatgctctgccaaaaaacatatttaaaaagtgaaaagactagtcaaagattagaaaaaatatgtatttgtcaatcccctatctgacaaactgtatgcattcaacacagagaaagagcaattatgacacgataataaggaaaatatgtgggcaaagttcagtacaggcactttaccaaagaagaaatatggactgcaactaagcaaatgagaagatgctcaacaacagtcattaggggcatgcaaattgaaaccacattataatatttttttaaaggctaagattacaaagaaaacaaaaccttgttacactaaataccagtgaggaagtagagcaattgacacactcatgcattgctggtgaaaatgcaagataagacaacaactttggaaaatagtctgccagtttttaaaaagtgatcatttaactaccaaatgaccttgcatcaccacccctaggtatttacccaaaacagattaaaacttatgatcactcagaaatctatgcaaatggctatattgcccttattcataatggtgaaaaatggtaagcaatcgaaatgcctttcagctaataaaaagaaaaatgagctctggtaatccatacaacagagtactattgagtggtaaaaaaagaacgaaccaactattgatacctacaatccatgtggatgagtatcaaatggatatcctaactgaaaaaagtcagattcaaagggtcatgcatgatttaatttacatgacattcagtaaaaagcaaaactataagaaagagaaaattttgctacaaagcagcagcatggaagtttctttggggtaatgaaactatttcagtatctttattgtgatggtggttacaagactacatgtttgtcaaatataatatttcataccctaaagtgtgaattttactatataaaattcagttaaaatcattaaactatacatttcaacttattatatgaaaactaaatcataatacaactgacttttaaaaaacatctggtatattaaccactttattatactatccctttatagaaattctcatgttaaatctatatattttatgcatagaaaaatctacaagaaaagatagtctcaaaagtatatttgtccatgaggattttgcttttgaccaatttggttaattctactattttattatttgagtgtcttgaaaaatattctgtgtattttctgtgtcagtcagaatgattgccattctaactggtgtgagatgatatctcatagtggttttgatttgcatttctctgatggccagtgatgatgagcactttttcatgtgttttacactgttggtgggactgtaaactagttcaaccattgtggaagtcagtgtggcgattcctcagggatctagaactagaaataccatttgacccagccatctcattactgggtatatacccaaaggactataaatcatgctactataaagacacacgcacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaaaaaagaaatatactttctgaatgtcaagatctcgactttctttccttaggtcaaactgcattttagagttatccctcttgagcacttagaagctgcaataatcctggcaattggcaaactggagactgaatctaactctgtagcatgtgaccatagacaacagtatcatcacattatttctctaaaaaacagccaccttgctcttgataaatgctgtaattcccattttagtagacaatccttcctttcagaatcaggtttgccatttgattttatcaatcacaagtttcaaatgatcaataatccattagaattattttcaaaaaaatagcttttggaagatgatttcaacatatttctttctctctcacccaccccatcccccaacaaacgcagccctcagtatttataaatgtgccccatgctgctttcttggtcatgctatgaccatcaccagcattacacatgttgttgtacttatcttctttctaagaatacttcaatcatcatttagtacaaaataaaattcatgtttctaacaaaaactcttcttcatctcggcaaaaggagaactctttcctctgcagttgtgtgtagtttttgtatgagtttagtaagatatattagatggtacttcatagtagttacgtaggtctgaatataccttcttctactaggttttaaggttcttaaagacagtatatcagcatttttgagaaagaactttaggcgaaaattcatgtcccatatttttgttaggaactatgattctagagaatagggtgtgagggaaaaggagagtgaggcaggaagcaagcagggtcaatatgacaatgcattactgagctggtcactgatggcatcaggtataacgaatcacttgattttgaaggactgtcttcaaaaaggtcaaataatctctttccaggggggacaaaatcataggccagcttctgtttctctctgaattaaggtttaccagagggagcactaccttcctgtacaaatggattgcacatccatgagtgctacaagggtcccaaagcattacatgcctcagtggcagcactgaattctcacagaagacatgaaagaagcacagaaaggacctgatgttagacctgccgggtgcttcttatgcgaaactggccagaggtcactcatattcgttgctccaggtgctggcgctgacccagtggctatctgccctggatataggtgacactgaaagaacctgaagtggcacataagaggtgtctgattgagcatgcatttgtggtaaagctgtaaccataaagctgaagttcatctttgaatcacccactatactacaaaatggtgtatacatcaattattaaaatacttgctaaataaataagatttctaagaatgtataatggaaaggtaagagtgaatgctcacaatataggtgagcaatcctgcttacagaaaaggtaatgagttagtaaattccaaatgtatgaaattgaaaagagtgttaactactagtgtaagtacaaaattatacaaatactttgctgaaaagtcagggccattttcttattctaattttagtgaaaacagctgtgtgacctctctgggcctcactttttttcatctgtgaagtcaaaagcataaatttgatgacatttaagattttagtcaaactttgaaactgatgtgtttgaagttctgaatctatggcaaataaataattaaatattaatttattaggtatgattgagtacaaattgtgagttaggcacctctccagttcctaagaatacagtaatgaaaaagcagatatgaatactgccctattcgagtttaaatcctaatgtggagagtcacaaagcaaaataaatatctatgcaatatgttagaagtggggaggccagagaactgcattgcatgtttactcgggtggccagggtaggagtcactgaaaagctgagctgaaagatccagccaaatggataatgggggaggagcactctaggccattgtctgagcagggggtgaacttcacatgttctggagaataacgaactctttgacttgagccacatgatagaagttagagactgttatgaggatgatgccaaagagttaagaaggacagatcatgtagcaccctaggacattttgagaaatttgggttttactcagaatgagtcattgaggattttgagcagataaatgtatagcttgatttaggtttataaaaggatcaggatcaaattggctgctatattgagaatagattataatggggcaagtgtgtaaacagagatatggaaataaatagtttccaaaagacacatctagcataatttctgtaaggtaacaatgtggctaaaatgtgttttaatttagtatttttatggtcgtcagggtggttaaaaggttttatttattttaaagtaggtaaaacatgaatttactttacaaacatgtaaaaaacaactaataaaagttctactcaaactatttcaaaaaattgaagtggagggaatacttcaaaactcattctatgaggccagaattaccataccaaaaccagacaaacatgcaataataataataactataatccaatatctcttataaacacagatgcaaaaatcctcaaaaaacactagcaaactgaattcaacaacacaataaaaagatatttcaccatgattaagtgaattcatcccagagacgcaagtatagttaaacatatgctaatcaataaacatgatacatcataacatatgatcatttcaatagatgctgaaaaggcattccataaaatccaactttccttctttaaaaaaaaatttcctttggttattatcttgattaaaaacacctaacaaactaagtataaaagaagtatacctcaaaatagtaagggccacatctaacaaacccacagctaacataatactgaatgggaaaacattgaaagcctttcctctaaggtctgtaacaaggcaaataggctaactttcaccactcttattcaacacagcattggaagttctagacagaggaatgaagcaataaaagtgaataaagaacattgtaaaggaagaagtcaaattgtccttttttgcagatgatatgatcttatatttagaacataaatattgaaaaaaacctaaggattccactagaaaccgttagaactgatccatgaattcagtaaagttgctacaaaatcaacatacaacaattaataacatttctatattccagcagtaaacaatctgaaaaaaatacaagaaagtaattcaatttacacagctaccaaaaacaaacaaacaaacaaaaacccgggaataaatttagccaaaaaagtgcaagatctttactggaaaactggaaaagattgataaaataaattaaaaaggagacaaaaacatggtaagatacctcatgttttgggattggaagaattaacacagttaaaatgttcataccagctaaagtgatctacagattcaatactatccctatcaacataccaatgacattcttcacaaaatcgaaaaaaaaaaaaagctaaaatttgtatggagccacaaaagaccacaaatagccaaagcaatccagaactaaaagaacaaagctatagtatctaaaaaacagcatgatgccgtcatagaaatatacacataagccaatgtaacagaatagagaacccagaaataaatccatgcattttcagccaactcatttcaaaaatggtgccaaggacatatgctgataaacaaatacttttcaatgaatggtgctgggtaaactagatagccacatgcagaacaatgaaaatagactcttacctcttactacatacaaaaatcaaataaaaatggattgcatacttaaacgtaaaacctaaactataaaataactagaagaaaacattggggaaacacttcaggactttggtctagacaaagattttttgggcaagtcctcaaaagcacaggaaagaaaagcagaaatagagaaatgggattacactgagctaaaaatacttctacacagcaaagaaagcaatcaacaaagtgaggagacagtccacagaatgggagaaaatatttgtaaactatccatctgacaaaagggttaataatcagaatacataaggaactcaaataagacaatggtaaaaaacaaataatcaaattttaaaatgggcaaaagatcttaatagatatttttaagagaagatacaccagtaggtatgtgaaaataatgttcaaaatcactagccatggggaacgtaaatataaaccacaatgaaatatcatctcaccccagttaaagtagctataattaaaaagacaacaaataaccaaagctgatgagaatgtagaaaaatgtgaccctcctacattcttggtgggaatgtaaattggtacagccactatggagaacagtatgaaggttctactgaaaactgaaaatagaattagcatatgatccagcaattccattccttggtgtatgtccaaaaaaaggaaatcagaatatccacaaaaaatctgcagtctcgtgttaattgtactactattcacaacagccaagacatgacattaatctacgtccatcagcaaatgaacagattaagaaaatgtagtatatatacaaagtggcgtattaatacattaaaaagaatgctactctgtcatttgcagcaacatggatagaactggaggtcattatgttaattgagctaagccaaatacagaaaaacaaatatcccatgttctcactaatatgcgggagctaaaaaacttggtcttctggagataatgactataacagtggttatcaggggctggcaagggtagggtagaggatggatgaagaaagattggttaatggatacaaaaatatatatagatagaaggcacaatttctagcatttaataacacagcaggagtatagctaacaataacttattgtacatttaaaaatggctagaagatttggaatgttctcaacacaaagaaatgataaatgtgtaagatgatagctaccccaattaccttaatttgatcattacacattgtatgcatgtatcaaaataccatatgtaccacataaatatgtattattatgtaccaatattaaaagaaaaaatataaacagaaatatatttatacattctcttttttatatactaatatttaaaactaaatcatactatatactagtatacaaaaactatatattaatatataaaactaatacatataaaaataaagccatgcatacatatttagtaactaaaaatgtactctttctctttccaagtattatgttgtgtattcctctcaatgccatgaaataagtaatttttcatttacagatgaggtcacatggtcaaggacatatagaaagtgaaaggaaggcttacatattagtgaagcataatcactgatggcagaaaaaaaatgaagaatggggtggtagattcctattactgctattaccaatgactacaaaattgatggtttaaaacaacacaaatgtatcttataattttggaagtcagaagtaaaaaataggtctcactggactaaaatcaaggtattgacagggctgtgttttatctgtaggcttgaggcagaatccatttatttgccttttctagcttcctgagtctggtcacattgcttggctcatggctcatggcccccttctatctttaaaaccagcaatggccacctgagtctttctcaatttgcatcattctgacttctatttctgcttctctcttcgacttcaaaagaccattgtgattatattggacccacctcaacaatccagggtaatgtccttatctcaagtcacttgagtggtaatcctaactcaatcttcaactttaattcccacttaccatgggctataacatattcaacaattgtgaggtataagacattaacacctttgagtggctaatgttctgcctactacaaatggtgagataaatttgaggtgatgggatgctagataagtcttttcctttcctcataacttttgtcagaatctatgtgaatatatatagcagaatatgtaccatcactatttcaaggctatcccatttaatttttgttatgaggtcattgactctttacagaaaacatctaacatgtcagcgctttgtccttattattgtatttatctgtgtggtcatgaaagaagtggtctatgtgggagacttttccaaattatgaatctagaatacccataaatatttagtctcacttattcctacagtgtgtatgggtaagtgtattatttttcataagatgatggctggggaaattgggaatacagaacatgaagacagttaacatacgtgccagcctagttgttacccctcattatattacagactggtaaatgtatctacctaaatggaatgatgatgctactcaagactgaagaaggtagccttagaaaattttctaatgtagatcgttgaatgttgaagaccttgccatgttaagtgatgtagagaaaggtcctagaatactggctttctcctgaagagacaatagatttccactgatgacgtagagtgacacatcctgagtaaggctataaggattgtggagactgactttataccagggtgaagtcgggacatgttctttcttcaaaagcttttctttaaggcctgcattctagaaaggagagacagtcccaagggtactttcctaatgtcatggtacactagctcctgtgttaagttggcagcctggggtgagggaagaagtcttcgtcacaaagaatacattgcccagtaggaaaccactatggaaatttatggacttaagttattcaggaacagtcatattgcatactgagtttcaaatgaccttgtgtagaaatattcatcaatgtcttacaatattcaccataagtctggtaaaagttacaaactggtctttatctaaccgtttgaaaaaagaagggataggtgtccacaacacagtgcggagtgtttaaaagagagccatacaagcactaagaaagccagaagtgagtaaccagcagaaaagtagataaaggttctgatctggatccagatgataaatggaatggcaagtgaaaatcgggatatattttccagaagataaatgttcctggatatcttggaacatcaagtaaattattaagttcttatatataataaagcaagattgtagattcatctttttattcaggcatttgaggaaagtgtgacttcaaggactattgaaatctgagacatatgttctgggtacattaaggagaaggtatagtagtattgaagaatataaaaatatatttaggtctcgtaagtcagcacttctccttacattaactatatgactccttcattgtggattattattccatccaaaatttcctatttagaaggccacatttggttcatgcaaatacgaaaagatgccataatcggagaaaaaagtttggagatcatgaagatgcaaacaggagtatttcttaatactttattaagcttatacgaatacactaaagtacagttttaatttggcttctaagtatactttactctatacaaattaccaccacttgaaagaaaaaaagagagccagagatgaatatatagtttccaacataatatagaggcatagtagcatccttaacatgacatacactgtgctcctaaatactgctcctaaatattaaggataacatgctaaaatttgtctttatccccatgttttgggttataaaatattagatttagaaaaaagaaaaaaaaagaaagtaaaaagaaaccactctaacacaaggaattttattttcataaaacatccatatccatatactttgtaggcagttttcaaaatggctttcagtgatcctcttctcttaatattcatatcctgtcctttcagcttgatagttggcttgagattaatcacacttgagcttaatcacttccaagtctagatgacaaaagcctttgacttttctcttgcacattcttttttgccttcttatttattagccctgtcaaagctgcttctatgttgtgagatgctttatggataacatccatgtggtaaaatagtgaagtaggcctcttgccaaccaccagttaggaataaccatggaggaactgagtcccaccaacagctacttgagtgactataaaagtggacccatcactggttgaaccttgggataactatagcccaattgacaccttgattttagccttgtgagatattcagaaacagaggatgcaactaagcattgttttaatttctgacccatggaaactgagataataaatgtttgctgctttatccagtaagattttgaataatctgttaaacaaataaatagtacacatacatatacaaacttgcaagataaaacataactttagaggaaaaaaagaaatcaagcaagaactagatacagttaacataaacaaaactcatcatatttcattacagcatgtggaaattgtgaagtatctttttcttatatatgttaattactcagtaaaaaattagagtatcgctgaaatctgtataccaaagttgaaaaagacaaagaaaacttatagaatgtatgggaggtggtgaaaagataattaaaagattcaaaatcaaaatttatataacagaatttgtattttaagaaaaatgtaaagtgttacaaaaagtatgtctccttctctggcagtaattatcctatttgctataatataataaataggttttgagtaactgttttgtggccgatttaagcagcaatccacgtaaacagacacctggatttccttcagtaagggagcaggaaatgacaattacattcttcagcaaaaacattttatctttgtttacagacattttgtgtgtgtgtgtgtgtgaatgtttctcacaaattgcaaaggccccccaccagtcttaacaaagaatttatttgaccattaactatatttcatgcgtaacatatattttatgacatgaattatattttgaatttagatttttacattttgttaattactacttcacaagaaggggaaaaataaaaaatcttcaaaaagcaattatagctcaatgatttaaatcaattcaccgggttatggttgtggcagataataaaaaattaaattcttcttccaaagctaagttgattactctgagtacctacctgtgttcttccaaaattttataaattacgtgtgattggagctcagatgaaatttagattgctgattgactttaactataggaaaaactattcaaagaaaagattaaatgagaaccaaatccttttatatacacacagaaaaaaaaacatgaaagtgaaagtgatctaatcagaagtattacaaaaaatagacaagaagaaccaacagttatacgatctctctgataatggtaaattctctctttaagtaggcatgttgctattgatgtatgctgaatgagtgtgttttagttttccaacatagcaaatctgacagtgaacttgaaatcagttagactggtaaggggtttctggctggattccacataatgctgttggctcatgggatttccttggtctagccaggtttagaaacagtttttaatcagttaatactggatttattatgttaaagaatgggggagggtaaaactcactgattcagaaactggataatatataagtgtataatataaaattaatctgcagcgaaggccagagtgctttcaaatataagccagtacatttctttaacagtttccaaatgtctgggaattttaatcactaattatagcattaagtgagccaagaattttagaaaagaatatacttttattagatattttcttgaagatatggcagtctaacaaggaacaattttagataataggaaaacttattggaatagtagtcaaaatctccttcctgaactgtgagataaatacttaaaaatttactaaatccttcattcataaataattcttattttccacctattaatttgttaggtgattgaatgttatcttgcactcttatgtacaatagggtttctcaagcacagcactattcgcattttgggccagatgacaccttgttgtgggggtgtcctatgaattttaggatgtttaacagcatcctggcctttctccacctgctggatgatttgcgccctcccagttgtgacagccaaaaatgtttctaagcactgtcaaatgtccttttgggggcaaaataattgtctgttaagatatactgctcaaaaagaaagaggggaggagagcaggtagtggcgatggttaatgggtacaaacatacagttagatgaatggataagatctagtattcatagcaagaaagagtgactacagtctgcaataatttgttcacattttaaaataaccaaaagagtataagtggattgtttgtaacagaaagaaaggataagtgcttgaggtggtgattaccccatttaccctgatgtgattatcatgcattttatgtctgtatcaaaatatcttatgtaccccataaatatattcacctattatgtatccacaaaaattaaaaattaatgaaaggtttctatgactcatgtgcaaatataattataatcttagtggtcacaaccagtatatatatttttatccttcttgtgtcagggttccccaggaccactctaaagtttgatgatatacatattcacaactatggtttattacagcgaaaggctacacagcaaaatcagcaaagggaaaaggcttatggggcaaagtccagcggacaccacgtacaagtttccaagaaacctctcccattcgagtcgcacagatgagagtacagatggtccccaacttacaattttttgactttacattgggtttatcagagtattataggcatttgtgacttacaatattttcaacttacaatggttttataaggtgtaacaccactgtaggtcaagaaacatctgtgattcatagcaatgagttgtaacaccagttgtggaatgtcctctagataagttcattagagacttaatgctaactgcttagcacataccacatttccagactttcagaaataaagcaattgtttagaaaaaccatcattgtttttacaaactgtttaggtactacacaccatgcttatcagttagggaatgacgagatccctttcagaaatccaagttcccagacaccagccactggtcaactttgcaaaaagatcattctaatcacagcagtctcaggtctgttatgttaaccctttctctatgctttcctacaaaatgttttgtgacatgtcagctgcattttaggcacccaaagacttatacaataaataggtgaactaattaatcaaccagtgatgttttcagttagaattccttaaatgtctctattgacacgtttgttcctaaggactcttacacctacaaagaggaaaatgttccacataataaagcataactacagttttataatagaggaaaattttagttaatcaaattgtaccagcattaacctgcatttccagaaaagtcttcaaacaactcaagatccaatgggaggaactcattttcagtgaaaagaaaatgatgtatggtaatattctggtcgatgtaactttcaaatgcaaccactaagagaaagaggaatttaaatttcttgaatctaagactccatgaataaccattttctgtcaaggagccaatattatttttaaaaataaaatcactcaatggttacatttttttttttttttttgagacggagtctcgctctgtagcccaagctggagtgcagtggcgtgatctccgctcactgcaagctccgcctccagggttcacgccattctcctgcctcagcctccagagtagctgggactacaggcgcccgccaccacgcccggctaattttttgtatttttagtagacacggggttttactgtgttagccaggttggtctcgatctcctgacctcgtgatccacccgcccccgcctcccaaagtgctggaattacaaggcgtgagccaccgcgcccgaccactcaatggttacattcttatttgagatatggagttgtctagagcccttcactcaagacgatctgctttagattaataggatgctttgagaaaataaacttcatgttacttttgagaaaatatgatgcacattaattttatgataattaatgttgaaacacctcccataaccacacatccctcttttatacacgggataaaattgttagtttagattttattacttaattattgtctggtcatcaccccttatcccctcctgaatatttaatgagaccaaggtccgtgctcttttttaattcacatttgtctctccaggaccttgcataggatgtagtaaagagtatttaacaagaatctgttaaaatgatttttttgaaaaagctcagagagataactgtccataccccatgtgtccccacggtatattcgatctttattttgaaggcaaacactatattttaaaaatcaaaatctaataaagataaagcaccatccctttacaggattgatttctttgattgtaaagtgtgcgaaaaaagggtttccggtgcactctgacaccattcataaaatcctaaccaggacctggtaaggccttagtttgtcaacactgtaccagaaatctctaatataaacaggctcatattataatcttctgcatttgtaatttttgagaacagggtggaaaagcactcatttaagtggaggatttttcttttaaatgctgtacttgagaatgtatcattattccagatgagacagataagacgcgttgctcccttgccctggcagtggatttgtttgtatattatgctttctaactctctttctttgctgagctagctattttatgtttctttgtgaatgactgtaccttaagggaactatattctgtatccattattttataaaggtgagtgggctcagtaaatgcctgaaaaagtaccttgactaagatcacagagttaacataataaacctgatagtgctgtaggaagaaagacctagttaggtgtggagtaaaacttagccttataattcccaggccaaagtgtttccaccatcaccaaatcagcgtcagtaactaatcaaataacaatttatttaagccattaaaaaatgtaatgctttcactgcaatgtgaacatatatttaaacatgatgacgatttgtaaaaacaaagatttttagaactaagaagaaatatatattacaaagtagttagtattaaataaactgtttcctggatcctgaatgatgataaaagtttaccccattaacactagggagcatattcaaagaatccaaaattctagcaattctttggtttagtagaagccacaagaagataatttatatctgaaattctgtaatattacagcatcccagttccttttgtgaaacccagagttccatttactcattcgaatggctatacttttttagaatctcttcaaatttgttccatacatactttttagatatgaactaaaattaggcagagtaatatagttttctcctcaatatggaattgaaaaaagaaatactccagttacattttccagctgagtactttggcttattattggatttgattttacctttaacagtgatacaaaggcaaatgcaattgacaaagttaaatatgtggtagcagagtttgaagtttaaaaccctacgtgcttgcttgcttgcttggttttgcttttgttttcttgagcaattgttgactactcagcctgctctgtaaagttaagagcatagactctggagtatcagatgtagattagaattctatttttgccactacctatatttatgaattaaaacttttttttaacttccctgatctcagttttctcatactttaaaagaaatttatgtgtagacaaggaggggtcttactactctcattagcaataaataatattattacttcattgtcaagtttcctactacctaggtacatgaagcgcccttgctctgtctctctttctctctttctctcctctctttcttccagtttcctttatttaacagcaagttaaaaatgcagttggagaaatcaatttattattctcaaacaatttattttacatttataaaaccgtagagatggcttatattgtttatgtgacattgtttatccacaggataaaagaaaaagagttaaacagtaaataattaaaattgttagtttatccacaggataaaagaaaaagagttaaacagtaaataattaactcccacagctatagtcattcctctttaaaaactctagtcaactaaccaaaggaaacacctttttggtgaatacaggtaagttagggcaaagttttggtagtgaaattgtaaagaatcgattactactgtgatgaatcaaatcataaagaatttaacttcactgtactatacaatctattttcaagttgaaagttagttaaaaatgtttcactttattttctttgaagacaataagttggaggcaattcaaacattttattatgaattatcaactaagtttatttaaataatgaatttatctttatgcttaatgcaaattgcatatacattgtattcaaaataaaatgcaaataccaaagaaaaattgttttctaaaataatgttacaagtttatatttgtttcacagtaaattatttttaaatttttgtcagtttacaaacaaaagattgcttaacaattgcaagcagcaaatttaccaatatataaaattcaaaatgttcttccaaacacaaatataattaagcagcaataaaagcttagtatatgaactttattaatagtggttatatctagtttgtagttgccaagaagtaccagctttacatgcactggcaacagtaataaacaatttatggctttctaataaacagatacgtgttaaaagcacatttaaaagaaataccagaagagtttataacatttagcgagcatatggtctctataaagtagtaaattaagtactttataaaactgttagtattaatactatattacaatattttatatttgtgctgcatagttttcaaagtatcatttagaaggattctaatatttttagaacttatttattcttcccaactttgccagataagatttatctctactatgttgaagaattaaaactgagactcaagatggttaaaattttgactgacgtatttcaccacttggtaggagggccaggactcataattaggtttgtgtaattctaagtcaatgattgttccagtttatcttgctgttgctcaaacaggtgtgcttttaaatttgcttataaaatatgcacaaacagatggcacctgctaaatacataactggcaataatatcttgatattttcaaatactcaagagtaatctagcacaaagagctcagaaatttgcaacacaatatattgcacccagaaaaaacccttaaaaccgtctagttcaatcatctatgttagagaaaaattggacaaatagaattaaatgtctagccaatttactatctagaaaatttcaaagttcagactcaaaaatcacttctttgaatccatttctagagctttctgtgttacatcaagaaaacagatttttttccaaatgtttatgtttctttgtccaatctaaaggatgaaagatactaattctctgtaatacataagaagaaaagagaattagacagtatctttatcaagtcccatcagattagcaacaaatttacaaaagtgatgttataaaactttttgactaaaaggctttcccaatattataaaaagggtatcacattatactgccatttaatgctattaagaaaacattacctactacaaataaatcttaccgtcatgtttctcaatctattataattaataaaatattaggaaaagacttgttttattgtgaaaatgttattcaatatattttattccagataaatggatattaaaggatatttatagtactttcaatttgttctgaaagctacatctgtattatcaggaatatgtataagcactaaacattgttgcagaatttgtctaaggctaacaccattttcaacaccatgaagaataaaacaggccgggcgcggtggctcacgcctgtaatcccagcactttgggaggccgaggcggacagatcatgaagtcaggagatggagaccatcctggctaacatggtgaaaccccgtctctactaaaaattacaaaaaattagccgggcgtggtggcgggcgcctgtagtcccagctactctggaggctgaggcaggagaatggcgtgaacccgggaggcagagcttgcagtgagctgagatcacgccactgcactccagcctgggtgacagaacgagactccgtctcaaaaaaaaaaaaaaacaaaaaacaaaaaacaaaaaacaaacaaacaaacaaacaaaaaaaaacaataaaacaattttcctatatgtcagaaaaaacttctttacagcttttatgaagtgtataaatccctgcatgaatatattcaactcagtgactctattacattctttgatgtccctcatgtttctaaaaaaaatgatgccgagtgtatctttaggatttgaaagcaatgaaagtatataaagccaactgacaggacctcacttatttcctgctggtttatcagccgtcaggaaggatttgcactcaaactcttccacctttccccccttgttatcaatggcatacatggagccacaggaagagtaacgcatagtgtggccatctaaaacagggtaaaattcagacagtcttatagaaataaagtcacaaatgaggttcgaaaataattaccaacagacacaaaagaagaatctttaaaactccatgatctaaatatatattgacaatataattctatgccaatgagtagttttgaattcagcaccatatactgactgcctatttatcacatactaaagatacaaataagtaaggagttacccacatataaatattccatcaatgtttgcacatccatggtatatattataaagatacatctagcaccagaggatgttgggtgctatggaataagaaaatagagacgtgatttttttttttattttcgagacagggtctctgtcacccaggctggggggcagtggcctgatctctgctcaccgaaacctctgcctcccaggttcaagtgattctggtgcctcagcctcctgagcagctggaattacaggcgcatacaccatgcccagctaactttttgtatttttagcagagacggggtttcaccatgctgcccaggctggtctcgaactcctgacctcaagctatctgtccacctcggcctctaaagggctgggattacaggcgtgagccaccaggtccggcagaggcatgaattaaaaacaaacaaacaaacaaaaaaaaaaacttaaattacattctcaccccatcaacttatttgatcttaccaagtcatttcatctctatcttccattttttaaccacagtgtaaaaacatttgacttttcttcccactatattgttgtaagtataaaatgccacaatatatgtgaaaatggtctgaaaatcctaaagcacttctatattgctctatatacactagagcaagaagaggttaaatggtttcccctggtagcaccttcctgagcacagaaaggtgacctcggcaccagggtgtactggctcacttccctaaatctggaatgtaatctgaagagtattacccaaatcctttttctattgttttttttttgttgttgtttttttgtttgtttgtgtttttttttttttttttgagactgaatctcgctctgttgcccaggctggagtgcagtggcgccgccaccacggccggctgattttttttttttattattattattttttatttttagtagagacagggtttcaccgtgttagccaggatggtctcgatctcctgacctcgtgatccacccgtctcatcctcccaaagtgctgggattacaggcgtgagccaccgcgcccggctccccaaatctttactgccaagaaaagtgacaggtttagtaatttcatagtggtttggataatttggctttcaaatttcctttagattagttcctttagattataacattgctaacactataaaactctagtttgagtgaaattcttgtggattcagatactgcaatcaacgaacattgagccaaggatgaattggtgctattcctggtcaattctctttggcaaataaagatagactcgttccatgattgaaagctacataaaaaatatctaatatcactacatatcaaatataatttaaaatataaaatcaaaattaagtccttattaagccttggtagattaagaaaatacaccattaatatgccgacacacatctaattattaaattaaggaaaatttttgtatcaatttttgattggtaatacagaaataaattttcactacaaagaaattttgaataagtattgacactgatataaagtacatcatttaattattatcattattttttcaaattttagttatatttagaagattagattaccttagattccaattcaaagactatatcccatatgattatttcagcttttttcagaatgcattatttaaaaaacaaaacgtttatggacataaccaattataatgtgctgctgctcacaaaacaattgattataaacatgccagaaaaaatgacacaagtcgcatatgtgttctttccagattcaagctattatcttctaaatattctaagtagatagtagattaagataatttatttgccatgtttttcacacttagagtttttctttcttttttttttttttttttttttttgggagacagactcactctgtcacccaggctgaagtgcaatggcacgatcttggctcactgcaacctctgtctcttaggttcaagcgattctcctgcctcagcctcccagtcccttgccatcacacctggcttattttgtattttcagtagagacagggttttgccatgttggccaggctggtctcgaactcctgacttcaggtgatgcacctgcctcggcctcccaaaatgctgggattacagccttcagccactgcacccagccaggtttccctttatgcagaaagcagcttgcaggcaatgctaatattggtttaattttcttaggaggaacccagtatagtacgggaaataattaatataatttgttcttaaaaatatagcttagtattgtattaatttttctagagactgagccaaatcaagtttattccaactaaaatactgcaaacatttacttaagctaatatgtcttattcttaaaatgcttaagggtgcagctctagaattatatttcttagtcacaccttactgcaaattatattaattggagaataaatttatttataatcctagacacgttttaggaagagaatttgaatggaataaacagggaagagaaagatacatcttcttatgataaaataaagatactagagatctttatgacacaatagtaaacatatatatgaattatgaattaatctaatcatgctcatacataaagatctaactgtgtatttttcattttaaatcagttaaattagttacataatctactgtataagattaataaaaatgaactaaaaatatctgttggctcatcagaataatgcagcacttttttcattgggttattaaggataatatttataataataagtgcatacaaagttcttattacagtgcgtagagcacaatggatgctaactggatgttactttctctctctctatcgtgtaaacaccatgagacaaggcgcggtagctcatacctgtaatcccagcactttggcagcgggtggatcacctgaggtcaggagttcaagaccagcctgaccaatatggtgaaacccccgtctctactaaaaacacacacacacacacacacacacacacacacacacacacaaaattagctgggcatggtggcaggtgcctgtaatcccagctactcaggaggctgaggcaggagaatagtttgagcccgggaggcagagtttgcagtgagccgagatcacgccattgcactccagcctgggtgacagagacagactctgtctcaaaaaaataaaaaagtaaaaaataaaaacaaaaaatagtaaataccatgagtgcaaaaagaaaagctatcttattactgacgtgtccctatcctttatatagtgtccattacgtaataagagcccatcagtcatttttttcaatatgtaaatacggagaaatatcttgactacagtgcaggactccatgtttgtttggctctctgctcaaattagacttttcttccatcaatatagaataagccatgcatagacatagtttctattaaaaatctgtaccctaatgagtagaatgggctcacacagatcttggaaaaatacatttagtaggcttggtgaaactgtaatggctttgtacagaactccactgcaacccacctgacaaactaggatatgctaaacaaaccagtcatttatgtgagcgtgtgtatgtgtatgtgtctttctgtctgtctgtctgtatgtatgtgaaagagagagagagagagagagagaaactatggatacttcctttataaattctggctttgccttgccttagaacaggacaacagacttcacaatttttctacatatatgcaaataaattctcggcactttaactgtctttgagttacactttgatacatccacagtgcaatttatgtcaataaaaatgaaattcctaagtaggagggagctgtgtcttaacgtgattagtatttggacttcctattattgtatttgaagacagaggatgcttggctttatgaagcaagctcccaattggattaccatatgtctcaaaaaacatgatagtaaatgtcttttgatagcatgagatataaaggagaaatataaaaatttgctttatgaatgttctgcttccagccggggtatattcagttgtagttaagatagttgtgttctattagctggggacaatttgtaactgtccttattagaaacatacatgtgtatgccaaactgctaagaaatgagaaatttctgtctatatcacctgtttttggcttgctcagaattctaccttttttttttttttttttttttttgagacggagtttcgctctgtcgcccaggctggagcgcagtggcgcgatctcgactcactgcaagctccgcctcccgggttcacgccattctcctgcctcagcctcccgagtagctgggactacaggcgcgcgccaccatgcccggctaatttttgtatttttagtagagacggggtttcaccgtgtcagccaggatggtctcgatctcctgacctcgtgatccgcccgtctcggcctcccaaagtgctgggattacaggcgtgagccaccgcgcccggccaattctaccttcttaaaaattggctttcctttagaaaactacttcatttgccttctttatggtagtcacagtgctatgcccaccaacaatgacaagtaagagacctaaataagaccaattagattattccttaaagttttatttatgccgagagagagacagagagagagagaagggctcctttccttagtaattgcaattatgaatttaggttgagttgtcagcagccttaatatatagctgcatggacaaatattgactgagagttaaagccaaacatcatgggatgcaagcaaaaggcatcaaaagaaacagattcctcaggaggtcttattgggtctctgaatacagccatgcctgaaaaactcactgtaagacccttcattgctttatattatttgagctgcttttctttcccttgtaatcaaaggaccactgacaaatactggctaagtagaatattaataagaatatacacgaaaaagaaaaacatgaatatgcttttggtataaatttacctaaaatattttaacatgcaaattagataccatgtagtttgttaactttaatagttcctcaaattaaaatgttttagtatgtaaatacagatggtttccaactttaaatggttcgacttataattttttatttgattgtgatgtgaaagccatactaattcagtagaaatgtttcatcaaattttgaattgtgatattttccaggctattaatgtatggtaaaatactctctcatgatgctaggctgcagaccccagccagccacaagatcatgagtgtaaataagtgatactctacagtgtattgtgttgctgacgctttttggatattgtcttttcacatcccatcatgtttacaaaatggcatttttgacttacagtgttgtaaatgtatgatgtgtttatcaggccacaactccatcataaatcgagcagcctctatatacacaatatgtatataattttgagtatctcttcatattaatgtaaagttttattttacacttcatttgtggctacttttttcctttaaataaaggcaatgaaaccagatcaatgagagtacttgaattaattctagttgtagaaaagcttggatgatacccttacaaaggaaacccaaataaaaacctaaccaattgaacttttgggttgtgtttggaactatctcttttcaatgaattaacatgtgttatgtgtttatgatgacaaatattagactatattctttaaggcttatcatcagcaaagactttccgggttataggacttctctttatgatttcatctttccaatttttctgacttatgcctgtattttcttttatctttgcctcctataggtctggcttcttctgtcctctcatttcctggtctcctactgactcgcctcttatctctatggcatgtgaccttgggcatgtctttcagtgcctgtcattcttcttatacttcacttcctgtctctgccttccctccccctccatcttactacttctcagcatccttatatacaggtgaaataaaatcacttaaaattatcaattagatttctagtaggaaattgaaaagtactatcatcattttctttataataaagaatgtgacatgatatttaaagaaaattatttttagaagtgttcaattccacttgaacactaccgggcaaacacctaaattttcctttgttcaggttgcaaaatgtgagcatttcctaaatttgctgtgaaccctcaggaataaagcaaaaaacaattttcaaaataaaaatgaacaatttaatagatttaaatatgaatgtttcctaaaaaggatatattaataaagttctgtactaatatatataaatcctaaataaatttccatttcaatacttccttttgatatttctgtcttctctctcttgatatagaaacaacctgcatgtatgcagttcagttccttaggcatatatgattcattcatcttaatttagaaaatatcaaggccatgcctgggagcagaattggggcattatttgtctttcggcagcgtatttttaaaattgttatgaataagtaaattgacaaaatcctttctaagatgtacagacattttcaatcaataatgcacactatcaggacataaaatcttccctaactttttgagaaatctttacgttttctttagggaatagattcacacttaggttttatcacctatcctacactgacgtttgggggctgaactttttgaggtaatgggtgcctctgtacagctgcaacccagaatgattctttcactactatgccctgagcaaaaacagtcttgggttacaggagtgaattagtgccttctcctgtttcctgcaccctttatttcatgaccttatcccatgtatagggcgagtaagagtagtcagttcatactgatctcagcagatagcgatataaacagatacttggctcatagggcataacttacatttactaagaaaatgctcaaaaccattcattgaagtttttctatacagactttcaggaattttaatgagtacttgcttataaaatgttgacaaccttaatcataaagtggtaaaaactaatatgcaatgtatcaagggaacaatacctccaactgttttcccagaatatactttacaaattaccaaagcagataactgaccacatttcctttttaatttacctcactagttctttgaagttctattcaccattagctctttgaataactgttttaaaacagatgggatgaacatctggataacacaacatatatattttttttatcaattgcctcactgatgtgaggaacatctcctcccacacacaccaccctgtgcctcatctaatgtgttaacactttggataatgagaacaacagaagtggatactaaatatcttattcaaattaactcaaatctgagtgcaaatgtggaagtatccatgcaattcacgaactgctgccccagactgtgtttttaacagcagtgtttgatgatgttggcactcttgatcattttctgtttttgaagttactgagttcaatgatccatcctttgtgtttatttatcaggactgtgaacatcacaaacaatttgagatgtttagaattaaatgttgattttagctggcagaaaaaatgcaaagttaggtaaattgatgagcatcattttcatgtatatattatctctttgttaacagttatctttcccagacataatggaaatggctgaggagtatgggtaaactgaagtatctgagttcaaatttatgcatgttaagatagaataataaacatgctactcttctgtgcagaaattcaatgccaaactaattcatgaaatactgtacaatactatacaatacaatatagttcaactatattggctcgaatcaatataactggtagtttaagtcactggtagttcaaagaaagaccaactagattctgagcctcaaacagcattattagggacttgcctgcctctttgtctggcttcctctacgatggcttacttttcaggctgggtttcttaataatgttggtaaatatgatcacaacaagctctaaaattctacactccttgcctttctgcctgaatcttgcccccccaaaaataatttatttcaggcacttccagtccaaattttaaaactgatactaattttgtgtagtttgggtcatgtttatgacctactaattagtcacagttgccaagaaaccgaatgacctaggtaatatgctcaactctgaagctaggctatcaggttttgaaaccaatggattaagaacaggtaagtagctgggcgcagtggttcatgcctgtaattccagaacttgcgggggccaagacaggtggatcacttgaggtcaggagtttgagacccgcctggccaacatgggggaaaccctgtctctacccaaaatacaaaaattagcctggcgtggtgatacacatttgtaatccaagctactcgggaggctgagacaggaaaatcgcttgaacctgggaggtggaggttgcagtgagccgagatcatgccactgcactccagcctgggcaacatagcgagactctgtctcaaaaacaaaacaaaacaaaacaaaacaaaacaaaacaaaacaaaacaaaacagttaaggggtaattctccaaaggaaaactatcattattttatcaaactaatgaaggaagcatgctggtcagtcaaaccaacctgtgtctataatcaaagtgcaagctttgcagaggagcttttaatacataactgaaatattattcataagtaattggagtattctggggaatagatattagtaaaagttaaggaaatagaatgacaacaagtgataacaacatatatatatgtatatgtatctcctaacattagtctaaacatagagtccataccactgacagcaggcactggacatggttagaggaccattctccttaccataaagtgagaactcagatatactctccaactaatttaaccttgaatcacattttacctatgtatgagctatagcataatgtcagagcatattaatcataaccatatagcaagaatattacagattaaaattgtcatagcttatttttcttgtcttataagaaatgctaattagggtgaaattcatgttataaaagtatttacatataaatacttcaagaaaaaatttgctggagatattagcagaacatgtcgtacttaaaaaaatgcaagaatttggtctaggctgggttgaatatgtttaggaaaacacagtcttttgaagaaaaagtagattgcaatatctcaaataataactagtgacaatgaagaaaataaagtgttcttatgaacataagagttgatatttgtaacttttatggcatagctgatgaatcattcagtaaaaccaaatgaaacaaataccttcaatctctcaaatcaaacaccatactattgagattttagctataactttatgtttgtcttgtttgaaaaaatacttcaaaaccccaaaatattttttgttaaaccatcttacatggttaaaacattccttttagagtaaacacttatgaaattcttaagcattgtaacttcatcattctaaaggattaaaatgtttattttaaattgaacatttatgaaatgcttaagcattttagctagccttttttaaagtgcaatcataaaaacaatggttttataatgaaagaaatatttcataattgcattcatacatttgaactgtttatacatgtggcaataaaatgaaatacaattgtgaaacacatattttatataaagtatagttgccaatgtttttgttttcttgaaataatctttttattctttttcgcttttaaagcataagtttgtgtcacaatttaaattcattctagaaacttgcagttaatccctgattacttgtcatgattagatattcagctaaggtatacatcacagaccatctgtgagaggacactatttcatttgtcttctgggtaatagggaggctcattttgaggatgaacccaccctgctcttttgtgaaagcaggagagtgccaggtggttggtagagataaacacaaagggtaataccggggaaaaagaaacgcagggctttcccagcaaacctttacaatattggtgcactacaacaggtggaaaacagtgagatgtcatatatgtgtgcaaagccagaacacatttcacaatttgtagctcagattccatgagacactaagaatacagatgttaggaagtttcaaatttcaataagggtagaatgtaataccaccttgaaaataccctttctcaactgcatgtacttatattgctaactggagaaaataactctggagagtaatcatggaactgtgtggagtttatttggttaatgggaccaaacatacagttaggtagaagaaataagttctagagttcaatagcacactctaaggtgactagttactaattcattgtatatgtcaatatagctaaaagagaatatttgaaatgttcccaaaacaaataaataataaatctttgtggtgatggacaacctaaatatggtgaattgatttttacgtgtggtatgcatgtatcaaaatatcacatttactttttatggatacataagagttgtactatataaatatatatatatatagtatataaatatactatataaatatgtacaactcttatgtatccattaaatgtaaatacatgaatagattaacaaatagaacaagaaaaaatgattagtacagaatatttagcctttttctaagtttcatgagaaatctgcagatttcctagggaaacttatgatagcctattaacatgcaaatataacgtattagatctaatttttaaaagtaaaaagggatttttttaatcgactcgaagaagaaaaagatcttttaccatggttttcttgtcctgggctcaacatgtaatgatgaaagcaaactagaatagaaagtaaggcaaagaaaaataaatatatatttttttcagtggtctctaaatgtcttataaactttgttatgtctcttgtctagctttattccaggcacaaactgatcaaaaattggttcactgaatgagcttgccatatcagatatagaaattttgagatttgctaattcaaagtacaagaacacagtaaatagtaagagaatacatgagcctgtgagtatattaaattcactggcatgttttttcatctatttccctttagaatctattacaaaacctagagaaatgtgactcctatgaaccactgttatgcaaaggtgtgccagattcattgtgtttagggtagaaaatatagctgggagtaagaaaataaaaaataaagattttaattccaagaatgccccaaactaagtaaatgatgtattaccaaatttttattgctgcataaaatacctctttgtgacaacccagtttacaggcaatttcagtgttgactattagagaactattaagctgagaaggtcatgtagcatagggtaaacctcatgacctcatctgttagaacatgtgttgatacgatagaccaaggaaaaaatatgctctgagtaagaggtaagcatgcaggatcaattcaaaatggtcccagatgaagatgccttctgagtatatgtcagggaagtgaagacaatgaatagttccatgcaagcaattcaagtgagaaagggcaatgcgtaaggcaaaataaatgagataagaagcaactgttgccctcaaagagcctggtaagaggaagaatttttgtaagtcttgcttatttttcattagaaaaaaaatttagaggcaaatctttttatttaggcatattataaaaatatttctgtatcctaactatgaatgagaaaataagcataaactcaaattataaaaagatccaacaggcaaaaagctatgacatacaacatttgtttgaggttgatacttgaaaagaaattacccacaagttgtggagaaaataaatagaaatctgtttttctccactgctttaagaatctatactaatttcaactctcttagacaaaatttcacataggccacgtgcataaatatttttatgttgccattataccttatatggcaagtaattcctgtatccatactaactttactctgttgagctaaatacctttttagcaaaaaatagaatgtatcaaaatcgtaaatgctgacatttattgggaaaatggaataaattacatgcgctataattctcaaacctgtttagtgcaaaatatcttaaaagatgaaaaaagttcagagagagcaatcacaaatggatagaaaggaaaattcaaaatgatgtcaagaaaaaactggaatattagctccaggagagcaaaaacttttgtcttttattttttaaactactctcaccctggtacccagaattttgtttggacatagtaagcactcaatagatttagtgaatgagtaaacacattttaaaacatcaaaagtattacctgtattacagtgaaaaatacctaatgaccttctacaatgtgccattctttatgcaaagtactttatatataacagcctgtataatcactgttaaaaccacagagaaagataatcatttattgatgagaaattagaagttcagatctattaagaaagtcatccaaagccatgctgacttcaaagtacagactctttactttaggacatggcataacctccagagggtaatgatattgagaaagctttgccattggaaacacaatttcatagacaagaagagaaggttatgttcacattacttttcatgcttcacatggcaataacattctgatctttaatgttaggatttataactttacactaaatactccatgatctgttgtctaaatggtaacaccaagaatcatcacttttcctctgtaataagatgtgcagtgtctttgtgtgaaatatagctatatacattgtatatcttctagttgagaaaattaatcatgcaatgtatctggaataagaaaaaaatacagcaacaataaaaataggacaataaaatgagtaatacgtttaaatttctattgccagaaaaattgttcaaaatagaacttatgaaagagaaatagtgtagcacaaaacaacagcagaggagaaatgatgaaaacaatgagagaaagagataaattagtgaaataaagttgaaaaaagtttcattttaacatcattgcattttgtgaaaaaattttacacttttacattaaagagtttaagcgtatactaaattgaatttcttacttgatgcttctgctttaaattatatcaacgcttaattaccatttaaagcttattattagttaatttatatatcattactaatgtcagcatcttgtcaggcataagagttaaatataaatttatattccccaggtgaatgcaattgatacaagaaaaaaaaaaaggagttcctttctctaaatgtatcacatagtgatacaactttttatacactacaaatagactgggtcagaagttaaaaaaagtagtttgtagggccaggcgtggtggctcacgcctgtaatctgagtactttgggaggctgaggcgggcggatcacaagatcaggagatagagaccatcctggctaacacggtgaaaccccatctctactaaaaatacaaaaaattagccaggcgcggtggcaggcgcctgtaagtcccagctactccagaggctgaggcaggagaatgacgtgaaccccggaggtggagcttgcagtgagccgagatagcaccactgcactccagcctgggcgacagagcgagactccatctcaaaaaaacaaaaaaaaaaatctatccactatacacctttttgtgttcttaatataatcttcccactgaatacacaatcatatttactaacgtctataaccataaatgctatattttaacattatagacttagtagggttgttacttaaacagaatacatgacaacatcttcatgttctctaatctgcagacaccttttcaggcttttgcaaaatacgtaactgtttggctcaaaatttattacgagttcaaaaatatttttaaatactgaatacaaacagagagtattgaaaagctattttaaatattcaagaggactggagaaaactcctccattaattttaatgatgaaattaaaactgaacctattaaaactaaacctattagtcatcaagaatgatgattaaatgaaagtatcaaacagaatctatgagtccatgctaataagtgtttagatcaattaataaatgagggagtagaggaaaagcctcccatttagaagaattccaattaaattacatagacagtccacactaaaggagggaaagcataaatccttacatcttaagtgtgccctggtgtaagaaacttctttcctaagagtacagtatgggaagggggaagaacagtgacatcacagttgagaaatccgacaagtcctatttcatccaggagatcaaggtcaaatttaatagtcataaattacattggtagtatgtaccattgatacaatgtgaggaaaataacaaattccctctgtaatatacctcccccaagcactagtcttatcaataggaaaagcaccaacaaatcccaacacatggtatgtattctacaatatctgactagcatgcctcaatactgtcaaggtcatcaaaaacaaagtccaagaaattgtcatagccatgagaagcccaaagagttaggacaactaaatgtaacatagtgtcctggtgccaccttggtatagatagaagacattacataaaaacttaggaaatatgaataaactatgaatttcagttaataataacgcatcaatatttattatctaattttaccaaatataccatgctaatggaaaaatgttactaataggtgaacctgtatgctggggtcatacggggattttctgtacaatctcctctatttttctgtaaatctaatttttttctattaaaatgtctattaataaaaataacttaaccaaagagtctaaatatgaatgtgattatatgcaggtctgaagggcataacagcatgagagcatagagagaatgcaaattacacagtccagaggatttgacaagaagtcttcttgctttgcaataagctgcttgggcacacttagataagtcatttaagcctcttttccctggtttgctatgaaatgaatgaacaggactacaagagttctgaggccccactgagctctgttgtccgttgatttacctacaaaatgatgtcaccctcagagagattacaatctacttgagaaagtaaacttgctaacattgaaacaaatcaaaacatatttaggaacatagttcaaggctgggatcatattctatgtagttcatattctcaggatttcagagaaactaagcagcattatgaaatacttaagaagtaagcgagacttaaggaccattttgaaaaattggaaaatatgaatgaagaagtgaaggacaccccatatcccaaataattggaatctgactcttacagcaaattctccttttgcttcagttttaggttctgaatggggtaaaatattccttcaaatccctctatgctttattatcacatatagcatgaaacccaagtgccttacatggtgtatcccaccttccttgacattgtccttgttagttttccaaacccatgtcatgccacttgtaaagtgatctgcattagcacagtcctgagctgtctttagtttcctgcacagactatagttttagtttgaaacctaaatagtgttctgtgccaggacaggactctgtctgggaaagaagtgtaaaacttttggacttggtttggaaatgctcgttcattttaattcctcagtttgttttgattatctgagcctgcagaaatgatgcacccaacatttctctcaatcattcaaatgatttaaaacagatgaaatttttgtatataatatatcagatttcagtgagttgttaacttctgtataggagccaacaggaattttaaaaatctgttgttaaacactaataataatcaaagttgcaagacacttcatgttgagaactacaaagacacagccatagataaagttaacagcgacctggtgtcactgctcactccagggtgtaagcttattgaatagaatggcaggcatgcttgacagcagagtacgcaatgcctttttttttttttttaaatctcccactctttttctattttatcaagcatacataattaaatttgttaagtgaaaggatgcttaaaacacttgcagggatgtttctcaggaacatcctgagatttttttttttttcaaaaattagtgactttaaagaaaccagcatcctttgcaaactcaccaaattagtgtgtgcgtcaccaagatagaccatattttcttatgggtgggatgctagcatgcaacctgggatcccaaaatgtgatatatttacaggaaacatcatcacaaaatgccatgagaaagcagactgtgtacagaatccattctgctaaaggtggcatcagagcatccatctttgggaagtagttgtgacaaagtttctagaatccagtgcctgagggtcagcagtccagctctggtgtctgtatccctcaacagtatttcttcctgcataagccagttagggtgaaatctgttctttgcaactcagagcactgatagacaatccttcttttcttctggtgatacgtttctctaattctttagcaaatacctttttgtctgtagttctcaatttttggttccctccttaactgaaagtaaaaactaatactctgttgtccagtattgtagtctaaacacatatgtatctatttacattaaattagttcaaattgaataaaattaaaaatttacttcttcagtcatcctgaacgcattttaacggcttaatagcaacatgagctaccagcaacaacatcaaacaatgcagatacagaaacatttccattactgaagaaagttctatcagaaagagctgctctaaggcatagaaaatttgactagggcatatgtttctgcatctacatcagagaatccccttttaatgagttaactgattctgttaatggtttcaaattatgaccttgataccatgacatattacattcatctttcactctattattcattttgattttgcaagtaagtttacaaatgatcagattagattcagagctcattttgttagaataacaaaaatttaatctcattactactcattcctaaacattgaagttttcctcccagttaccttctcatgaatgatattaaactccagagtaaaatctgaaggctgacactaacagagccatccttttcagaaagtacatccaactatgttaaagtgttcattttagttcaacgatacctgaaatgcaggctgtgaggtggacatttaggatatgtacctgcctagcatacatttcccatccttttactaagagtactccaatttttgaagtctcccctagtatacaaagtcttggtacttctgtcagtcaagttattttctcactctcccctggccttgtgcttgacttaggaaacaattaaccaattggattatgctgtagaaacttacaaggagggaaattaaatgaagttacttaatctcaacgaaattacccaaatatatgctcatgagttccccttcactagacccccagagctgcccttattttgtccttcctgagttttgattgttcaaaatttactttgcatatgtgtcctcctgcaagattttaatgataatttttagattttgcttttagaatagccagttggcttttgcaaaagtattagatgatatcaatgtgcccatatttttacctacttgggaactttttcaaattacatctgttcttgatattctgaaatgccacgcttacccctttcttatctgtcttggtagcctaccacactattgacacactcatcatgaaccagataggtactttgaattcatctgcctgagaataatttaaccttcatggtctatttctgccaaaatactgctttaatacccccaatatttgttaactctatttgaagttaaatttctatctgtttgtgctttgagagatgttggcaaagagaaaggaggaaaataaactattttagataggcctagccttgtcaaatgtgttggagactttatagaaatcatgttgtcaaagtgatcaatttaaagaaaaacatacttatgtcttcttattttctgtatcaggatgtaactgaatatcttttggttagacatttgatcatatgttattttcccaaaccatcatttcaaggttattatcataagacaaatcactctaaaatctaatagttcaagccagtcagaattgagtgatgaaaatatacagctttatttataagtacattttatcattaggcttgaattggttcagacgtcatgaaaaattttgcatgctagtagtaattcctcaaactccaaagggattagagtttaacaaaattgccaatccaaaaaaaacaccaagcaaacagacatttattttaataagtacaaattacacataattataaatattccttatactaatatttaaactcagcagacagaggacaggttgaggtttgatttatattcacacttccgtcttaaaattttcaaaagacatcttttatttgcttacacatgaagaatgatcagtatcactatctgaatataaattaataagtgaaagtatctgtatatgtaaattcaggcaaactcaggcttaaaaatctaccttattgtaccacattgcaaaatagaaaggattgtaattctttataagtattcggtggaattaagtgcaatgcaaaacatgctatgaatgtcagctgttatatggaaaacatctaccagaaaagccacccatgagtccactcagataataatttttcctcttgtctgttttataagctgttgaggaatatataaaagaaatggaaatttacaaatttcaaataaatgaaacatacatatttttatagctatataatattacatacatttaaatagttacttgtattttattggctcttcggctacattccaaaacttaagcaagttaatttaggaagagccattaaatgcacgttctcaggcatattttcctacttgtaatgttcatgttcaaacatatttttcaatatgtaaaagtaaagtctttgtaaaataaataatttaagacattccttgtattataactgcattcagaatgtataatacaattatggcttggaaaaatcaccttaaaattttgtcttatctttttgttgtgcagaagctccactcaaaagaagacatacatgcgtccaacaaacatatgaaaaaaagctcaacatcactgatcattagataaatgcaaatcaaaaccacaatgagataacatctcattccagtcggaatggctcttattaacgttcaaagaaacaacagatgctggtgaggttgtggaggaaagggaaagcttttacactgttggtgggagtgtaaattatttcaaccattgtggaagacagggtggcgattcctcagagacctagaggcagaaataccatttgactcagaaatcttgttactgggtatatacccaaaggaatataaatcattctactataaagacacatgcatgcatatgttaattgcagccatattcacaatagcaaagacattgaatcaacataaatgactatcaatgatagactggagaaggaaaatgtggtacataaataccatagaatactatgcagcataaaaaggaatgagatcatgacctttgaagggacgtggatggagctggaagccattatcctcagcaaactatcataggaacagaaaagcaagcatttaaagtgggagctgaattatgagaacacacggacacatggggaacaacacatactggggcctgtccaaggggtggggggcagggagaacatcaggaagaatagctaatggatgctaggcttaatacctaggtgatggtatgcatctctgcagcaaaccaccatggcacacatttacctatgtaacaaacctgcatatgctgcacatgtaccccgaacttaaaagctgaagacttttttttttcttagagggagaaactagatctaaatgagtcataaaatacaaatgaatacaaatgcttaattctcctaatacgtcatttttaataaattaaaactatgcttatcagttcatgtgggattgtctaaaaattataaatgaaagatttaaattctctaccttcacaaatcaggtacagctagcattgatgtcattgagatttggctgatggtacatcattagattctataattaatcaccaacacctgcagatgcattctcaacatgaaattacttttgatatcacatggagaaggagagatctcactaaatcttttaactatgagtactttggaggtaacagagatgattgtcatcttgtcacactgagacatgttgattctagcacttttggattcttccatgaatatgttaaaccattaccaataggtcaataacctgcccttttcacccctgactagaaacactattttaaaagagttcttattgatttttttctagctgtttttatttttctcactttctaaaataccaagaaaatatcattcaatgctgcaaaaataacctaaagaaaaaaaatctaggagcatcatacaataaaaatgaactgatttcttatgaagtcagcttcaaaactgtgtaaggcccaattcttatctctgacaatctgttacttaacatttgctgcttaacacttcataaaagtcaagtctagatgaactggcatacttcataggctttttttttttttttttttttttttttttttttttttttgagacggagtctcgctctgtctcccaggctggagtgcagtggcgcggtctcggctcactgcaagctccgcctcctgggttcacaccactctcctgcctcaacctcccgagtagctaggaccacaggcgcctgccaccacacccagctaattttttgtatttttagtagagacggggtttcaccgtgttagccaggatggtctcgatctcctgacctcgtgatctgtctgcctcggcctcccaaagtgctgcgattacaggcttgagccactgcgcccagccacttcatagtcttataaataatttactgtaatactcattaagggcagtaaaacaatcagcagttactacacactgacagattcaagtatagagtgaatgagatactatgtatctactatatcttgaaactaaaacataaataagtgtcacaaatttaaaatatacatttaaaaaagaatagacacacacacaagcacacatacatacaatcacatacacatccaaacacaggcgtattgttatacatgcatataaattaatattaaataaaacttatgttttaacaaactctgtatacttaaattcaccagtggttagttatcccaggcagtattacctactaagccttagggaccattattttcatttaaattccagtagtaggtaaaacctaaatgtcaaaacttagcacaatgtttaatgagtggataaatattagaaaccacgtctcctgaaatcttaggtaagtcattattaggggcttactactttcagtacctgacatttactcctttttttcatattagttttattttttattaaatgtcctcctgccttgaagataatctatttaataaagaagaaaaaaaagtgcttttttactttgaggtttacttgaacataagcatcacctttgtaattccacacaagcgtcacctttgtaatttgtcctttaagacaattagactgttttatatcaatgtattattaaacttgattgcacttatgcaggacatattataaaagaattatgagggaagtacacagatgctgttagagtctactaaaaaatagattatttactattggaaacccaaaggagagaatgcctcaaaaatgtggtaataaatacctgtgggaaaatcttaagttgaagaataatcctggacataattttatttactattgttattatatctttatcctaacgagattaatgactgatgttttcactgcaatttcagttaataggaactctatacaatgaaattgcttgatcaactgatagttttttagtttattgttttattgacacataatagttatacatgtttatggagtacatagtgatgtttagatacacacaacgtatagtaatcagatcagggtaattagcatatccattatctccaatatttatcatttatttgtgttgaaaacatttagtatcttctagctatttaaaaatagatattattgttaaccattgtcattctacagtgctataaaatattagaacttgatcattctatctagctgtaattttgtgttccttaacaaatatctcggccgggcgcggtggctcacgcttgtaatcccagtactctgggaggccgaggcgggcggatcacgaggtcaggagatcgagaccacgaggaaaccccgtctctactaaaaatacaaaaaattagctgggcgtggtggcgggcgcctgtagtcccagctactcggagaggctgaggcaggagaatggcgtgaacccgggaggcggagcttgcagtgagccgagatagcgccactgcactccagcctgggcgacagagcaagactccgtctcaaacaacaacaaacacataaaaaaaacaaatatctccacatccttcctttccctctaacctttccagcctgtagtaacctgttttgcattttacttctatgagatcaacttattttagcttctgcatatgagtaagaccatgcagtgtttaacttttggttcttatttcacttaacataatttcctccagttccatccatgttgctgcaaatgacagaacttcattttttatgtctgaatagtatttcatgtgtatatgtgtcatattttctttattcagtcatccactgatagacatttaggttgattccataccatgacaatcacgaatagtgctgcaataaacattggggtacagatttctcttcgatgtactgattaattttcctttggataaatggtcaatagtgagattactggtatgatcattttaatttaaggaggtattcatcaaactggttgataaaattaactagtcccagcttaagatatctgggatctagaagcactgtttatatactttgcatgagacacagttctaaccatacaattaaaaaaaaaaaagattccaagcagttcatacctgtagcctcagacttaagcttaccctctaattagttaaacattagggcaatgattttctgcctgtattttataaaatgtcttcatgctggtggtagagtgaatgtggaggaaaagaacatatttaagtggaggccattcatgatataagataccatggaaagcttgagttttcagtttaggctacagaaaatgcaaataaataaattaaacagttggtttaaaatattactacaagtaggattttcccctgaaggaaggcttggttttgtcatgttttatgctcggtttgttaggttttattgttggcttcatatgtctcttgctgatgggagtatgtgacgtcaccacacggcatagagaggaccaagaagctgtcccagtatcataacagaaggagactggaggcaatgtgagaaataaaaatgcagagttaagaggaggtttatacaaagaaagaactagggagtgcgaagaagagacataatttaaaagaaatgttttcttttattatggaaaaatatgctgtttatagtataatgtgaatcctcttctcattatttttactcaaacttcattaaaatatcaatttctggttgatgcgttgtgctttttaagagataccacgaaagaggacttaggtggttattctggaatatgggtatttacgatgagtaaggtgactattttcatgcaatcatttcagaatcagcactgtgagctgtcctgccttaagacaatcgttgcgcacatctatacaatactatctatttcactccaccaccataccaatcatcgagcgctggctgctcagcagggtgcggatgtgtacttgaccatagccatagtggttctcttgagatgcagacagtttctacactaaaaatgagttgacgtttaggagaaagaaagaacaatcttggtggtatccatttgaaaaagggaagcggaacttcaaggaaatattggcacaaaaactaagactgcttacaagaggattacctcatctgggttagaggaggatttcaaggatatgaggcgctctcatcacaataaagcagacattcccaacagtcacagaagcaggcaaatgaaagatgatgtaaacttatataagacttgagttgcttcatcttaagcatccatccaatttcagtacatgggttcttttgctgtttcaaagttctttttttttcttttagtactgtacatttccatataaactttcattcagagtttttacttttaaataatttctgtagctgccttttgtacttatttgaagaataattgaaaagaaaaaaattgagaaaattaaaacagatttctttttgccaaaagaaagtattggtaatttatagcaaagctggaaacgagggcctcttaagagttttccaaagtatgtcagctagtagcatggggttttagatcttttctttactgcaatcaatcctgctggaaatatgaagtcagttcagaagatcagtagagttgagctagcaaaagaataaaaatcctgaaaggagttattaattatgtgcatactgtgtgcagacagaatcagaagatactggccaagacattatgaaacaaggaagaattcacgagaaactttgaaattgccatatgcaagatgcaagttccctttacccaattttgcactcatcttctgatgctagaaaagcaaatgagaatgttgctaacacaaatgttatgtatttgcactgatcgagatgggtgagttcaacaagggaatccagtctcagtgtggattactgataaatgtccttgcttttgtgctagcctaaatttctagtgttgagagacacattttgtgtagattccctatttatattacattaactaagtatcttgaggatatgatgatttcagtaaatgtcattcacacaatccatcaatagtcccggggtggaggggcgttatcagctattgtttctctgaataagtattatcaaacattgcttttctgctatacagaagcactatggaatgaaaccacaaagtctgtagacaatgtttttgcacactgtaaaaattttataaagtcaggtttcatttaatttacacttttgtttctggttagtgtttttactataatttgggaataatgtacagtggtaaatcattgtgaagtaacactgcattctccttaaaattgggatgtattcaggcatattaattatttcaggattcattaaatataattctaaaagagtttctctttaaatatttatctactcttgactggtcgtattgaatctcacattcattactaaaataaatttaagaggccttgataattgcagaccaaatatatagttacaattgtcgctatttataaagaggttcaagaactctaacctataattcacattaagttgaggcatcaaagaaaaaaatacacaaaaaaggcatgttggcagtgatggtggtactaccaaaggtagagttgggtttcattcctttcctgttccagcctatctattgcttttaaataacttatgctgctcgtgtgtgaagggatttctccttttactcacatatttacaacctctaattcaggagagagattagagatagagaatctaatacccttttaagttgcaggactataaaaacaaaataggcctcactccacttttctaaggcaagattctaggaaaggataaatatattcatgagtcaaaatccactacaatgaaataagtaaccaagggtaaatatattcatgagtcaaaatccactacaatgaagtaagtaacctaggttactgaccagaactctgcattgaggataaagccaaattctttataacctcaactctgtcagagttggtagtaatcaggactaggattcagtaataagcacttttatttaatatatatatttatctgtctctctctctctatatatatatgtatatatatatatatacacacacatatgtgtatatatatatacactcatatatgtgtgtatatatatacacacatatatatgtatatatatacacacatatatgtgtgtatatatatatacacacacatatatatagcatttcttcccctttctgttcaatacagcacactgattctttcctactatgtgatgctccgggctggtatgtaaatcaagaggcctgccttccctagccaaaatgtgaacacagcagagagttagcagggtgtaaatgaatcctactgtcattcccaataatttgaactgtgagtacaatgacacaagaatgagaaaaataaatggacttcattcattcaattggtggtgctctatcaacattgtcgatttgtgcttcctacatagacccctgaggctttactgcagcatttttataaactagtctcattctcaaaccttctcaacatttgtgtgggctaatattctccagaaaagatccttttatgattaaattggccactattggtttatgttcatgcaactacagaatcataatttatagcacatggcaagcatataagaaatatttgcacttattcttataaacagcagtggtaaattctacattgtttagccctttggggtggtttgcttgaattctatatagaattacaaaatgttccgcagagaagttctcaaataattcttgctgtcattcatgtaagataagtaagacactacttcgtgtgaggtgccacacataagttctagggaatacttcatcacttttgagcaagccagcaagaaagcccttaccacaaggaggatatattttaagagaaagagaaatgtgagtcaatcagttttgatagcttatatgcaatggacagttatcagtctgagcttacattacatttactaacgtaaatacaaaaatctttgggacatggtgagagatgtcagcattagctagctgtgggtcagctgtttactgcaaaacctgcaaggcttgggaactgggagaactgtttgttctcaagaggagacgtgaaacccgaaatatctcccttgaggatgggattttttaatgtacaattctttatatttttcactaaaatctatgtaattttctttcacaatcaacataatctgacaaaaatgagctgttcctcataatattgagacattcttggaaacattttgaggaaggaaagcttaggaaaacactatcaagtttctggccaaagagtagggctccacacatcaggatttgaggtatgaataaaaatgaggcatttttacactcatcaggtgataaagcaattgtgtaaaaaaaaaaaaaaaaaagaaaattctagaatataaattatcttttaacgaatgagaacaaattactttggagatatttggtagcttccttaatcatagtagctttgaatgatatagatgcccgattgtcaacagagatcaaaactaaatcagaaacttaaaatggcccaataaaatgtaaagctccttagaaaaacagcattgctataaagtctcaaatacagtaatgtgggagaaaatgacacgcacagcctatggtaagggataagagctgcaatatggagaagtttatcttggattctattttattacctctacctaagccactttttaataaaaatcatcaacagttcacaccataaaacattttggacctagcccaagtgagaaaagtcaaatatatttatatatgttttttggctttttaagagattatttattttttattatactttaagttctggggtacatatgcaggacgtgcaggtttgttacataggtatacacttgctatggtggtttgctgcacccatcaacccatcatctacattaggtatttctcctaatgttatccctcccctagcccaccatcccccgacaggccctaagtcaaatatattttatatgagatccatagtactcacaaaatttaatacatctatgtagacattgtcaaatataggaagacacttaacatatttctttgaatatactgaccctttttatatattaatgcctgtgtatcaaagtacatttcatacacagtttatcttctcctgaaatgtgattataaaattgatactctacaactgatgaaaagctagtaattgaaatgaagtcattctaatgaagcaataacactaacatagttttccaataaatatactgtgaatgacttagcctatggaaaaaggttttgaataaaaattattattttctaaatatctgaactgtaagatattagttctctaaatctatcttttttcttttccctggatttgaatatcatagctcactaaacatctttacaatttgcttcctctaaacacattctttcttctggaaataaaatggtgctttgaaagaatattaccaataggaagacatatttcaaacacgaggttcctgctttcaattacctaacagctggtactatgcgtttacatttagaaagacaaaaccttacaaagatgtattatgctttttcaagtaatttagatttgtcacagtgcaagaaaaactcattggcaaataattcaaataggcttgtaagtctcagagataaggggctttaaaaaaagcaaaatacattctttaataagcaaagttatgagacagatctataaaatagaattgagaaatctttcaaagtattccatgcagaacagctgatttagtaacctactgtgaaaagaactattgatactccaatagcagcggtgatacagtgaaaaggtaaattttgaggatgcgatatgactgcttgatctagtagtacaatactgtgaacaagcagggactttgcagctagacgtatttaagttccagttctgactccataatttacactgctgtggttcacttaaaactctgtgagcctcagtttctatatctttaaaattaggctaataatgcctatgtaagtgttgtgaaatgctcagaaatataaactaaaatcaatgctattgttttcctgtcatctggcaaagagtattgctccaattttatgtgtcaagtaatgtaaaacgtaaaagtactaacctaccaaatctgttctttttctaattgattacagaagaatccattaactttagtggcaagaatgtctgttatctctcaattgttctctcccttcaggctgatttttttgctaatatctttggtgctgagataatccaaaagagaacccccatctcctttagtggcagagctggcacaagcttatacacgacctcagggacctaagaactagcccaccaagcttgctaccactggagtccccaacacatccagtggtagtactgccacacacaggagagctggccagcccaatatctttctctccagcaaggcctcaccacagtctctacaaacaactgtagtctatgctaccaagacactcacccataccactgatgttaattgaagtcagagaaatcacatggagactatactaatgtgcccaccagaacccaagccaaagcactctaccaaaccaacactctaggacacatctacaggaaaaaaagtcttttcctataaaagctactccataaaattggaagaagaaactattccaccagttgcacagatatcaatggagggatacaaaacaggtaaatgcaaggaaacgtgacactttcaaaggaacaaaataattttccagtaagagaacccatctctaaaaggaaatctatggaatgcttgaaaaagaataataataattaacaaagaaacagatacaagaaaacacagaaaaaatgtttaaataataagaaaaataatttatgatctgaatgagaaattcaacaaaaagataggtatcatgagaaaaaatcgagcagaaactctggaactggaaaattcagtgactgaaatgataaatactactgagggctttaaccataaagtaggaattttttacttgaagacatcttttgaaataacctcatcaaataaggagaaagaaacaaggaaagaaagaatgatgaaaaggaaaaaagaaagcaaagtaaacatagtaaagaaagcctgtgagacatatggaacatcattcagcaaataaatatttgcattatgaagtttctgatgaagataagaattcatagaaaacgtgcttaataaagtaagagctgaaaaattcccaagtcttcagagagatatggacttccagagtcagaaagattaaagatttcctagtagattcaacccagagggttttcttatcgatacttatagtaaaactatcaaaagtaaaagacaaagagaattatggatactggagtctccaaagtggggaggctgggaggggaataagagagacaaaaagccacatattgggtacaatcttcaccactcaagtgatgggtgcactataatctcagactttaccaattgtattaatctgttttcataatgctataaagaactgcccaagactgggcaatttacaaagaagagttttaattgactcagagttcagcctggctagggaggcatcaggaaacttacaatcatggcagaaggcaaaggggaaacaaggcacctttttcacacggcggcaggaaggagaagtgtcaagtgaagggagaagaacttattacaccatgaggtcctatgggaactcactcactatcatgagaacagcatgcaagaaattgcccccaggatttaattagctccacctagcctcttccttgatacatgagggttatagggattatgagggttacagttcaagattagatttggttgaggacacacggcctaaccatatctccactatacaatttatccatgtaatcaaagaccacttgtacacctaaagctactgaaattttaaaaaataaaaaaataaataaaaagatcttagaataataataataaaaaaaaaaaagcaagagaaaagtgttgtcacatgtaggggaatttttaccagactaagagcagatttcgcggtagaaatgtaacaagccaggaataatgggataatagattcaaagtgctgaaagaaaaaaataaaagttggtcaaaaatactatgtccagcaaagctactgtttagccatgaagaagaagtaaagtctttcctatatggacaaaaactaagagaatcaattcatcaccactagattggcctgaaaataaatgcttaagggagtccaacatctggaagcaaacagatgatatctaacatcatgaaatcatgcaaaagtagaattactgatggagaaaaatgtaatccaaggaaaattgtggtgctatgatcagaaggcaaaaataaatactgggaaaaaggcaatatatatttgtataactctgcataatcatataatatattactgctttttgttttgtttatatctttatacatgctggttttggtcttgaataatctgaagatgaatctatgtgaatgaattaatttttatatattttattttttctacctctgacttcacccagctcccaacccccatcgcatactgaacccattaatggcttcatttccatcatgtcagtcatcagtccttctctaagccccaagacatccctgaccaagacaggaagtgtgcctgcatttcagaacggaacacagagttcatctacccgatatgacccaaatatcagatcagaagaagatacagagcaggcaaaacacaaaaaggaaaggcagcataaagtcagttccattttataaaaatgcctttcttttttactcttcttggaaaataacttcttgttctcaaacttttggtgatcagaaaaaaaaaataactttatttttttctttctgatacataggagcctggagcctgcctcaacatttttttctcttattgttctacctagctgcatacctcagtattaatactagaataaaatgtattttgcttttctttcacaatcccctcctcctttcttaagcttcatattttagctctctaattaactcccaagtagggtaatacctaataagcattatgtatacaattcctgagagactatttaagaaacaacccatagagttatcccttgcatacctttgatgagtttcctggatccccttttgatctggattaattaatgttcctgagggagtgctgattttctagcattcttccacctttgatgcagaatctcaaaattcccttgtacaataactttgggtagcaacatgaacgcaaatggctgttcagatttcaagaccttctatactaattctttgtaaacttaggctgagacaagggggaaaaaagcatgtagcaccctggataaatcttaaattctgccatcagagctaagatttaccgtcatctgtttctgcagagacagacatttttttttaaaaggcatcctatgcttgactctaaatcctcacttatatcttcatcaccatctagagatggagcacctcagggaagttccagggattgccatcagcacccccttctctctgatacgttgttaaaggtttcctttctaataaataatttattgagttcctagagctatagactgaagtgtttattttggattctacattttttcattcaataaatgtattgagtgtccacacttatgatataatatgcacttatacttctccaggtaaagtaatataagaaattgtactgattggtgcaattactgaaagtgaaagtcccataatcaccgtcagttataattctgtgcttttagaatatatgacacaaaaccggcagcttgatgagagcatagcagtcatgcattcatctgtatatcaatgctaggataatatcatctgaggagtccatagttaaagtctcgaatgtagcttttgaatgaatcatatatgacatacataatcagcaagaacagacacatgattctactacttcactctattccaccagttaaagtttgagctcctaggagaagatctttcatatacaagacttttccaaaataacagataaaaacatagacacaatagtcccaaaaatattttcagagaattcaggcaagttatttttcaagtatccatgataatgctctgtttatagaagtcaaagacataaagtacagattattcacaagaaacagctgtcttgagaaacaaatctgatttattcatttaataaacatttgttggcaccatgcaggtcagtactgttgggaatatagtcataagaaagatacgtttttattaaagcagaattttaaatgaagggtatgctttgtggaataggattttatagatctttgaatttatgtcaatacaatgaaatgacaaaccgtagtttcttatcatttagtcttcaatatatgactttaggttttcttcttatcaatctgttcctgttactaagaaaacaatttatagtattttataataatgagaataaaatcaaatagggtatggcaggtcttcatattattattacaattgttcttttataacttgtatccattgcaattttctttgctaatttcctcaaaagttaactatgtaaagatattatatttctatataatatctctagatttgtttgttctaggttttacttgtctaacctagaagattatcctacaaagtccatggcctttaattatctaactttgaaggtatcatctttagatagaatgccaattttgattctaaaaaacttgatcttgctgtacatgtgaatcacataatgcagttaattggttcattaattatctataaaaatgtggaaaaagtcctaaatggttgacaaatatatgctaaaagcagggtataaatataggccaacatttaaaaggtttccaaaatattctacataaagataaaaaggaaaaaaaaacaatttttacaaaaatcatcttaatgtatgctttgtgacagttacacaaatatataaagtgtatgatacaatcctttatctaaaagcatttatttttcaagttttgaacttgactttttagaaaatatgtctaagtttttacatatcattatgtgatagtcaacaatagtgtcaaaattctaaacaatttgattcaatgtgagaggctactgcaatgtttctcacttcagttactcttaagtattctcttctgcaaggcaagttacactacctctatattatctaaaagtgactcttctccaggcatcaagagtgcagaacatgacaggatgagccagtatggacttttcaccttcccttcatggggcagaaaaacattcaggaaatcagagattttcagtttaatcatcagggcatgaacctcagggctcaaagctgctgagagccaacatacggattttgaggacagattcaactagcaaagccaatggagagatgcatcccaaattcatgtttgagccttaagttcagcgaagcttgtagcaagccagttatatatcactaggttttcaattagttagaacaataaatttatttatcttctcttttgaataaacttatttaggcagaaagagagtatccgagagagcgtgaataaacagcatgagaaaacttggaatatcttagcaacgcaatgacaccataagactggcagcactgtagagaaaacagagtaagaaagaagagaggcacaggaaggggagaaacaaaaaataggaagggtgaccatcaggtgaaaaataatgagaactttcaggaacatatgggaggaaggtttgactctaaagctattaaggggatagaattaacaggaaaaaatatagcatttgaaatacgagcagaaacaaacagggataaaacagggctgatatatgggtttcaagcttgtaatatgatattagatgttattagtagacgaaataagattataatgaagaaaaattagaggttaggaagcagggatggagaagagatcatgaacttagttttacaccttatgaatctgaaataatcatgggatatccaaatgaaagttccaagagacagttggttatgcaggtctgagctatggaataaaatttggagatgtcagagatacaattttagctgccatctatagacagaaattagttaagaatttaacggtagataaaataaatcagaagtaatatggaaggctggaggggaaaaaaataagaaagtatatctgagaacattaacgtgtgagatatacatagagtaagaagagcttgaaagtaaacctaaaatctgtcttcagtaataagatttaaaatgtaaataattataaacaaaaaataaacaaaaggtgaaagttatgctatgtaaaagtaggcagaggagagattctaagatgggggaaaagtcagcaatagcaagtaatgcagatgggtcaaatcttccattgagtttagcaagtcattggtgacaactggtatggggcatctcagaaaaatagtaaaggtggaagtaagattgcagtagagaaagtggaattgcattaataattcactcaatgggtcatcgagtttgaagttgaattcaaacttatgaatctaattctttatagaatcaaggtcctctagaaacttggtcatttcctatatgaaactttcaaagaagatatttatattccccatgagaataatactaactacatggaatatggggtcacattgaatgtctcaggaattgttgctgattttttttctatgagaaagcataagtacgtctaatatagtgaatggctcccaaaacattcatatttaaaattcatttgacaaccaatatataacataacatttataagaatgtctttggtatgaccaacaccaaagcaaatacaaaaacaaaaatccttaaagacatactatgtgtgaatgttataagttatccaaaaatcttgtttctattttgtcccttgttaaatttttaccctatgacttgctgagaagctgcaggagagagaatttcctgatgagttgtctaacagcttattctttcctcctgctatgtcctcaacatctatgttcaatattaaattgcactgcagcggagatgactgtgtgtgtgtgtatgtgtgtgtgtgctttaagcaaaagacagaggcttgagtgatttagtagctacaaatataaatcactgacaagcaattaacatatactttggttcaaaaccaaatatttccttagcaacaatcataatcactattttacagtgaaaattggcatatttatgatatgttgacattaagatattcagtaagcatattgatgtttaaattccatgtttaaatgcaactatttataaatcaatcatcccacaatcaccttttcttaattttgaagtgcaaatatgtgagtttaagattttagattgaccaaagtgcttatttgttttcttccacatagctcagtttaaaatttgtaaaaagtattaaaccacaggaaagaaaagtgataaaagcaaatatgtgattcagcaagtttcttaatgtttgaaagtaaatggaaggtcataattatttaaagcagaatacaaaaatatcacattgaaaatggcaaaattgggtgagtatggataacatacactatcaaattgactggagaaaatacgacaaacttaacaaataagggtagcatgaaaatcaagaaagattagtggtgtcagttaaaatattaaataaaagtataggtaaattagggggatccttccccaagttctgagcaattttcccataagacttctccttccccataactaagattttattttctgaagaaattgtcagagagccaccagacttttaagtcaaagaaagtaaggccaattctttgcttgagtacaggaatgtctacctgctgacaagctctgctcatacacagaagatttccaaagagcatctcagtgcccagccactagtgacagtgacaactatctattaaaaatccacacacacatttttacatatgtatatatttacatatatatatatacctatatatgtaaaaaatatatatatgtatttccctcatcttttagaacacaacaagagtatttatctcaacttcccaatagttaaacttggccttgtgactgagttctagacaaaggcaggtgagaagtcccatgtgccacatcccatcctatcttgatttatgaaaccttctttgcaggctgcttatttttttcccgcagaaagttgtctggggtaacaaatcctctgagcgagcttggaagccatgtgttgcagatcattcccctggccccaaggtcctgttgacttaaaatccacccacacagagatacatgaaaaataataaacactgaacaattacacgtgaagatatatatgtttccattgcctacatactcatctaataatttaatgtgaatggagaagcaggattaatcagcctctttgaataaaacctgaaaccctaaaaatggaaaataaaacagaataaaaaataaaaggtgggaatagggagaggaaataatagagaggtagctaaataaaactgctttaaaataaacatcctcacaaagataagaaaatataattttaaaaaagcaaatgacttagaggataagaatgagatcttgagagaaaaatattaagacccacaaacaaaaataacaataacaacaaaaatactcaaaatactcctagaccaattatctttcaatcctaacacagcacctgaactgcttttcatgtttactaataacctccatttttgaaaccagtaattatttatcagttcctgtctttttggaatcattaatggtatttgaaacaattgatccttataagggcccagagctcttcttttcttaaaataaaagaaatatgaggtagtactcagcaatcaagtagtccagataggtcaaatcttccattgaatttagcaagtcattggtgacaacaggtatggggcatctcagaaaaatagcaaaggtggaagcaagattgcagtagagagagtggaattgcattaataattcactcaatgggtcactgagtttgaagttgaattcaaactggagaatctaatcctttatagaatcacagtcccttagaaaccttgacctcttcttttcttaaaatttaaggtccacagaccttttcttttcttaaaatttatatccagcccaacttctcttctaagctctaaacttgcagggttatctaatttgtatgcattatactcatctcaaacgtaacatgtttaaaaatgagatcttaatttgcctttctaagctcatgctaatcttcccatctcagtgacaattttaaaaatcctgaagtcatccaatctctctctctacttcatatctcacatttaagccatcaatacattatggtgattctatctttaaaatgtattcagaatcaaaaccacttctgaccaccgcactgctaataccttaggctgagccaccatttctttgtgcctaaattattgcttgggctccttaatttctcatttctgctctcatctacctgttgactatttccacagagcagggagagtagcacctttacaatgtgcattaggaagacttctgatttcattaagaagcccctcttgttacaacacaaaagccctgtacacaacacaattaatgagcatagaatgaccctgagaagtagaaagaacaaggtgaactggctagagacctaagggccaacaacaacatggcagtgagccctctgggtttccttattctggcccataatctggggcagggctccaaaatggactggaatatagatgcaggtccaaaaagctccaagaaaaatatctttactctaaacaaaggaccagaaaaatggtggtctaaaaacagaaaaagttttgggaaatacttgcctactccagccaaataccaaggacaaaaattgcaccatctctaccccactagtgacttcagcaatgtcaagtagggagcagatttttcacaaatgacaaccttgcttctgagaaagcaggtagctgccactaaattcatctactcaaggagctgtgatgaatggttttgtgtgtcaacttgactgggcgataagatacccgaatacttggttaaacattattctgggtgtgcctgtaaaggtgtttctgaatgacattaacatttgaattggtaaactgagtaaagcagactgacaacccaagtgtggatgcgctttatctaaaccactgaagtcccgaacagaacaaaagttgctctccctacctgtcttcaagctgggacgtgagtcctttaccatcagacttgaactcagactggatcaataccatcagtattcctggatctccagcttgctgactgcagatctagggacttctcattctctgtgattacttgggacaatttcttgtctatctatctacagatagacagacaaataggtaacctatttgtcacctatctaatttcctattcattctgtatctccagagaaccctgacaaatacagtaatatagccaggttgagcactggcagggtgggatcttatatctcattcactaccagaaagaaggaaatgtactgagtcccccattcccaactcctacccatatcatgctgttagcagagtcctccacctggaccaccaggtgagctaggtgagcctctattcctacccagtaccaagctgacttaattaaggaggcaatatgaggatgatcttgtcaattgtaggctccactccactactccatgtcaccaccagcacccaatatcagtaggctcaggggaactgaaccttcatccccacctgggcatcaatgagattgaaactgtgttgcaagtctaggctagttagcactgcgctttatccccacccttggtgtcagggatattgagtagctgagcctccacacccattctgcagcaaaaaagtattgcaagtcaattctctattttcaatatctctggtggctctgggatacaggagggaagctgagattttatacacccacccagaggcaatgaggcagtataagtctgggtcttaaaactgctgaaaggaggactgccattctgaaaaatcatggaatttagtggccagcatttttgaagacttagaaaaatttatttttctaagtcaatttatctattgactatcatgatctgtggaatgtctcaaaaaaatttaaagatacaggttcagcaaagtaagctgaaaaaggcatgaattaatgatagaaaaataaaaaattagaaaagaatcacaatctatttttgcatattgtagtaaagtagccataatttatatatgtatatatatgcttatatatacatatatacacacatatatatacatatataaacatatatatacatatatatacacttgtgtatatatatgtaaaactgtgcttagaacttggggtaggataaaaaatgagctgatggtataaaataaccaaatgttaaatagcgtaataggaagaaaacaatatcttgaatcagtaaatcaaaagataacatcataatcatgttatttaaaaatatgtgaataaataaaataagaaacatcacaaaaaagggtttacaaagttgtataggaaaacttgactaaggggcaggaatgtgttcttttttttttcattatactcacaatttaatgttcttttttgaaaacaatgcacagctatttctttgattaaaataatcatgaattctaagaaactgctttgagatatatatatatttcctttaagatatatatttctttcctttaagatatatataagatatatatatatcttatatatatcttaaaggaaatataatctacatcaaaatggcaactatttactaaacatgcattttattacataaacacacagcaatgctctttgctttggcattttctcaattacacaatatcttccattcaagttaccatctcctaaaaagttatttgagaaaatcttatttctcacaatgaaaccttattatctgaagctcagctgaatattgttctatccttagccctaatttacaaatacaaaataataattaatataatgtatgctattgaaagctcagtatatcctgagtggaaatttttcaataaaccttataaatatgcctgaaatgtttgctgtcatttttttgaaaaatattagcacaccaatgcaactatagctaatgttccaaatggagtattttatttcatgcttaccgtatcagatggaatgtaaggttaacagactttcaacacctcttaaatgaagggcttcatgcacacacattcagaagtaaaattaatcagaggggcaaaatctgtacctacctggtagaggttaaatggatggcatatttaaaatcaccattcatagctcctggcacacagtagactctaaatattttttccttctatcatttataagataaattcaacaacacatcaaagaaagtaggaaaataaacattcaaaccaaactcttgcattcattcctagattgctttttttaaaacatagtcaaacagtagtaataacaaatttagtaaaaagttctgaattgtaaaattcaaaaattgtttaagttcaaatttttaacataaaattgaaaatcaaaatttgagtactttactttctggcaaatctctttatttatcataatctgccttatagctagggatagccttagtactttcatattatacattttcacttacaaaccatacacattctttatgatgatatttctcccatcttttcttgaaattcagaaaaagaagtatatgtgtgtctcatttaaaattctccacacttcttagttttatactttttttctaacttaatggtccacttttccttgtccttggtcgatcttcactcatcttactataaacattcacttactttttaaaaattcctaccgcctctctcttccaaaaccagtccttatattaagtaattaaataaaaatgaccaagtcaccaccaggacaaaataaatgtccattctcaaaactattacttcagttggccttaagaaagtaggatggacagtagggagatatcttttctagtaattctgcaaatcaataccaccattctctgcaaagcagacaggaggaaattgattgtttcattgcaatgtttcatattaaaaaaccaaaacatcatttcagcttttccatactctatggaaactaatattcagagcaaatatgtattctttcatcaaatatttattgagtacttaccaaattttggacactgagctagttagtggaattactaaaatacaacgtgcaaggccacaaatgaaatatgctttttcatttaattgagagcaagactatgagatagaaaataatacctgagttttccaggtgatgcaactatagcttatcaatattaaattactcactatattctgtgcagaataagggttgaaacaaggatttaacttgacctctgatgccttgacctctgatgacaatgcttttgctttcaagaattatacctaaataattatgttgatgtcaaggatgatgatgatgataagtatcaatctccatttactgaaatataccttggtttcaggtcctgtgcttgcatgctttatgtatgtgaattacatccttttatcaccctttacagagagaaaccaaggctcagagaagttaaacaacttgatccttgctggtaagggagtggaatagaattaaagctcaattccatctggttctgtattcttttctttaccatcaattctctatagcaacagttattgaaacttgaagacccatctcacagcctctctcttacatacacacatttaatttcattctccatgcttggatcacaggctctcttctctgtctttctacattatctatctatctatctatctatctatctatctatctatctatctatctatgtatctatgtatctatctatctatctatctatctatctatctatctatcatcatcatctaggtatctatatctatatatcaaccttcctattatctgtatgtatgcctgtctcagtctccctttctgtctctatctctcagactttctgtctctatatccctttccctatctctttacatttttttgtttcattttgattattatttgtctttctggcaatctgtctatttctgtctttcttgaccctgtgttttcccggcctgtctgtcactctgcttctacctttctgtctcaacctatctccacttctctctctttctgttcttttctaagtgtatatctcagtttctctttctgttccctttctctttttcttatatttgactgtctctaacttttattatgtttttccctgtgagtctctctcattttctttgtgtgactatccctgtatctctctttgagtttgtatctctgtgaatatctttctgtgacttatctgtgtctgtctctgtctctcggacagagatgtaagattctaaagtaataaaaacctctcatccagttttaatgacccttttctggattccagtgatgtgctgcaaagttgaagaaataagtcccttaaatgataaagcaaaaagaaaagtcactgtccttggataaacaatttgcatttccataaggattcagtgatgcagaatcagaaaaggctcattctgacacctccatgaaaacaacagggagagcattcattagctgggcttccttttgaatgatgcacttcattgcacacaccgctgtcctcccccggtcaggaaacagtgcttaattctatcggaagtttgccctttcactaggcatgagaatgaatgacttttcaaagtaataggaactacacatctgccatggcctgagaatgcttacactctaaaagccatacagaaagttacacctcctatcaatttcttatccatcaaggaacacaataaacaagctttgaacttttccatttaccaacttgaaggaaagaaatgcttcattttctttagttttttgaaataatgactgcttttgcctcttacatttatagcttcaatagccatgatctaattttaagggtgaatgcaacctttaaacaaggtttatgatataaaaggaaatttgtccattacagtgctcagaaacttttactctttaggtgaaaattattttgttgctgttattgttgaaacacacacacacacacacacacacacacacacacacacacacacgatcatcttaggaagtaattggacaagattaaaacaattaattgtatttaaaattatttagcaatttacaggtttcttattcattttgctggcttcatttataagttatgtattttaaatgtggacactgaggaacaaatgtttagagggtgtgctgaggttctcaaggaaaataattgttgtccttcggacagaatatgatgtttctatgctccttatattaataaatagcacacatgtgtatgtgtgggcagggggggagcggggtgtgtccatcttactcagcgtgactgacttttaggctgagattaagtcatactcgtctacatattcttccaagtctctcacttcagtttatacaccacagttgaaaattgtattttaaggtcaagctagtcgctctcacattcaaaactacctcccatcctgcccctgccatccatacatgcaacgaattaacatgtgcatttggaatttctgggtgtattctcggttcttgtcaccatttcaacctaagtgcttccagtattcaatttaaataaacgttacagtttctgggtgatttacacctctggaatttctatggcgactctatcaagagaaaataatctggccataaattactcacattagctttttttttttcctcactcaaaattgactatgagcactaatgagtcaccacacttccttccaatacccttggatgcaactcagtcatatttgagtctgaaactaataaatgaagccccacaggtcactgttagttttgaatccacattctctcatgctatagtgttaacgacaacaacaaaatcccattacaaaagaaaatatatcaaacctcaaacaaagttttagttgagagtaacaaaaatagtttttggatgccatccctgacaagtaaaacaatcttttcaatattataattgtatagtcttattttgcatgtgaaaaccacagatacatagaatgacaaaatgattctagttcacaagtggtcccgatactaagaactcttttaaaaaatggaaaaatacaaacaaaatgactatgaccaaaacccactcttaaaatagagtctgaagtaaaattaaacttttagataataaatatgatcattttatgaagtagtgtggtctctttgtttagattattatttctgctaacttttccttgtgttcaaatcctgagtgaaacttaaaaccatgtatttctcccagcattagggctacaataaaatgtaaatgtatatggggggcttctgtgttaggaagaagttaatataacagctcgtttatgaaaagctattgttttacaccatttaagtaggaaaaaaagttcctacagtctgaaattgtatctgcacatttacagaaagggggagtacactcatctacccaataaagtagtcacatttatgaaattactttataatttttggttttacattttactattttgagaaggttcataatttgtctaaggagtaaaagtcctcatgataaagtgataacacaaaggaatcattaattcctcaacatgtatttgcttgacgtacgttttgtgatcaaataattatagtgatttcctttgataaaaataataattaccttttgcctttaatttcaaacataagctatgaaccaaatactggagaatttttgcaagtggcataaaaacaatttatgtctgcctatctgctgtgaaagttgtataataaaaagatacaacacataccatgcaaaatttaaatgtgaacaaattaagagcaaagttgtaatggacatttatttttcactgggtttttttaaagcataattattagtgttttttaaaactatagttcagatacttatcaaatattatcagtgggtataccatatttttaaacatttcctagaaaatgaaatgttttatttaaatctttttgtgaataatattcaaaacttcatgccataattttccagagaagttgctgacacttaggtagcacaaactctgacctgttcaggtcacttaatgattatgtttaagggtaatttggggggcaaagttgtagggattcacatttcctgctcagcacataattgcaacagctgaggggttaggaggtcgccactcagtggaattgggcacccattaaatggcacttttatttcataggagaatgagtccacagtcaaggggatcaagttgctgaaacttgaagacacacatgtacagatacattcactcattcacacttagccacaacttaagcaaactaaagaaactaatagtaaaaccaattttctgtgaaaagaaaacaaaaaaacagttcacatgagcatatacaacaaagcttcatacctgctgtgcaaaccacagcaagcattttgcgctcaaaatatgcctcttttacagattatttgtttctctaatgttaagcaacataataacttaagtatttggttactagatttgacaattggctcttttgtgaaagcaaatgagtatgacttggagttaaccttacaggaggccatcatattatactctagttaacaatggctttctgcatacgtgctacaagtccatcaaatcgatggccatctgtgtgtactagagacacagagtatcaacacactgaacctgaaacttgttattcagggcccacccactctatagctaccaaagtatattttttaaagtaaaggccacatcacaaagtgggaaagctgttaatactatctagcattaattctgtattagaaggatacagttgacctagattcaaattctaaatggttaatgcttccagatacgcacaaaggaagtaaatattctaataaactaaaacatccacagtaaaaatatcagtatactcacaaaagacaaaaaatactgttcattgtgaggcagaattagctactttaactcaactgccaactataacctccagcaacaaccactcataaaacaaatcatcaatatttgcacacagaaaaacaaaaagtcaattctgatgccatttttctgtattttttcaggttggaggaagtagaagaagtggttgaggactaaaaattcttttaaataacaaaccagagttataattcaaaagcttgtgtctttgtaaagattacattgtcatctaaacaaaattacaataccagacagtaatcaggaagaatgaaaggacaggcagttgtgttcactcttccagcaaataatcacttgcaatcattactactctattctttcaacaagcatgacagaaagtagcatcatgacagagatcattgtactgaaagaacatcttaactttctctgtggttcactgctgccttaaatttgaaaaaaataagagaagggcgggggaagaacttacttgcggtttaaagtttcatctttagtccatgtaagattatgcagcaagttttcttgccaaggctgcctcttgcacatccctttaaaaagaaccagtgctcataatctagttccaagacgattcattcacatgttccacctcttgtttctgtgaggcattgatatccactctcatatcatcaagaaaatgttactaggaaaatttttagaaaagcaaaacagttcaacatgttaactcagaaagcataccatcattctccacgttctgagatgtatgccacctgccttagttaccacaagcaactaacactaagctgctagcaggaatctgtctgccctctatctgtcgctattagctcagcacgttg

SEQ ID NO: 1183 - DNA, 980193 bp, Homo sapiens; identical to SEQ ID NO: 1177

SEQ ID NO: 1184 - DNA, 980193 bp, Homo sapiens; identical to SEQ ID NO: 1177

SEQ ID NO: 1185 - DNA, 998520 bp, Homo sapiens; identical to SEQ ID NO: 1182

SEQ ID NO: 1186 - DNA, 980193 bp, Homo sapiens; identical to SEQ ID NO: 1177

SEQ ID NO: 1187 - DNA, 992601 bp, Homo sapiens; identical to SEQ ID NO: 1178

SEQ ID NO: 1188 - DNA, 980193 bp, Homo sapiens; identical to SEQ ID NO: 1177

SEQ ID NO: 1189 - DNA, 214658 bp, Homo sapiens
ccctggatgattttttttttatttggaaaagaaggggttctgtatccagagggggttccatacccacatcgtcggtggtgggcagtgtggccacatgcccggatggcaaagccggctatctagcaggcagctatctccgcctggtttttgtgcttgggctcgctggccctttctctgggagcctggagggttggtgagtcctggtagttctgggtcatgaactgggtgcttgcttcaggttcgcccaggtggaaacggttcagaaatctgtccattttccaagagcctggaaggacaaacagaccacagggaggcagtgagaaagagccatggacttgaaagctggcaggggcctgagagggaggccggctcgtgggagccgaggcagcaggtgatgcgatggccatggggcgtagtggctgggggagcttccggctcctgttgcagaggtagcccccagatgttagcagagcctctgaacagcagcagagctgcctgctccccagagggcaatggggactgagagcccagccccagttgagaatgtctgaatctccttccccagcacctctgtttagcaaaactgccttctcgctcccgctcccgggcagaaaggaagcccagtcatgcgggctgcccacttcctctactaatgccctctccctgcaggctcccctgaccccaggacaggaggcttcacccactactttccttcacacctgctcacccctgctgctggggctgagattggtggaagtatctgtgctcttctttcaatcttctcccctaaaccccaaacacctcctcgtctctgtcccaggacagggggtgcaccagtgtgccttccccatggcagaggtggaggggcagcccctggaccctggcgggggagctgggcctgcagaaacccagacggtgcccaggtcggaggggttcctcctcagggggagaaaacacaagtgtgtacagggaggcgcatcttctggggcaagtgtgaacaggccttgtggcagggcaagaagggcacagcctggggcatggagtgaggctgagggaagtggtcagaggcatattcccacgttcttgtttcccaaaccctggatgtcaggcaccctgggcagatgcttgccaggaaaaggcaggaagtagtttaatttgaatctcagataaatagcaaatcgcttgttggtgtgagcgtgtcccacattctgcatggagcatccttacatgaatttttttttccgttgtttatctggaattcaaattttactgggcatcctactttttgttgttgttgttgttttgctaaatgcagcaacctcccagggtggagagagagtgcctggggaagatcctgtccggagcagagctaggcagtggtcgatacacagtggattaatggagaccagtcacctctgatacccagacagaagagggcaaggggttggaagctctcagaaccccacttgagactcacgggccacccaccctcccacctgcctgtctcctcggtcagcacccaccacccttttcatagcaattaagatagcaagcccattgaagcgttgctgcctcccagaggctgctgacatttcaaagatgttctcaaggagaggataatttttaatctgaaacccaaaataacaataacaataatgcaaacaataatagcagtaacaccccacctatgtgttggtactactgtaagagcttgacacataattcgcttaatcctcacaccaatcccaaaaagggaggactgttcccattcccagttcacagaagggatgactgaggcacaagctggggtactggcaaggaagcttcgtagtggcagggatggggaaaggcctttgcagattccctcaaatcctattcgactcagtgactgcatgctcagatggggcccaggggggctggaaaacaaggggttccaggagttcttttgcagaaagggtggccaaggtgctgagaaagcctctcccggtggaggtgtactgactgcagccgggttctcctaggaggctcagtgtcacctgagtgtcctttcagaggggctgtgcctgagcctctgcaccctaggagcccagctggctggaaggaaaggaattatggtattatgaccctgggaacgagtgtgtgcacacacatgtgtatgtgtgggtgcacgtgtgtgtgcgcacgcgcacatgccagggtaatacgggcttatgggtgaattggtgtgtggcaggaacagggacgagggggccttccccaccgtagggcaggaaggaacctgcacggcaggaagggaattgaaacccatcacgaggctggggcaagctgcggggaagaaatcccctgagtccagagcgagagctggctcccctcaatagttcggaagcctctgagccttcagtgccctggggcactcgtggttcctttccagtcccaagtcgacagccctgtggttctcgggctccctggccagctcctgaaacccagtccccgtgccggctagcctcttgctgcctcctttcctggcttggccgcaactccttacaccccctgtttcctgccacagagggcaagttctagaaggcagagggggtgagtcaggcccttggggtgtgtggggagagctggagagctaggaggctgcggcttctgtggtcaccgctcagaggaaagccccttcctgtatggcactgctgtccccgagaggcagagagtccgcggccaggcaggaaaagggcagcgctgctgtctgtgcttgggccactccactgtatcctggatgcacctaggccaggctcttcctgggacgagggtaggggcagtgtgggcacttcagaggccttggtggtgggaggccttggctgaagggagaaaggaggaggaagctgtctgatgcctgtctcatgagccacctgccctgtggctgggacacagaggcctgggcatctcaggacagggctgccacatatgatgtacaggttgatccctgcacaaccgtagggggtgctgttctcatcctgcatagccagatgcagcagtcctggcactctcacttactggtcagtgctgataggaaagatgttagtgatgagagatgttagatttcagcgatgttccagatgggggccaaggggagagcctgataaccttatctaaagccactgggggatttctgggccaccactctgtgcctggcctcctattaggctctaggggggaaagatgtcccctgtcttcagcagctggggaaggggctcctcctcggagctttagtcccagggactgtgatgatggcaggaatgtttggaaaaggccctggggcaggtcttgacagtcactctctccaccccaagcttcccaaatctgtggggttggctttccactgtttgggagtggtttgtcacgtgctggacaaactctggacggctccattgggccagttagggctaagcaggcatctgagagactgagaggtgctctgccacatccagcttaccctggcccccttgcaggacttggtagaatgggggatcggctcccctgccagaagtgcaagctcttagatgaggtcagaccccagggcccctttaacactggcagccatcaccctggtcctctgccaggcatggggtcagcggagctgccttattttaccccctgcccttggcgagtttctaatataatacaagtaatactaacctaatcacagtctggtccttcaaagggtggccttggccagcagtagaactttgtagtctgggtccctagcagacaaggtccccacccctagtgacacccctggattcccttcggcaggaccattctccaggctggggtgcagtggcactatcacctctcattacagccttgacctcccaggctcaggtgatcctcttgcctcagcctcctgagtagctggaaccacagttgtgtgctaccacacctgggtaattaaaaaaaaattatctgtagagacagggtctccctatgttgtccaggctgatctcaaactcctggcccaagtgatcctcctgcctgggcctcccaaagtgctgggattacgggtgtgagtcactgcacctagacaggcccactcttaagacttcccaacagccgaggacagcagttcctgggtgaccctgctgtagccaagggacgtttcccacctgactggtccttggtcctcagtatttccgtcctgatgtatttccatcctgatgtacttccctcttagcctgggaagtggggtaggaagctgagggagggaggctccccccaccccagctccattctcccatgggcccccgttcaggtgggctggagaacaaggagtgggttgctgagaccttgaggttggagctgcggcagcctcttgtcccagggcggtctctgtaaggacaggggccactggttctggctccggctccgaacagccctgttccttcaggtggtgatctgtatctacccaaggtgatcaccctcttccctggcctcgctgcctctcctcttaggtaagggcaccactgcttcttgttgggggatggtggccctgaagagaaaaaacaaaaactcaactccagcctaataaccgccccacagagagcccggctcaggtctgtaatttgtctggctcgtcacgggaccggccacattgatagaagcactgatacctttctgccgagattaatgatgtcccggcggtggtaggcgggaggcctgagacttttattttttgtgccattaaatgacatccagagacttccactcaggacctgaaaagccctcgttccatcacatccaattactccgggaggagatttgctgagtggctgatactgcgggctccagaggctttcgggtagtggggggcactttgactttggcaggagtgagagggaggggatgccagcagagtttcggggtggtgaggggtgacctgcgtctcctctggagagaggacccaggagggctgaagagtggaagctggttctaattatccagccagtgcatcccctaggcctcctcctcccttctgcagctggggttggggcaggaaagggatcaggaggatgggagacttcaagctgccagtttagcttccagtgataaattccaatatttggtagtggcaacaattggctggagtttggggtagaatctgggggcttatctgtgtggtttcttcacgatgtgttcaacattgcttgggatggctgatgttcggctggactgggacttgcttcttgaggaggtccgcctggggctcatggagatttcaggcagttcccagcctgggtgcctgtctgagtgttgcccgggatggccccagctgggtggctgccaggcccccagttctacccgctcggccaggtgggtggggccctttggaggaagagcgcctcctgccacaagcccacacagtgatcaggggctgggccctgggggatgctggggctgggccaggtgaaccaccatgggaggtcacgagggtgggctgagtgtgtttgtgtctgtctgtgtgtgcgctggtggggggcagtctgagggcgggggctggtctccaggcagggccccctttcctctcaggcctcttccctccatgcttcctgacaccatgtgctgctgtgttctgctactaggctggtggatttcctcccagcctcatccctctgcagcaacatctcctactcttgaagctgcgtggggctctgctgcccttggccccatgattccccttctttctcacccaccgaggcctgcatgccttcagatgccacaagcaagacttcaaccccctatgtggcaagtccctgcccgtctctcctctctgacccctgtgggtgggtggttccacctctgagctgccgaatttgggtgcctgtggtgctagggagcggcttatggctgcctggcccaggactcccattttgcagtgagcaagtttcccctctgagggccctgaggctgccctggaggtggtgacccaagcctctcttgcccgttagtttccagcacgttgacaccatcctgggcgctcggccttggagtggcttctggagcaagctgtggcatgtcctctcgtggggcagagaggggatttcccctgctcgcttgcaagaggagtgtgaggctggcttgtgacacctctgggtgaggtgaccgaggtgtggtgtggcacagaccgcagctccccaggattctgaggctcagccacagccagggagggggtgtgtgcgtggaccattctgggcagctgctgctggccaaggaggcctgggacagcaggatgcaactgtgctctgtctgtatccccactggggcccagaagtctgggtcaggagagcggggatgtaggcaaggcggtggcaggtgcaaacagcccttccctggaagtcagaagaaagtcaaatggctgttaactgtggacgcccttggtaagtcatgccactcactgtttcaggctttgctttcctcgtttgccctggggtaggggtgatggccactgtcctgcccccttgacatgggtggcaaggggaaggccagggaggggcagggtggctggtggagaggctggtggagaggcagccctgcctgcctgggattgggacagggaggacgtcgatcaatgcagagactgtcacttgtgggcatggtactcacagaggtggctgccttctcaggtgctgaggcaagctgacgtgtgtttgcaaatgtgggggtgtgagaacgtgcagatccatgtgtgtgaatggcttgtggatgtgcatatgtgggtgtgtctcacacacagacacactcattaactgaaagccaacagtgggctgggcacagggacaggtgggagaagggaaagaaggcagaggtgagcgcttctctcaaggaactgatagtctcatggtggaaggggggccgccacgagtggcaagtgatttagaaatacaaaagagatcaaagcagatgtctggggaggcacaacaaatgctgtgtgagtggagaagacgatagagactagagatgccaacagcaggttgggggaagcctggctcagcggatcagccttgtggggttgttctagaggatgtgatggagggccagcagccgggactggtgcttggaaagtgggcaaggcattgcgggtctgggaaggggagaatgagacgcccagatgggcagtggtgggcaggcagatgtgagcaaagaagtagttcagggacgtctggcagtgtgccgcacacaagggcaatggtacaaggtgcaaatgaaatctgcctggaaggaaagatgtccccctcagaggggtgttcacttagaatcagagggagacagcccagcatgtcacaggcctgagataatggcatctgcaaatctggaaaggcaaagtgtggcctttgggacaagcgtcacatagctgtcctgtgacgctggccggccagcccttgtcagaggcaccagttaaggctgtttagatttcaggggtctctctgttcctcctatcttggggaccagttatgcttgtgctgtttgaatatctcccctgactctctcagtgagcaccccctatccatagagctacaccagggtgactccacacatgcatgagagcagggacaccatcacatggtgacttcttacagcacccaaaacagcgccaagtatacactaggcatctggcatcagctgagcgaatgcagaaggcattactgagttatgccaggcgtggtttgaaagtggccagagaggaaggagctgtgcaaaggtaggaggagtggggtggcacggcagggtttcatcagctagaagtggggtagctctaagcccctccacgacccttgctgtgctcctggcctcgtggggtctgatgcaagacctctactaggaagtatcagggctggctgggaaagtcgagcctcatcagttggtccctgcatttatttggcagaacagggaggccaggacattccgggaagctgggagcaaatcaatttcaggtcattcaattgcagatcaactagtctaaccctgtatcttgatgaggtcaaaattgagacccagggaggggaggtcacctggccaaggtcaaacgatcagagtcgggacatcaagatctcatttgctgaccacatgtacattgtcctgtggtcacagtaaaaagaggaatcctggggagggtttcacctccttgggtctgaacaatgccatccccacatccccctacatagtcatgacaggctctactagaatcatctcaagcctccttcttcaccctaagcctgtcatttacccataagatccagggagggaagaggcctgaacaggatggggttcagtggcccgtctgccatagacgcccctctacctggctcctgtaggctgacctttcccctcgagtctctagaagcttttcctgcctgttcacccaggggacacaagcagctggttataccacactgcccccctcccaacccctgacaccctgcttcctccacggattctctcccctggagagaaatctagatcaaggcaagtcctgggacctgtgttcattggcaggaccccatgctctggcctcccaagcactggtccagccctgggctccgtaagtccccaggcaccgtccaggtgcttcagagagcaccaggccctgagtgtttcaacatcgtgcaaggacctggggtttctgcttttgcaatcgcccctgggttcatccacacctcactgcctcatgtctcgacccctctggtggtgtcctgtcctctcattctggtcagttctgcctgcccctccaggttcgtcgtctccaaagagtgacttttgagtgttgcttctctggtaaataatttctaacggcttcccagagtcaacctgcaaaagccactcctctgccggacttctgagaaccttgtttttccccttcccctccattttctcacttaaaaaaaaaaaatctatggtttctccaacccagagctccctcttccttcactcaaggattcagatctcctccttctctagggcccagccctgctccaacctcctccccatggcctcagggccagagaaatttgtagatcatctggagccaaccccttattttctagattaggaaactgaggcccagcgaggttcattgattggcctcaaagtgaaactactaactagagagaggggagtccagattgcctcactctacaataaaacacctttatatcctctctggctggagagagcacagtgttctggagggaaaggtatgacaggaagggaagagatctatccctgagtccacagacttccaattgtccttacagttagaatcacacaattaagtgtttaattacaacctgctttgcattgttgtttaattgtttccaaagtagactgtaagccacttggggacagggaaaattcctggtgcccttgattgtgtctcctctgaagttcccagcacagcgctgggcacatggaaggcatcacatggcaagactgggaccttggctggggctttcatctgggagggccatttttttttttttgtttttttgagacggagtctctctctgtccccaggctggagtgtagtggcgcgatctcagctcactacaagctccgcctcccaggttcatgctgttctcctgcctcagcctccggagtagctgggactataggcgcccaccgccacgctgggctaatttttttttttttttgtatttttagtagagacagggtttcaccatgttagccaggatggtctcaatctcctgacctcgtgatccgcccacctcagtctcccaaagtgctgggattataggtgtgagccaccgcgcccagcctgggagggccattttaaaccctgtacagatgcaagtccagtttctaagttccccatggacaaaaggtgggtcaaggggtggggtggggaagtacacaagaccaaacaacgcgtttcaggcccagcgcgttttggcttccttgcctggtcaccaacatcttgggaggggtgggtcaggcctctgctggtccctcaggccactgtggtttctggaggacaggctgtggtcgagcctcaggagccccagcacgcagagtagggaagcgtctttggtgtatgcagctcccttcctctcccttgtctgtccctcctcatggcatctcccgatgctctatccttccctccatcctgccttcagaaagcacttcacccccgagagactcccgccctgggcataggcatggtgatcccggagtctcatggtggggctcagaggcactgcttcattttatgagaaccccatgggtgggagaatgtcataggctgaggtcccgacatctttggtgagatcggtagccagggtgctggagacagtttttcttggtctgggcaagatacataattttgtttccttctctctgcatctaaacttaaaagtatgtctttggcaaagccgtttaaacagattcacggattggcaaggtgctgagggcacctggggaaggttcactggtggtaagtttgcaccagctccactcccagggtggcctggagccctctgtgataggtgggccctgctcggcacatctgaagggccctgtcgctcaacctgtgcctttctgggctccatgttcctctcctgtggggcctccggcatcgcggttgtagcaatacctgtgccagcttcctagtgggtggatgtttggtcgaggtcactgggtgagaggaaatggctgacgacacccaccctcccacttgccttcctgccagcctgggggatgtgcttcttgcacttccagatggcattgttcagtctctattgtcttcccttccctaaaattggggagctgagagtgcaggggtggctttatttcccattttctgcaagagaaatctaaggctcagatggcgggtgggggagtcgggggcatggctcacactgggtcaggtgagacacttgtggcatgctgcagtggccaagtggccaccgctcctgctccctggccctggtggcaggaggaccgaggccaagcaggcggggttcgccattaggaggctatagggagttggtctgctccagaagccaaggagggctgctcagagaagctagtggaggggggatggtgggggacatcttcccctcatcactgagatggcacagccgacccagtaattagcaacccatgaggatagactggcagggtggcattccagggccctcttgcccagatcagactcaattacagagcacaatgacttgccaaagttcaggggcagctgcctgcacatgccatgcaaagtttcggggtactcttctccctggctgcagtcacctgctttgagaccctgccttacataccaacccacccaactggagcctctacactggtctgtgggacttacttctcaagggagaccacacctgatgccaacatctttagggcactccttccagttcactcccaagaaacaccagccttcgaccccagtctccaaggctcatgagtgggggtcaaggccccaatttccccgtaaatgcctgaagcgtttgttccaccccagaattcaccccggtggtggctggaaggatggggaggtcttacctcgagttttgttttccttgggaaggagagagatgacttttccttcctgaagatagacaaagaactggtagcgatggaagccactgtgtgccggtggggagggagcctggtaggctataggtagaagcaggagagaggtgagcatcaacatcccatactaccgagggcagagctctctgccttcccatggtcctgctgacctccctggggccccagatcagcactcggccctgcaaaacattaggatttgtatttggcgggatctcagcttcagtattttcatttaagaagtacatattttggtgggggtgagagtgggggaggaggtggtccaagaggaaacaccctgagctggcttgaaggccttgggtgctggcgtggctcccaggcctttatgggccagtgggtgttggcattgtcctgtttttgctttagtctatcctgatggatttcctgcctcaagagaagcccatcttcctctgtgagtgtgtttggcagaggatttttatttattttttcggcatttgcttatgaactcaatccccaaagaagccaatttcttggctgcgtctggagggtctggaagtggttacgagggtgggtgggactgggttcaaaggtttgatcatgggagctgtaggagctgggtgctcggggcatcagggagaagttccctctcccagtccttctctctccctccaggaggctgagctctttttttggggcgggggaagtggggtggggacatccctcattctttccccaagtccatgcagagtcaaggtcctgctggcctggcctaggtctttcaaggtgggcctctttcccagagtgcttcaccccttcccactccccttcccgctctccatcttcctttccaaggaggagagccaggctggagccaagaatctttctgggtgggtgggaaagaagcatttgcaatgaggatgttggtgggagggagtattggtcctttatggccatctccccttctttcctctcctgatcattaaacaaaagcacgacttgctgcttggagcactggaagagtccctcactgtgcacttccggccactggtggcttccagcatgccaacaaccggggaattcctgacgattcatctttccctgcatttttggatcgcagatcagatatatgtgtgtgtgtgtgtgtgtgtgtgtgtgtgtgcacgcgcatgtgcactcagagtgagagcagagctgggtgtgctgagagccatgtgtgtggttggaggtcccactcggggtgggtgtgtgtacatgaacagccagtgtgcaaacgccccgatgctgttttggagggcctgtgtgtgtgtaaatgcaggtaaaggagcatttcttcctaaacaccgccagggctgagaaagacttctgagcacaggtgggtgccagggagtctcctcgtgtgcttaggtatggagggcagatgggacaagtcagtgtgggcaagatgtgtgggcatgtgggctgtggagtacactccaccgtgggcacacttgacgctgcccaaaactggtgacctcagttctgtgcggacaagtctgaagtgagaactcactggatttgtgcaatggagaatttatcctctatctcctcaagggagatagagactaatgcctctcactagggctttcctcaagaatcccctcttcaaaacctccaaaggcagagaattgaggcgtgaggaggaggggaaagggttcacacatgctagaccacttctccgggccaggccctgggctgtaggccttcacttatgacatctcctccatcttcccatttcctggaggcttgagaggtaaagccaggccaacagtgagtggtggtgctgggatttgaatccaggcctgcttggtgcccaagcccacgctgcttcacggaactgcagggctaagtttggtgcccagtgctgtgccagaggccagcccagtacctgagcatccctttcaaggtaggttgggggcatcctcctggggcagggatctgagagaggggagctgggggaaggatgggggtggacaggggttacaagcagcctccagtcagatggccccctgcactgtgaagctggctgcattctttactagccattcacatggcgcaggatggtctgtgcctcagtgttatcctcttaaaatggggacactgatggcagtgaccataaaaggcagttgtggagatgaaatcagggcatccaagaaaactctcaggctggtgctagcacacgacaaagcagcaccatgaggttttgattcctgtgatcgtcactgatgccctggctgggggaaggggtccctagggtcttactcacctgataactcctggccctgaatcttccctttcttcaggtcggcgccctgaaagaagagacaagcagggctgtaggttatgtcttgggcacacttcaggccacgtgggctctgcgggattgcttctctctctgcaggaggaggatgggagaggaaggaggatgggagaagaagtaggatgggagaggaggaaaatgggagagcaggaggatgtatggctgcttttgggagacagggcagtgagtggggttttggaatgggtacctcaggggatccagggaaagaggacagacacacgtattgctgaggggggcaaatggacaccttccctctagagaggccctgtaggacacttcccaaagagctgttccacgatccctattggtgcctgagactgggcgctacacatcacctgcagggtctggtcggatctaagggaggcgcttaggtctgcagttctctggatcttactaaggagcccatcttctctggagggaggactctgctccctttggagcctttagaatattaagcaatgggctcagagcaaccagcgggggaagggaaagcaggaggaggctacactgcctgattctgtggcagcttctccccaccctcagttaactcagcccacaaccctggggcagtttctttggccactgggacagcctcagtttccctcctctctttccctccctcctcccctccactcagtgtctatgggataatgaggtgaccccgggggtgggtgctaattactgtttgtgcaggactgggagatgctcagatgaaagagactggagccgggcccctgggtctgtgccatggctcaggggccccaggccatgccagggagccccaaggcccctaggtgtggggttttatagccttaatgaaggtgattagcgtgactcttaattgagtctgccgacacctaactgtgccctggctaccttttcaccaagcctagaagaggggctcatgggatgctgggaggatgggggagaggtgggaggccctgcttgaggtgggggcaggggcaggagagatccaatcccctagcttgaggtttaccttttatagaactaaagtcctactcgctcagtccagaacccaccagatctcctaccttttagactgcagcttgtctattattgtcctcactttgggcctcttggtcagatatccctcttccaaggctggttcctatagagctaggtctcatttggttggaagaaggagcaggagactgtggaaggatagacccttcccccacgagccccttgtactttgtcttcttcacctgatacaggtgagatagatctttccttccttccttcattccttgctggcttgcttctttcttccttcctttctttctttctttcttccttccttccttccttccttccttccttccttccttccttccttccttccctttttttggagtctcgctctgtcatccaggctggagtgcagtggtacgatcttagttcactgcaacctccgcctcccaggttcaagcgattctcctgcctcaacttcccgagtagctggaattataggtgcccaccaccacgcctggctaatttttgtatttttagcagagatggggttttactatgttggtcagactggtttcgaactcctgacctcaggtgatccacccgcctcaggctcccaaagtgctgggattacaggcatgagccactgcgcccagctgagatctctttcctttaacttccttctactctccctgatcctgttcttttctgctcaggaggatctgggcagccttcaacatcaggtcccacccatatggtgatgcacactccagctctgtctcgctcccctctcagcacagtcccccaactccccgcattttgggcctggctttatccagggctggcattatccaggcccaggtgtggccaaagggctgtggcctgacaaggataagggattggagaatggaagcctgtctccttgccgcccatctcttccaggagaggagggaaggccttgacagatgcctagcagccactctccctacagagctcttctgccacccgagcaagatggagagttctagggctgagcgcagggaagggctgcccagcctggtctgccctgagctcctcagcctccccttattcctttccaagtcagcccagccagcggttgtttaaacaaaacaatagcaacctaagctggctgtttcttttcaattccccccaggcttgggtcccacccagagtgaggcaagggagcaggcaagggtgggggccagggccagtcagatcagggagctggtttgtgcagagctgcagtgggtggaaaggctgatctggagccttgatggggtgggaagtctccctttcttcatcctttcactctggggagcttttcttatcaaccggggccagcataggcaaagattctgcaaatccttacgttgggtttgctgaggcaagccactggcccttcctagccacccagcagatcctgtgcttgactggggcactgatggcaaatggactgttcaggtcccccctggagctgatcccacggacaggtgctggtcctcactggcagaaagaacgggggaggacctggtggaggagggtggaggaggagtaaatcagaagctgtgatttactcggattgtcttgagaattgcctaagttctctttggccataaacctttcctcattggtcagtcctggaggggctacaatttctaccatagaatcaacacctggtaggggctttaggaaactaaattctaaaaggtgagagagttgggctccagagagggaaaatccagaatgttcaaggaggatgaggccttagaccccaggcccttcgagatcagctaactcaaggtctcatgcctttcgacctcagtgccatcctgtgctctttctgtgacatcatgacaatcccatcagttctatgggaggcatcattttccaaagaccatgattaaaatacggagatattatctggagggctggagctgcggtgaaaatgggggccctcccacccgattttagctcttctaaaatatcttcatgatggccaagtgcaacagctcacacctgtaatcccagcactttgggaggctgaggcgggtggattgcttgagccaaggagtttgagaccgaacagtttaggcaacatagcaaaacctcgtctctacaaaaaatgcaaaaattatctgggcatgatggcccatgcctgtagtctcagctattcaggggactgagctgggaggatcacctgagcccagggaggtgatcctgagccatgatggtgccaccgcacttcagcctggatgacagagtgagacactgtctcaaaacaaatatatggattagaatgtcacttctagcctgcgatcaccctagaaagctgaaactgcccggggatggatgagattcaaggaagtttcaggaggtaagagggagaaacctgtagttttgagcactgctcagggttgctgggctaggaaagtgccctgggaggagggggtaccagcccagcatttgaggaacacagacaccactcctgtcgagtctgagaagagatcggctttggaaggagaccctgaaggaggctgaaagttgggctttctcaccgtttagaatttagtctctgaaggcccctaacaggtattgattctatggtagaaatttaagcccctccaggactgaccgatgagggaaggtttatggcccaacctgcagggtctggtaagagctccctcacaccttcggcctcctcactttgaccctgctgcctcccccagcccagactccagatgtgctcttgcctctctaagatgggctgagcacagaccaaatctcctttcccttcctatagctaagacaggctgacattttcaaaaggaactcgtttaaatgctaaggttaaaaagaagaaatatagttgatctttgaacaacatgggtttgatttgtgtccacctataaacagatgttttttcgacaaaagttacactgagtgtgcctgcctctcccgcctcctgttgcacctcctccacctcttccacctcttctgcctctgccaccccaagacagcaagaccaaccccttctcttcttcctcctcctcctcagcccattcaatgtgaagatgatgaggatggagacctttatgatgatccacttccacttaacaaataggaagtatatttcctcttccttaggattttcttaataccattttcttttctttggcttacttcattgtaagagtacagtatagaatacatataacatacaaaacatgttaattgactgtttatgttattggcttcccgtcaacagtaggctattagtagttaaatttggggagagtccaaagttgtagttggatttttgactttgttgggggtggcacccatacgccctcattgttttatttatttatttatttatttatttatctatctatctatttatttatttatttatttttgagacggagtctcgctctgtcgcccaggctggagtgcagtggcacgatctcggctcactgcaacctctgcctcccgggttcatgccattctcctgcctcagcctcccgagtagctgggactacaggtgcctgccatggcgcccggctaattttttttttttttttaatttttttatttttagtagagacggggtttcaccgtgttagccaggatggtcttgatctcctgatctcgtgatccgcccgcctcggcttcccaaagtgctgggattacaggcgtgagccaccgcacccagccccataccccctcattgtttaagggtgaacagtaattatagaaattacagacaacatagatgtagttcagtttctcatcctcgagaacgctgaaaagcccaggatgggtttttcaggagagcagaccaggaacaccgaggtatttgggtagtgtgcctaggaggacattctgggccttctaagtttgggactggagggcccggggaaggcaattcttcctcatcaacatcctgtggagatggggagtctaaaatacccatgactctcctagcaagggaagggaggaggaggtgaatttcttagaaggacccttaaatgctcagggtataagaaaaatagtagtcatcacatgttctcacttataagtgggagctgaacaatgagaacacatggacacagggaggggaacaacacacacaactggagggcccatggtgggggcgtggggagggagaacatcaggataaatagctaacgcacacggaacttaatacctaggttatgggtctataggtgcagcaaaccaccatggcacactttacctgtgtaacaaacctgcacatcctgcacatgtaccccggaacttaaataaaataaaatttaaagaaatgaaaagaaaaagaatagtagtcactcctttttcctagaagctggccccatttgtgtgtgtgtgtgtgtgtgtgtgtgtgtgtatgcacatgtgtgtatgtgcatgcatgtgcacatgtatgtgagtgtagggtactgggtttatgcatgactgcttggcacaggactaggtgcaaattattctaattgcagagaggagggctcaacactgtggacactttggaggtgcttctgggttcctagaacatgagatttcctttccagctctctcccacctcagatcccactgcttctctggcaagctagcctggaacttgcaagcgagatactcagggaaagttgtggcttgactgagagtcatagcaaccccattctcagtccagggtgatgcagactgtcttcccagacttgtcccgtctgggtcaggtaaagagcacggtgctggaagccaggggtctatccccaccgctattgccttgcatttgtaacaggctttcagctttattctccaggcaaccatccaactggttgatctcacaacatcccattcagaggaagggcagagatctttagccccattggacaggagagaaaccacagaagcttcagctcctcgagggtggggactacaccctacccatctttgtgacctatgagacgctcggcacacagtgggtatagtccaagtccgtgggcgccctggcccagtgcccagcccttgcaacttgagccatccctacttaacaacctctatcctttgggtgtccccgtagggacagagagctgcattttctgaggtctttcatagacttgagggtccagcgacactcctccctcacctggggaaccccttaggtaaaggctctttggctggatttggtaggtctggagtgtggggaaggggtctgactcactgctggtcccagcagggatgctggcccagttccctcattccccttcaattacctgtaggcagcggcccacccacctgggtgtttgtgaaggccccagatactcaggctcgtggtgcctcagagcaaagggtcagtcgcacatatccttgagtgagggagaggacttaatctcgttacccacctcttcccatttgcacaggaggattcaatcttctgcctgggtgcaaaccccggtcagagtgggaagttttgctttttgatctctgggtgaaatgtaggggtggggatggggggtttggggagggtggggatgggggaattggggagggtggggatgggggaattggggagggtggggatggggggacaggcatcagaagagtccctaacttgaaaggtgaggctcagaaaggtgtcatggagataagggagagtagagggagaaatgagcaaaacagagcacttgagggtgggaaggaagaaatgagaaaaaaagggaaaatgaaaacagagttccaagctctctgacactggcaccaaacaagaaagctccttgctgttttgcacagctgcctgcaggctgccaagtggcaaaggatccaggaaaaggcacaggactggaaagcgctacccagcaatctgtgtattcggcaattaacaaagggtaagtgagcggaaggcactgacagctcccaggctctgaggtccccaggggccgcctaacgccagcctagagaagacccagctctggagactactgcctgctgccagggagaggcttccagtcaattaaccccaatggccttctcttttgccctagggttggggagaggagggatggccactgaggtgggtggaatgaagcccgtgggaagtggaagaaggaggcgcagatctgagccctcctgggagctgagtacttctagactccagggtgtaggatggccaattattttgtggaccagtttccctccagaaatgtccatatcaaagacttggtaggccttttcctggcaccttcatgggcagtggggacagcttggtgaatatcatcttaggagatgccaatgggtgcatggcagatcctggtatcttggcacagtctggcaatgggactcctgggttttgattcctagtttggcttcaaatctggaattggttacttctctggatctccggctgccaaagttgggtgggcactattgaaaggaggctagattttggggccttgagggatgtgtaggagcttttcagttctccagtggataagacaagggaggggaagggcagcttaagctgagaaagctgtctaagccacgtatcaatgtgcggttgtgggagaatgatttgcttctaggagtaaggagtttacccaggatgggaggagcttcacccagagcgtcaccaccctccatgacactgggttaagagacgagatttcccaaggcccaggccatctgaggcttgaaaagtacaggctgtccaggccctttgttctaggtcgtgcgattgccaaaaatgtcacaccgtcttgcagctgtgtgtgtgtgatagtatctagcacaaagctgcccctgaggaatggtagctggtgagatgggtagatgaatgaatgaatgagaggccctgtgttggagatagaaatttaattaagacacaggtcatggtataaggagcctctgatctgctagaacagatagatcacaaagaaataataattacaggcttaaataattgaggcctagaggccatgctggggggagcagagatgaaggaagagataactgcttgggggtagtgatcagagaaagttattgaaaggaggctagatatggggccttgaaggatatataggagtttttcagttctccagtagacaagataaaggagatttctcttaggttgagaaagctgcctaagcaatgtataaatgtgtgcatgagacatgggaagatttcaaatgacttgggtgtccgttgaagccagaaccagcatgtgagtcttcaagaatctcaagagaaggctagaaatgcaggatggggataagactggaatggtaggcagtgcctctgatttctgagactcaaagctctcagcaacctaaaccctgggtccacagatcccaggcaaggcttcttctcttctccaaatgatcagtaactgtgtcccaggagggccaccagagttggttggctgagctgccttccctgtcaagagaggaggagggtgggccccagctgggggacactgcccacgtggcaggtcagagcaggatgctgctgaattttgtcatcgatggcctcactcagagcaggtaactcttggacccccaaacccaaacacctcccttttacaaacagtaatttttgtttcaggtaataaaagggctacatgttccttgtagaaaaattgtaaaacacagaaaagcactagaaagaaaaagcattccctggatcctaccacatagagacaattgccctgagaacatccttcttttctttgcattttggttccaaagtttcttgtcacacagatggcagcttcgagcccctggtgcctctggggcctgtactggctgggactcccaactgtctgccctcggggaactcctgcttggcgaaacttgcccaagttactttcagtccctgacactcagagagctggctgagccacaggaaattgtggagccacctccttttgactcttgcctgtcatgggtcactcattctctggatggggttccggggtggggttaagaagaaggaaagaaataaagaacacaatatatagtcttattaaacctgttcttcttagaagtagacaagagtgggggtgcgttgtctcatgcctgtaatcccagcagtttgggaggctgaggcaggaggattgcttagggccaggagttgcagagcagcctggccagcatagtgagaccccatttctacaaaatattaaaaaaattaaccagacgaggtggtgtgttcctgtagtcctggctactagggaggctgaagtgggaggattgcttcagctgggaattcgaggctgtagtgagctatattgttgcaccactgcattccagcttgggtgacagagtgactcggtctcaaaaataaaaaaagtaggcagaaatattaagttgaaagcaaatatcaggagtttgttgctaaatgtgattactatgcactgatatcactttaaactaaagactgccctttctagctactcagaacaaaaatagcttttgatatcaacctcaggttgccgggacgcctcatttatctgaagtcatatagggaattgggtattccttataaaaacatttccctgatatctcaaatcttatatttttagctccccaactccttttctcttacctattttggatagccatcttattagaatactagttcttgtcttcttatgtgattttaaataccattgtagttgtcattgtggatgccagttttgcacccaactacagcatgagaccgcaaagctgaaaagcaaataaaggccgggcatggtggctcacgcctgtaattgcagcactttgggaggccgaggcgggcggatcacttgaggtcaggagttcgagaccagcctggccaacttggcaaaacccggtctctattaaaaatacaaaaattagcaaggcgtggtggcaggcgcctgtagtcccagttactcgggaggctgaggcaggagaatcgcttgaacccggaagccagaggttgcagtgagatcagattgagccactgcactccagcgtgggcaatagagttgagactccgtctcaaaaaaaaaaaaaaaaaaaaagcaaataaaaagaatgagccattcaggcttccacctgccccagcctccttagaggccaataattgaatgtttatgtcgtggccatcaggcaaagaagggggacccacctcttgcggagtgcccgtggtgcgcaggcatctcgccatggtctttacgtgagttagttcactcagatccccgccctccaggaaattccccgctaaggtgcaggatccccccactccccccgccttggagagcaaaggcttgctgccctgctttgtggtctgatttctggcagccacaagaacaagggaaatggagccgtccagttaaagcagcctcagtcaatgagcaacttagcatctaacacagccattctcctgcagggcagcctgggcttcagtccaatgtcattaccaatcagctacatgactttgagcaagacacttaatttcacagcgtctgagtttccgtacctataaagtggcgatgataacgatacctgccctggtttcttcacagagctgttgtgaaggtgcaattaggaaatggaatattctgaagtcccgcagcgccgtccaagtgtaagggtcattactaggctgagctcccggcgggaccctggagggaaaggctcggtggttgccggggagtagacggcgtaggggctgaggatggggatgctgcctccgtccacccttggagccccgggagcccatcctgcgaagtctcctggcagggccagcctcctgaggctgatggctgcgccgtgggcttggaggttactcagctgtgaatgttgggcctgccccgctgggcctatactcagccagggtgcgcagagcgagtggcacatcatgtttattaataacccttgatgaggggcattaatagctcctaatgacaccatctgagcctggcctccttccttctctcgctgctcactccttcctctttccctccatcccttgaagacacatgatcccacagacagacacaggcgggctcggctcaggagagcgagtcagaggtgttgtccaggaggtgggggctctggagcgggggtctggccttgggggtcagacagaggatcctgggttggagagcaagtaggatgcctctggctctgccatcaagtggaaacttggccagaaactgctcggtgatgggagcaagggaagcgcagcagtgggaagaattttccagaactggtgggaatgggagtggcagggtgtgagatgggagaagctggagctgggaccagaatgaggccaagggggcctaggggcaacctcaggctgggtccgagagggccagggatgggagagcacaagtcacacacacacacttgcacactcgtgatatactcacaaggcacatgctcacatccacactctcacatatacatacgttcacacactcacatacttgtagtatgctcacacacccacacatgcatgttcacacatgctcactcacacacatgctgtcacacatgcacagaggcacaagctcacatacatgctcatatatccacatgcacagacactcacatgcacacacatgctcacacacactcacatgtactcacgcactcctctcctagactgcctttcactgggtatgcctggggctgggcatggtggggaggaccagaagaagggggcatttgggaaggggttggtggccaggctgaagctgggaccatgcaattaggaaaagagggtgtgggaatctccaggcccctggcagggggccaggacaaacagacaactgattagcactgaggtctgtgagtgagacctaagctgctctgttacccacccagggggctgagagccaatggggctgggctgtatccgagcagaggtgggagaggaggcagtcgaccaagaggcagggtgggatggggtggggggcaccccaggtgctgccctcctcccgtgctgcatgtaggaggctgcaggtcaccttgccctccctgccgcagcagaacaattaggaaatggatgcagttaatccctaagacaaacagggcttgagaaactgcaactcaactggagagaagagagctgtagggctaactcctcagcccgactcttatcgctccccatctctcatccggcacccagtctttccggctgggtggctgcacctccaagagggagaggaggaggaagcgaggggaccaatacactgggaggaagtgacctgaccagacctttgctctctaactccggctggacagaggcagcccagcagccccctagcatccatctggcttggggagtggtgccccagggcttatgagtgagctggaaccccatgtcctggaatcccgagtggctgtgactgctgactgatgcccccctccccacagttctggagagtggctcagcagtctccccgagctccggccctagcagtcctcccgtctcccctctgtctgggtaagaatggcccctcagcccctgaccctgacccatcctgttctctactgccaacgagaagatgggtactgtcttggcttactctgctctcctcatgtgccacctatgagatgaggtgtccttgggaacccaggccacaaaggctgggctggggggatggagggggagggggtgcccaacagccaagagcctcgactgtggctctttggggaaggctggtagcagcaggtgggagtcagattcctcgttctgttctctgctttgtctccctcctttgccctattttaggtttccatacttggctctggtgggaagagaaagcataatctaccctttggagcctcttctctccctccccaccaatgggcccaggcctggggctgctttgtgaacagaaaggaagaaaggaaggaaggatggatggaaggaaaaagagacagagggactctggaagaaaggtcaggaatttctagcaagaaaagatgctggcgagatttggaagctctaagaaaccctgtgctcattagaaagtgtgacaagaagcagaaacattctaagtctattcaaatcacggcttgctcttttccgagggactgatggtgaacttggacccagtcccccagcccctcagagcagcagcagtgtgccctgggagcttatcagaaatgcagaatctctctcaggctcaaccctagacccagtgaaccagaagcttcctcttaacaagaacctgaggcgacttctacgcacactaaagtctgtgaagcccctcagcaccaccacagcagcttcctgctctccgaaccttcctgcccaattcccctggggtctctgggccagggaaggggaccactcatcagatctgtagtggcagctgtggtgggaaccatctgagccccggttcctgatggtacctcctttcctgttccttctggagaccccctcccctggggctcacccttccccctgtggccccagctctcaagtcagacccttcagacaggttgggttcctgggtgttcagaggggctgggccagacctgagaaggagggaggcacagccctttcccttcacccctgcttagagccatggaaagtggccccaagttagtgactctgggtgtgctattctgagccttgaagttcctggggagaagggaaagggctgggcacacaagggtgtttgttagctcctttcccccagatcatgctccccccacctaccctacgtgaggagggagggttgcttgtcctccaggcatgcagggacctcagggactgggaagagacagatgggatggaagaggcgagagaagagtggttcttccgtgttgcctatagaccagatgagggtgcggggcagccccggtgtgcaggtcaggatcaactctagggccctgtcccaagcaggaggccagcagtcaggcaacttcctcgggtctccctcctccgaggtgcccaagccagctgccatctctgctgagctgccgttctcacgtgccttggtcatgccaaggcctgtgtggtgggccttcgtgtccctgcctgccttcgtcaacccagattcatttgtctgagccaacggaagagtgaatgtggcccaccagggcctgctggggtccaaggccctgccactgtctgccaggcccagggcttgttctcattctgttgtggcactttttacagtgctcagcaggcaaatgccaatccgggaagtttgacaatcatagcaaaaaaaccctgagcctgtgctcagtgaactccacctggagctcacagttggtcccatgtcccgggaatgctttgggtactgacagagccccagggagaggaagggaggcccactgctctctcaggcaagtgacccagcggaacctgggtcactgtgccaccccatcagtgggtggctgtctgttaagggccgctcagctgagccccacaggtggtgggaaggtttgtgtgcagaggaggaaccctgactgtcttggaagccagcgccaccgtccccccggcaggcaggagagcggggttgggggcagcccatactgcttggcttccagtccccatggggaacatcgcctgtttcagagtatgttgaaatgagtctttgcacaaccatgacaagggcccagctgttcctggtgacagtgcgcagggacacgaggagatgggaggaaaggggacagggtcacagcagagggagggacccaaagaggatcaagggacagctgctggctccccaggcctccctatctggggctcccctgcctccttccaatcaaagcccaccgtgctctaggtccagggcagggcctcaccctcgaagctaggccttcagaggccttcctctgaggagtctgggattctaggacaccaggcccacccctaggctgtgccatgggaagctaagagaaacttctccctagaactttttgctgtgagcagttaattgccctggcatctgaggctgctgtgcacacaagcaaggggcctttaatgaatgcaaacgacagctgattaatctgccagctcttgcgcccctggtccttgctgtggggtctggctacgctccattcagcctcgatggcctgcaccagcggggtgggctccaacctattaccagtggcgctgccagccctaatgggaaagagggtgagacccctcccctcctctgcccccatcggcctgtggtcctgtcaagcatgagaggctcttgggactggccctggaagtgtgggcttgcccctgctggactttgtcactgggtgtttcctatagtgatgtggtcacccctctggggacagaagggggatgatgacaaggggagtgctgtctagctgctcagtgggattcatgtgaagggattaaatttaggaggtaagggggtgctgcctagacagtggcagaggatttatttttcagtcactcgccaactgtggccttgagaaagcagccaggccacctgatcatcgccttgtggaaaaaggcagagagagagaggagttgaggctacgagagagtcccctttttccaccccggttcatacatcctaccctagatcctggctgatgtcaactcagcccacctctatggagctcctgctaggtgccaagtgcggtgtccctgtatggggcggcttgcagtctggcaggacacaagagtcaagagatcattacagctgtgatgaacgctaggaagaggaagcgcagagagccttgggggaacagggagggctttctggaggaggctgcatagactctctgccagctactggtgcttggttggggcaggcggtgaagggctgtgtgctggggagccaatgctctcttatgccagactccagtgcccaggcctcttatgccagcctcctgtccccaagaagccccaggcccttatcagtgcttccttgggctacctgacctccccttgggctgcccagctgctggggctggggagtgagcaagggcagtgagagtgaggcctgcctgagagtggaggctactgacctcctgggcaggacctccttcccagaagcagaagcagagctccctttgggggagaaaccccctcagtttctactgtaataaagaaggggcctgagctcttgctggagcctctaatgacggggttgaggtgtaatgaatatctgtgtactcataaaacaggctaatgacggccctcggccctcattttatggacccgtttcatccttacttgttcccaaaccagaagggaccatcctgggggctgagccaggagcctgatggcagccccagaccacagctgtttggagtgggggctaaatggttcctgagcctgaagcccctccggagctgccttttcctcctccatcccttatctggttgagacaaagtgaggaatttaggtcaatggctgacaacaaccagccttaggaaatgggcaggggacagggagggaggaagtgcatccaccctgattcttaagagtgtcaacacttgtcacacatggaggccagaaagagcattcagcacctgccggcagcaccacgcccctttcctctgcccaggtactgataggagctccctgaatcatcccagttgcaattccaacacctgagcagaactagactccgtggagggtggggctggcccgctgaatcaccagtaacacctgtgttttgcttgtgaggtctccctgctcactcggggaccagccaagcctgaccctgtttggcttctcggagcttggtgagatcacagcctgggggttgtggctgcaggccagtgtgacctgctgtgcagggagtatttttaaagagatacttgccctgtgttcccaggatcagctccctgagagactcaagttgttctttgaattctgcctccctctcccaatttgattgtagacattggtcaggggaacataaaatcacttgggataaagtgtgtagtggaaattaacatgcaatcttcttgccatagacaagcccctgggggatgcccagggagtcttggtgactggtagcacctgagggaggtgggatgagcagaatcagactccctaattcccttgaggatgcagagatagactcacctgttttctcctgagttctagaactgcctaactgtggtcttccggtcagagcctggacaggagccacaggccaccatgacagggtctgccggtggaaaaagactcatgtatgagtcagcctgctgcctcggttcccagccagatgcgggcccagccctgcctccaggccatctgccgaaaattggggtcagtggagggcagaggagcccacgcatgcaggttcctcgtgcccctaaccaagctccccttttcatgtcctctcttcttgcagacatcgccttcttacaatgcagaacagacgatgcactgtctcaggtcacgcttagcctcctacgggggcacgacagaagaagaggaacatttagagaggcacagctcctacatccttggatggggagagtggggagcaaacaggccaggtgagtcacttgggggttgggccatggttgttagacagtgacagcagtcctggacccgtatccagcactctccactctaggggtttcaggcccttgtgcactgctgtatcacttaatcctccttcaccaggaggcagagagggtagcgtttgcagatggggacacaagctctggagaggttaatgacttgccggagatgggagttccaatcggcagcagatcagcaaatggaatgcgggtgtcctggcccgtgatctaagtctcctgattcatagtctaatgttcttttgtctacacctcagaacaaagaggggctgtgttcagaaaattgattctgaagggaagggaatatttttttccctttgctggaatttctctggagacttcggacttgctcaagttggatggaaaagcccgtctagatcttcccagctctctcctgggttatgcccgggcctgggggcagaaagcttttgagacagggacaggccacattctccagtgccctctcgacttaggggaccctgtgcactgtggtggggaggtgtcactgagagtggtgtgatgagtcaccatgtccccagccttgggtcccgcagaggattgggggagtgagccctgcagggatgtggggtagccctggtgattcagggcaggggcagaggctggggccccatggctaaaagtttcacggatcccaggctgagacctccagagcccctgtctagctcaactgagaagagttgatgaagttccttgtgagcttggctcatggatgatctcagtctcaagtgtactactctgattctctttatctttccaatccagttcacacttctttcctctgtgaagccttccttctcccagcattccctcccctcaccctactgtgttgtggccaccactctgcctgggactacagccatttgtccttctgcctctcctctgcctgagagcaaggtgagaggatcccgttcctgttctccatctcctgcccgtaacacaggaggaagacacacaggatgtatttggggaacaaggggaggaactcacatcccgagagcctgccttacccatgagctctccctctgccacaacagcccgcgaggcaggaaactgaggctcagggaggcagcgccttgtctaagtcattaggcggcagaactggaatttaactcaagtatttctgacttcataggcgaagctctttgccaaggtcaatgatgctgctccaatgtttgcttagaaaaatatgggagaaagtgacaaatggactgctcatgtgtctgtggaattgaaccaaagcattgtcccctggtctgaaaaatgcacccatctcgtggcaggagaagccttttcatattactatattcaacttccttcctttttttttcccctgcaagagacatttttgctgaagtacatgtgaaaaggaccacagggtcctccctgttagatctgccccaggcccagtggaacagagcaaggaatgtctctctgtgaatccaggtgctgaggtgtggaggcccctctggggttagagagagctctgggtacaagggctgatcaatttggaagcagattgggcactttgggtctggaaagccaccaggtgttgtctctttggcccctggctggttgcggtgtctgtgattctgggctctggtccttctggactaggatggagggtgcggtggggagagtgttagtctcctcgcgtttggtcagatctcagccagagaagaaagccagagctgtgtcctctctccttcccttcactgccttccccttctctccgattccagcctcttcctccctgtcctctctcctctctcccgcctctccccctcccctcctttgttccgccctctcctcctcttctccctcctctctctcctcctctcctccctcctctcttccctctttccttcacagaggacctcagccttccatcagagaacagatttcttctgaccattcgatccccaatctgcctccctccagatcggtgctgtccagtgcgacattctgtgatggtggagttgtcctctctttgtgttgtactatagagtagctgccagctgcctgtggtcatcaaagttcggaggaatggagttgtaaaaagaattatttgactctcgttctgtcacccaggctagagtgcagtggcgtaattacggctcaagtgatcttcccatgtcagcctcccaagcagctgggactatgggcatgtaccaccacacccagctaatttttataattttaaaatttttttagagacgggggtctcagcacattgcccaggctggtctttaactcctaggtgatcctcctgccctggcctcccaaagtgctgggattataggcatgagctaccatacctggaattatttattaattttgtacttattatgggctaccacaagtgaaattatttaatttgaattaatttaaattgaaatagccacatgcacttagtgactaccatagtggacatcagagctgtgggtgataataagtgctggattcctgggaagtccctgggggtgcccccacccttgttcaggctctgtcccttcctcaagtgccactgtgtagatccagggtctctgctgtgcccagcctcctgtacagcacccgagagaggccacagacgactgggttctggacttgaacctgggtgaccttgggcaagtcaccagatctgtgggtctctgtggcctcttcagtaaaataatgaagatgatttattgcaagcctcaaggtttgtgtttctttgggcaggagcctactgtgatcagagctgggggagccagtgtgagcagcagggtgagtggggtgtgcatgggtgtgcacgctcaggggggtggggggcttgaggggtggcagggggaccctacgggatgttgcttttcagcctggcgctgcctcgctgagtagcctgagactaggaaaaggcttaaagaattcacagtgggaaggctgcagcctgactctgctcctggccggcgtttgcccgctgcctggccctggctgttccaacgatggacttccttcctctttggccataaaagtctcccggaaagccttcccacagaggccccgggggctttctcagggaatgtgtgagtgtgtgctcacacaagcactgtggagcaggagcccagggccgcgtgcaggctctcccacagagctgtgggtcctggcgctggaggagaggttcgtcccagcctgggtggagagcggaggaaaggctggcccttgcctggacttgggccctggcttatgcaatgctcagactcttagtcaacttcagcaactggggcacatccacacgcatgtgcacacacgtgcaggcacacacccgggcagggaggtgtgaggaagggagaccaatgagcctgtgccaagctctgcttacagatctccccagatctggagagaaaaggggagcccttctccaagagggggctgcgctcaggctgctagggtatgatgatggctccaagcctgtggctgaggttggatggaccattgagaggagccctccagggtgaggggacagaagcccatcagtccgtattgatggaatgtggctacagtgtggagagaagaagatactttctcttcctgccccagaaggtacccaagcctccgggatgctgggtcacagaacccgcctggcagagagttgcatcagagcgaaactgcatgctagatgcctgaggggagagggcactgaggacttgtgatcctaatttcccaaccttcagctgctcagggtcaagtccttaggctccacttgctcttctcccctccccagcattcttctgtactaggttgcacatgatgagggtggtctgaggggagaacaaggagggggtgtgactcagagttcacccggctgtcagcagccctgagtcagagggagggtggggaggtgggtggaacagcttttggtagtcttggggttccctataagcaagagcatcccagaaaaatagaagagagccccccagaagctacgaggctcccacatgcagggtaggccttttctcggccaccactacacaccccaggagaacaggagaggcctccacgagtcctggatgatttaggtgcggacttgcctgggggaagggtgttggcccagaggaccccttgggtacctctgaactctgggattctgcagagaggcctcaccacatcaatgctttttgctctgtgtacccagatgggtctgtggagaatttggggggttccactgctgggactggggagatgacaatctggggtcaggggactgaggtgggtgtgggatgtgggaacaggaggggtgtcccatagcaccagtggagcttctgcatctgcttcagggctcttgttttcctggaagtaggaaggagagtggggatggctggaaagttctgaaaattgctttttgcttatgtatggtcttggcaaagaagctgtggggtgtgttccttctttatcatagctggcagccctgacttcccataatacaatgattgggaggctgaggcctggttacttggtgcttcctccacgtgtctctgtagacctctctgcagctcttcttgttttagctccgtaggcaagacatcccattgatgtaatgtcagcctaggagcacaactgtcttcccgggctcacggcctccacctacccagctagagctggagagccatgccctccccaggccctgcatctcctccctccctggtcaggggtgtcaccagcaagggcacggccaccaaacacagcctgtggatcagctctctgagatggccctcgtttgctcactgtctgaacagagcatttcctttccttcccttcctgtgagcagattccccatccaggtgggtagctgcggccagctatgcaggcaccaatgagctgcaagggaggtcagccaccctttagccaggtccaccccctgccttttacagaggagcaaattcagggccacggcatccataggaccagtcacgggcagcagtgtggatctacaacccacctctcctgattctcagtttgtcattcttttttttttttttttttgagatggagtttcgctcttgttgcccagcctggaatgcaatggcacgatgttgtctcactggaacctctgcctcctaggttcaagcgattctcctgcctcagcctcctaggtagctgggattacaggcatgtgccaccatgtggggctaattttgtatttttagtaaagacggggtttctccgtgttggtcaggttggtctcgaactcccgacctcatgtgatccgcctgcctcggcctcccaaagtgctgggattacaggcgtgagccaccgcacccagcctttctttcttttttgagactgagtctcgctccattgcccaggctggagtgcagtggtgtgatcttggctcactgcaacctccacctcgcgggttcaagcaattctcctgcctcagcctcctgagtagctgggattacaggtgcctgccaccacgcccagctaatttttgtatttttagtagagacggggtttcaccactttggtcaggctggtctcaaacccctgaccttgtgatccacccgctgtggcctcccaaagtgctgggattacaggcgtgagccaccgcgcccagccagtttgtgattctttatgatacattaatgctttcattttcctaggggcttggatgtgcatggggctggaattggaaaaaatttatctgggcagaattttttcttcttccaaaatcaaggtggatggttctgggcacatggctggtgctttttaggtacttgttgatctgcccgttggggtaactcctgtttcaccttctatgggaaggaagggaatatcccgtgggagtttgttttttttccttgactattctcatccttgtgattgcattctggctgggcagttagaaaggagggggtcagatgggccacttccccatccctagggtcaagcttcactctctctcagctccctctcggaactaagacctgagcaaaggggtcagtctgtacagtgcagccaccctgactgactgttagagaaataaacaagatgttattgtgccgaggggagaagagttacatcaaaagtatctcagagaggaagaaagccaaatttctttttatatgagatgcatggatagggggagagagagagaaaaaaatgcctgggtaattaacttaataggtttcttaaagaatgcccttgtgagtgatgttcaacacattcaagtgttgacaagaaggcattgaacttgacgcccacgcagcgggcagaagcatgctctcggctccaacacaccttctttgtctgaaacttgtggtaagactcagtgctgggttgtgaaatctgtcccagggaatccgtgctgcaggagctccaaggtcaagccccgtgcttctggatagggttggggctggcaagggtgaccactcggaactaagatcccacgagtaggagagcagaggaagaggccctcaagtcagacacctagagatgctgccatgcctgggagagacccgtgagctctagggctcccaagacaacctgccactcttgggggtggtcggaacaaacctctgcttcttccctgcaaatcctggttgccttgggaaacttgggtctgatgtccaggaacacgtgtgagaccctaggtcttccctatcttgatgaactaagggaggaatctaggtgaatgtatcaatgtggattttccctttctcctaaatcggtggtagatagagaggccccaaatcattgctgggctgctgaaacaggaggctttgacttggataaggaggagtgtgtctgtgtgtgtgtgtgtgtgtgtctgtgtgtgtgtgtgtgtctctgtgtgtgtgtgtgtgtgtgtgtgtgttgtgcgtctatatatttgtatttacagaacattttgggttgctcttgactgaaaccacaagaagcataaatcactgttcctaaaacaaagcagtctcctctgccaggcagcctgcctcagaggccccagatgtggatggggcccttggcctctgcctgttgctggcagatcagcctgccttcccattgtcagtcacccactcttctcatcaccagccacccactcaaccaccctctctttctttttgtttcttttttgaggcagggtctcattttggcactgaggctggaatgcagtggtttgatcatagcgcactgcagccttggcctgctgggctcaggcaatcctcctacctcagcctcccgagtagctaggactacaggcacacaccaccatgcctggctaatttttttaaaaagttttatattttatagagttggagtcttgctgtttcccaggttggtctcgaactcactcctggcctcaagcagtcctcccaccttggcctcccaaagtgctgggatcacaggcgtgagccaccctgtctggtcccatcctccctgtctgttacattaggctcaggcttatcaggagatgggtgttttcaggctgggacctgaatctcagggtctctgtcacaaccatagtggccagatttgtaaaatggataaaaaaggtgacatgaatgcctttgtgaaagaacttctctttcttagatactttaccaaataaagcaaactaagtctacggttgcctggccatagaccctgtggaagctcactttaagggagcaatccaaaaggcccaaatccacacccttggttaacgggtttccagcctgggagaaggacctgcactgcctctcacccaaagtcatataccaagactgcgcgtgtctgtgtatgccgtggggagagtggggtgaactagaaatgctcctcatttacaatcagtcatcgtggaagggaatctcctcttgcaaccagaaagtctgggctagctctctgctcctgttattggccccagcccttgttctgggggctcatttctgcctgcagcagctggttcccaccaaggcaatgccattattctggagaggcaggattccagaatttgcataaactcctagggcatttctgtttctaggaaaagggaagaggtcgtcatctttctgcctaactccccatgcattaggacatgatagtcaagaaaaggctgtgggcttagctggggatgcccgttaattttacagtccaatttctccttccttcaccaccccatcccttctccaggctggagacgtattcctgctatgtctcctcttttccccattgcccaagttgagtttcctaagggcaaatggagcaggttaatcagattcctcacttgcctgtttggcccaggtgtgtggtcagggaagtatcctggtagcttagttcagcgcacattgatcgagtgcctaccaggtgcagagacagggctgggtactacaggggatacaaaaattaatagtctcactgttaataattcctgcctttaaggagtgttcattccatgggaaccacacagctgcctgcaccatccctatattcttagagaatagatgctccctgctcaggagtcaggagggagctgtgagcatcccagagacaagcaggtttccagaaactatctctcagtaatgcagaacccaccttccagcatcgaaactgggggccgcatgaactttgacaaggagacaacaatcaaggtgggacagatttgtgcctcaaactctcttgaaaatataattttcttcccttggatatagctggctcgagtgaagcagccttcttttaatcttgacaaaataatgaaatcagatcagtgatattggcgtgtttcatgtggacacatgatgctgggagaacttcagagctaggcagctcccacaactgccaagagactgaagctgaacttcaaggcagagtcctccagagtggcttaggcaaagtctccaccttgctgaagcccttcctggtccaccactccttgtggaggagaggggaaggtgggagccagggtctggggctttgccgggctggtggccgcctcaacattggctttgggatgaatctcaggaccagacttccccgcccttgtgtgggaggtgtgaggggctggagctgggaggcaggaagtgagcgcagatgggctaccgcctggacagctgtgcggggaacagagcacatctgtctgggtgtgagtggggcccctccccacaacctctgctgattctacatgtttgatagggtgtgggctgagggtgtgggctgagggtcccaaatggggaagaagatgggaaagtctgactatagagcaggaacgagggttgctgatggggtatgttcagatggagggagaggagggttgaagagaaagtggaaaatggaagcaaacagatcaaattttatctttctcaggatgggctctgggctttcagcggctctccaagccccagggtctgatgtctgttcctctgggaagctgccctagacccctggccgccccacccacagggtgctccctcctggtgcttccagtatcttacatcgtagttgtgaaagtccctgggataactgctcatttttctaccttacctactggactgcgggtgtattaagatcagagaccttgtctctgtgactgaatcctcactctgtagacgtgtgttgagtgaatgaatgattttatgaccttaaccaacacaaatttttctatttaattccttaatttttctctaattggctttaaaaattgctaggaaagcttatcccaagtagatgcctgggagatctttgggagttagaagctggagtagatttctcatcagaaatttgccagcaggcctggaagtgagagagccttttgctcttttcagggagcaaagcagagaggaaaggctcattctagaaactgcacaccctgacttggcttcatggccatttgtgtggcctccttggggcggttggtctccctccacatgaagctgtcatctgcctgatattgagccagctaggcagggagtatggatcacacagacctctgcaggctcaggaggtggataatttccccacatctctcccctccctcacctctctctggttttcacagtgcaatgaaaggatgtgggagtttgagacccatctctgctgtgtggccctgggtgagtcagttctcctctttgggcctcagtgttctcatctatagaatgggagggctggactgagactccttccggctcttaactactgtgaatctggtaggctaatgaggagggaatatggcccttggtggttattactgtctcctgagagcctgggctggggctttcccttaacttaggtgtgggaaagtggggaagggcccaagaggccattattccactcccgggtttcgaaaccactcctgagttcacctgctgctataacggtgactcttcttggatgatttagttgagtcttgcctggagtccaaagatctgcttgagtgattcttaaatgtttctcaagcttctgctcctggctttctattatctagcggagtgtaacagaaatgccaataggcaggaaggaagagctgaagttcccagggctttgggccaaaatcgtatactcatttctctccctctttttttttttttttttttttttttttgagacggagtcatgctctgtcacccaggctgccgcgcagtggcgtgatctcggctcattgcaacctctgctttccgggttcaagcgtttctcctgcctcagcctcctgagtagctgggattacaggtgcccgccaccacactcagctaatttttgtatttttagtagagatggggttctaccatgttggccagtctggtctcaagctcctgacctcaagtaatccatccaccttggcctcccaaagtggtgggattacaggcgtgagccaccgtgctggggcaaaattgtatactcttttctaacatcatttttgtcatcatcatcaccatccattactgataatgttagacatttattgttcttttttttcagccatgtgcagtgggtaagtacatcagcaagcaaactggcctcaagaatcccgccctatcctgggcatctggggttgaggctggctgtgccaacctttgcacagggtttcaatctgacctcactcagaaaacggagccacttgcttagagtccctctctctgaacacgctctcccctctggaggaaaagcattgcaatcccaagctcctgctgctgccgtacatctgcatcttattcatctttgaagctcctgcaatgcctccaacggggacacaactaaaggtgctcgctaaatacttattgataataatcattataatgatgtatcataatagattcagcggggaagttggctactgagctgccctgagctgagacccatatttaactccttgtctgagcatcttctgtgctcaggccagagcgacagccttgcgaggctagcgtgggatggtctggagacaaggtggcaagactcaggcaggagctgaacagctggcgcctccttctggcctcgcagggctggagcaggactggggagggcgggcttgtgcgagaacctctgcccctgggctcccaggatgtgaccctccctgccagagacccttaaccccggacagccccagctcaggagagctaacagtgagcgagggaggctgttatgtaaccgactgaactcctcgtcaacactggtgactaattccgacagtctcggccagttgtggctgattctcacaccctctgctggatgcatctctccgcttcctccctggccctggccccagccccaccaacctccaccactgtcccatgctcctccccacgtggactggggatgcttggggaagcaagccttttctagatgcgtccagcccccaatctttgcatcccttcctgccttaaaaagatgccaggagcagattgtccatttctgtctgtacaaaaacccacttgcctgggggctcattgaggcccttcttttgctcctgggtaagggagaagaaagtggttgctggcaggctgggaatttcggcttgccaaggctgggactgttgagttcggaaatcgtggtggccaaactccaccatttaccaggggaaagggacccagggagtacctgacctccctcagtctctggacctaggacccctggccctgtgggtcgcaggttccctggatgatgctggggaaaaggcctgtgttcattgcctcagttctaatttttctttttcaaaaggaagctctcagaacgcccagctatccccactgcagaaggctctccctgaaagggcacaggtggaggacgtttgcatttatctggagacagttcatggagaaacacaaagaggtgtcctgacaagacaacaggtccacagcagtcgtcatcatgagtgctcaccatatgccagggttcatcttttaaaatccttaaccaaacaaccaaactgtggttgggattattctctttttataggtgagaaaactgaggctgaaagccattgggtggtttgccaaagctgagaagtagctgagctggggtttgtactcacaccacggtgactcggaggcccaagccagttctgacacactgccttcccatgacattcccacgacaggttcccgaggtcgttggaatgcttacacatttcagcaacttcatggcaactgcccagctcgacccagaagataatactaccttgtactccccctgccgcttccttcctccaggcagctcacagacatgacctcattccctctcccagagtcccataggggtgaaggacagggtggggatcgttaactctgcttcctagggaggaaagggaggcccagagagggatgctggcccaccctgggtcatccagccagctagcgggagagctgcaactggaaatcaggcttccctgccctcggggacagttatttagcctcctggatgtgagctagaatcacccctaagatgcagcaattggggtactcctcttggggtactgggactcagtggctgaaacagctccaagagagttgggcctgtgctgaaaacagaaatccgagatgcatataaattcaatccgtatgagaagagcagggtggcctgggaggagtggtcaccgcagtggctccacctcctacccggccacctgcagccctgcctgggctgctcttggtctctctgtgcccagcttccctggccggatgccctgggggccagagcagccgcaggtgcgatgaaaagaacactggccttgaggtcatgggacctggggaggatattcaccaggggcccctaagttagtcattttagctctcagcttttccatttttcattcaaaaaatggggactctaactccatgaaagagacattgtgtgtgaaatatttcatcataagctgtgaagcctgcaaagaaactcctggtgttctctgtagcctgatttcatctctactaaacgctattttgaaaatgattttgaagctggtgggtcacatagaaggatggcctgagcatccatccatcttccctccggtgaccctttcacttcgtgtctgtggtacccagtgcctggtactgaatgttcctgggtggccccgtggttcggcaaactttctggaaaggcccaggtagtaaatatttgaggcctggtgggccacatatggttttggtcacatgttctttgtttgtttcttttcttataaccctttgaaaatgcaaaaacctttctcagctcacaggccctacaaaaataggttgatttggcctgtgggctgtcgtttgcagggggccggtttacctggtagaaagtgggtgggtgggagtttggaaatggacagaaaagcccgcagcccagttttgcacttgcctggctgtatgctgttaggccactcacttggcctgccccggagttagtttaatggtctgccctatgattctaatgatgcctacttcaggggctatcatgagaataacatgtaccccatagcaggctctcagcagatgggagctgatgtcattgcttctgtccaacaagcatgagaatgcagggtccaggggtggcccaccctgtccgcagtatggtggggtggacagcgctttcctagggcttgggatattttatcagggagccaatgccttgccttggaagggagaggcccccaggctggggtttcatgacagaaagaggagtgaagtccggggcttatgtcaggagctggtcagtgcacactggcagagcatggagaagtggaagccaggggaggggaggaccatctgcagggagggggcgagggtgggaggagggccatgggaaacagctgtttacctgttttgggcagctgtgatgggctctgctggccttgggggagtgatcccaggtggctagagtggccacagcagtctggtgggctcagggaaaggtgggggtagacgtgaggcgctgcagacctgggccccaacactgactttgttgctgtcaggggtgggggctgggagtctttgaggctagaagagaccccgcatagacggaggcccagggaggcccagggctttgccaagagaggatacccggggagtacccagtcctcttgagtcctggcttcttgtcaagtgaaacattagagaaggacagcctttttttttttttcctcaacaaagggtggactggagtaagctctccccataataatgaaagcaaccatgtcccaagtgccttctgcatatcgggcgctgggccggatctttgtgcaccttggcacccatcctctcaacaagcctctgccaccatgaggggtagaggtgcccgctccgtctcagggctgcggggctgcagctggggtgagaactggctggagtcagtggtcctgcctcctctgtgccccaccacctccccgggagcctggctctgccatgggttcaagttgcagtaggatacccaggccaagggggttgcaatcttgattcctttctttttgagaaatgcagagagaagttatgtagttcctcgagaagcccccatcaccacccagccatggagactgctcccttccgcgtacccgtgccgtctcatggctggttccgaagggctcaactgggaacagcctcccaggctgcaacatagcagtgtgacacggagctcaaggcagcgtctcagtggtttgctcatttctgcacatgcttgcatctgtgtgtgcccttcctctatctagacagcacttctgtcacttctctcctggtaaacttctatttggtcctttaaaacacagctcagatgtcacctcctctgggaagccttccaagactacctaggcacagttatcaggcattttgattgtgctcttatcgttgcattattttcagggacaaacatcggttgggcacttattacaccctaagctttgtgctaggcacctcactgcattatctcattgaatacttacaaacctatggggtggatattcttacccccattttatagacagggaacctgaggcttagagcagttaaatcacctgcccaaggtcacctagctgttgagtggtgagactgggaagtgaacacaggcagtttgactccggtgccctccctcctaaccactaaattatattgcctcccttacatgacttaaaattgccccagactgtaattaaacgtttatgggtctggtaaacgcctcacaagcagagaccatgacttatttatctttgctgccttagaacatagcacatagtacaatgcatatagtaggtgcttggtggatgcttatgggatgaacagtgaatgaagaggccatgggggttgaggctgctgatggaaggtggggtggctgaggccagggaagggaggatggcagggggggcagttgagtggacaacgtgtgtgtgtggtgggtgcagggagaaggctccagaggcctgggaaggaaagtggttcctacagggcctgtaccatgccattttggaatccccaggctactacttagtaagcgtcttcaatatgctagcaagtgcttcagacatgggcattctaagtccacaatacgagaaggcttgtgcaaacccccagacaactaactcacataggaagagcctagacctcagtcctcgtaggatgaactctggcaaaggttcccctgaaggcgaggtctagaccaggtgaccttgaacgtgtctctgagccttgctggcattctttgggtctagggtgttcaaggaggtttcgcgcacaccagttgccctgtgcattagtcctctcttgcaccttgtgactctgtcatagtagcctgacttcccagaggaagcgagctctagggccagcggggaggcgggcatcagatctccatctcctcctggccccctctgcccatggcccacaggaggtgggaccctgccaggccccaaagcctggagcctccccagcaagcacaggtgggctgtgaggtcatgcttctcagacctgaaaggagacagccatcacatcttgcaggtgggcctgccccggggaactgtggggtggggtgtgtgtgtgtgtgtttgtgtgtgtgtgaacccctctagccttattcacagtcccctctgggggccaggggcgccccttgatgccaaccggaaagcccttatcttgcccggaagaggtccaaagcatgtgtggctcctgacatggcgaggggaggctggggggaggcggggaaggcggagagagcgagaagacccccctgcaagccgtgttcatacaaaatgcatttcccaacgtatccctctggcctgtcggagccccttctgctcactgctctgtttatacatgatagacaactaattaacatccaaacctcttgaaaggtcttttcagaggtaatgttctgacagattatgtcagcaaggagcactgatttgtctaagcatggatcacattgtttcagattgaatgaggtgaatattaaactgctttaaatgtactcttcataaagtactaattacacactcccaagagagaacagccaaggaatactaaacagtagagaagtcaacagagggttctttttatagtatgttgctgggctctgtgtttttctgtctccttctttctcgctctctctctttctctctttttttttacagtaaaatcacagcacgctaaagaatacacatttatagcacaatgcttctcatctaattatatggcaatcattagttttaagctggatgcattatattttctttgatatattatgcctaaggcataactctgcatttattgttgctactggcagattttagctcccccacaagcccccttttccaaaccccaactactttctaacccccaccttttaacaaattatttaacccctatgttagtttgcttattgtgccagaaaaaaaaatcacaatttaaatcggcaaaaaaatgggtgaaacaatatacccttcattaatttaaagaaaagaaatcgcatgtgttctggggagctgtgcaaattttattaaccaggtgatgtcctgaatacacaatttctacctcccaccccagtgaatttcctttgcaacaaattctaccagatcacactgaattccctcttggctgagactccttgtccctcagggaaagagatatttatatgtatataaatatatatctagaaaagcaacacagggtggaaaaccatgtgccaaagagcattccttcaaaatgcctatccacagatgtagccagaattctgctccatcagtttttctgggtctttctgacattagcttttgcccatggttgagaaaaagcaaggtcaattttgagatgtcctaggctctcagattctcaatcctgaagaaaggaaaaagccaagttccctggggatggatgatattgacccatctggtttcttctcggtcaggcctccaattcccatgccgttgcagagaaaagagactgcaagtctccgagaggtagaattacttctccgtaagtggcaaagtggggccatgttctccccaactgtgactttctctttccctccccactccaatcaaagaactgtggagtcttggggttgaaggcatcagagatttcctttgctcgttgtgttacagccaaggattcctggctgaaaggggctatgcatgtcccctaacatcacagagctgcctgcggtcaggactggactccaggttcctgactcctagaccagtgtccacttcagacagagaagttccaagcaactcttcctacacaagaacgaccaagggccaaggaataaaatgacagcagcatcttttctgagggctgaaagaagtcttttttttttttgagatcgggtcttgctctctctcccaggctggagcgcagtagcatgatcttggctcactgcaacctctgcctcccgtgttcaagcgattctccgacctcagcctaccgagtagctgggattacaggtgcatgccaccacacccagctaatttttgtatttttagtagagacagggttttgccatgttggccaggctggtctcgaactcctgacctccggtgatctgcccacctctgcctcccaaagtgctgggattacaggtgtgagccactgttgcccgccggaagaagtcttaaaccccttgggtttcttcttgaatcccactccacaatatccccaaccaaagacttgttcattcttggctctggacactgcctccaatccccgacagcggtcagatcatcactgtgtagctctcatggtttaaagtacgtgtttacgagcagtgaatgctggccctagagcgtgtagcttcgaatcttgcactgccacttcccggatctctgaccttggctaagagacttagcatttctttgcctctgtttcccccatatctacaaaatgggaacaatgcgagtgtctgcctcacagggtgttgtgaggatgaggctaggtaatatatatgtaagaggtgcccagcctactaggctaattaaggttagctatcattattgttagaaagtttgccttctcaaccgagctctttctcccccaaacaactaccatgaaagaactatctcacctccaagaactaccatggttgtagttctgtctggggccccatggaagaagattaatttttctcctacatgactgctttcaactatttcattcattcattgcacagttttgctaggtggtctctggatgccaggtgcataatgccaggtgtggagagagccatgaagaagacctggtccctgctttcaagagcccatactccagaaggacgtgtaatttgtcttcggagcttctcttccccaggggaaacgctcatcagtttcttcacatattcctcacttaacatgatgtcaagcctttcctggcccatgttccttatgtgaaatcatccaaagaaatttaccaaggatgaagaaaaaatggcagcaaatttgggcttccattactcacacatactctatagcacccattactcaggagattgggattctattgggttagagtggtcccaagtatgttgttttttaaaaaagctctgcacacttgaatctaatacacacacacaccctctatcctgaaaaaatggagaaggataaactcttctctcccaatgctgatctccacctcctccagggtctctcttcaagtccaggttactctctgtggaggtgttatttgatatgtgaaggtgtgagctgctgacctgtgaacgcttcagggtgcactaagttagctggcagcctcactgtgcaccgcgtatgccagccaaaacccagggaccaaggctggctttgtgggcatgtgaccggtgtagttgcccaatgccctgtgctttgaaggcctttatgtatatatatattataatagtgttcgcagccgagttcctagtaatttcatcttggaatgtgtgtttggtaagtgaagtatcatgggactatggagtgtgtggtggggatttggagcctcaactggctgacccgtggtcctactctgaggctgctgccaccttctgctctctgtgggagcctgggtgcaggtgcagagtggggatcggtcatacaccccatggcatcttagagtgggacaaacattggtcactcctgtccccaaatggcaacattcagtggatgatttgacagaggcctctcacccacccccaatccaggttccaagcacatctgggcatggaggttgcaatccttggggatgcccctggccatgaggaccagtgggtcagagagaggaggggatggacttcccctgtcccaggcagggccccacatttccaaattgccctgggtcctgcaaatcgcggttctgccagatactgagccaagcattccctctctcatacctcttcccatcgcatcgtcaccgggtcctcagtttctttccttcttccttcctttatttcttccttccttccttccttccttccttccttcctttctttcttctgagacagcatcttgatgcgacgtccaggtaggagagcaatggtgcaatctcggctcactgcaacctccccttctcatgttcaagcgattctcctgcctcagcctcatgagtagctgagactacaggtatgtgccaccacacccagctaatttttgtatttttagtagagatggggtttcaccatattggccaggctggtctcgaactcctgacctcaagtgatctgcccgccttggcctcccaaagtgctgggattataggcgtgagctgctgcacccagcccaggtcctcagtttcttagaaacaccttctcttagggacaaacattgtccctcatgagcccatgcctggatgactgtaaccacctgggagggaccccctgcctctgttctctcatccttcccatcagtgatgctgccaaagctagcataatagaaaacaaattcaactttctcattctcctgataaaaccctgtccacaagagtcctcttctactccaggataacatactgtgtatgtccgtgcatgtgagtgtgtgtataggttctaagcacctaaacagatattcgctccacgctgcgggtgggctctctccacagagagagatcaccaccattcatggatcaccacctgtggatcaccaccattcatggatcaccacctgtggatcaccaccattcatggatcaccacctgtggatcaccaccattcatggatcaccacctgtggatcaccaccattcatggatcaccacctgtggatcaccaccattcatggatcaccacctgtggatcaccacagtgtttaagaccaagcgaggaaacatgtcacagtggaatctgggcagtgaggatgctattttcgaggaagagctcttgcctcacaccagtagacacaggcagccagctccttggcctaacttgatggactccctaaacacttcctcttccttccaagcctgtgtctcccttcctcaccctcacgccacagtcttggccagtcttgtcacggtgaggccatcaggtgagaggatgtggtgtggaggatgtgtgcttcagggtcgggtagacccggccattcatgcctgtgggactgtggatggtgaaagcccaccgacaggtcacaggcatctgggaaatgccaaacaaagtggaagaagctggctttgggtgatgaccagttcatagatggcctctgacctcacggagctggcagccccttggcgataacataaccctctgtgcactggctttctcatttgcaaaaggagatcctttcctcagactgaaataatgcacataagctgcatggtatgaaatttctgaaggggcattcttccacagcccaagaggtgtatcaggaagctggcccttcagggacaggaacacctgtgcaccacatctctgcgatgatgcgacctggtgcctgtgacacatccctgcacattgctgtgggggtaaccaaaaatggagctgtgggagccagtggagggcatgctggcgtatcaggggcagcagcacccggggcggcggttgggggaatggaatccaatatgaagatggttctttctttctctaacactttactgcatgccctggtgtcacttttctcagcatggcttctccctgcactccttgcttccaaatgctcagtacttcctgtccacccaggtgggtcacagcacaggccttggaggaagccgactaagctgggtttgaatgattgcttctgcaagctaacagccatgtggccttaggtgagttatgggacctccccatgcctcagtttcctcatggacaaagtgggggctgacaataccatcctccttacttcaccgtgggggtctagagtgtgctgcagaagtgcctgggtgagacctgcttccggttcctctttaagccatacgaaggggtgttccggatctaacagattctcccttctcaggagtacttgcattttaaaagatgaccctggggctgcttcatacagcacaataaattgactagagcgaagctccggtgggaagcagtggggtaaagatattttgggggcaggaaatgaccttcctttacttcccaaatcataccacttagactagcagttctcagcctcaaagctgtgacacgctggtgtgggaccagcagttgtgagatgtatcacaagcaaatgctgccaaaaataaagtgctgtggtttttgaataatcccccccaccaattttttgtttgtaaatcagagggaattcagggttatccctataatgttgtcacgtccgctgtcattcctccgtgatttctcgagcgggaaagaagagtgagcaggaaccactgctttctgcaacaacacaggtgattcctacgatagaatactatgattgcatttacatgacgctcaagaatacgcctgattgacagtgataagagtccaaataatctcaccttgccgggggtatatggatggggaggaggtgtgtgggagactcttggggtgttggaaatatttgctatcttgatctcggtggtggttacttgggtaaataaccattaaattgtatgcttaagacctatgtacttgatgtatgtacttgtaactacatagttttttcttttttgagatggagtttggctctgttgcccacgctgggctcggctcactgcaacctccgtctcccagtttcaagtgattctcccgcctcagcctcctgagtatctgggattacaggcgctgccactatgcccagctaatttttgtatttttaatagagatggggtttctccaggccaggctggtctcgaactcttgacctcaggtgatccgcccaccccggcctcccaaagtgctgggattacaggcgtgagccactgtgcccggcctataaatgtttttttgaaaagtaccttggaattccaggcaaacacctataaagggttttcctatggtgcctgttggaaattccctaaatgccctagggtcttgggcaaagacagtggggtgttggcattaatgcaggagtctgggagcactggggtccctagcaggctgtttcccctgaagtgactgcccacgaacacttcttgtgtccctctgccccctggtagatgcctctttggggctgacatctcagccttattagtgccagtgcttgcagagacaggaccctctttggatgtcttatttttcctggccacacagcccctagcacagtaagagcatgggtgctaccagtatgtgttgtgaagcatttattgcctggggtggtttggggtgctcacgcgagccccccacgacagcctcagtgaacaaagccaagcagaccccccatcccctgccaatccaaggccccacggtgctgaggtgacagttcccgggcctccggtgcggagctcattttgtttgctttgtatgttagttttcacccagcccttcggttgccaaggaaacagtgacgcagcctcgggtggggcctcggcccagtcaatacggagccttttgaggcaatggttcagggaggccagctgggtgctggggagggtggcaaggaggtagggggtgggtcagggcaggatggggagaggagtgggggcgggctttttgttggcccgcggatggtgctatcaggaggcagtattccatttgcagcctccggagacccacccttggctgtgtcaccggcagatacgaggcagaaggttctagaggccgaaggaaccgcccgttcctatcctggtgtttgtgtggcctgggacagtcgtctccggggctctgccacatgtcaggcctctgcagaactcagtcacactaggagctgggcagagtgggtttctgggagctgagagcatttgtggacatttgggaagtgggggtctgctggaaactaaggtccaggtggatccttttgatgtgagaagcagctcctgtgtcccccagggacgatctccttccctctctaccctcacgttgccaccatcagtgacatgagacccctgggagctctcagccagcttggcctcagtgcccctcagtgccccctcagcctcacgctccctgggcacgccattgaggttgctcctgggttcctgcctccctcaggcccatactcttggcgccaaccatgcagcccaagtttacaggccaggaggctacctgagactccagccctctggggcttatctcagagtctctgttttgaaggctcctccagagagggagggccccattattatgcttggtcctgtctcagtggctctggatgcagcctttcggtaaagatattctgagttccgttcttaaccctaagctgccccacaacctggtgaataagcaaagaccttccctgctgtgtgcctcagtttcctttctgagacccttcctttcctgctgcgtggatgctctcccatgtcttgcctgcagcctagagaggaatagaacagggcctttccccaggccccgcctccccacccgaatgcctcttctctgtcatctccccatcacccagcctctttctcctttatcacccttccccagtcacttttcaaattctgtcagctcttccttcaaaatgtcgccagcatatgtcccttctttttttaaaaaaataaattccattgtttttcttcgtatgaaagagaaatatgctcagtgtagaaaatttagaaaataccaataaccaaagagaaaaaagaaaagaaagccgtcatccttcctcccgccattgctgcagtcattattttgagacacacaagtcagtcccggcctgtgctcaggaacctgcatctcctctttgttttgtgactccctattcctgccactctgctgccctcagggcccctgactctctcctcttgtccaccccgccgcctatgccacgctaaccttctcaaactctgccttcgaaatgcttcagtttcctacacgtcaaatcctaggcagccatcagcccctaggaagcaggcgcccctctgggtggaagcccacagggtaccaggtctatggcgggcacctttgtgtgaatgagaaagaaggctcctcttccttggggcagaggaagctctgggactgggtcagtggcttggtgggcagacagcaaggagcagtcaacagctgtgggaggtggccctggtgaaacctgctctctgccatatggttgccaaagcctcccttaccctcccttatcaatcgcagtcccccttccaaagcacctatcctccctcaatgccaggccagcctagtccctgcttctcaaatgctgtgtgttcgatgcccctctggccttggccgaagctgcatcctgtcctctctctccctaccctcccactgcgcatccttggaggcccagcccaggggtccaggcaggtcccctgagtgaatctctgggtgggttggggtctggggtgaatgggagagggcctgcgctggccagatcttcctccaggttattcattgtgactgtgtgatttttcaatgtcgcctgctcattcagctcttgaagacaccctgcccaggctgagggaagttgttccatttgtcctctgaatatttctgtgcctccatcccacctctccttgatcagccctgctcctcaggcagagaagcatcatcttcacattagcagttcaggctgtgtggtttaacggaaagcacacgtatccacgcatccgctcaacatgtatttattgaataccttcacaggttttgcagtaaaaaaaaatcttggcttagcttctgatgctaccactttcttgagcaagtcacctaaattttccaagcctcatttgcccacccataaaatgggattgaagttacttctcaactcactcactcgtgagaaggcattgaaatcagatatgtgaaagcattttgtaaaccgtgatgcttggtgaaatgccatgagcatcccatcacctttgtttagggtgtgctagtcacactgaatagtgtaagctgacccccacaggactgaacacctaccaggcatttgataaatacctgcaggttagttaacacaatgcattgacagtaccatatataccttcttcaacagagaatttgttggctgggcacagtggctcacaccactgagcactttgggaggccgaggtgggtggatcacttgaagtcaagagttcgagaccagcctagccaacatggtgaaaccctgtttctactaaaaatacaaaaattagtccgacatggtggcgcatgcctgtagtcgcagctacttgggaggcagaggcaggagaatcactcgaacccaggaggtggaggttgcagcgagctgagatcgtgccattgcactccagcctgggtgacggagtgagagtccatctcaaaaaagaaaaaaaaagaaaatttgtatagattataacaaaaccatatgtgatgaaataataataatattgacaacactaagcaatcattggatggaactctgactccgtgcttggcaccattcaggtagaaggtgagacttgactccagaggcagggcgcagacactggaccaaattgaggactagctaaaacagggatggggtggaagctgctttccataagacatgcccaccagcatgctatgtcagtttaccattgccatggcaacacctgggcgttactgcccctttccatggcaatggcctggccacccaaaagttaccaccctttccctagaaacttctgtacgaactgccccttaatctatgtgtaattaaaataggtataaatatgactgcaaaattgccctgagctgctactctcagcacagtgcctatggggtagccctgctctgcaggagcagtcatgaagctataatgctgtcagagttttaacactgccgcttcaataaagctgttttcttctgctctaccactggttcacccttgaagtctttccagggtgaagccaagaaccctcacaggctaagccccaccttagggttcatctgccctgcatcactgtgataagaccctttgtaatcattgtctcacttaacccttcacaataaatctacaaagaaggtactgttgttacccctattacatagatgagaaaaccaaggcttaatgcaattaagtaacttctccagggttgtctagctggtgagaggtctgggcaggagagggagcagggaaataattggacatggtgcgtcaagactttgggctgagataattctgcatatgcaaaggcatctagaagagtcccaggcaaactgtaagcactcagtaactcatactaattattcctgggttccatgcccattatataccttattttatttaattaaatcctcacaacaaccttgtggggcagggcaggtattctctctctctctctcttttttttttttttttttttgagacagggtcttgctctgtcatccaggctggagtaaaatgctgtgattgtagctcattgcggcatccaactcctggcctcagttgatcctcctgtcttggcctcccaaagtaggtattcttatgtacattttccaaatgaggaaaccagcagtcagagagattcagtgcctctgcgcaggccacagagctatgaactgagaggctggtctgggacccaggccctactgtctcctctacctgaaggtcagctatctgaggcccacagaccttttcttagacaaataggaagattctgcttcccatgacattgctggccttacttctgtgagcctcttagctggaaggtccttgtgaaggccttcaaggcagcctccaccagaacccacctgcctcagaaatacctgcacagtcttggctgctgtgagctgggctctcatagctaacaggggccctctctttaaacttcaaaggaacaaagacttagagaacccatcttggccttccccaccccctacccctctttccccacccccaaagaaaaatgaaagaatctgataattacttctatctaccacccaactgtactaattaccaacctatttcttcacagtatgacagacaccagctctggaaaacacatagagataaattagcactaattggttttcctctggctgtttgaattagtatttaaagctccaattacaaagcagaataattgctattaatgtcctatcgcagcacaaaaggcagttcgctcaagcaccagcccaggtgtattattactctgattacagcatatttaacctggctcgttaagagggagacacaggggacagtttcaatatggtggacaggccacttcctgcagggcacaaagctggaggagacccgtgaccccagggaagaaaggcggggagggaggcagggagatgaggggatggggaagctgagcctggaagcctgtgggatttctcagcaggctcctggggtctcttcctgtggctctcactgtctcctgggggccttttcctgggctggcctacccctctccctacagaacagctgcctgctcatacccgaagctagcaaagtcatccgcaggccttcctggcccctgagagggtgctcaggagggaggctgctgccagaaggacctgtgggatgttcccaatgttggcatcaggcttgtcactagggagcgggtgggggctgagccctctagccacacctctgttcccttgggagcctcagccgggggctttaggatgcagggttgcttgctgttccaaccgtgggggtccttgctttacctcctccacccttttccatcttgttcctctaccagggaccttccctgttctgaccagaggacgatgggagagttgggaagaaggtgaactccgtgcagtccccttaacgggtgctatacacagggggtagggtagagagccctggctgtcccactgacaggctagatggcaagtcctccaacctccgagatactcaggtctcttcaactataaaacgggcaccacagcctccctcctgctggtttcacagagctgtgaggttcaaaccaggatggaggaaagtgctctgtcgatcacagcatgctgctcctgaaggaaggaggccagggcttgaactggatctgcctcttgctgctcctttctttgctctcatcttccctttcaatcactttccttcctcttctttgtctctttctctacttccacttcctcccttccttttgggcttctgcatctcactcatctccccattcacgctaggatgttaaggactcaatgagttaccctttcctagagcagctgcgtttaagaagggagggctatgtttaacccaaagaaatgagtcactaatggtgaactttcaggcaaactgagatgatattttgtgggggagagggaggatgtcacagtactcttcagagccccataggcagctgtctactcactgacacacaggtttggcgccagcctgtgccaggctcaattttagccagagagggaaggaggccccgcagggaggagtcagcaagagaaaaatcaccgatggggggtaggggccgagtcccctccacctggcaaacccagctgaagttgctgaccctagatgtcaaggtcatgacatgaggcttcggggactctcattttggaggtgcagacagggagccgctctggcccagccgtccccaccaggataggctgctgagtcctggccatccccgaggctgtcctgaggagttcagcctcctcttgtctgtcagcgcctctgactcttgtccgatttccttctgttgccatatggaaagaaaccaatctgactttcccccatggtcttctcggtctgtttcatcccttttaggtcccctgtcctcccgtgccctccagtctctccccagctcttccccaggagcccctctttccttggtcctgccagctcctgggtgacaccatcctggagagatgccacaggccaaggggcaaagtggtatctgtggagctgagacccaggttcagtgcagctctgcattaagttagccatgtgatacattttccgttgcctctctggcatcagtttccccacctgtaccataagagacgggccccaagttctcttctaaggtcatgttctaggttttagggctcccctctcttccttctccatatcaactggccccttctacccgagaaagctgcctctctcagcagcatctttcagggacccggaagccccaagcatctggcaaggagggttcctgaggtgggcaatgggaaggccgtcagggcccgtctgccagggagaagcctccgggtggtctctgctgggtgggcccagctgtcgaggcccaggcaaggagcggccttgccaaccaatccctcctttacaaccatgccgggaggggtgcgcaggggcccgtgggtggtgttcacgtatggaggggggggatttctttttaagagacaaggtgggtggaatgggggaagccagctggctgtgggctctatttctactgacaaggctttaccctgtaggtgtgaggaattccaattaaatatgcagcctatttgtctgtgtgtgggagagggtttgctgggaaggagggggacggaggcagcgtctctgcggcataccagcaaaccagaaattagctccgttcatcacaggcacacggggcttccctcagccctcctgtgcactcacaggaggctcgaggagacagacagaggaagcgagagagaggttggggaggcgggttctccaggctggaagggcttccggaatctctgagtgggcaggaaggattgcccgactccttggctcttgggggggtttcccgttctggaggcgccggcagtgagcttctctgggccatctgtccctaccagggatggccagggtggtctgggctcacccctggaacaatgggggttgcagatgcacacagaggggtgtctgtgtgcaccagagaggcaggtgggtctgtggcaggggctgcctggggcaggcaccattacctctccagggccctggggaccactgggaccctccccttcttcatctctgcaccaaagtaatacttagaaagcctcgtgaggggcagcggtttctttgaagaacagaatcctgaaatgctgacgccagcgctcacacccttcctagcagagagattatgccaaggtttttgggggtgcatgggtctccagaagccattgcaaacccttccctttcccctttcttcatttctctttttactcatagatgagatttggcagaaaacatgaaagttctgtagggcacagaggccaatgtatgttgacgctgataaatttggtctttcaacagtaaaattatgtggtttgggggagctttccatggtgcctggcatgtgagtacctttgaacctcagtgttgatggttgcagggtctgtgggcctcctggttacgccatcggtcttgctctcagccttcaaaccactggtctttcgttccggctgccactctgtcttcttacatcctcctcccacgggtttctccatcagccgagtcctctctgcatttttgcttatcttttcttgatgctgtttctctccctatctgcaaacacttattcctccccatctctactttcaccatctattccccaactgattaaaacataatcactcgttgacttaaggagctaagtggcttgatatggatgggagaaggagaatggttggtaagccatttttttctgatcgggcatccgagatattggtcaatgaatcccatgccagctgactcctcctcttcagagcagcgctgaagtgaagcctgcggagctgggaggtggttggcacatggcctcataacattagccagactggcctgaaggatggcattggggtacaaccagggcagcatgtgatgcgtcctacgggggcaggcttgggtggggacatgggaagggcaccgatcagaatggtgggttggggcagagaaacagcagctgaggtccggagggagggagctacaaaggaggtgagtgtgcagagaagcaggtggtgtgggtcagagcatacaagtgagaaactgggaaagacattcagcactgatctgctcatgagggagggagggtgctggccccttcctcattttccccgatttccctctttccttctgcttcccctcaggtccccctgagttccccctcctctactcctccactcccctcacttcctccatctgcatcatctctcacatttacagtgtggaagaggagggtgtggctaccccaggagaactttctgggatggagaggacaagaccacagtggacaggctgttgggtggggcccttctaagctgtgagagtgacctgggctggagcccagggtgggcctggcctagagcataagaggggctgtggggaggggggaacgcagccctgagacctgaggagaggcaggccctgaaggaaatgagcaggcttcagctgaggccacattgacaggacctcctggtgacagcctgaggtggccaggacacttaccccctggctgccagcctgctctagctccatcggatacagggttctcttctcactcgccctgcacggcactcctgttgccccagagccgggggtggtggctggggcaccgggaaatgttatgaatggcagaactgctccaagcccccagccttcctcttgaggaggaggagagaatccgaccatgaggtattttcctggcgctaaggataaccttgtaggaggcagagggaatccaattagacatgcaaggctggggaggctgagggcgtgtgggagaaggctgcttttcactttctggcttccccgcgccctcaatgagaaattatagcttggctccttcgttacagcccccctccgctctcctctttcctttcccagggccgtcatcacactcagcttttcccaccaccagcccctgcacagagggggaaacagagtcccacaacgatgggacccgcgaggcagaagccctcctgggcagtgccatcacggttcccttcctgtctctagttgcccctggaatttgggggaggctgcctcctgtacccctggagttggttgcccatctacccctgtctctactgcttgtcctgagcttatctgagctctgcagtgattgtccatctcgcccctctctgcttgggctcggcacaggtaaagcagcaaatgacctccttcctcccagacccaaagtccccaactgcccccggtggacagatccatgtgcttccatgtgagactggatcctgttgcccggaagatgccccacttagtcctctttagaggcagttatggggagacagagcttgaacttttttttttttttttgagatggagtttcgctcttgttgccccggctggagtgcagtggcatggtctcagctcactgcaacctccgcctcttgggttcgagtgataacttggacaggctcctgggccttcttgggccctcaccaagtacgcccactgatagcaactgctccacccaagatgcttttcctgccttcctgttgtccctgtttccctcgcctgtgatccggggatgggaacgaggcttctgctgatggagcgggcctggggccaccctgtggactgggatgcagaggcctgagtggagagctccccagcaaagcctcctgggagaaggttctgggcatgctgtctcgtggctgctgggctcccggatggctccccagccttccttcttgccctaccctggccttctctccttgctctgctgaggccatctgaagggggatttttcggggtaagtaaagtcttcagccagttttagtgccccgcacagtcaggggctgctgccaccagggcgggctcctctgtcatgttgtcggaggctgtcctcggaggtgtgaggaactccaattaagcactcagcctgtctgcctgcgtggggggcacgggctgcatgggaggcggtgactaatcctcacagcactgatcagaggccctggggagtaggtggtgggaaggtgggcgggggaggtgggggaggagggggatggggtttcctcaccaagtcagctggctcccagctctgcgcgtgtgatggtgcccagaggagggtttgggatcctgagaaggaaaggccatggggaccctggctccccatagaaggatccagtcctcgtggggttcaaggtgacccatatttggattcacctgttttccaaaaacctctgatgtaccaggcacgggtgctccccacaaccctaagacggctgttattggcctcaatttacaaagaatctgagctgcagagaaataagtgacttctcaaaggtcaccaggctaggaggtggtcaagggagaggtcccacaccaaggccagtgggttttttatggcgtcacggaggtcgccaggcaaagagctctaagggtctttagcagagcatctgggtcccaggtcacaaatgtccccacccacacccccattatatggagagacagaaaagcccagggagagagctgggctggtgccgtggtcccccgactctgtgtcccaccaacaagaagagtcctttggaaggctgggtggtgtctccactgggaatgttcattcatttggcaaatatctatgaaccactgatatggtgcccttagcactgtgtttagcactgggaagggtgaggaaagtcaggtctggaagaggagacactcagcagggcttcgaatatatgcatatagaaagtgattggctatttttattttccaagaataaatgggaggaaacagggcagaaaccatcacatgggcgacttagcttggacatgcaaatgctttggaggggacaactgctcagtagtttgccagggaaagttaaaagcagcatggattcccaggcatcttgtttttttaaaatcttttttttttttttgagacagggtctcactgttgcccagggtggagtgcagtggcacgatcacggctcactgcaacctctgcctctctggctcaggtgatcctcccacctcagcccctgaagtagctgggaccacaggtgctgggaccacaggcacgcactatcacatccagctaatttttgtatttttttgtagagatagtgttcaccatgttgctcaggctggtctcaaactcctaagctcaagcaatctgcccaccttggcctcccaaagtgctggaatgataggtgtgaaccatcatcgtgcctggccctttttaaaatcttgaggcaggagaggaattatacattcctttctcacccaggcctgggtcaatttcactggtgaccaaggctgttgtttctcgaccttttcaatagctttctgaggcttggagtagctcgtaccttgaggttcatttgtccaggaccctactaggtcctctcccctccctaagcacacacagtagagagaacctccctgggaagccaggcacatttgcatttctgcctgaactacagatgaaggttttgtgggttatgacttcgtatggatcctttgaggttccacagtgccctgggctgcccaccagaggatgcctcctgggaagctaggagaaaacctgcgatggaagttataaggcctgaaggcattgactcccctgccatacacccaccaggaagaaaaggggtccggatcagcggaccttcagcagctggaaggatgtggacagagggcactaaagtgatggctggactcctccgatcctgagggcgtctaaggctcagtcttaggtcttcccttctgtaaaaggatgagaaagtctctagggttgcttctggctaaggggaaaggaaacgagtgtgctccgagtgctcccacgtgttgccctgtgccctgaactgcacacagcctgtctttcttagtgaatcaccccaacagccttgtgggatagacactatctcccatctccagctgaggaaactggctcaaagagactccgtaacttgtgaagacagcgcagttagcaagcagcagcgtccgggttcagatctgaaactctttgtctttgaagaggacggcgcctgattgtgggatggcaaatgaccctttgccccctgctggactgacctcaggtgtcctgttcagagcagaggtgacagaacctttggggacaggccccagcatctccttgttggtaccctgtcctgcccaccacgtttggatgcccttggcagtggaagccctgcttggggccggccccgccttgcagtcctgtggaggagtagggagttccgggagagccggagggggaaggggctggtggaaactcccgaggcagcaggcaccggggctgggagtggggaggagggacacgggggtgggctccaggcttttccccacacttcctcagggatcgctttacataaccagggctgcttagtcaccgctttttactttttttttggaaacaattttctcagcatcacagctcccgtctccatcccttactagtcaccggtgctagggaagtcccttttctcccgttccctaggcaacccagcacatttgcctttcaaatgatccaaggcctgggcgggggtaggagttccctccccctgtacccaggcctcccacacagccactcctgcctcagttggctatgtcatgtggcccagccacccgaagacatctgggaaaaccagactccttgcctggcctctgccccaatcccagaccctcacatgtttggtctttgaatttggctcaggctcagggaccccagctcacggctggaggtgcccatgttggacttcggacatggcagcctgtcccccttcctccctggggaagagggggagccaaccaggcatcttctgcaggtgacagagctgggcctctctcagcaaggcccaggtaacccggggggctgaagccacccactctgccaccgttccccaggaacaggacctgctgacctcagttccccctctttaatctcagcagccatggtgggtgagaggatctgggattccgtcttgttctttcagtcactctgtggctttctcactattgcttgtgtcagccttgactggacagaggtgtccaagtgcttgggaaactgagacttgagacgggaatgagcatgggtaggggagaggtctctcgggctgggtgccagaaacactggacagagaccagatgggccctaatacactcccctttaaaaggccacaatgttgatcttagtgatacaaggtgccttaccagtgggcttgataactatgaattaagagcaatcatgtgagctataaaaacagagtagtgcaaactcacagagcacgtgggaacctctccctcattcattcaacacacactgtcgagcacctactctgtgctaagcatggttcaagtccttgagaaaccaccagatccagacctctgcctttgggggcatgaaaatacccgacccatccattagagagtttcagggaactgacatttttagaaggtcaatggaccacatacagagagaaaaagtcacatctgggcaccagggagtgctaattaagaaaaaaatcgcttagaatgatttcttcaagcaagagttcttaacccaggactcatgaatagtcttcgaggggtctgcaaatgaccacaaattgcaaaattgtatacctctgtatatgtttgcatgtatatttccctagggagagcccgaccactttcatctgattggcatctctgatcctccaggaggttaaggaccgttttatcagcagctggcccaggtttggaggcagcacgttttagggtatcctgagagtgacagcccacatacacatcacacctggaggttagtgtcctcagtggtaactgagtaaccaacctcccaggactcctggcgtttgcttctgccagagtcacagggaagacgactagctccctcagctttcctgcccagacccataatagggaacagcaatcccgggaggttccagctgccagcaactgcaggttccatctcagccagagggtactggccaggcacctgctccatgcagaagctgcacacctggctgggtagggctcctgaggtttgggtaggggtacatgggccaggtcttgcacttccctgggagagggttggggcaacccaggacttcttagggctctgtctcccccattccaaccttttattttgtttctatatttagatcctttctcagtcctttcttgagaataagggagtgatgcttagcaatgttctttgtgttttcattctgtgttccctctggggaaggatgggcatggctgtctaatgtggatggcagacgtctatggatgaacgcctcctgggatttctgtgtgaccagctttctcttgcctttggcttaaggctcgacttcctcactggatgcttgtgcctggaactgccctgtaggggtgacgccctccaaaggcagtggcgcagctgctcctgtgcgtacccagtggctttcttatggcggtggccaggtgctcagtgagaggcctgaggctctgggtggaaccagattccaggattcagctaggatccaactagggtcattgttttcagcgagatctcacagcagcgaccctcaagatgacagaaatgaataatgcctccctaacacatgctgtggtttttggtttttgttttgttttgttttgtttgagatggagtcttactctgttacccaacctcccatgctcaagtcatcctcctgccccagactcacaagtaactgggaccgcagacatatgccaccatgcccagctaatgttttgtatttttggtagagatggagttttgtcacgttactcaggctggtcctgagctcaagtgatctccccgccttggcttcccaaagtgctggaattgcaggagtgggccaccacgctggtctggccgacacatgctgttttcaagcacttcctgcccaccaggaggggaagagatcactggctttggagttatagcaggaggttgaaccccagagtggctctcattgaccttgggaaggtcatgcaacctctctgggcctcaatgtccacatacgtaggaggagcctggggacacctgactgcaggctgttgtggggattatggagacagcccctggcccacagcaggtgccccatctttgttggttttcttctgtccctgtcaccagcacccctgcaacctgctaccaaactgagtagatgatgatatgtaagtggagagggtgtcagggttgaaggaagctatgaaggtttcatggaagaggtggggcttgcgtagaacacacagcacactcggagtgggggatggggtcaggaatcaaaggcaagaacgagaaccagagaaggaaggaagggaagggacagagtgtggttatcttgcagttgcttttacaatttgtcattgatgccttgatttgaaggaaactgaggcaatggagtagctgagacaggcctcctagccttgaattctggccctgctgccagtgactggatgtgaccctgtagccaacctcccgacctcccgtcccgggagatgtgccaggcttgggtgctgcgagccgggagcctgatttagcgcacgccttgttaggagaagctaattaacaaacctgcatttaaataagcagccgcccgggtgtttgtaaccaccgccttattgaattgtgacaagttattagcccttgcatgttaaatgaaacagaagcatccaggaaaaacccctaaatccaatctgcataaagcagattcctgctgagaaaatgacggcagcaaaaactgattcactcgccgctttggggagaactccaggcctcccttccttcgaggttacataaccctctgtcaacagcgacatcaggagaaaggcagcgagccggaggggggaccgtcaggaacgctctgggatccatctgggcgtcaccttttgcgggtgctggggacactgcttgcgtgaaggaacagaaacgggccacgtgtgcacggtttgcgcatgtgagctgtgtccaggcctgctcctcagatcccagtgtgtctagaacactttgccgcccactctgtccccacttttcccaggcctagatgctgctcccgtggcagtgggacgacagggcagctcagcacagacccacgggggcccggcaacttctctctgcatttccgcaaatgaggggaagctaggagcaaggtcagcatgtggtgccctgacaattctattttggaggaaaaaagccgttggccctcagctgtcttcaaccaaggatactagaaccggaatcgagagctgctgtgtcctcagttaaattcctgtcctcctggggccacctatgggaatctggcccaagtgcccctctgcatttcctgccgagtgcccaggacagaaccacggccatttcgagaccccagatgtcctccaatgtgtcctctcggagacgccctatctctggaatggggtaaggctctaaaaggcaaattgaggtcggcggtctggcttgggacagatccgccatgtgctccctggccacagatcctgctcctgctccctgagggaggaggattgagacacaagcccagagagggaggcaggggtgatccagggtgtgaaggagtcagatgggctctgccacctgctagcaacatggcctgggaaagttacagatcctccctgagcctgagtcctcattcaaaacaggagcaacagcgaccactccaggtccccggagaggccacctcagtctggcatcgagaagcttgtcaatgactgtgaatagaggaggaaaagagcagaccgacaggcaaacgtggagctgcattttctgggctttgctgctcttcctcctggagacaacggggctactctaaagaatgcaggtttaaaatctcagctctgctccttactaccttctgtacccctggataggtggattcacttctttgaaccacagctttctcgaacgtcaagtagggtcagtgcttatttcgcagtgttatagtgggaataaaataagacagtgcatgtttagaaagtgcccagcatggagtagaaactgaatacatcctggctgtctttcccttcctcctatccccttcatccggctttttgtctcccagcaatagaaacactaaaccgtttgttctggaggggctctggattagtggtactaaggaaagaacactctaatacattatgtattctggggcttgtgttccttggttgggacctctggtaataggctaggtatatttctgtttttttgtttgtttgtttgtttgttttttaagagacagggtcttgctctgcttcccaggctggagtacagtggtgtgaccatagctcactgcagccttgacctcctgggttcaagcaattctctggcctcagcctcctgaatagctgggactacagttgcacgccaccatgtccggcaattttttttagtttttgaagagacgggggccttgccatgttgcccaggctggtctcgagctcctagcctcaagcaatgctcccacctcggcctcccaaagtgctgagattacaggcatgagccaccatgcctggcccctctggattttgaaaccctgtctattagtggctttaaaaaaaagttgctagggcagcagcttgggggagcaaaaaggaagccatctctttctcctcagtcctaacgtcatcaaatcttcatctgagtgatcaaaggttgttcatcagagcacacttcatacaaagctccatgccagggagtgagggattgtcaatatccagggaatcctatgcaggaaacagggctgcaccccctaccgcttttttttttttttgagacagggtcttgctctttcacccaggctgaagtgcagtggtatcatcacggctcactgcagcatcaacctccaaggcccaagtgatcctcccacttcagcctcctgagtaggtgggaccacaggtgtgtatcaccattcctggcttattaaaaaattttttttgtagagacagggtctctctgtgttgcccaggctggtctggaactcctgggctcaagcaatcttcctgcctcggcttcccaagagtgctgggattacaggcgtaagccactgtgcccagctaagggctggtcccttctaatggggattctgatgtttgggcaggagaggagtctgtaggggtgggttcctctaggaacactatcttggagggtggtaggatttgcacaggtgaggagaggggtcgtatttttctaaaagaatgaaatataatgagtggagttgaagagttggggtcttcctttagatacaccagccaggttagcataaagagtttgttctggagaagaggtcagagggcaagaattacactgagtcttaaaatctcaaactgagctagccttgagaacgttccttccataaggtctggaaattggcagaggcgggggagggggataccaacattttgatgggcgagttttgtcccatggcacccataccctctccttgtagtcagaaatgacttagtacagattctcagttggctggtgatggcaaagagaaaagaggagttatcctctaaggctaatacttgctcctctttgccactgcttacgcagtcaacaaacacttgttgggggtaaggccaattcaacatggcctctactctcaagtacttgagtctggttggggattcagagaaataaaccaccactactactcctacggctacgactatgagtaattgtgcgacggtgctaagttccctgatggggaatgtgggagtttcctaggtgagagggggctcagttctgccccaaagaagctgggtcacaggagggccctgtgaagggtgaaatgtttcagctcagccttaaaagaagatctgggcagatgaaggggtcgaggtgagggctggggaagggaagggtttacgtttcgttgataacgcgttgtggatgggcctacagagcgtgcagggggaggcgtgcaacgggcccacaggcttggagctctggcagaggaaaagtgggtgtggctggaggcttcagggatgcacgggctcatcctgggaacatatgaagggaagggggatgctgggagaaccaggagcagcaggcaggaagccaggtagagggagggaacctgggaaggatgttgagaaggactggccaaaagggcaggtggcagtgggatccaggtagctgaaagatgaaggggtttcaaaatgggagagggcttctaactatcaccgagaaacccctgggacaagaactgcatgtttccatcagaaagtggctgccagggggacaaagaaggagcagggaaagacgaatgagaagagaagagggagaaatggcaagtgcagcctgctcttaggcggaagccgtgtggctatgagggcccatgagaggtgacgcagggagggaaggccctagaagccctgagttatggcagtggggaccgaggttggcaggctggggcacaagcagggtcctggcggtgttcagagtctcacccatactgcgaggagtacccaggacaaatacctacacgtgtcccatcctgggcctcggtttcctcatctgtaaactggagaggctggaccacagccttgctaggtctcttttcaactctaaaatatgactgtcctgatggttattcatatgctatgaattctaaattgatacaaggattctacattgatagaaattctaaattctggatggcattttagttaacatgtaccaaaaagcctttgaatatgcaaaacctttgacctctgagaatttattctcagaaagtcaccacagaggtgaatgaagagttgtgtattcacaactttgttcattgtagcgttggtgataatataaaaaaaaagcagatacaacctaatgtccaatagtagaggattggctgagtaaattatagtacatccatatggtaaactacttctgcactaaaaatcatggtttagaagattatgtgttgacatgggaaaatgttaatgatatattgctaagtaagaaagcaggctacattgcagaatgtacagtatgatacattcattttcaaaatttttgattaggacacagaccaaatctttaattaatgtcattttttttcttttcttggcaagcaagaagagtattatctagaatattgtaactaaaaaatgaaacagaaagacagttatacactaagtgtgttcacaggaatttttaagtcattaggatggagagtaggctgtcagtgagtcaaggaagcggagaaattctgaaactatagaattttagaagcggaaatcacccctagagatcgtcgggcccaacctcgctttttttgagacgaagaaattcaagctcctagggaagtctagacagtgactagtcagagatgggggtgggtgccagcctgaaactagggtcgtccaaccttcagtttatgctggtacgtttgccacccctcagagagaccccgctgatacttaagaggtgactctattcctaagccccctgaggtggggctgtgggctcctcccttcctcccagcctctgaagacctatgcagctcaaagctgctctaggccacaggaaagtacctgggcccactgcagagctctggggcaacgtctgcagcagcatgggggtcctttgcgagctgatccagtgccccaaagggaaatcagtctctgggtggcccagagctaggcttcactgtcttcttaagaaatggatgctcaccttgtcaaacacttttgtgacagacatgattctccttcctccagaaaaaattcctctccgcctcccactctgctaaccctccaatgcaaagacagcacttcatttttaccgagttcaacatcttcggggacaggtgcaacgggcagatgccctgtagtccatgttgatttggtaattctgtagcactctttctgatgcaagagagagggtgttgggcctggccttccaggatggggagtccaatgcctcttctctggccccatggcccgctgacccccatggccgctccgtcatccctctcctgggccactgaatagcctgctagcagatctccctgctcctccccatcaaccctctctaagtctcagcaccagagctgtggtctttatttcatatgcctgttaacttccttttgtcatccttcaaccattgcatgggctgtttgatgattctttccttccttccttccttcattcactcatttatttattcatcacatgtgcaggcagagagctaggtgcagttttgccctcaaggaggtcacagtccagagtgggggcagagacccttagaaccaattatcctcaggccatgtggaagcacctcctgagggggtagatacagggattcaagggatgacgagggccctgatggctgaggtagaccaggaagcctgcttacatcggtgggatttgaaccgtgccttggcataccggtgggggaagaggggcacggaagaggaagacatcccagacaaggcccctaagcatggcaacagcttagcaggggcagaaaacaccagggatatctcggccttgctggggctggttgggatgatgggatcacgtggggtggagggggaaataaaagctgggctggggcctgaccttgaagggtcttgtggctacctttgaaggctcagtgttctagttccgaatttgtacattttacaggcttctggagaaatgaagagttggctcctttctcagcaaacagacggggtttaattgctgttactgtcagtgtagttgcaaatatcatataaaaagggctttttggctaattgtttttagaagaaaaattcaagaactatgtatagatattatgcatccagggtactttaaagatcaaactgtttatattacccttaaatacagtctttagcaggcggcactgggctctgtgagtaactgggacacacgatgaccccccagggcttaagatgctggaacaatatgacagcagttactttatttctgaggggaggtgggggtggtcagccactaccctttgataggccagaagaccagatgaatagagatctaagctgggtaatgttgctgcaccattgccctaaagggctgcctcttcacgcaggcaaccaacctccccaccccagacacacacagaaagaactggattccacgggcttctgggggtgcaaggggaaggggctgccatatctagtgggctcctggagaagctcgggctgaggagcagagaagggagcagcctcagagcttctcatcttgtctccggtcctgcagtcttctttcctcacccgcaaatggtagagagaggagttttgagccgtacaaataaagcaaattcatatctgctcattgccatcctgtcctcatgctcaaccctctctcaaattttaatttggtagcttttagaaaggcaaatttatttgtgacaccatccaaattctattttattggaatcctcttctccaagggtgcgatcgactaccgagaaagctgtgggcttctccttttgatattttcccaagctctctgtgcgttcgcgcgtgcttgtgtgtgcgcgcacacgcatgcacattcattttagggtcctctacatattttacgtacaaacacataatgcatattcacaaggcagccgcggaagtgtagatatattcatcacatatatgtgtaactcagtgcagactcctagaagccaatatttaagttatcatatttaatttattcaacaaacatttaataagcacttactcttcattaaacactgtcctaggccctgagtgtacagcaataaacaagtcagacaaagcctgtgcactagggggctaacatttaaaagcactggattcttttttttttttagacagggtctcaatctgtctcccaggctggactgcagtggtgtgatcatggctcactgcagccttgaactcctagactcaagtgatcctcctgcctcagcctctagagtagctgggactacaggcacacaccaccacgcctggctaagaacttttttttttttgtagagacagggtctcactatgttgcccaggctggtctggaattcctgagctcaagggatccacctgccccagcctcccaaagtgctgggattacagggataagccacagcacccaacttggatttttagtacaaggtttccaaacacatgtgagggaatctgtgtggacagtcacagagggagctggctaggtcaatagatcagcactcccttaatccaggagagacagccatttgggtgcaatattccaaacaaaggtggcattagggttccctgctgcaggtgacatctcagggctgcagggccttaccccatagaacacttcccggtgcttctaaggtggagatgaaagagctggagacaagggttggtgggccccctgctttgtggccttagatctttaccctacagtggtatcggtccgtgtccttggtcatatcctttctatgattccaggtgattttcaatgccttcctcttccatagagcctttcctgctcatcccagtcataaccaaagatgccctcttgtgagctcatcctaccttctgtgtgattcacccagtgcttcacacacgctgccttattttgataggtagcaaatttcgttctaagtatacgttgctctttcaaagaacactcgtggaatttctactgatgtggaaaggaaggaccctggccctgcccatgggagctgttggcccagtagggagaccagcaagctaatctgtaattgcaagcagagagccaggtatatgtcagaggtgtgtacagggtgccatggggcattgcggtgggtggtagggagcaggtggctctcagcagaagtgaagctcaaatgctcccgaaagaaaccacagactccttggagtgggacccttacctaattctttttatattccccaccatgattgtaataatcaaattatcttgcccagcaatttttaagtacaattttaaaattggattacaaaattatatatattatagaaaatttggaaaaacagctaagcccaaagaatataaaaatcactcataatcgtactacccagacttaactattatcaacattttggtacatacactttccagtttcttttctccatgcaatgaaaatgagttgtgctctaattacttttcatttgctttttcttttcatgtaaaaaatggcacaattattttactcatatccttatatattcaccttcaaccattttaatggttgcataatattcttttttcttttgagacagagtttcactccgtcacctaggctggagtgcagtggcatgatcttggctcactgcaacctctgcctcctgggttcaagtgattctcctgcctcagcctcccatgtagctgggattacaggcatgcaccaccacgcccagctcatttttttttttttttttttgtatttttagtagaggtggggtttcaccatgttggccaggctggtctcgaactcctgacctcaagtgttctgcccacctcagcctcccaaagtgctgagattatagacgtgagccatcacacctggttggttgcataatagtttatgtagtgtaatttatttgccaactgtgtcttgttggacaaattggtcatttctaatattccattattataagtaacacagggatgagtagcattgtggatgaatttttgctcacatccataataatttccttaataattatctaatacataacacgccctgccttattttgataggtatcattctttatataaatttagtgtacatttctagaaggagattgttgtgctgaaagctatatacattttaaaggcatttgacattcaatacacacagccaaataatgctgcaaaagggtttttaacaatttacactctcaccagcactatatgagaagatactggatgacattttatttatttatttttttaaaaaccaaaacaaaagtcaaacattgccaatttaatggccacagttggggaggggtagggagaggtggtgatggtttcttgtttttgtttgcatttccaactgccagggtcgattttcatttttcatatctttatattgtatttcttttgaaaaaatttcctattcatgtcctttgctcatttttctacttagtatttttctattggtcaaaaataaataacagcgaacatttattgagtgcctactgtatactaggtattgtcctatgcactttatagactgccttatttcttacttctttcaacaaccctgtgagaggtacgcacaatttttttttttttgagacagtgtcttgctctgctgcccaagttggaatgcagtagctcaatctctgctcactgcaacctctgcctcccaggttcaagcaatgcctcagcttccccagtagctgggactataggcggaggcccctatgccagctaatttttgtatttttagtagagacaaggctttgccatgttggctaccctggtctcgaattcctggcctcaagtaatatgcccgcctcagcctcccaaagtgctgggatgacaagcgtgagccaccacacctagctgaccatacaattattatcttactgatttgtaagtgcgttacgtgttaaagacaataatcctcaccgtatattgcacatttttttcaatgtgctgcttgcttcttaattttaccctcagaagtttttatttacagaagtttgaaggttttatgagctcagattggtcaattatttcacttctacttttgcaggtacatgtgaagaggtattttcctatattgagatcagagaaatattaaagcctgttctcttctgattctattatggtttaactttaaacatttaaatagctaatccatttacttactttgattatggtctgataaagagtgtcaacatttatttatttatttcccaaatggatagtcaatcatccctaaaccatttatggaataatcagtcctttcttttcagtttttcatggcttccttattatactctcagtatatatcttaatctgtttcagatcttgctattcagtgatatgtctgtgtattctctcaccagtgcctacttttaaattattttatatatatgtgtgtatatatatgtgtgtgtgtatatatatatatatatatattttttttttttttttttttttttttttttgagatggagtctcgctctgtcatccagtctggagtgcagtggcgtgatcttggctcactgcaacctccacctcctgggttcaagcaattctcctgcctcagcctcccaagtagctgggattacaggcatgtgccaccactccgggctaattttttatatttttagtagagacggggtttcaccgtgttagccaggatggtctcgatctcctgaccttgtgatccgcctgccttggcctcccaaagtgctgggattacaggcatgaaccactgctcccggcctaattattatatttttataacaagaagtgcaagtgttctattctacccttcccttattagtcttgtttcacaacattttctcaaatattctttatgagttttccccatccagggtgcactttagaatcaccttaaggtccaataaagatcattttgtcaagttacaataaaaattcctttttggtcaataaggagcacatgtgaaaattaatttggggaatgttgatttgtgaacttatgatgtatctctccaaatattcaagtcttttacattctacatgaaagatttttttttccatttaaatgcttcacatttattgggtaatattttaacgatattttatgccacttgttagtataaaaataacgaatttaccttattttctgaatcaaaaaatcaacacacatggataagatttttttgtgtgtgcttctaagtgtcaaagacattttaggaggtgtgtttgtatgccgaaatgtgagaatttctgagcatttctgtggttaagaggttgataaggtgggaatgtttacaattggaatggtgctgaacaaatcccaaaggtatgctctccaagcccaaagtggccagcacagtgtcctccaatatggcggacactcgatacttatgggtggcctcacattgctgtgttggcggacgcttagagtctaatgttggcaaatccaaaataagggattaaaagcagtgactcactctggtacaaatatcagactcttgaacctatagatttgcccagttttctcagcaattctcaagtgtgcgtgtgtgtgtgtgtgtgtgtgtgtgtgtgtgtttgcctgtgtacgtgtaattcatttccccactgggttttgagttccttgaggtcaggaatttaatcctacccttctagagccccatacagtgcccagcagagtgctgaactcagaaggtgtgctcagtaaatcatcgttaagttgagcggaattgtctcttactactatcattgtcaacagtgcaatcagtaatcagcagctgggaagccttcctccgggcagccctctgtgctggctctcagggaaagatatgccaggctcaaaagccctattctctgcctgcatgccgcctaagaagaagcacttgctgcataccaaggaagagctatatagacaatgtcagcacctaagatggttagagccaaaaggggcctagattatcctaagtgaaatgactcaaacagaaagcaaaaaaccacatgttctcacttacaagtgagagctaaacagtggctccgcatggacatacagagaagaataatggacactgtagactctaataggtgggagggagggaggcagaagagggatgaaatactgcctattggatacaatgtacactatttgggtgatgggtacactgaaagcacagacttcacccttacacaatagatccaggcaacataactgcacttgtacccctaaatctataaaaataaaaattaaaaaaaaaaaaacaaattggctgggcacggtggttcatgcctataatcccagcactttgggaggccaaggcaggtggatcacctgaggtagggagtttgagaccagcctgaccaacatggagaaacccggtctctactaaaaatgaaaatcagccgggcatggtggcacatgcctgtaatcccagctacttggaaggctgaggcagaagaatcgcttgacccaggaggcggaggttgcggtgagctgagattgcgccattgtactccagcctgggcaacaagagtgaaactctgtctcaaaaaaaaaaaaaaaaaaagacagaaagaaagaaaaacaaacccaaatcggaatatctgagtgcaaaaacccaaaaaacaaacaaaagccaccaccaagaaaaggggccgaggtgatcatgcagcccagctcttcactttacctgggaggacaccgaggcccaaaggagatgaacagcttgactccaagtcagtgaactcattggcagaagagatcagggcaggtctaaaggtgatgtggtggcctttaagcagggttgggaaattaggaataacttcgttttgggagagaagaagggaaaggatattcggggaaggggatagtaagtgaagaggtttgaaggtaggagtaagtaagttgctgatggtgagcagagcagcagtgggtggtcagttggtggaggaggctgctggtagaccccgtagggtccatgtgatctgaaggaaccgggggaagagagtcttgctgctatccatcgcaggggcaatgatgcagtgtatcacgactgttcactgactttgagtcaaattgttcatctccctggtcctcagtgtcctgagatgagcgtatgaaaactcaggtggtcagagtgagtgccctgaccaggatgatggccagaaagggctggtgccaacatcaatagcaatgctctgggtacagggctggctgtgcacgggtgcaggagggaggcgaggagagtcttccccaggggctgggaaactagggcaagtgctctgggacaactaggaaacaaggcagcgtggaatcaggtgctaaattgtgtggcacagactgagtgctaagagggaggccagagaaggagagagggtttggagtcatcaggaaggcatcccgaatgagggggattttgagcagaactttcaaaaaagaacagcactcagataggagggggtcctaggtgtactcatcatgctttttattttctgggttttatgatgctttcacatcctggagccttgctaattctggagagaatgctcttcccagggctagcaaattcctagagagagatagtaaacaacttgccggtgaacacaccttccatacacaaactaacgaatccagagcccattcccccaactacctcctttatctactctcacacaccaaaccaatattccccctgcgctaaatcaccccagggccagctaccagacagctagggatcacccctgtggcacagagcctgctgacattatgcaaacaagccagtcctaagttgttcaaacttgctcacctgcatgcccattccttcctgcagaacccacaattaaggctctgggccatgctttcctcttcctgatgaccctggtgtttcctcacagagccctttgtggcatggcctggcatccctcctctcgggaaccgtgagtaataaactttcttcaatggcattgatctccctgtgtcatcactcggtcatgtccataaatttttttttcttttcttttttcttttttttttttttttttttttttttgaggtggagtcttaactctgtcacccaggctggagtgcagtggcgtgatctcagctcactgcaacctctgcctcccaggttcaagtgattctcctgcctcagccttccatgtagctgagattacagttgcccgacaccatgcccggctaatttgtttatttttagtatagacagggtttcacaatgttggtcaggctggtctcgaactcctgacctcaagtgatctgcccatctcagcatcccaaagccctgggattacaggagttagccaccgtgcctggccatatctatgaattaagacctggatacaataaaaatactgggaaagggagcagcctcctgttttggagcagctggtgcagaggaatctgcatggactttgcagggagacacagtgaagggcagatccctctcctcctttcctttgacctccccctcctgccgtcctcccttccacatctctcactttctgtcattgtgcggtagcttcctgctctgttttcctttgagtggcccagccaaaagtccagtgttgtttactgttgcttggagtttggggcttaaaccagttcatgaactctccccatgtgactagccctttccagccttattctcaattatgttataatgcttttcctgctattaaggaattttaggcacctctaaagccaatggggaagataattcgggagctggggatgagtggattgggagaacttttctgaaacttctaaaattgcagtcattggcaggggccaggttaaggctcacaaaatgccaaattttgctttatttatttatgtatttattttattatactttaagttctaggatacatgtgcacaacgtgcaggtttgttacataggtatacatgtgccatgttggtgtgctgcacccattaactcgtcatttacattaggtatatctcctaatgctatccctcccccgtcccccaatcccacgacaggccctggtgtgtgacgttccccaccctgtgtccaagtgttctcattgttcaattcccacctatgagtgagaacacgcggtgtaaggatctagaagtagaaataccatttgacccagccatcccattactgggtatatactgaaaggattataaatcatgctgctataaagacacatgcacatgtatgtttattgtggcactattcacaacagcaaagacttggaaccaacccaaatgtccatcaatgatagactggattaagaaaatgtggcacatatacaccatggaatattatgcagccataaaaaaggatgagttaatatcctttgtagggacatggatgaagctggaaaccatcattctgagcaaactatcacaaggtcaaattttgcttttaaaagagaggggtgagagctgagcagcccagggtaaactttcgctttcttctttattgtagtctgacctaaacaatgcttgctgtgtctcggtatacctggagtcttggttaattacccagggactgccctgggcctgctaaccataggttggatggggcaggagacagaaagagaaatagtattaagagttgggacaccttgattccggtccacactctgcactgataagcttctatgaccctggacctcagtttcttcatccataaaatagaagggtagaaccagatggattcaagggcttttctagctctacggtctacaaatctaggatgcagggaagcatccctcatctgtgccatcagccctgtccccgcttcaggcacgtgttgtgactctttactcttcatggcaaaggaaaataaatgtcccctcattgctgtgcccaccctggcatagtccctgggcaggctgtctctgtcttctctccctgggcaaaccgcacatcaggctgcaggaactccattgcaaagcctcaggacgattcctcagagcctccgggataaaagtattggtttattccctgggattacagcaggactggggcaggtggcatgatacccagagctgagtgtcctgcccagggaggggctgcagagggcagcagacatgcttcttggagccggtgcatacaactcccagatactgtgggagaatgccagtttcctttcttacataacctttcataacctaggaacagtccagattttggctgcctttgcctcaagagatgaatatatgccccccttttcttggacactttcctccttgcctaccccaatcctacccaccttcacggccccacccaactctgccactccacaccctccctgcccatccagcctccccaagggcaggctcttaatcctaaccttcttctacactgcccccaggacctagcagagcacagaactcatggagagtagaaatctgttgaccaatgagatcatgctggggaacgattaaccctgtggttaattaacaaactttgtgcagtcacagctgtgcctgagaagagtgagcccctagtcacagcggggagggctggggagagacttcaggttgacaggcatgatctcacttgagcctcacatcagccctatggggtgcatggtgtcttttatagactggggctcacagaggcaggtgactggttcagagtcacagagcagtcgtatggacccaggtccacctggtgtcagtatccctgtacctaccactgcaccacactgcctcctggagcaaagaggtccctgcttcctggctgccaggccctcagggaggtacctgttcctggtgggaagtagacaggaagatgcatgcagaaacagaggggaaagtagttggggaaagggtgaggggtagcgtcagggaccctggcctctactgccttcaggctggttcccaaagagatgaaggattttttggggagaaatgtgtatttcttagggaaaaggcagaacctgagcttaccccttgggaaatggttttgcaaaagcacacgtagatgggcatctacacacatgcaatgcacacatgcatgcacacacatgcacacacatatgcctccacacccagagccacagcagcccggctcccagccaccgtggccctcccccaccaaactccgctctccctcctaccctatatgtgcaatcttgtgaaaactccaccactcttaaggttaataaggctcatttgcttaagatagcacctgtttctatggtgactcctgccacccagaatctgttcatcaactgagacaagaaaacagtgacttccatcctctttgaaaggaaaaagccaattctcagtcaagggcttgatgggccagcagcccagggagctctgggcatctgtccttccaccctgctgaagtcccttcctgctgcccctccccccacctcccagcatctccagattcttcccaaacgctccggactgtgggttcctcctcctcgtctctctgcgaagcaacagaacccgctgcaggaggagggtgttgctctctcccgactctgggccactggctaatctgcccctcagtctctgatctctccacaccagctccaccgtggtctttctgggtggaggttggcaggggagccccaagaagcccctgggccttcccacccatccccactacccccgtgccaagcctgtctctcacccggcactcctggattcctgtagctgcccccaacacgtctcctgccatggggcttgtccttctccagtttctgcccaaagctgctagctgactccttctcctaaaatgagagctgttcgggcctcgcccctgctcaagggcccactctggtcttctgtggtctgtagctgagctttgcaacactgacctgacactggttccaaccacaggtcacaaatcactagagaagtaggttcccaggcaggtgttgctaataataaagcttcagtgagtgacttaccttcaaaagtaaatgagagtggcttccacattctccctctaataacgccaatctcatcggtgttccaagacgctttgttactgggagagcaagcgcgcagggaatcgcgaggaacttggagcttgttttatgtgtttggagacccaggggagtgtgttgtgcgtacgaacattttggcagaaagaaaagtcgagggctgcttagtggaggatcaagtatggaattataaactatcagagcctggtgttatcatcaaaatctacctccctgtttctgtttgtaggtggggtaatagagacccacagggcggcagagactagagcagcgtcaccagctagcaagcggcccagcatacatgtcttccccatcctggccccaagctctttctggaatatcactcagtctcctgcttagcagagcagacccctcatggcctccaaggccctgtaccgtgagacctccctgcctctcctcactctcctcccaggatggtgctctgttctaagtgggctggggttaagcttgtttataaagtcgcagcacctgagggccaatctaatccgacctcttgcccaatctctggcagacgacttctccttgaatatctccagacacaacacactcggcccctgaagacacagcagccctttggctgcaaatatcacgttcgtatcccacagccaggccacctgtcttggcctctcctgggagttccaggctcatttcaatctctcacttaaaatctaaaaggcacctctggctgggcacggtggctcacacctgtaatcccagcactttgggaggctgaggtgagcagacctgagatcaggagttcgagatcagcttggccaacatggtgaagccccatctctactaaaaatgcaagattagccaagtgtggtgctgcgggcttataatcccagctactcaggaagctgaggccggagaatggcttgaacccgggaggcaggggttgcagtgagctgagatggcaacactgcactctagactgggcaacagagcaagactccaactaaaaaataataataaaaaaataaaataaaataaaaggcatctctgagtgaacatgtctaagacagagcttgagactcccccttgtctcctcacctgccaggcctccagtatcctcatctcagtaaagggcaccgttgttcactcaggccccagagccaggggccatcctcgcaccatccttcaccctccacgtctaattcattggcacgtcctgttggctctcaacctcacaacgggttctgaggctgctctctccatggccacggctcttgccttggtgtaagtcaccgtcattcctctcaaaggagcaaaatggtctcttacagctgtcttgggccactccacatagcagctagatagatcttttaaaagtgcaaggcaggggctgggtgcggtggctcacatctgcagtcccagcactttttgggaggccgaggtgggaggattgcttgaggccagtggttcaagagcaacctgggcaacatagtggggccctatatctataaaaaataaaagtaaatagctaggcctggtggtatgcacctgtagtcctagctacttaggaggctgaggcaggaggatgacttgggcccaggagttggaggctgcagtgagctatgactgcaccactgcactccaccctgggcaacagaatgagaccctgtctcctgaaaacaacaaaaatgcaaggcagtttttaccccgtgttggaagtcctcccacagtctgtgtgccagactccttgcccaggcctggataaagaccggacattggcggttctcaaccccagatgcacattttttctttctttctttcttttttattatgatgaggtcacttaacacgagatccaccctctttacagtttttaagtgtacagtatggtactactaagtataggcaccgtgttgtacagcagatctccaggacttaatcatcttacattactgaaactttacacccgttgaacagcaacgccccatttcctcctcccttcgcccagatgcatattcacatcccctgagaagccttaaaaataaggatgcctatgctccacccccagagattctgacttagctggtctgggtgcagcttccttggtgattctaacaaacggttagaacctccatccttcctggtctcccttgctgcctcatgacctcatctcttccatgctgccccgtgaccaccctgctgcagccacaccagtccccatctgattctggaacacgccagctccttcctgctgttccctcggcccggctgccctgtcctcgcagggttgcctggtgaattcccactctgctcacaggtttccttctctggggaactttctccccgctctccttctcatctccacggttctcaggactcaactccatcctaacactccccactctgtaatggagtcattgatttttctcctctgctcccctcaccagagagggagctccttaacagtaaggatgtgattgcatacaggtcagcacggaggacttttagggcaggtcagctactctgcatggtactgtcatggtggatacacgtcgtgatgcatttgtccaaacctatacaacatgcaacatcaagagtgaaccctaatgtaaactatggactttgggtgataaagatgtaggttcacggattgttagcaatcgcgtgttttgttttgttttgttttgagaccgagttttgctcttgttgcccaggctggagtgcgatggcacgatcttggctcaccacaacctccgtctcccgggttcaagcgattctcctgcctcagcctcccaagtagctgggattacaggcatgcgccaccatgcccatgtaattttgtatttttaatagagacagagtttctccatgttggtcaggctgtttttaaactcttaacctcaggtgatcctcccacctcggcctcccaaagtgctgggactacaggcatgagccaccatgcccggccatgattgccagcattaagttcgtcaattataacaaacataccactctggtgccagatgttgatagtggaggaggcttggagcaggcagcaggtatatggaaatactgtgtactctgctctcttttgctatgaatgtaaaatgctttaaaaaataaagtctatttttttttaaaaaaaagggatttgattgcataaactttttgatctgcagtgcctgaatgaaacctattgcctaaatgggctaagcacatgctgaatgaatgaatgaatgaatgaatgaatgaggggtctgatagatgcacagaaaggagaggtataactcttcaatggtctgaaacctttacttttattgatgtggcctaagatgatattaactgtctcaactcccacattgtggcttgacattctattattagcttaaaatttagattaaaattagcttcaaaactagctaaaactcctcttgatcttttcccctcatgaacctctgacatgccagatcttcccccttctgtatgtgtgcaactgatttagaacctaaatatagaactttagattaatacctattaaatttaaatttctcaatgcaggcacatccttttgatttgccaaaattaactgttttgtgttacccatcgtattagctattccttgaaactttgacctaaaatttggtgagcatgctatccataaagatactgaacaaggtagccgggtgtggtggctcacacctgtgatcccagcactttgggaggctgaggcgggcagaacatctgaggtcaggagttcgagatcagcctggccaacaaggtgaaaccgtctctataaaaaatacaaaaattagccaggtgtggtggcatgtgcatgtaatcccagctactcaggaggctgaggcaggagaattgcttgaagccagaaggcggaggttgcaatgagccgagatcatgccactgcactccagcctgggtgacagagcaagactgtgtctcaaaaaaaaaaaaaaaaaaagatataaacaaggtgaggcactcaggccagaatcttgcagcatgtcaccagggaccaactagaagattggtactaattcatttgtcacctcttcaggaatgatttgttaacaagtcacaaactcccacctaccacaacagtcattgaagcaacatctctcccccttggccaaaaggttaccacaattgacttgttctaatgcctggctcagccaagctgtactgtgcttactgacagcatcttcctggtccaaggggtcagtgcatttcccaacaaagaaatctgagtggtcaggcatgatttgtttttggtgaatctatgctgactcctaatgtgcactgttttcttttctatattgtctcagaccatctgcttattaaactgtttttgaattccgatgttttgatgaggactgatattacacttaccagcctaaatttgggaatccacattttccttccctatttctggaaatgatttcgtgattgcaaatctaagctctttctggaccttggaggtgtaattcatttagcaatctcaactcatttaaagcaatggcatgtttgtggattgcagaagggttttttgtaagaggggacagagcaggtaacagtccgcagaggcctagaaggtttgagcagatctgagacaatagaagcagatcagcaggagaacacgagggttgtggggcaggcaggtttcagagcctcaaaggtcttgagtaacacactggggagaggggtctctgtctgagatactggggaatcactgcagttcttcaagtaggaaagcaatatgatcctatttagattttagaaaaatcatcccatgaaggaaagattcacatttttgtagacggtgagattataggaggggaaactcttagtagatgtttgcaataacaatctagagacatctataacaatcaagggcctcaattaactcacccatcttgtcttttaatttatgtttatgattctttttttctaccccattcaaatgttgagcttttaattacgctgttcctttcctgaaatgcaattgcttgtatcctctgacttttccaggcctgctcataatttcaactcttatctacattgtgaagtcatcacagagtgatgccaccccatccatatatctgtccacctaccaaacctccacctccatccatttatccatccatccatctacccagtctctatccatccatccatccacccacccacctacccaacctctatccatccatccatccatccatccacccacccaacctctgtccacctatccattcatccacctactaaacctctatccattcattcatccatccgtctatccactcacctaaccaatgtctatccattcatccatccacctacctacctaatctttatccatccatccatccatccattcatccattcatgcatccatccacctatccaacctctatccatccattcattcagctatccacccacctacccaacttccacccatccattcatcactccatccatccatctatccatgcatctgtccatccacctatccaacttccatccatccacccacccatctacccaacctctagccatccatccatccatccatccctccatctatctattcatccatccatccaccaaccacccacctattcaacctccatctatccctctatccattcacccactcacctctattcacccattcacccatctcttcctccattctttattcattcattcatttcttcatgccttcattaattcaacatttaccgagggcacttaatgttctgggctaagtgctaagaatataagaagacacatttctgctctccaggaactcatggtctaagagggaaaagagactcataaataataatgagggcactaattgaggtttaactgagtgtggcagcagcacagcgggactgactaactcagtctgggggtggtagagcaagcctttcggcagaggtgacatctgagctgggccttgaagtaggaggagttgcctcacggagatgaggagggtgctcccaattcccacagcaatttgagtctaaaaagcccacttggagttgactaaaccattgagtattgctctctcattatctcctatatgttggccttgtctttccaactgggcagcagaaaaaccacattttaaatccctaacatgtactcaccagatttgatttgatttgatttttttatttattgtattttattagtagccacagtgctgagagcggtgtgggtcagacaatcaatcctaatggctacctgtcaagtctgatgcccactggtggcttctctccttcaaggtctttaaagcgataaccacacaggcagctcattctcctggccaggccctgccctacttcttgggagtgacatacattttgtaccatcgaaggctcgactttctaagcttcctatggaggattgagggtggtaaaggatggaaggaggaaagagccagcatatacatagcaactactaagcaccaggtgctacgtgctgggtgtttcacaaatgttatctcgttaaatcctcaacattcctgcgaggtcgactttagtttcctcttatacagacgaggaaacagattcagggaggtaaacaatttgctcatagtaagtagagaatcaatctcctgcgtccacactgcacttggagccccggtccagggctgtgcatggctgaggcaggtgtggctagaggtagaggtgccaccaatctcaaaccaaactgcttacaccagcatcaccacctctgagcccccacacatggccacaatataagctgtcacctgggctgggcctaggtggtgggtgtggaacccgtttagactctggagtagcaatatggcctcatgagtaggcacgtaggttttgggctccaatctcaggccgccacttgctagctgtgacatcttgggcaagttgcttacccactctgggcctcaatttctcatctccattacctctgtcttttatgaggactgcatgaggtgcttatgtaaaacacagcacttggcatcacttgccaagtgcatcaatgatgtttttcttattttccttcttcctctccctctctccttttcttcctcctttttattctctcttctttagttattgttgttgttaatatgttctatggatatgagctacaggaagagtatctgtggccaggagagacaatatgccaggtggagacactgtgggagatgccaaggggcacaccttacaggtcacctgcaccagccttctacccagtgggaaaatttcctgggtcacccatggataattactgtcattaataaaagccagctccttggtgggatatatgctcagttcttgtgcagttcaaattcttagaaagttcttcctcataagggaccaaaatgtgcttccctggaaaacttcccccactggtcctgattccgcctggtggagtccagcaagatctcttctgttttccaacgagatttccttaactctttaaaggccattccttctcgtgtgtccgtagttgttccaataggctagcctttcctacttccttccgctgctgctgacctgatgtggtttctacagaacctgaccattcaggttgctttcctatgctggtcattatccctcttaaattactgcggccagaacagaagacattattccagtgtggcataaacaatgcaaacagatagaactttctaagaccgaggaaggatcaccatgcttcaaagatgctgcccacccttctccctctcccctcccccaccgccaaccccctcgcttcctaagagcatctgctcaggggtgggtgtctgaggctcaaaggacagtgaaaagcccgggttcctcatgtcagggcaaggatggatttgggctgttggtcttatacattttctggctttgcccatgaaggagtgccaggagccaccagctgccccctcagagctgagttcagagttgggtgagcgagactgtgctgttccctttggggtgtctcatggaggggtgtgtgtgtgtgtgtgtgtgtgtgtgtgtgtgtgtgtgtgtgtgagagagagagagagaaagagaaagaaagagtgagttttctgcctgatccaggaattctcctggatggcagaattggtttccataacgactttctgatataaacatatttgataaaaataagttaacagtggagctgtggtggagcacagaatctcagagtgctgagagagagagagagagagagagagagagagagagagaaacctcctagaagaacagcattttctttctctttcaccccacctagtcagcctctctatacacgcttgccataaaccaacgaaaaagctttgtttacaatattcctgtatatactggctcccttcctgcatgtataccttattcatatccgcactctctctttctttctctctctctctctttctccttagttacctgaagcactacagtatgtatgggataatatgataaactcatttccaattcactgcattatcccttgaatattttaatgactcattgaatgaagtgaaaaaaagctatttcaaatgaacaattatgctgcattagtctaagggctgattatatttaaacactgctcacatggataacaggacacagcgacctcagcatacgagagctaatttggctcttatctccaaataatttcacatcgcaaattaccatgaaaacctaaagggctttaaaaacattcatcaaaagataatattccgctttgtagcaacattttatttaaattattttgaatgggagcaaaagcatctctagggcgggacaatgacagcagagtgggactgtgagtgataaggagatggcaggggcactggcttctgttaaaaatagaggtgggaaatgttggagaggaaggggctgcagccccaaatgtgggcagtgcaccataggcctggctgtcacttgcagcccagcatcacacctgggctgtggcctgggacggctccagggagtctgctctggttcaggaggtcacaggggatccctagaggtggaatgatgggactgaccaaaggcttccaggctccaacacgctttggtttcctcaaaagccagctggggtcacgttaggtcctccaggctgggcctggactcatctagtttcaaagggcaaaaggatgagctgtgttgggcactgtctagaattttcactttgcaagacttgagtccaattgtctaagggagtttgctaaatcataagtagctgctatggtcagatgtcaaagttgggggctgtaggggagataattacatttaccaaagtcctactattctgtgtcagaagacttaatctcattgaacgctgggaaatagatattatcatgcccattttaatgatgaagaaactgagcctcagaggcttctcctctttgcatatgtaatttcctttttccttgtctccactctgaagagtgaggatttctgtcagtttcacagaggcaaagttgcagtctcagagaggtcaaacaactcgctcagcagtggaaccgatcactcaagcacaggtgtcctggcatgtgctacccacataactagaaagcagggagccataattcttgccctgtttattggatttcccattatcttattcacctaatgtacttagaggtccttcccacctggaagcggcagagcctggaacctcctctagttcatctgacccaaagtccgagctctttccctttcccttcagggtggccacatacaagtctggttaataatcacctggtttatggccacctctgtgctgtctccatcagcaagcactctttatggcccatagagctgaacctacatgttaggaagcctaagtcacgccttttagctgcttattagttaaaatggatcctcacagtacaggtcaaagcatgcatgggaaactgcacaaatatcagtggcaaaactgcaaatacagctctaaagacagaagtcattattaatcccatctccttggtttgacctcttcatctgaacttgcaggcctgataaagattgtttattctgtttattatcattagtgtggttctggatatatagaaaatgagattatatcattatttttatatcgatatatttaaatttctacaggctctgctgctccattgattaggcacaaggatacacgtgccgcttcctatagtgcctctctctagggacgcttctcctctttgcatatgtaatttcctttttccttgtctccaccctgaagagtgaggatttctgtcagtttcacagaggcgaagttgcagtcttagagaggtcaaacaactcgctcagcagtggaaccgatcactcaagcacaagtgtcctggcatgtgctacccacataactagaaagcagggagctataattcttgccctgtttattggatttcccattatcttattcacctaaagcacttagaagcccttaggaaaaaacctctaattatggaaaaatttaaccctacagaaaagtagacaaaataatgaccctttagagactcttttaattcaacccagaattggttgcatttacagttgccaaaggttgagggcactgaatgaaagggaaccatgaacttgccaatttccttttctttcttaaaacaaaaaagatattcagggcaaattttagaatcattgacggtttctaggaagattttcttttttggaagaaaaaagatactcttgtctccttaattgttcttagtgttctttgtcaccaatcatgatattctttgtggaaagtattaatataccatcttcccgtgttcaatatccccattaacaataaaaagtctaatgaaaatatctgcatgaaaagctctgaacactaacttcagagacaaataaaagatgcaccaataagtgtttctttgaaaatgaatgatgcaaattaattgatatcctaatgagctttcagcatgaagattattagttagatggagtcagaactgaagatcatctttaaggaaatgctaaggacactgcagtcggggagaaagatgttatctgtcaatgctcagttagaaatcgctcttgctcaatgagaacttttcaaagagggagccaagtgggacagcataccttatgtatctgtctctgcctgtcctagcctggccaggttcggagactggagcctagtcctgttcctgagttgatggaaacccacaggtataggaagttccaccccaagccagcctctgggggtctcgtaataccaccactgtgctgcagattccttccttggtctctagaatagaagccctgtgagggcagagccttcctcaattttgtttgcgtttgtgtcaccaatgctaacctagctgcctgatttacagcaataataatataagagcaagtaatgatgtagagtttactatgtgttctgggtattgttctgagcactatccttaaaataattcgcttaagcttcataacaacagtgtgaagtaggcacactactatctccagcttacgagtgagtatattgagacacagagaggttgagcaactagcccaagatcacacagctaataatggtagattaggaattcaaaccacagcagtctggctctggagtccttgctcttaaccactgtgctatactgaatagtgttctatatatatttcttgaattaaacgaacaaaggggtaccatgaattaatgcccggtccctactgccaggcatctaacttttggcttttatttaagttatccaaagttccagagctttatcctactccgtactaaaccctgccagcccctctttggagtggaggtggggggtgccacagatatttcttgtattcctaaaaactcgttgctgtcctgtttcaacccagatagcctgtcaaaaaattgtccctactgaagggttcctatggccatggcctgatcaaccatccagttagacctggccccctaatatcagggtcagctgaagttccaccaagtttgcttctgtggtcattgtgaaccacagggccatggtccctctctgtctgcagagactttatggcaggctttcctactaaggctgcttgggtaatgatggtatttagggtgtagtattatggggtccaaaacacttacctagtgtgttttatttaacaagatagtattcactggggacagttccctggaagcatctacccataaaggatagttagaaaaagaactctgggagtgaaccggggggtggtggagggaaccacagagatgatgtcttccttgttatagagaggggatagtggctccttgtcctagtggagttgatgggagagatgtgatgtgaactcaggccacatggtacggcaggaaaggcatgtgacttggggttaagggacgcggattgaagactcacctctcttacccattagctaagagatggcatcattcaacttctctgggctctgctttccccatctataaaatgaggattatgtctatttcacaaagtggtgttgagtttcaagagttttaaaagtgcttttcgcttgaaaattgctccacaaatgagtgatgttaagaacgaccgaggcatcccagctctatggtcttccttcaatctgctcaacccctctggatgcttgttaagccagaatgccgtgttctccccagaccgaccgaggtggaagttctgcgggtggggtagtgcctaggcagctgcattttaacaagctcgtctgccaattcgaatgcactcaactgtttgagacccacttagcagtggtgaacaccaacacaaaggaagtactctgggtttgatcagagccttcacttcctctggtcgaggtctagaatctgagacctaaatgaatttggttgacaccgtctctgtggctggtggaattttggggaaggtgggcagggccaagtggatatcgctgccgcttcctgctgaacactcacgagggaagcagtgcaaatgtgacggaaacccgcgcctcctccggcctgagcgggaaggccgagggccgcacccgggcaggtggcactggtaagctctgtggcttagcagccttgccggacagctgccacctgtcacctgccacctgttctacttctaagctgggctgctgaggctaaattcatgttcgttgtacagagctcctgtgagaggtcccttctgagtatgggggtaaggggagtgcaggagtcgggggtcttcaggcttggaagagaggcagcctcatggtcccaagtcctctcaattctgaagtcatcccaccctaactgcttttgcactccggcctcaggaccgccgagcagagctcctaacaggaagccctgtgtgcctggggtggctgtgaatgtgaccttcagggcaatacttctctcttgagtgtttcacccctgagaccgctggggaggcctaagttcagaaaatgacaacgctctagccttggggggtgagggggagatgccagttctttctctttcatgcccactgctcctctccccttcctgatggctcaaacctcccagctctgtccctttgtgtgtttatggtgtttggccagggaagtgtgtggagtaacagaggtggctccagcactgcccacgaagctgctgcttgggtctcccttgaggaagccccttccagggccataggcagggctgcctctaaggatgcctgtccacctgagctccgtgggaggggccccggtcactgggccaccagctggttgccagggtaactaccctctcacccccctactcccacccagtggctgcgaaaaccctgccttgctcaggatagtcacaagctagttcagatttaaaccccttcctccacccacagttctagaaggaaaaacataaactcttcatagttgcagaattatttgttttccaaagtgctctcataagtcattggctcatcatgacaatcacagcaagtcagcagcacatttcccatattacagagcaagatgaaatgcccagaggagccgacagaggtcactgggttggtagccagccaaggtccaaaccacatccaaactttgtttttctagttccgagttcccactatcttacagagttgatgcctttgtatactgtttgcaaaacccatctgcaggtgttctaggcacagattcgtgactgtttgaggctagtgtggacttccccaaagagcactgccaggcactcatgaacaaaaggattcaataatcaaatgcaactggaaaatcagtgtatatgatatagagcatactagactagtaaaagctccaaaagcccttgagtgagaaacagaatgaattcagttcaactcagagtatccaaaacttgtttggcaacacagcctttccctcccacataatggcacaaacaagccaccagatttgaggaccctccctgaagagggtgagccaggctccttcacaattatcgtgatgacaaagacacaaagatgagaggcggccacttgtttctgtacacaaagaaaaggaagttgctgtgcctctctcatgccccatgccccatcatggggaggagctccaggacttctcctggccggttctgccacctgcacgtctcagaatcccctcagtgcccccaaatccagtggtgtgctgaagccaattgttaacgtttcagaaacagtgtgagtcagttgttaaatcatcaggagcttgaaattaaatcaccactcccgtggtgggagtatttatttataccataaaaatcagcaaacactagaaatcaggactctccccacccttctagaaagctgggttaccagcataccactggccctgggacactttttgaaattgttggaaaacttgggagggctttgatagctgagcactgggggagatgggacacagaagtcctcgctccaaccttcctggatgagaggtgggaactgcactgaatgataatcttccagatacaaccccaaatgcgtcagagagtgcctcttggcctgcttaccttgatatctgttaccagccaatgtctccagaatctctgtctgggttctgctctgctaggggcatctggatccaccatcaccaggatataggttgcgccctgtaacacatgtaccgaaaagtaatgtagcgtcatggctgaaataggaaaataccacggggcagacctccttttcccgccattccaaccgagaatggctgagtagcccctatggcgtcccatccagtttatccttgctctcgtgacatccctctcacatcacgtttattctcagagaaatggcatctgtgaagcagacagcaggactcttggcttcctctttgtgaggaagaataaatccaacaagatatacataccaagcacctgggaagttctgagcgctgtgctgagtgccgtggaggaatcaaggaaacctaaaacaggtctctggtcctctcaagaagaatccagtgtagttggagtgacttgtttatcaattcaacaaatatatgaggacttattttgtgtcaagaacggtacctatcacaaagaacaccaggattcattcatcccttcaacaagcctttgctgaacacctactgtgtgccagaagctgctctaggtgccaggaggcaacagagcacaagacagtaaggtccatactttcaggaagcttttgttctaggtaaaagacgcagataataaaaataaataaataagcaagggaacgtgtgagtagtgctatgatgaaaataaaacagggtgggatgagaggtgggaagtgttctggaaggaaaaaaatagctgctatgaaggtcttcaggtgggaaaaaagtaggctttgaggagcaagaaagagcaccattgtggccagggacaagcaagggggagggtggacatggcaggtgcaggggagggagcagaggccaggccacagggggctctctaggcctggatagggagtggggttttattcaaagtgcaacacagaactgtttcagggtttggggcaggacagtgatatgctctgatttatgcttttagaggattcttttggctgctgagtagaaaatgaatgatctccaaaggccagagaggaggccaggaggccagttaggagactcgcagtagcatgggaaggatgttggtatcttgggctaggatggcagaaatggagacagaaacaaatagatgggttgggggagtatttttaggtaaaatcggcagggtttgctgatagattcaacggcacggcagtaaggagggggatggagaaagagaaattgaggatgaatcctgggtttctggcttgagcaactgggccattaaatggtacaaataagacttggagaggaggctgtttgaaggtggacattcagagttctggtttagatatcttgagtttgaaatgcccctcagaatataggtatgcatgtcggtctgtaattcagaggagagatcaggactgggtgaataaatttggtagtcattgatatagagatggcctttaaatcagtagagcagacacagagaagaaaagaggtctcatggctgaactgtaaaacatgctacaattgagaggaggggagaatcagggaaaggggactttagagccaaaaagtttgggggaacacctggaaagcaggtgtcacaaaagccaggatagaaagtgtctccaggaagagaaagtgatcagctatatcaaatgctgctaaaaggtagggccagatgaggacacagatgtgacaatctgatttgacaacttggatatcactgttatcacgataagaccagtttcagtggagtagaaaggactgatatttggctggaataggctgagctgagatgggagacgaggaattggagatagctgttagagatagctattaaagatgatcataaaaagggaaattttggtaggaaggacagctgagacatggagtggctataactaaagaggaaagaagagtcaagattgtttttgtttttttgttttgttttgttttgttttttgagactgagtctctctctgttgcccaggagtgcagtggtgtgatctcggctcattgcaagctctgcctccggggttcacgccattctcctgcctcagcctcccaagtagctgggactacaggcgcccgccaccacgcccagctaattttttatatttttagtagagacggggtttcaccgtgttagccaggatggtctcgatctcctgatctcatgatccacctgcctcggcctcccaaagtgctggaattacaggcgtgagccaccgcgcccagcccaagatattttttaaagagggggatgatgtttgtagaccaatggaaatggtccagtatagaaagggaggtagagatgacagagaggaggaaggggatcattacaagagctttgggcagtggagaggggacacgatccagagtgaaagtgaagggctagatcttgggtagaagcagaggacatgggttcagatgcaagataattggaaggtgagatagtgaggaatgaggaaattgtcttccgattgcttctatttttcaatgagttagaggcaagtttatcaggggaagagggattataggaagtttggggacagagaaaaaggtgtgagatagtcatttaagagagtgagaaaatgaatataccataggtatgtggtaggttaccagatagtattacatttcacagttgtgtcctttttaactgttcaagtacaggtgtggaatacgtggtagttgggtttaacttgaatgggaacttaggtgtgagtatgaaggaagagaaggaagtgagagaggaaaaagtgagtaagatgaatggagtaaatggaaaaccgtcctggccctccccttgaccgggagaggcaggcacaccctgttgttctaaatgctttctgatgttctaaatgcttaagcagaggagcatttatcaaccatggaggggaaagggaaaagagagattaaatctctctaccccaggagtccaggaaggctgcagagttgtcttttgagcttgatctcaaaggcaggtaaagtatcagtaaagtatcaggaaaagcactctctaggtacttggtaagggcatgtgcaaaggcaggggtggatttttggggaatggctaggccgtaaggcatctgaaaagaaatagtgggtgacaaagctgaaatgggtattgggaccagagaacagaaagctctgtacgtcataagttgtttagaatttattatgcaacaggacccactgaaattgtttgaacaggcaactcatataatcaaatgtgtgctttggggctgggcatggtggctcacatccgtaatcccaacactttgggaggctgaggtggactgattgcttgagcccaggagttcagacccacctgggcaacatggcaaaatcttgtctctacaaaaaatacaaaagctaaccaggcatggtagcccatgcctatggttccagctactcgggaggctgaagtggaaggatcgcttgagcccaggagggtgcagtgagccatgactgcaccactgtactccagcttggatgacagagtgagaccctgtctcaacaaacaaaaaacacatgggctttgggaagacacatgatgagacatgaagaggatagaataaaggatgaaaagcagagcaaaaaatccaaacaaaccctgaaaactgcaatactctggagaaagaccacagggatttccattcaaatagtagtaatagaaaggagagacatgtgtactgcagaactcacagcatgaggtgaccgggtagggcagacgtaggagaggaagaagccaggacgactctgagattctgtcttgggcagcttggtgataatgaagccatggatattaggggtagcaaagtcagggggacagtgaggcagtgagtttggtgttgaaatcaacagggagagatgccctgtaaatgaagttagcgctctctcaagacttggcaaatgggcagtggagattcatggattgcctggggagaatctgtagagtgaaaacaaaagaaagagtgtggtggaacttgggaactcaaagcgggacaaggaagggagaaagaggctgaggagggccgggtgcggtggctcatgcctataatcccagcactttgggaggctgaggtggacggatcatgaggtcaagagattgagaccatcctggctaacacggtgaaaccccgtctctactaaaaatataaaaaattagctgggcgtggtggcgggtgcctgtagtcccagctactccagaggctgaggcaggagaatggtgtgaactcgggaggtggaggttgtagtgagccgagatcgcgccattgcactccagcctgggcgacagagcaagacctcgtctcaaaaaaaaaaaaaaagaggctgaggagaagagagttcggaagagagccaggggagttactgtcatagatgccaagagagaaatgaaggaagggataaaggttgtgtcagtatcacagtcatcaaggcagatgagggccacaaagtgattgttggttgtgacaatgaggggattatggacacctttccaaagatgattagtttaaaggtaaaaataatgaccgttggattttaagacccagaagaagctgtaaaccacaaactagatgctataggaaattaaatcagataatgagaagataaacccaagaaaatctccaaggactcagaagaaaagaaaatagtaggtgaaaagaaggaatatatactaaagtgtgtgtgtgtgtgtgtgtgtgtaaaatcccagtagaatcccataaagagaaaactgtacatagtatctgacacatccaagaaagtaataagaaaataaaaagaaacaaagtgtaaacatgataaaagaagaaatgaagaaataaagccatatgccctctctcttttcctttcttcttcttcttctttttatttttttgcaaatgacatgattgtctacatgagaaattttaaaaaatcaactggaaacaaaagtaatattcagtaaactgttacaaattatacacaaaactggtactttctacatattaataatagtcctaaagtatacatttaagatcccattaacaatggtaacaaaaaatgtaaaataagtaagaatgagcttgatggtaaatgcaagattatatgaagaaaacaaaaacattattgatgcacaaaagaaggaaacttggatagaaaaagaaatacaatgcttttaaattgaaataatcattttgcaaaaatgtcaataaaccttcaattaattttttaatctggcacaatcccaatcaaaatcctaaatagatgttttgtgaacatcacagaataattctaaaggtaataataaatgtaaacaacaagtaaataaaggaaaaataattatccaaggcaatattgaaaaagataaaatagggatgataataattttggagatattaacatatcttaagctacaataattagaacaatatggtgttgattaataaatacataagtaaaggaatcaaaatagaaaatccagagagaaagttgagttttcaatatatgtatatttactacatgatagttataatttaaaatgttatttaatatatgacaaagtaatttcagatcagtggggaaaaaatagattattttataaatgatattgggaaaactggctcactatgtggaataaacaaacttaggtccctatttctttcagacaccagaaaacttccatatttaaatatgaaaatgaaaaacaagctttcaaactggtttaataacataatattaaatttatgcaatggaacactctgttagagttagatctttatatactcatataagaaattttctaaaatatactagtatgtgaaataagtaagttacagaataatgtgcatgatgtctcaaatgtgcaggaaaactttatatatctaactatatatatatatctttatagatatatttgcatatgcatagaaaatgtctgaaaaaatacacaccaaactgttaacagtaaatgtcatgaagggaagattgatatatctaactagatataattttgactcttttatatggcaaaaaaagtccaaaataaaattcaaagacaataaactgagggcaaatatttacaatatctatgaaaaaatgtgattatctttaatatacaaagtactctttaaatccataaaaaaagactaataactcaatagaaaaatggatgaacagcatgaatgggtaactcataaaataaggagcacaaatgatcaaagaccatacgaacaagtttactagtcataaaaggtatgcaaaaaataaaataagatccaatctttgcccataaaattaacaaaagttttcatgtttatctcgagtttttaaggtatgtagaaacaatgggtagatctccaaatcctatgaactctataatgtcattgtctattttttaaaaaggagagaagaccaaaaccacatattgtacacatgtacatgactctatggagagaaaaccagaaaaatagaaagttaaatgctgaccgatgatctctaaatgatgggataattatgaactttattttcttctttgtagttttttgcatttcccaaagtttatgcaataaaatgcattgcttttatacttagacaaaaagatttgcactcaaggaaaaaaaaagtcatggtgagaaatcccagaaccctcattcttctcctgtttaaacaatagccaagggaagtcttctcagtggcagactgctctccctccctgccctgatgttccccgtggcccctcctgtccctaaccctacactgctgcctgattctttaggacagcgctccccaatatttttggcaccaggaactggtttcgtggaagacaatttttccccagatgagggtgaggggtagtttcaggatgattcaagcacattacatttattgtgcactttatttttattattattacattataatcgataatgaaataattataaactcactgtaatgtagaatcggtgaacaccctgagcttgttttcctgcaactagagggtcccatgtggaggtgatgggagacagtgacacatcatcaggcattagattctcataaggagcgttgcaacctagattccttgcatgtacagttcgcaatagggtttgtgctcctatgagactctaatgccacagccaaactgacaggaggtggagcccaggtggtaacaggaatgatggggagtggctgtaaatatggataaagctgcactcactggcccaccatttacctcctgctgtgtggcccagttcctaacaggccatggaccggtactgggggttggggactcctgctgtagggtgagtctgcattgcagggcactgttgcagatggtcatatcctgaggtttaccctagatctcctctctgctaagcagccccagaagagacgttttcaaagacttctgtggtggtcttgcagatctctctcaatgcaatcagggagctgggtcccagacctttcataacagtcattgccaacagaagctccttagcaaatgtttggcagatgtggcaaaggagtgcttgttcaccaaagaaagtggaaaacaacctattcaagagcttagcccttagccaggctccttgaagttgggcccacccacttctgtaggtccatggagctgacaggatggaatagtgttcagaggagatgagcacgtcttccttctggccggtgaaactaatttctgaccatggcagcccattctttaagcatagccaagacagaagaacgtgccatcaacacttccaacaagggaagtgaatctagggaattttatacttgccacatgttttcttgcctaggatagagactgttttatacttctgtaggggtatagacctagtaaaatgccagcctttaataggtgcccatgaatgcttattacaccatggactggtggttcttagctaattccttctcttttctggcttgctcctaaaagatgaggtagctgagccaggtgatctactttccctcgggttctaacatccacatggtggattcagagctatctagacataccataaaaataagactgcttatatgatccagcaatcacactttgggggatagaaatccaggtgtcactgcagcactattcacaatagccaggatgaggaaacagtaggatgtctatcaacagatgaatggataaagaaaatgtagtatatccgtacaatggaacactattcagccttaaaaaggaaatactgtagttggtgacaacgtggataaaccttgaggttattatgctaagtgaaacaagccagtcaccaaaggacaaatattgtgtgattccacgtacatgatatatctaaaatagtcaaacccacagaagcagagaggaatggtggttgccagggttggcgtggggtggtggggggacatggggagttgctcattgatgagtatagactttcagtcatgaaggaaattctagaaagcttggtgtacaataccgtgtccatagttaacaatatcatattgtacactcaaaaatcttttgagtatatctcaaggtaagtgttcttatcacaataagataaaataaaaataaactaaacccacttgaagaaggcaggatgaaatccaagttctttccaaagacactgcacatcttgaagcctgacagcacactctgccggcaaggctgcggggaaactgaggctgcatgcattgttgtaggaatgcacaatatgagtgatgtgcctttttactcagtgattccacttccgtgatttttccaactaaagatatctgcacacttatgaaatgacttgtatataaggttattcatttcagccctgtcacagtagaaaataagtgaacattgttggaaataactcaagtgcccatgagctggggattggttaataaacaatgatatgtactcagagtggaaaacttcgtaactgtaaaaaaaaccatgaggatctctaagatctgatatgaaaagctctccaggataactttagtgtaaaaagcaaggcgcagaacagcatatctattgctttatttttatagaagaaggagaaaataagatatttcttcacatttgcttgtatttacataaacaaactctggaagggtgcttaaaaaactaagagaggctgtgggtggtggtattgatatgggtagatgagatagagacatctatatgtgtgttctatcattctgatttttaaagccatgtgaatacctattacctgctaaaaataaaccaaacttataaaataacgtggaatgtgcagcagtcacataatattttggaggtgtatcatcattatcctggagacatcagtctctagttctctttcactgatgctgagaggtaaagaaggatggccttgtccctttgcagcaaggagagctcagagaaccctcattccacttttgaaggttatttggggaagtgcaactgctggaataagaccctgggtgctatggagcagggcatgagcaaggtgtaggaagccacattaacaaatcacaatactttgggaggatgatgatgacatagaaacagaattagatctggatttgtccagataaagttttaaaaaacagctatatggaggtatagtttacatataataaacttcacccattttaagtgtacatttcaatgatttttaaaaaaatgtacaaagttgcgcaacgatcaccataatctaaatttagaacatttttatcatcccagaaagaaattttgtaccatgtatgcagtcattccttattccccccgccagttccaagcaaccatgaatctactttctgtctctgtaatctcctttttgcccttcctggacatttaatataaatggagtcataatacttgtttttttttgtgttggcatcttttactcagcgtaatgtttttgaggttcatccatgctgtacatgtattagtacttcattcctttttattgttgaataatatttcattgtatggatagagaccacatttgtttatccaattggtggacatttggtttatttccactttggctattatgaatgatgctgctgtgaacatttgctgtaagtctctgtgcaaacacttgttttcaattctcttgcttagacgtctagagtggaactgctgggtcatattgtaaatttatgtttaacattttaagaaactaccaaactgtttttcaaagtggttgctccattttacaattccaccagaaggttctagtttctccacatctttgtcaacacttataattgtctgtcttttgattgtggccatgctagtgggtgtaaactggtatctcatgtttttaatttgcatttccctaaggactagtgatgttgagttccttttcatgtccttattgactatttttatatctttggtgaaatgtctatgtcaatttcttgcccatttaaaaattggattatttatcttctaaaattggattatctatccagaaataattgtaataggtgtgtcccaaggagtaagggaaaatggaggcagcagggtgagtggaaagcaagatggcagcaaatatttccatagatgggagaggggctacccagttggaactctgctctgatcagctgtcagggctggacttgcctcattcttgaacttctggtttccggcctcaatccccatctgtacatggggttgtacaaagcctttgccttccctgccttcccagccatcggtcctcaacctcatcactgtgcctgaaatgttcttttcttctttgtctctgagacagtcctattttcctcctctatctctaaacccttccattctttgctctggaactgccactgacaacaagccatctcccctgcatcctgtctctccagcaattgctctctacctctttctgttttcctggctttcccctgaagatccccttcccctcactgctctcttgtggtatgtgttctctcacaccccataaacctcagggtcaggaggttgggtagacgccattgcaccctgttgccttctctgtggcacacgccattagttgaatacatcctctgtcttggttgctgtcatctatgacttcttggttgctacattcaccaaagacaatggcacctgctcccaatctccttcgtgtccttgagtcttgctcttactctggtgactttagcaaacatgtggaacagccacccaacaccatggcctctctggttcctgggtctttccatctcgggcaatctttccctctctatctcaaccatcgacttccatagctacaccctgaagctgcttgtcatcccccaaacggctccacctccaaaaatcactaattctggccataacccccctctctccagcttgcttcttcaactatgtctactgggagtagtcttcaacctcagtggggacctccaggccactggtaactcctttctcaaagcccatcagtgggagctgataattttgcacagcagcgattttcttcacttgtgtcttaatcagcttaaatggccagaacctgaattcccttgtcctctgccatttgaacattttcttgacaaaaccccaaagctgggtaaacccagctttcctttacttccatgtgtgacctgagcagtgagtgctgcagcagaaagtcacatcacagaagaggttggccccaccctatatttttggctaccagcttcattacaggccctgagtgccactccaaatttctctggtcaacttgccctcccacccttactcatgactttccaatatttcaagccttctccaatatccttaaatctccaacctccaacctcccctaacttccctgacccctctcttagtaggtaacattctcattgatgacttctcaggggaaattgaaggcatcaaatagtaagttcttcaagatcttcttcaaggcttgcaactccccagtgcatctgcccccaatctcttcttctcctctcccattgtcttagtgaagctgagtggctcaggccccaggaaggaagagattgcttcctctgtcatgctttggatcctctccccatcatcagcaataccttctctctcttgaatattccattctccttttcctcctcatcattaaaacatgaccaagtctctttcatctttaaagacaccttccttggccccatatcctcccctgcttttcccctatccttgtctcctccctgcttcacaggcaaaatccacgaaataactgtcaacaccctcagcctgtttccttacttcccactaactccttaatccaatctgcccccatcgcttctgctgcagcccttgctaagatcaccacctccatgtcaccaaatccaatggatgttttccaatcctcatcacacttggcgtctcagctgcagttgacgtggcagcccaccccttctttatagcaataccttcttcccatgacttctgtgcttccatcctattcttcttcctcaagccttgttttccccactgctgggtcctaggctgtggttttgtgtgtgtgtgtgtgtgtgtgtgtgtgtgtgtttttacggagtcttgctcttgttgtcaggctggagtgtagtggtgcgatttcggctaactgcagtctccacctcctgggttcaagtgattcccctgcctcagcctcctgagtagctaggattacaggtgcgcaccaccacgcctggctaatttttgtgtgtgtgtgtgtgtgtattttagtagagatggggtttcaccatgttggccaggatggtctcaatctcctgaccttgtgttgtgatctgcctgcctcggcctcccaaagtgctgggattacaggcatgagccactgcacctggccagctatcttcttttatcaccctaacctccgactcaggaacatcaacccacagccacatttatttctctaaaccagagctgtcctctgagatccagaccctatgtccaatgacccactttccatcttcctttggctgtttcagagcacctcacactcatcatgtccaacaacattgcctggtattccagagtttcctattttgcatctggaaatgcaaactagaaaccggggcaccatctttaccatgttcctccctcttttcctccttttccaatccaccgccaattcttgtcaattcagcctctcaaacagccctcaaatccacccatttcccccctatcaccactaccaccacatcaaccaccatcttttgtcttggctactggaatagcctcctaactggtctctttgaaaccctaagcaattttctacactgatccaaagtatttttttccaaaacacaaatagattatgtgatcctgctgcttaaaatccttctctggcttcccttggatccttaatgtgttctacaaggtgttgcacaatttggccctgcaaccagcccactgtccttgtcatcttgtacacattctcctgcaccctgtattccagtttctagggttcactctgctccctccccactcatcacctttgcatatgttttctctatgtctagaacaccccatccctggaactacttaactttcattcattcttcagaactcaattcaaggtcatttctctggagaagtgttcctgagccccattctagattatgttcctttgttaatcatccttgcatttctttccctctgatgctcatctcagtttataatcagtaagacattaatcagcatagttttttattaatgtcagtgtctcccacaagagtatgacccccttgaaagtggggatggcatctatttctgcttgccattatattcccagtagagtacagtgtctgcacacagtagacactcaataaatatttttgaataaataaattatatattggcccaggtagtcccattgttcattcattcaacaagcattgattgagctcttttcatatactaagcaccatgctaagggcttgggataagagatgagagaggcatgcctctgcctttgaggacatagtagcctacagggggagttggatgtgtgtgcagagggtccaaggaccctctgtgctgtaaccaggcatatacctagcactggagaagcaaacctaaggacgtgatggaccctgctcagggtgaccaaataaagaccagcagaggatgctaccgctgagctggtcctgaggagtggagtgtgctcaggagggaaggccatgcctggcaaaggaagcagcacatccacaggcagggagcagcaacttgtgttgtgtgtctggagggtggagttcacaaggccaagaggtgaagtggagtggcagtggatgagcccagcaagattgatgagggcagatgagcatgtgccaggggaggtttgtagatgaaaagggcgggggcaggggcaggggaggagtagggctgacatgatcagggctggattgtagagagagaattcctgcatgtgatgtggtgggggtggataagaatgggcacgataaaggccagtgggggctagcagaccaattcgtgtgagggatgggtcagcatggcacaaaagtggtcattcctggaggcagaccagtgtgccacaccctctgtagtgcagcaatgctgataggggctgcatgtttgcaactccaaaatgcatgtgtggaagccctacttcccaagttgatggtgttcggacgtggggcctctgggaggtagtgatgagggtggagcccttgtgatgggctaggtaccttcataagaagagacactagagaactcacttcctccctctctctctgctctctgccaagtgcacccacagtgagaaggctaactacaaagcagcaagcaggcccttgtcagacactgaatctgctggcacattggtcttggacttcccagcccctagaactgtgagaataaatgtgtgttttttaagccacccagtctatggaatttttgttatagcaacctgacctaagatgttcagggagaggggctttcctgacgcagagagaaaatctctggggccctctcctgccttgccactggggagtctttgcgtgtctgcctttccccaagaggagaaacgaaaagtatccttaggatggaatgtgatcagatttcagcagacattgagacagtcctgagtcctagaagcactggcaaggtggggactgtttttattttctgtattttctgatgctgtgacacttggagccttgctgacctggagagactgcccttcccagggctaattcctagagatagcaaacacccaccccagagcacattcttcaaatgccagccacccacccacagcccccaccctcacccatctcctttatcaggctgggtcactgtccctagtcccaatcatttgaccagacactggacaacaaggggcagcccccgtgccccagagcccaccagaattattcagatcagccaatcctaaacctgtctaccctgcttaccctgtctcacccattccttctagcaaaaaccacaataaaggttcttgcccatgcttcccccgtattccctctgcctcctgactggccctgtgtggtgtgctgtgcctcctgtttctagatatctgtgagtatgaacttccttcatcaccatcatgtccctctgtgtgtcttaccatacccaattagaagaaatccctggtatgttttaaaacagggcccttgactcctaaggctcagttatccatcaagcctatctggagtctacaggaaactgaggaccatcaagcatggcatgatccctctttctgtttttttgagatagggtcttattctgtcactcaggctggagtgcagtggcgcgatctcggcttactgcaacctccgcctcaagggttcaagcgagtcttctgcctcggcctcccgagtagctgggattacaggtgcatgccaccacgcccagctgatgtttgtatttttggtagagatggggtttcaccatgttggccaggctagcctcgaactcctgacctcaagtgatttgcctgccttggcctctcaaagtgctgggattacaggctctgatatgatttcgaatgtgggttactgtctccagcactctcttgtccttgagtaggagactgagctgacctggctaggttaagcttcacgatcgtgattagtggagagccattttctccaaggcaatggtctcacccctgccttaatgtgagaatcaccaggggaactcttcaagctaccaaggctgggccccactgggtggaggttttgattgaaggagtctggagtggggcccaggtgttgctgttggtttataagtttcccaggtgatctaatgtagagttagggacaagaatgacaaccctaaagtctaattcccctgaagtccgtagccaaatctatgactgactacaacccagatttctcccctcctcatcagtgagctcagttcggttcattagaagactatgtgtcttcttcataaagaggacaatcttcccctgacctcagctggggacccttgtgtcctgggtcctggagatgaaggggatccagcacccaattgagaagctgaagtcacaaacacaagtcgccctgcgctcccactattcgtgatgatgttggttgccatacaaatttagcccatagtgggctggttgtgtttgagcctcccccaccaagttctgtatgggaaatctagttaagagccttcttcctgggggaggttgagtgtaacagctgctcttcgccagggctgatgggcccgccaggatgcaagccgggtgctgcccctggagccgaaagcctttcatccccaaggacgggttcgaatttcaggctggtgtccagcagccaggctggtgtccactgctgctgctgaggacaaagacacatcctgggctgtgaggacagaggcacctccacccaggagctggggttcacagcatgctctgacacattgagaaagaggtattgtgcagttgctgtggatcagagatcctcctcccttgcttgcctctattctagaagctgggaagctaaaacactggatttcccaggctctactgcattgagaggcagccatattctggcccagaatatgtaggagaaaatccctagggagggatctcttctggaataaaaggcaaagtctcacttggagaagaaaatccttgctgtcttttgtcccctcactcatttccttcttcctgcctggaatgtgaatgggatgttggtgtattgaagccatcctgtgactgagaggggacaagtgtgtgactgaaagcctgtgttctaaagatgataaagcaaaaagatggaaagagcccagtccttggctgaatcagcccaggattcagcccctagacttcttgttgcatgacacaaaccaaccccttagtctcctatgatagggatttttctcccttgtccccaaacacatttctattaacgcctaggtcacttctgacaagtgggtgccagaggctggtctccagaaaggcgacctaacgttgtgaagaggttattcgagtaaacgagtaaatgctggggtacgtggattccagccccagttctacatataggctgtggcttagggagttatttactgtcactaaggtatagtttactgatctgcaaaatggcaataatacctgtctcacacagcagggctattctaaaaataaaatgagttaaaagcatggaagtatttttaagactgtgaagcaatgtctgtgggtcaggttttgttattgtgaacaaaaggcatcagcaattttttccaccggcccctggagcagcagtgaccttgacagccggaagacttcctccaaatggtccatatctccagctgcctggagccagagagactgagcttcctagcatctttggtggggctagaaataagcggcccgggaacactggtgcacatggaaacacagcatctcacaggcagccctctggtcctgtccatgtccccagggggtattaagctcacctgggaatgggactgttacagaatcctggagcactggaaggaatagggatcatgttgcctttatggtaaacctagcaggaaccatccaggatcttccacagcctcccagcaatgggtcccccactatcctgggaatgcagttcattctggtacagcttaggttgttagaaagcgctatgtcccatggagccccaaaatgccttcttcaaactcacactgtctccaagaatgacattagaacaggccctgtcctgcttgcgcatggcaacccctcagatatttgaaagcatttatcacggctttcaatgaccggctcttcaggcaaaaggtcccagtttcttcactaattcagctccctggggctccatcctacatcctgcctcaagtggctcacagttactgagggagacagacgtgtaaacagcaacagtgtgatgcagggaaaatcatctaaacagacattattattctgagtctataaatggaaaaatgggggctcagggtctctgcctaaggcagtgaacttcagatgtgaatcctactcggctgctgtgcagccttgggcaagttgcctaaactctctgggcctcaggttcactatgtataagatggagataataatcaaagtgcttttctcttagactgcatgcatattaagtgaattaatacatggctcagaataatgcctggcatatgtgaagcgatcaacacatgaaagacaagtgaatggcttctctgggattcaaaatcatatcgcttgtctccaaattccactctcttccccctgctcagagggtagagggacagatttggagctgacttttactcacaacaatatggtatttgtttgtgtgttgcaaattcctgcacacctaggtctctggacacttgtgcaatttaaaacatccatgctacaaacatatacttgttggcaacatgttccggcatctccgaatcaagtgccttctgccactgtgctgcccagtcctctggggaagacagtccctctagagcatctgcccactcaagatggctggggaaggaacgctctcgcctggctcacatggctctggctgtgtgccaaggggtgtgggccagccgggtggcgagttcaaatcctcattgtactctgtcccctcctcaaagtctgtgctgtgctgcgtaccccgggtcactgcaacttttttgtcttaacaaagctgagaaacgtatgtaaatttcaaagcttcatccgcagccaagcaggcagcaaaaatcactacatgtcaaatgatgaattaagatattatccatactgcatgaaagggagagagaagaggaaactgatggaagagaaagaaaaaaaaaaagagctcctaagcaacaaagggtgtggatcgtttctttagtaaagtagcaatcagacaaatatctctatctcccaagctacattcatatccaccatcctaaccatttcctcctctgacttaacctgtttctatgaatggcactgccattttgtgaaattcaaagtatgaatcatctttcgactcttccctctcaaagtcacgcccaattcttactgatttctgagtttacagtctctagaatctatcctcacctttccccatcctttctgacacccttgagcgaggtctgcgctagctcttgcctctatttcgatagcatcctaactggccttctaacctctaaacctctcttcctattcactagatgcttgcttaccatcagagaaagctagtggtgttttggtaaaccaactctctcaggaaaaaaagaaaaatcaggccgtgacttgtagcgattgttcatttccacgggtgatattcacaccgtggtctgtccaagctaccaacatgaggtgagtggctgcagcattggaaagacgtagaattggcgtttgcaagctcattgctgcccgataatcttcctaaagaacaactcgctacagacttaggccctaaatataaacttcataacctggcatctgtggccctgcacctctagctgtcagttagcctgcccaggggactccatcatacccatacacatgcccacacagacggaggatgtttctgatctccagtgtgattcttgcttccccacctctgtgcctttatttgtgtagtctctctgcccatcagaaaatccttccccttcctcaagactcatctcatctatgaatacttctttgaagtcccttggaccagagaagctgtcctcattctttgaaccccaatagcattttgcttgtacctttgctgaggcaccttccatattctgctatgtatttggttctgtgtgggcttcttttggcctctcttattagattattatattcttttttttttttttttttttttttttgagacagggtcttgctctgttgcccaagctggagtgcagtggtgtgatctcggctcactgcaacctcaatctcctgggctcaagcaatcttccaacctcagccccctgagtagctggggctacaggcacacgccaccacacctggctaatttttaaattttctttgtagatacggggtctccctgtgttgtccaggctggtctgaaactcttgggctccagcgatcctctcaccttggcctcccaaagtgctggggtaatacatgtgagccacctgcctggacttcaattattatattcctgacagaagaactattatttctttgttgctcctgaagtgcctagcatactttcttgcacacagtaggtgcttaagacatatttgttgaaatgaactgtacccattttctctgttaggaaacaggttttttggttttttttcaatgttctggaaagggaaagaaatttttggccacagagctggatgagcccgttggactgctggccctgacactgtattgcttgctaaggagcctgcaccttggcttgggagactcgaagcctctggtcctttacttcctccctcacacatgacactgccttctagaaagtcaagaccagctcagcagacctgacgctccctcccaacagcatccacagaaagcactggtggggttggctcctggctagggccggcaagttcagcgtttgcctaaaagctaggccggggcctcagccgacccaggaagcctcggcggtgaagccagagctggggcgatgctgccaggcctggcgctgagctgtggctcggccccctctgctctcggcctaagccgccgcagtcgccagggcccctagtgtgaaggaatttgagttctaactttaggtggctacgtggctgatggctgtgtttgtgaatatctcattcctactttggttgcccagctggtgggaacagaacgggtagtcatgggactgtcatcgtgtgctgtccaggttaacatgtagcatttctattactattaacagactttctgctcctcactccatctgttctctgaaataattgcagttgtacagaccatgccttcgctacaggcaagctctggggaagaggatagtgcttttatgagaaaaaaaaagtgttaaaaaataacagcaaacatgagaagagagtggggatggagctagcagcaggtttccaatttctttcagattccggcctgcaaaggtggcgtttttcacacttgttcgggatgaccaagcccagatagatgggggtgagaggctgggctggcggctcagtctttaggacgtggtgttggtcatcacgggattcagccccagttgaggtgggtggagccttggttgggctacccagctgggaggggcggggctcttgggaagaggcaggggctttgggggtggcatggcggtgtcctgctcaaaggagctagatgggctcaaggcctgggggaaaggctggtggatcaagaagggctggtggggaggcagaggctggaactaaatgactggtcctatctgggcctctgattctccacatgcaaaatgggagaggttcatctcaacaccttgctttcttgaagggctgttaggagaatgaatgggttactacaacatagtgagggttcttctggcgaaaaggactacaagggatgatgaagacttggtgtgtgaaatacaatagctactggtggcacaaaacaaatacttgcagggttgaagcctctggtttctaaacctagtgtgtgtgggtttctgtcttcccatagggtgctaaacaaggcataactgagaaccacaacctgacagaccctcgtgatttgttccggttccttccctcccactgccagctcttccacgtgaggggcccatctcatcctgtgaggctgaaaatggtgttttttaccccctcgcccaaaccccaattggaatggctgaggagggaggcaatgttgagctttttaggagtgaacttgttggggaaagaaagaaatgaattaagggaagacagccatgagatttctaagtgttcttccaatttcaaggaagtgttttcatttaaaagaaatccacagaatgtgaccggtctgctgtaaataagacatttgttggggaaatttttttctgtgtgtgggacactatactattctccatacccatcagaagattttataaaattccagaaaggctcagagaatcagatgaattatatctaaccgtgatcacagtgtaaaacacggttcaggtttcggatagattttgcctgtcttccttacttcatattaccctctaaactgagcatcgtggcctagattttccttgaaactaggttcagtggggactggtgggcctttaacaaagaattttttaaacacacaggtgtggatgaaaatgtgaccctattggctggggtgtcccaaaagaacatggttcttttcttttcttaaaaaaattttttcttcttttaattttttttttttttttaaagatggggtcttaccatcttgcctgggctggtctgcaactccttgggcccaagcaatcttcctgcctcgacctcccagtgtgctgggattacagacataagccaccgtgcccagccttggttcttttgttagggaattggaagggtgagaactgtgagcaattcctgcctgttgagaaattttcagagttaccttaggaacacccacatgttcctcttgggtcaaagacttggttggaagaatgtggggaaaatgtgaatcagttgcttgggagaatgtctgtgttaaaggctagttacatcgcactggcttttggtgtgtttgctcccatcaccaccttgtgatctctgccagggactggtggctggctcttagtgtcctctgctgagtactgtggcccagtgcctgacacacatgagacaaacaataaatgtgcatgctgagtgcatgaacaaaatacaggaaatatataactaatggtaccaattgccaaggagtttaccaccaagtaagtgccttttccataaaaagcaaaccctggatgtataaattgatgtaatcagcaataaaagattctcgaagaaataatagctaccattagtcaagcccttttcaactacatgccaaacccctcatatcccctgacgcattttattctgcagccaacacaccagctcagcactatcatctccattttaaagaagagaaaactgaggcttagggagaagactgagtaacttgcccaagggcacatcataagtaagtagcaaaggcaaaaatcaaacccagctctgtctgactgcgaagcagcggctcttagccactctcttctgtggccctttgagggggtggaagcaggatttctgtaaagtacaatcattcctacttcatctgtcagagttctttagggggtaaataacttagtgggaaaggaaattgtatttagtttttcaaaagcttttgacaaggttactttcaaaattaagaacctttggtgccaaatattttgtcattgatagggaacagcttagggacaacaactaacaaaacagcaaacgggtcctttctctattcacttctaggttgctttcttttgggttcaactctaggcctatttattctacaccttcatggaagaggaattgtgcaatgaggcctccaggtaatcagaggatcagggaggccctctgcatgtgcaaatgccacctggtgcagataaatccaggctgatgccaagaggctatgtgagaacagagaaagttggcagccctgtgctagaatgaaccctgcatgtagttctgggaggacagcttggaaaaggataagaatggctacagactgttccctaaagacaccagcccaaagggccgctgagacctgaaaagacaatgaaaggtcaagcttcactgggaaggaaacacacatatattggtgcactgccttcgcagagaaccatcgtaggcctgcctaggagtgctgtctttggtttccagtgctgctgcagaaagggccactcaaatggccaaatataagaaacgggcaagagagagggagaggccatgtaaggacagaagaaggagacgaggtatgttcaaagtatttcaagttactaggagtacaaatgttcaaacacagtcttggttatcaaaccctggaaggcagaactagagcaaactcttgacacttgaaaaggaagcagttagtacagataaaaggaactgctaacttacacagtgggtagtcaactcgtctaattcattatccccaagaggtgagacaggttgaaaatacaaattgctctttaaaacgtttggagaaactggcggatggtcgattcacagtggattcttgggtagatcgtgacttttaggaggggatccctaaggactgagagcagagaggagaactgtggttattaaaagtctgggtatggtggccagaggcagcatttccagccacatggaaaacggttcatttggacccagggtgccaattctgatgctcttgtggggctgaaggaggtaggaaatattaagtgcatattctgagtagagtgaatatggcttacaaaaagtaattgctgctccctacaaatatatgagccatgtcatcagggagaaccttaaaaacctgagtttaaaatccatggggctttggaacactcttgcgatgaaatggaaggagcatgactctgtcaacagaccaggatcccaacaggcctgcacagccataggaagggtgtgcagggccgttcctactgccataagacgcagggctggcttcacctgcgtgcagcctctgaagctgcacaggccctgcacttagaagggcagctgcttggtttaatgctctgctgttgccatctggaaattctcgatactttttgaactacaggccctgaatttttatttttattttttgagatagagtctagctctgttgcccaggctggagtgcagtggcgctaactctgctcactgcaacctctgcctcccaggttcaagtgattctcatgcctcagcctcctgagtagctgtgattacaggcgcccgccaacacatctggctaatttttgtatttctaatagagacggggtttcaccatgttggccaggctggtctcgaactcctgaccttaggttatccttctgccttggcctcccaaagtgctgggattacaggtgcgtgccaccatgcccagctaattttttgtatttttagtagagacagggtttctatgttttggccaggctggtcttgaactccgacttcaggtgatgcacctgcctcggcctcccaaagtgctgggattacaggtgtaagccactgcgcctggccaggccctgcaattctattttgtgcaggcccccacaaattatgttgctggtctggttagcaactactcagttgatctaatagtggaggggccagagaagggccaaggaagaaaggccaatcgaggcagctggatccaaatgataccaggaagtgggacatgtatagaatgaacagtttcctaggaaatgggttgctccatctaagtgtcatacacaggctttgctgaaaacatttcctaatgtcagggaatcagccaagagaaaccaggcctgggagaacctggggtgtacttgacggtgctcaaccacctgctgcatggccaatccatgaatggaatcatctaggaaattccaacatcatctagaaaagagaaaataaaattagccttattgggcctggtcctgagtggatgtttggaagttgaatgtcagccttgccccagacacgtgtgtttttcagaaatattcttaagtaatgacttaagcttatgacaagggccactcctgagttatctgggaagctcgaagagcctggattctggatcaagggtgaagacgatgaaagagggaaaacaaagaccctcacaggagtgaggcgatgcccctccgctcctctcatctctcctctgacggctctgaagcaacatttctaacaagcacttcgctcttggggccttggcttttccattgccagagcaagtcaactcaaatcctccttagaaagcacaaaagcgctgattcagttggaaaagtggggaaaaaaataccactactgaaataataactggagtgctcatattgtcacagaagtaattacagaagaaacaccaagattcggccccggaaattttctaaagatgcttctgcctctataaaccggcattttccagctgacagagaaagaagttgctataaattaggacgagactgtactaaaggaaatcctggattgcaaggctgtacccggttagaaaatttatttatttatttattttgagacagagtttcacttttgttgcccaggctggagtgcaaaggcacgatctcagctcaccgcaacctctgcctcccgggttcaagcgatcctcctgcctcagcctcctgagtagctgggattacaggcatgcaccatcacacctggctaattttgtatttttaatagagacgggctttctccatgttggtcaggctggtcttgaactcccaacctcaggtgatccacccacctcagcctcccaaagtgctgggattacaggtgtgagccacccaccatgcccagccgaaaatttcaagtatctcaataaggggtcccctgcgattttcttccctttcacttaactgtgttctcttttctctctcttttattttgatttgttttgttctgttcagaaagttggttctgttggggatatattcctccaggagttcagggagagaccactccttcctagccaaggacttcagaggtgtgccctggcccactggccgggttactgctttgcccccagccagaatctgacgtatctgggatctgactctgactcccacccctgctcaaagccattggtccttagttgattggaccatggtgggcacttgacctggggcagccaacccataagctagccagtgtatgccctggcacaaggaaaggtgggccactctcaaccctatgaaccagggcccattagcagggggcaggagaaatcagggtcatggcaaactaaagccccatgcaggcagggcccccaggagctaatttacccaggatgcaaaggggagagcagcagtataaaggggaatcagttgcccagaccgcctgaggcctgccagctctccattctctatctggtcctcatgcatcccctatatcagccttctagtccttgaaggatgaaggaagactttccaacagtcagcgctgagcagctctgcaatgggctgcctgggagtgagggtggggttagggaggaaagtaaatccatcatcagaccagacgcagtggctcacgcctgtaaccccaacactctgggaggccaaggcaggaggatcacttgagcccaggagtttgagaccagccctgacaacataccaggacgcatctctacaaaaaaaaaaaaaaaaattgctgggtgtggtggtgtgtgcctatagtcctagctactcaggaggctgaggttgagcctgggaggttgaggctgcagtgagccatgggtgcatcatggcactctagcctgggcagcagagagagacctgtctcaaaaataagtgaataaacccagcagcacatggtagagatgttctagggaagcttcagagcctcctctgatcttgccattccatgagtctgtgtattttggcaggctggtcagctctacatccatctctgtggcctgctgggggaaacaccttgccatccttcaggttgagaaatccattctcaatatcacaggtattccacccacagtcattctgccctcatgccccataaggcgcctctcgcctccttaagccactatcaggcattattggtttagaaatctgtcctctgatcagatcgcaggctcatctggacaagctgctcagctcctctctggacctggcacgggcctggcccggcacagaatgaatgcgcgaaatgactggcgtggtcagccaggccctggatgggcaaccttctgctcctgtattcctgcttgctggggttgggcccgcctaggggatagcttggatggcagagactgggacagccgctaagtgggggtacatctaaaagagctagagatgccaggagaaatgtccttcttctatgcggacctccatctttgggctgtttctggtgggttgcttctcctgtctgtgtcctcagaatgccaccctgcatacactgtgtgcacagatcagggcatctgtctccctcccatggtcagtggcctctcacaggcatcaggggaggctgcacactgggaggcagattgggagaagcaacagcctggggagtcccgggccccagagttctggtcctgcacgaccagggctggctccttcctctccctgtgccaccttcttttgagtggaaaaggggaaatgtggctcttagaagtaggagctcctgcttttaaaggcactaaaccctggattgggagagaatctggtggccttggtcaagccatcatgggatcgtcatcaccccattctgagaaatcgcatcaggttccctcgccccaccctaaacctaccttttcacttggctgctgagcctgtgataactgaagtgtcaccactgcgatgcccacagttctccttctcttggagaggagaaggccagggtgacagggagtctaggtttgcaccccaagccaagtaagaggttgtgtcactgatccccaaagcatctcaactccactccctcatgaggttgaacccactgggcccggagtctccagttccctgcccacatctaccatggcctcacagtggccaacactggtgagttgcagaaaggggactcaatacaaatgtcaccaaaaacttgtagtgtttgggtttgggccaaatagagattgcctgtgtagagacaatggagggtcataaaggtgacataacaaagggggtcctggcagggcacgatggctcatgcctctgatcccagcactttgataggcccaggtgggaggatcacttgagcccaagagtttgaaaccagcctgggcaacgcagggagaccatgcctctacaaaaaatttttaaaaaataaaaaaaaaggggatcctggtaaattggtcctcaagagaaatcacttccatcactgtgaatgatgtgcatgtccaatccacacccccaaaacaagtcatttttctttacgttattccttgactatgcagaaggtgggcccatccctctgaggcggagaaaggaagtagaggaatgtcagcaagtcatgttcaaaggtcaggggccctggggcagcagggtcagagccgaaagtcagatctgccatcctctcccatcctaccctggcatacaacgctttaaggtgtcacttctgctttagagatctctatatttaaaatatatccttggaaaagagtcttctactctacctccatctttttctctgctctcttgaaatctccattttcttggagattttatgaactctgtctagttggaaattcagaacaccatcatggggtggcaggaagacccccaagggacaggagatcctggttgcagttctggttttatccctaactagctgggtaacttcgggtctcctccttgttaagatgacaggctaggtccccctctgcttctcatatgctttactttgaaggctaaagcagcctgggtttcatgaggcaagagagagtcaccaggcagccccaggaagtaggtccatggtgggggagggtaaaccctagcccctgtccccttccctacaaagatggttgtcacccctaggaacagcatcagggaagactgggtgagtggaggaagctgaggatggtctgagttctacgtgtctccttgagcaaccctgctcaaccccagcccccaaaatgctccaggaaagatgcctggacctcaggtggcttcgagagaatgctcagaacctgagcctgccactctcagtgggggtaatcgctgaactctgtgagccaaacacctagaaagagctgaaatgactttaaatgcctaaacattttaaaacaaaccttacaacacaaggcttttaatttttttttcttttgccccagtgctaaagctctctctctctctctgtcgctttctcttttggggggaattcaaaagccgttttatgcctcattacctgcacactgtgagtgatgtctgtcggtccatgtgctgtaaataccttaaatcatgcttcattaagaatatctatggtgctattaaagagctataatagacaacgagttaacagatgattaaagatgaattccatttgtgtcagtcaccagccagagagagacgagaggctgtaagttctcaactcattatccaagggagtgcagctcttcctggatttgtgaggagtagggaggcaggggagggttgtctgcctgccgagagtggagtatggggcgagcagggtggtggcgatgtgggctgtgccaggggaggatgagtgtgtgggaccagccaagggggataggggagaggaaatcctgtgcaggctcagagaaggggaagttgtgtgtgtgcatgtgtgtgtgagtgtgtgctcactcctgtgcaggtgtgacaggagctgtgctgtctgacggtgctgtcagctctgcctggctgttcccatgcacatggtcaaattccacttggagccataagaaacagatcaatttttggtagccagagaaaaagaggcaggtgggagggaggagagagagttgcaaaggtggagacacaggactcttagtagtagctgtggcaaggagaaaggaaggagaaatttcctttcttctgctgtgttttcagggaagagacgatgatgagtgtcatcaagaagacaggcagttggggaaaaaggcagactgctgagggagcggaattgtttccctttgaagaactatccgataaagacaaacgtacactgtctagtctctaaactcttctcagaagcactagccaccatcattcagagagccagataaccttacactattttctcctaatagagtccagtggcaggaatctggaaagcagcaagtaccagctccaggcagcatgtccatggagcaagagggcaacccccagcctctgtccccttgagatcttaaagtgcttgggactctcagttctgtgcttgagaccctaaagacttcagcaagaatggctgggtaaggtcacataatgaaatgaagatgaacataaagcagttctaatagatgacttcagtattctccatggctattaaacttattcatcctttagaaggtaattattctctcattttacaaatggagaagctgaggcactgagtaaaaatagattatggctaccaatgagttaatagatattaggtgccttctactgggagatgcgtttctggcatctaagacctggttcttgccttcaatgtgctttacagtatagacaggaagtggggcgtcccactgcacaggcagggaaaggaaagctaccgacctgaggtcagttagagggcagaaggagagggtggaagacatggcaacttggtattagcagccttggttgaatctgtgtgttactttgctaatgataacacaccagctcttcttagcaccttctgacccagacggtgtttccgtgcccactgccaagttatcctggctctgctggcaatgctgatgtgtggcattatgtgattcatgtccccagtgctgctgtcgcattctctgacatcctgggtgtcacctgccatgctgtcttgaatatgctacttggcctggggtgttactacaactcttcactcttcatatctactttttatgcaaataaaggttaaagatgtcaaaatctgatgcttctgattcctttcacatacagtcaactcaagacattcacatgtccatggctttaatctgtcatttgttgctgtggaatgcaactggtttgtgagtggggttgggagagaggacctcagtgtactccgtgaaggaggtggcacatgtgggcatttggtaaatgctgggtggaaagaaatagtgatcaaattagggtgggggcagtgggcacagaagagcttgtgtatgacttgtgtttcacagttcaccaaatatgtccacacgtaaggactcctggatcccccaggagccctgtgatagaggaagatatcatcctactctttaagaaaaaaaaaaaaaatccgtggcttagaagaaataaataatgggcttgaggacttggccagtgagtgattgagctgggatgattcttgttcttcttcttactgcaatgcctcccctggtttagggtctgagttgatgagaccctcctgaaaacaatggaaaaggtgaacaggcaagagtgaatgggaggaatgcttgctggccagcatctcgaatcaggacaaccagtcaaaagagactgcctgatggtgggaagggactgaagagggactggaaaaggaacaaagccaggggcttcttggagcaagctggtcttctgggagaactgggaagccagagagcaaagtcatgtccaaacagccaggtgaggcgggagctgtgatagggctgggcagcgccactaggaggggttgttcttggtctgaaaacatctccatggcaagcgtgtgtgtgtgtgtgtgtctgtgtgtctgtgtgatgctagaaagagcaggggctatgagcctagctctgtctgtggaacctgccatttgtgacttctagtcttagttcttcatttatatgatggagatactcatccttcctcccaacatggtttgaaaatgaaatgaaatccggatgtatggagctatgtctaggcgcatacgcaggaagactgctgcatatagtcagtgttactaacagccacagcctctcaggacctcagggaggggtaggaggaagggcctctcattgcaatgtgatccaagtttagaaaagagttggaatagacttgggttcagacacggcttcatgccatgtcccacttccaggaaaagaaacgggcttgttggaaaaagaaaacagactcagaaagcatcttgggcatccaacagttcttaggaaacagcatttgggcaaacatcattgaatcagcaacacttggatccagtttccattgacagcttcacaaactgaagatcgagaggcgggggacctggaaaggcagcctctttgggacaacatccaaatggatcttgccctgggtgacagtctccactcctttcctctcctccacatttggcttgcatggtgcctctagtaagttctaacatgcaggactccacggagactcctgggcttctggaagacggatgcgaaagacccggagcccaaagccggaacatctggcttgagttccaggcgcaccagttattggggcactgaatggcctttctttgtgactttgcattccagttccttctgagtcgattcttgagaaggaatatactcccatcaaggaagtgctttggggccctcagtgaagcctacttaaggtacacacttgggattttggaactagatgatgagacccagagatcatctggtataaccttattataggacagagaaggaaactgagctcaggaaagctaagcaacttgcccaagaccacacaggaaaagcaaggtcttctaactcatgttgcggtgctctcccagggcgccacccaccacacattagagttactcgggtcctcacacctaaagctgacaacgagcagaaaaatcctctctcttttgcttatcagaatcccattacccatagttgctgggaaaagggggcattaaatagttccccagaaagcacaagcgaggacttggggggaagagggagtgtgtgtcagccctgataattgaatctcggtgcaaagagacagccggatgcactgcaattgagttaagtggaaaatggcattttcgtattgttaggagccttctcagcccaaggccctgatcatttactccgagcacctggtggtcttgcagctctgaccccagcgcccagctgagccacgggccagctgggatcagctgtgtggggcagggaaagaaattaattttcaatccctggggactgcagttggtagctcagcagccaaggattacacagacccggagagaatagggcaccatccctctgggggagttattgaactcccaagtgctggtggggaggtggcaaaggaaagagggagaggggttggaacagtttttattgggaatcccatcactgagatttaatggacattctgttgctggagatttggtctcttgccgatttctcttcccaatatttaatttcaaactcctgccctccacctccaaagcgtcagcccctagagtacagaagaactgagtttcttgttcttctttttttccctatctgttgtagtgaggcaagaagttgctttggcagagcgaccatgctctgattacacgaacacatttgcagattccggcaccctcccatcttcaacgaccatcccaagagcacaaacctcctgatttctttcccaaacccatgtaaaaaggagcaagcctgggtctcctttccctccgagcccaccttttctagtcgttggtaaatgaacagcagcgagaaacacaccacaagagcgtccaaccagaaagagcctagaaaaaatctgtttcccaacacaaacttggttccaacggagtcttttgtgagtgtgaagaaaatatgaattatagttcctggccgtgcaaagtcctcactaaaaagaaaaaaaaaataagaaagaaagaaaatgctacatctgtttccatttcagttgctcacatgtttaaatacatcgatgaggcatccgtctaaatttaccaggtcctgagcaattaacaattaaaaaaaaaagactaaaagatgatggcaacgtttgaaaaaatgcaaaatgctaagatgcgtgtgttcatgtgttcatttctatcacactgcattcctttgcaatcctggcactccaggaaaactggagcaaggcctctaaaaaggaacagggcatcattagcgcagccagatccctatcttagcctgcagcaattaccatgcttccaagcgagctgcgaagcgctttcattactgggggactgaggggtcactcacctccagcccccatcttgggctaaaacaagcattttccgaactaagcattccagtttcatttcaatctgtaattgctttgatttcggtatgcgtagaacacggaggcttcatgaccaagaattttattagtcaataagtttgctactgttatgaatcattagccctcattttactcctttcccacactggcctgaaccagtgtgacagatttcttttgtcctcctgtggggaccagtgaaaacaccctgcaagaccacctgttccagggataattggtttctccaggtcacagaggtgggataaaatcagtggatgtaaacctggagcattatttctgctttcatactaaaggaagtcaatgccgggcactggagtttactgcaaagttcttacatttatttaaagttttaaaattttcaagctgcttaatatctattagctcaaagccctgtgaagtaagtaggaaggtacccttcttttcagagagagggtcaaaaagctgctgatcagagttaggtaggaatagagggaaccagggcttcctgcctcagtcctgaccttctttcaattctacaacttgcctcactgcaaattcccttcacaggaggaaatccagaaggtgagccattagggatacagagctcaaatcctggactctactattgcctcctggaagtccagcactccctctttgggcctaataaatgacagcctgagtccatggatggttctgaccaggaacttgtccggacgaaggcaaagaaacgcttcctccaggccttaggaggagttgggatctgcagatgaacagatcacaggagatgcatcttggttgggacaacaattatgccaactgcttattgtttttgataaactggccacagatcctagttagcaagaacaacaaacctcaccaacgccagaatccagagaccatgagaccaaaaaaagaaattcatataagagaaaaaaatgatccatccaatataatcagtgcctgcaatgctgcacacagataggtggtctcacagcctcactacttaagaatcccaatgcatgactccaggtgctagaggactggatatggccctacccttcaggaatcgactgagttacaaagtggctttgagattggcagcagcctctaggtaagtgaggagctttgctggtgttcattttaactctaatttccataggagatgaaacctgactggtgacttcctttgtatttccctacatctgccaggacaaatctttttgcagagggctcaccaaaatatgtatattcactacatatctgcttctgggacactatcaggtctggcacccactcctcctacacaacatgcatacacaatagtattatagggggaatgataaaaataagtagtcttgccgtagggaccagtctcaggaacgtgcctggtggaaatgaatgtaatagtgccttgataagagccaggaatacaaaccacctccacgactgccagtaaaggacagagagataagcaggggctggggcaatgagggagcaaaggagttaatgtcttttctccccgtcttcacttagggaatttgaattcttgatcaagcgatttgtcaggattgttgtgtatttactgtaattacagaacatcaaatgtgcattgacgtaattaccataaatatgtgtaaagacattataacgtgtaattatgtcatataattctttaataaagcatgcagaagaaaaattactctgcacatgctcaatgcatatcttctcctgactctttctactgaaggttttatttgctccctccccctccctcttttcaaattccagagacagtttctcccatttaggattaactagcagaagggtgagattagaatgtgtgtgtgtgtgtgtgtgtgtgtgtgtgcgtgcaagcttgtccaaatgagtgtgtatgtgtgagtatgcacgcacacacacacacacacacacacacacacacacacacacacacatgcaccccaggaaagaaaggcgttttttaaaccctggaagacgtaccatggtccaggtgtgaacagcataccagtcttacagtcagtgttcccatggctgacacagaagaattctgtgatccaagatcaactcctcctctctctctgcgcttctcccacctgtaattgcctgggtgacctgtgccctgcatggggtgaatgtgtcggtgcacgggtcacaccgtgtagtgacactgagagctcctgggagagggatgcttgggaagatgttgacattactgtgaatgcagggaacttttgtaaagatctgaacaaaaagtaaaatcccccagatgagatctctaggggtgttcaagtggagcccagattgtcaccaagactagaacacatttaaagtccttccccagccctcagagagtctattagatgtggggtctgtgtcatgatctgtattttcacatcccttcctctggccctgcaggccttttggaggctgtgcacccctgaggttaagtcttctgcagagaaaattgctggaagtattatgtccctggaactcagcgttaaatcaaatgagaaagaatgtccttatgcgtggggaagaccttcccaatgatgatatcaaaatcaaaattataaaggaaaaagacttattagactatgcaaaaaggtacaatttctctacataaaaataccacaaatatagtaaaaagcagccaggcatgatagctcacgcctgtaatcccagcactttaggaggccaaagcggaagaattgcatgggcctagcaatttgaaaccagcctagacaacaaagtgagaccccatttttacaaaaaaattttaaaaatagccaggtatggtggtgcacgcctgtattgccagttacttaggaggctgaggcaggaggaggatggttgagcctaggaggctgaggctgaggctgcagtgaaccatatttgcatcactgcactccagcctgggcgagggtgagaccctgtctcaaaaaaaaaaaaaaaaaaaaggaaacctaatataataaaaagcaaacaaaagaccaagaagatatttgtaacatatatgatgaaggggataatatacctaatgtactaaaaagtctgaccaatcagtaagaaaaaagtctaaatagaaaaaatgggcaacaatggagagaaaaatcacaaaataaatacacattgccaaaaagcacatgaaaaaataaccagcctaatttataatcaattagggtactattttttacttgtcaaattggtaattattttaacaaattctaaaatacagtgttgatgaaatgttgacagtatgataatagaaattgggttaactttcttggggcaaatttggcaatgaatatcaaaaaccttgaaaagggctgagagaggtggctcacacctgtaatcccagcactttgggaggccgaggcaggcggattacttgaggccaggagctcgagacgggccaggccaacatggcgaaaccccgtctctactaaaaacacaaaaagtagccaggcgtagtggtgcatgcctataatctcagctgctggggaggatgaggcatgagaattgcttaagcccagaagaagaggtttctgtgaaccgagattgccccattgcactctagcctgggcaatagagggaaactgtctctaaataaataaataaataaataaatatatagaaaaataaaaaaccttgaaaaggtgcataccctttgatctattagttcctcttctaggatcttacccccagaaattaaaaataaagtcaaagatttaggcctcagttttcctgacaccaaattatttataatagtgaaagaaaaacttccccagaaacaactcaatgtccaacaaaggggaactgattaaatgaaggaagatagagtctgaactccacagaacacaattcagccattaaaaatgataggtgagtgtttgatgacatgaactgatgcactatgatgttaaaaaaaagcacaaaattataagccagtctgtgaagtaagatacaattggtaagtataaaaatgtagaggaatttataccaagatattaatactggcttatcttttagtgtgggagtagggacatttaatttttttccctttctttaaaaaaaaatctgggtagtccaaatttttatagtggacatttcctactttaaaaaatgaaacctacacacacacacacacacacacacacacacttactcactcacacattttggtttaatatcctgaggcagtttacagagaaagcatctataccatacggggctccatcacctaccaatgctatacccttctctcagcctcttgctccccatcacccattccagaaaacacttgtggccagagccaagttcttgaaggaccgccaggagtggaagactcagtgcacagtatattctggcttttaagcagtgagtgagattcacagcaagcaaacagcagaactggaattggaagctaagatgacagcaggccagaagctggcctggttggtagggtccttgaacccaggactgatgtaacgagtctttcatctgaagtcacaggagaacctgaagttgggggagcaaagagagttgattctggtgggatgcagagtccaggaccaaagagggaggtggaagtgggttactaaatggaaaagccagaagccagcatcgaatactgaagcattcctcataagcttttctctctatctatctgactttgtatatgacatggttaaggcagcataccaagtcagggagcagtgagccatggagaagaacagggggcaagggatggggagcaagaggagagctgtccatgagaactacctgcaatagtaggaattgtccgtcacctgacttacatgcccctggtgcatggtgtgttgggcgatgcttcacggaccgtccatggggcaaactcttagttgttaacccaaccatctcctccaccacttttcagagcgtggggaccatggggtagaattcttctaggtgacaagggctgagacattttgttcttgctgctattataactaaggcggggtcctctccatgtcccagtgagaagggatagcttcagcagcacccacagacccagctagtcaaagagggatagtgtgggtgttgaaatggtgaaaggaatcgttcagcttcctgcatttcttcttaagttcctttctcagatgttgggcagcaaaatagtgacggcatctgaggagtgtagctgtttttagcaacgtggcttaagaaaggagttaacatggccttaatgaataaccacaggttaacccttatcatcaatctcagaatgagaatttccttcttctcttttcattttggtaaatgcagagataaggagcatacagaatatatcctcactgtcaaatgcttggccccagcatcctgggaaaatgcagagtattaagtatctcatcctgttactcagatttcaaagtatggcattctctctatcccattcattttctcaatattcttagaaagcaagaaagggataattagactcatcttagagatgaaaaaactgagactttgagatgacaactgaagcctaaaactctcatgttagataaataacagaggctgggcctggtggttcatgcctgtaatcccagcactttgggaggccgaggcaggtggatcacttgaggccaggagttcgaaaccagcctagccaacatggtgaaatcccgtctttactaaaaatataaaaattagctgggcatggtagcgggtgcctgtagtcccagctatttgggaggctgaggcaggagaatcgcttgaacctgggaggcagaggttgcagtgagccaagattgcaccactgcactccagcctgggtgacagaatgagaccctgtctcaaaaaacaacaataacaaaacagaactacacagaagggactaccttgtggtcatctggtttggactccatttagaagtcagcatggcacgggtgtccccataatacccaaacacttcaaaaaacccaacatgcggaattccaagatgtcatagaccagctcatttctactttcaataagtaaacctttgtcttaggctgagagaagcccagcctataaagcaaactacggcagcacctatctaccagggagcactatcacatggccatcagactccccccgtggagcctgcaccccaggagaaagtcaaagatggaaaatccaagtggcttctgaggcagagccagtaattcgccgagtgttgagcttgcagcactgaggttgcttacaactattcaattggaaaaaagtcagactcatcaggctggaatctcattagtttcccttagtgagctggagcttgaatactccagggggatcagtccaaaacaaagccagcagaggaagcagccagaagtgtccaggtgcagtgggctgtctctggcccaggtgagatgagcctcgggacctatttagaagaagaggttgggttgggatagaactgagatagcagcttggcatactggcccacagagtacctgtgacggctgtctagtagccaagattgagaatattagaagacccacttcagcaatgtatgaaatcaaagcccacattttaaactccacactccctgacacggcatttgaggcccatctggtctccatcttgcctcatctcctattatgtccctcctcgtactttaactttgggccctatcagtccagcatcctttccttgcatacaacctacactcttatgcctctctatcttgccttacatctttgtttttgtagatcccttcccaatctttttaaaaaatattgtctttgggaggctgaggcaggaggatcacttgagcccaggagatgtctgtccctgggcaacatagggagaccccatccctacaaaaaatttaaaaattagctgggtatgatggtgcacgcctaaagtctcagctactctggaggctgaggtgagaggacctcttgagcccagcagtcaaggctgcaaatgagctatgatcatgtcactgcactctagcctgggtgacagagtgagactccgtctcaaaaaaaaaaaaaaaagaaaaagaaaaaaaattatatatacacatatatatgtatatatatatacacatatatatgtatatatatatatacacatatatgtatatatatatatggtgccagaatacacatatcatgcaatttgccatcctaaccatttttcagtgtccaattcggtagtcttaaggacattcacgttgatatgcaactgatctccagaatgcttttcattttgcaaaactgaaactctttactcattaaacgactccctcttccctctccccccagctcctggcaacaaccattctgctttctctctatgaatttgactcctctaggtatcctgcctaagtggaatggtacagtacctgtctttttgtgactggcttatttcacttagcataatgtcctcaagttccatccatgtagtagcatgggccagaatttccttcctctttaaggctgaataatcttctactgtgtggatataccacgttgtgtttatgcattcccatcttttttgccctctcaaaatctgactctatcttcaaagcttaaaacccaggatacgtactccgtggagctttcctcaagaccctccgttacaagttagtcatgtacaaagatcttttgagcatctgttccatgctaggcaacagggacacaaggatgagtagccacagtctctcctgcacggtccatccaagcccagcttactgagcacactgcaggtgactcggtgacagccctgactgtccatgttcatgacacactgtgctgccacgaggtctacttaatggtttctgtattagtcatctcatttgtaagctcttgaggacccgggccacatctgatctcagtatccccagtgcccagcacagtatattcaacatagaaaatgctcaataaatatttgttaaaatagaattaaatttgcattccttggaacgtagagcttcttgacttctaagtgactggccagttgacacaataagctggaagtcagtgcccacttattgccagagctgttacttggtttttgtccagggcctcaggttttgattccaagccttcaccagtggagtggggaattttataaaagaatttcactttagcctactgaagtcagcagagggagaagtggaggttcaatttgccctattacagctaataataatagctcagacgttttgtgctctttccatgtaccagacttcccaagtgctttccatagactaattgaatcctcacaacaagcctaagagataggtttttagctaggataaataaatatcgactactatccccatttcgcaaatgatacaactgaggcccagagaggctacacaccttacccgctgaatacagaggaaattaagtcatacggccagaatgcaaatgcaggcgggcaaactcccaatcctatgctattctcctggactttctgtggcaagatttgacagagattacattgagcagaactcactggagaatctctttaaaacattaaaagggggcctgaccagggctctctgatgtcagggatctattttctgttttggctctcgttctgagtcttgcagcccatctggattctgaatttccttaggtccaaaggatgtcaacttgattaaagagaaatatcaagaactaagaacttctcttgacagagaggtatggggtaggggtggtggacaggagaaaatgaaaagaaacagaaaatgggttcagttgccacttataataacctagtctcaatcttgcgctttagcgataagatcttaggagcaatttgtgaggagagtttgagcggcatactggttggatcgggagcacgaagtcattctctctgtccccgctaagtctgaaccctgaattaatttctcctgcatgtttagctagcaccaagcgagtgatgccaacacaaaagcggccgcttgatcaggagtattgatggggagaagagaaagaaaagatcaaaagcactccggctgaactgaaggtatggggtgacaacagatcccagagaaagctggcagcattgttcaggaggccacaggagtcgggggcctgggatccatcctcaatcttcccctaaccacacaagtaactcaatctctggatctcagaaaaattcaagctggaattagtacccccatgatgtcttccagctataacattctatgattccatagcctagccaattacctacaggagtatctcgtctgcataaaaaatggaactgttctcctaagtatgttttcctgccccagaagagtgattcagcgattaatgtcagggtccctgatttcctccctaagtatctaagacttaagggaagggaccaagggaagacttcacaggatccgaaaacagcaacttgtgtagatcagccgggagaggagctgggagtacagtcataacaaggataggatagagggctctggcagtattcagagtaattaccatttattgagcatttattaggtacctcacaccattctaaaggcttaaacacaaactcttttaagcttcaaaggattctcatatatattcaatctataggtgagaaaactgaggtttcaaaaggctgaataagtaagtcacaacctccctatggccacacagctagtaggagtggaggtactgaggtgtgagcccagaccagggcccaccctcataacctttttttttttttttttttgagacggagtgtcgctctgtcacccaggctggagtgcagtggtgcgatcttggctcactgcaagctccgcctcccaggttcacgtcattctcctgcctcagcctcctgagtagctgggactacaagcgcccgcccccacgcctggatgatttttttgtatttttagtagagatgggtttcaccatgttagccaggatggtctcgagctcctgacctcgtgatctgcctgcctcggcctcccaaagtgctgggattacagtaacctcttcttttattgtcacgacagactgggatttaatactggaaagttgaccctggatgctgttggcagtgaaaggcggctgtggaaatgtccaggcacaataataacagcatggagaatgagatgcagaaaggccccacattcctgctgccccagtagacaaagctgctgaatgcaggggagtccctcatgctcccttcctctctgtgtgtcctaagggccattatccaagcccatcttctgcacagctggctccaattggaacacaattcaggtgttcaaaaaatgacactataattttttggttggaaagcagaggctgaaactggtaaggaggcttcctacagcttctgaaacctcagtcatagatagttggcagcgttttctgatttatggtgaagggcgtggagggagggttagcttctggctgaagtgtgcatggggcttttgatgaggatgaacagtggttagggtcctgcctccctgcatccttctatctctatacgcctcagataccaggagagtattccccaccccttctcactgctctgatctgttcaacgcacattcattcataagctcagacaggcgctgtgtgcgtcgttgctagttgccatagcagagacagagggtgggtctctgccctccaggagtaccaagtgtccagcacataagaaaaaagagttccatctgagcgatgatacctggctgaaggactagggagatgttaggcctgcctaacagcatgctacaggagaaaagaaggatgtgtcactctggatctccagttaaggaactgtcaaatgtttctcaaatgcacgctgtcctctccaagacacttctccatgatgtctggtccggacttttatcatctcttgccccgactactgtaagggcttcctaacccatcaagcctaccctcctcacagccaccagaatgatctacttaaaactccagtctgaccagatcatctccagccccgccttgctcctgggcacacagaacatcttcacctccaacttcatactgcttttttctgaacctcgcgcttttgttcgtgaactgctctcaggccccctgccttttgcatgattaattccaatctcaattatagtctcagctcaggtgtcacctaggacaccttacttgattataaacaggacaaacacaggaccagccccttccctccctccttgcctggagtgagagttctgtgcccttataacattctcggcagaaacagctctgtgaggccacctatttgtattgtgatgatctgcttctaggctcacctcttcagctctttgaggacagggactgtgtgacctctgaacctaacccaggacccagcactgacttaagaggaagtgagaaggctctggtgaagatagaaccaccaatagaccataggagacgaggggttctgtcccagctgggtcccatccgcatatcctaaccctatgcctcaatttcctccaggagaaagcttgggggaggggtgaggagaagcagtaggaatcgaagtgactcggaggaagcggcttccattcattagcatttgtaaagggctctgagcgctgcagatggaagctgctccgccaggcagcttgttaggactaaaaatagagttgtgtagcaccttctcggcagagctcaggaaagggcggaaggggtgagaaaataggtagccagaggtggaagtagctgaccaagtcctagcgggtagtacgcaccacagtaaaacaccacgggggccgctgggcaccgccgagcgccaggctggtgaactgacccgcagcgcaccccatctgtgtgggaaggtcggggcaggggacccagggcgggatggcggtgctggaccccgatgaggccccttcacggccactagggggcaggagtgcggggcgggcagcacgagggggcaggtgtgaccgtgagagagggaggcaggcggcgaggccaaggggtaggtcaccaggcggggacctgcagggccagacgccgagccctggatgcgaggtgggggtagacagaagggctggggcggcccggggaagaaccagtgctggacggggctagaggcccacgttctcctgtgactcaggtctgactcaatgccatttctgaaacagcctggggggcggcgggagggggagggaaggtgtttttgcgaaaatgacaaaacaactccttgctcagggcagcccgggaagagcggcgggcggatgggaattaccccgggtccccctgcggcgtctcccgctgcccacccacgggcggtgacggtggcggtggcggtggcggcggcgggaccccgggcctggctgcgcgctccacctgcgcctccagggcgttgggcgggggccgcactttccccgccgcgaggtggagcgcgccaccgcccccccggccgcgcagcgagaaggagcctcggggaagagctaaaaaaggcaaggcgctgctgccggtgccggtgccgcagccgccggggaaggaattccctccgcccgggcgcacgcggccccccgcccccgccccatcctgctcagaaaagcctcggatgctgcccgggaggaggaggcaaaggaagactccgttccagccacctcccgccgcccggatcccagaggaaaggggagaggaatctccccaccggatctggtgggcggaagatgggccacgcgggaaggagatcggcggccactcccgggggcgcgagcggcggcgcctagagggacccccaccccgggctcgaactcccgacaagactgagcgcagggcccaccccggctgtcccagctcgggcgccccaaacccacagctcccactcaggacacgcgcctcgaggtgtggcccggcgccgggcggtgctgcccggagagcgcgcagcccccagccggccgcgccagcgctgcgcccactctgctctcccaaacccagggcgtcatcggctccacgcctgtcccctttcagagccagagacgagccccaagaaatcaggaaataacttcacttgccaaattttagttttcagagcaattccacgacaccgtcttgcttgtctcacagtcaccctggcgtctccatttgacaaatgaagaaatgggagactaagaaaacttaattatcagcctgcgttagctaatatatgtacgacacaaggccacgcaggccaatcttgggtcctgtggttcagaaactttcatctggtccttttcgctatccttctccggggtcttttcaagcatttaacattttggggatgcctgttttgtacccagcaagacgctgaggacagagagatgaacagccactctctgacctcaaggaactcacagtccggtgagaaagagagaaaacaaaattacagattaaaatatgctgtaaaccacactgttctaaacacggaaacagattcggtaacttctctaggtctcaatattgtagtggtgccaccaggatttgaacccagacagtctgactccagaggccacccacacataaccactatactaaactgcctcttttgtgcttaactatatagccttaagggggtggggtggggggaagcaaatcacaaaacagtatgtacagtatgcttccaattaaaatacatataaacacacaggaaaaaaacagaatatatgtcaaaatgatgagtgatttttgttttcttcttttttttttataagcgccatatttttcttcacggaatatgaattttataataagaaaaaagcaataaatgttattaaaatacagcttgaatgcaaagcttccaaaaggtggtgatgtgtgagtttgccctagtggaagtggaggagctagtccggctgggagatggggaaggggaccccaggaaggagaactttgtaccccagctgtgcaaaggatcggcaggagcatagaggcgggttgaagaaattgcaagtaaatctgtgtgataggaacgaagaggggaaagggtgcaggagatgaggcctcaaatcacatttctggggaagcccctcgggtagagaattccagacccctaacattatcctaaaatctgccctttcccttgaagacctaagagagccatcccagagtgggctgagattcctgaaagttattattgtgttataaatctttttctatctttggaggtgaaaaagctggatgtaggacattagactctgtcaacatatttgggtcagaaggtgccaaagtgctgggtggagatcatcgaggatgggctgttaccatgcacattttcattaatcgggcccgcttcataactcaggtttactcttgctcagatccgagcctgcgaagatgtcgtgtcaataaccccccagcccttgtgccgttctgcccatctcacagaggtctccttagcacaccagcttattaaagcactagattttcaggttgcggaaggcaggtcttgtcctccacacctggcccagcttctcaaagtgccctgggttccccctttccatgctggggaaccctggacaaaggccagttcactgcccttccccctctggctccagccttcttggaaacaagcctgacccctcctccaaccccaccccaagagttgcagcattcagtgcacagaatgcagactagcagcttctccgcagattctgagttccaagctggaaatagaggggcctttgctcacgtcattgcatgaaattcaccatctgccacttcaacaagagagactcagggatgttgaatgtgaaaactcggctcttgcttgggcagttgactggatttcagggtgaggaccacatctggcatgttaaccctgggacctgggttaccaatattagagatttggcctgatacttgtccaataggtgatgaacccatagttacagatctccttttaaacagtcacctctgtgcatgcacagaccgtaggcaataggatctagcccagcccggctggcaggggtccagggtagatttggctgtttgataagtggctgccgacagagttgaagccactgccccagatgttgggggttgggtccccctctgtttagctgccttgtcagtagagagggaagacagaccatgaggagccattgtgagcatctttgcaggtcagaaatgtctatgcttttgctgctggagacgggaaaacacccccctggttttctcttcttactgctttttagtagtgagcagtcaaggtgtttggggatttgtctttgtgattgtctcttcagtgtgatttttggtagcctggatttgttcgcctgctttcaagcctccagggagtctcagaaaagctgctttcctctgggtgtgcccggtgtgtgtgctgcctgcctgcattctctccaactccccagtaagtcctgggtagaggtaggggtgggaggaattgggttttatttttcctttttattccccacagaactcagcccaatttcatatacacaaacaaccctgaactctaaacccatctgcccaacatctgtgtgcctgacctctccagcaggatgtcaaacagtgtaaacaaaacatgtccccctgacccctaaacctgctcctatccctctcaactaatggcaactacgtccttccagtggctcaggtcaaaaatttttgcatcatctaggattcctctttatctcacccccatatcgaatctagcaggaaatgctgttggctcaatatctgaccacgtctcaccgacttcacctcctctgtcatctcctacctggattatcacacttagcctccttccttccttccatctgggcatcctgggcagcctgttttcaacatggtggccagagaagtcgtgttcaaacctaagtgaggtcatctcgctcctctactcaaatccttcccatggctccccatttctctctgagcaaaagccaccagaccctacaggatctgcagataccaccccaaaatcatcctacatctttctcctccacgctactcattccagccacactggcctccttgcagttccttaaacacaccaggcactcccctgcctcatggcctttgtactggctggcccctctgccttctttctctgccttcttggttccatcttcatcctctttgcttaaatatccctttctcagtgaagtccactctgccatcctatttatgttgtaaatgtcccctgtgccagtgcctcttgtctcccttgttctgctcttacactggactgggttccagatcgctgtatggtatacttgtgtatgtttttccctatatatatttatgtttgtttatttatttttgtgtatgtctcccctaccagaaagtgagctccacaagacttggggctttgtctcgttccttcacagatgcgtcctcaggacttagtgccgggcacagtgcaagtgtttaaagaataaacaaatgtgggttcaaagtgaaaggtggttacaggctcatggactttccccaggaagccatgctcccccatagctgctcttgttttgggcacctctttcataaggagctgtgaatctgctggacacacaagaagagggaacaaaactgaaggaggccacagactgggagaaaatacccatggaaaaagacatacttgataatggactgggatccgaaacatacaaagaactctgaaaacataaccataggaaaatgaataacccaattaaaaaatgggcaaaagatctgaacagacacctcaccaaagaaaatatacaggtcccaaagaagcatatgaaaaggtgctcatgatatgtcactagtgaattgcaaattaaaacaacaatgacataccactatacacctattggaatggcccaaatccagaacactgacaacatcaaatgctgatgacgatgtggagccctaggaactctcattcattgctggtgggaatgcaagatgagacatctgccttcaaagacagtttggcagtttctcacaaaactaagcatactcctagcatacaatccagcagttatgctccttgatatttacctaaaggacttgaaaacttaggtttcaagacacaaaacctgcaccagccagcctggaacaaatccaggcttcacacaaaaacctgcacacagatgtttattcataattgctaaaacttggaagcaaccaaaatgtcaatgaatggttaaatgcaccatggcacatccatgcaatgaaatattattcagcactgaaaagcaatgagctaccaagccatgaaaagacgcagaggaatcttaaatgcatattactaagtgaaagaagccaatttaaaaagattacatgcggtaggatcctaactatacaacattctcaaaaaggcaaaactatggagatagtaaaatatcagcagtcgccaggggtcaagagtgagggaggggatgactaggtggagcatagaggatttttagacagtgaaattgctctgtatgatattacaattgtggagacttgtcattatacatttatctaaacctatagaatgtacaacaccaagagcgtaacctaatgtaaagtatgggcgttgggtgagaatgacatgtcaatgtaggttcctcaaatgtaacaaatgcacccctctggtggagaatgttgatagtgagtggtggggagtgggggaatgggaggagtcaggggtgtatgtgggaactttctgcagcttctgctcagttttgctggggaccaaaaactgctctaaaaagtaaagtctattgagaaaaagttgaatgggccacaggtcttttcaaacagtagatctgcaggctctaaatggctacttctcacctatccagagaagcccttgggacctctgccagagaaggggttttgttttggagcaaccctcacctcaagattctcaggatcaaagatggccattgatgaaggtggaaagggaacgttctggaggatcctctacagatgcacttggacttgtttctttcctgctcaacccaggaaaataaaagaaagacttcctattgctacgcctgacccccaatcccaaagttgggtgaagcaggatcctttaatccactgaaatgctgctgggccctgggggtgaggggtcgggggtgggtggaaaaagaagcaggaagagctgggataggtgaccccggaaagcaggagcaagagtccagcctctgtctagaagcgaacatcaaacaacctactggtttctctctgacagcagttctgtcctaaggacagttcccctctaggcttgggcccacattttgcacccccatcactgttgtgggaaatgtagtttcatttctgcccatgggcactaaaggacctaggaagacctctctggaataataatagtcactacagatttagctcctcgtcctgtactaagagatttacatctattatcataattagtccccataacattctttttttttcatttttatttctatttaaataggttttagggtacaggtggtttttggttacatggttaagttctttagcagtgatttctgggatttttttttttttttttttttaagaccgagtctcactctgttgccagactggagtgcagtggtacgatcttggctcactgcaacctccaactccctggttcaagctattctcctgcctcagcctcctgagtagctgggattacaggcacgtgccaccatgcccagctaattttcgtatttttagtagagatggttttcactatgttggccaggatggtgttgatctcctgacctcctgatccacccgcctcggcctcccaaagggctggaattacaggtgtgagccaccgcgcctgccctgatttctgggattttagtgcacctgtcacccaagtagtgtatgctgtacccagtatgtagtcttttatccctcactcccaacctccccccgcaagtccccaaaatccattatatcactgttatgcctttgcatcctcatagtttagctcccacttataagtgaaaacatatgatatttggttttccattcctgagttatttcacttagaataatggcctttagctccatccaagttgctgtgaaagacattatttcattccttttcatggctgggtagtatcctatggtatgtatacaccatattttctttagctgctcattggcctataacattcttatgatatatgtatgaaatcaagtagcttgaaaatggtggagtcaggatttggacatgggtctttttaactctatccattgtcagtagagttaagtcatgtgtgtactgcacagtggccctcaggcaagagggtgactaaaatccagaccctgtccccgttgccaagccacacctcctggcctagggatgaatcaggccaagagacaggacccctttttgcagtttgcacgaaggtgctgaggatgctggctgcagccctgtgcagtggaacctgctctctgggacttgccagggccatgtgtgccttttctgttaggacaggggaaagggaaagaaaatgaaagtcttttgttcagtacgtggaaaaatgaagaggcagaaaagtgatctttccaataccttaaatgatgaaggcactgccttcaatggttttaagtcttcctgactgtttactcttagctactttgattttctaggtaaaactggtttaaaatttttgtttttgagacagagtcttgctctgtcacccaggctggagtacagtggcgtgatctgggctcaccgcaacctctgcctcctgggttcaagtgattctcctgcctctgcctcctgagtagctgggactacaggcatgcgccaccacgcctagctaatttttgtatttttagtagagacagggtttccccatattggcaaggctggtctcgaactcctgatgtcaggtgatccgcccgcctcggcctcccaaactgctgggatcacaggtatgagccaccacgcccagcctaaattttgattcctgacttccagggtctttttactagatcagggaagattagacatagaaaggggaagattcttataggcaaaattaaattacagcctaaactgagtaaattctcaccaaaatcattcttccccaggtgagtataaagagaaaggggctggagaatctcccgaagctggtacagttattggcgagactgcacctgcattggtctttttaaacccattagagtcttagttatatatttcttctttctcttcattgtcagccatggaggaaaggatgcgatgaaaagatgtcttaggagacaactttatatttttccatttacgttaagttcaccaagatagcatttaaagtaaccatgctggccaggcacagtggctcatgcctataaccccagcactttgggagctcaaggcgaggaggattgtttgaagccaggagactagcctgggcaacatactgagatactatctgtgtgaaaaagtacaaaaaaaaaaattagctgggcttagtggcacaggcttgtagtcccagctactcaatggggctgaggtgggaggatcgcttaaggccaggtgttcaaggctgcagtgagccgtgattgtgccactgcactccagcctgggcaacagagcaacactctgtctcaaaaataaacaaacaatcgaacaaagtaaccctgtgaatagagctgtagattaaacatactatactcagtgtaacatcatcatggcctgcttgagaaattaatgttgtctttaacataccgatactcatttttattcctggggagattacttgcagcttgatgggtacatgtggaatattgatcgggaggtcggggggagtcccagatcttgatcttgggggtgttaggagagatttaagagttcccccagtgtgtgaacttcaggatttgtaggattggagcccctccctgtttctctagcttccctcagctggctggttaccacatttgtccctagctctaggggcagtcagtttgctaagcaaatggaggtgaaaagccaaacccagcaaaaaattccaggtctcgacatcttggtcttcctaactagctgtgtgtgtgtggagcccatcccgcagctggggccttggggaaagtgtggaggccaccagaacacggatgccagaagccctgacttgtgcagctcaaaagcttgaggaacttcagttaaaagaaaataaggttagaatagtggaaagggaaagaagtggaaagcccctgtttaaatacctgggaaaatgaagaggaaaaaaaattattatttcaattactatgaaaatgtattttattagaagatggggattcatcattgacactcaaaagcccgaaaagcaatatcccgcactataatacccctgcctccatgcagggagaatgagttattaaattggaagatgaatgtttctcagttcagttaactgcatccgttaaaaaagaaatagttataaacttgctgtgggtcctcaaaccctccccgctaaagctgtctcttgccagcccccaaccctctgtatcttcaagcattttgatacaacccccctttcgtatttctacggcatatgaaaattcaggagtaagaaagaaaaaagtcagcaaattaaatgcaaaccagaggtttttattattattattttaaaaaaccagttgcatatagttcaattgtggcaaagtgcgacaatgtaaatgcagtgctttcttatgtataacagcttttcctccactcctatggcagcctcaataacgcagcgcttctgttctgcatgaataaatatgtataaaatgtaatgctgcaaagaaaatccgataactgaaagataccatttcttagattccgggagcaacatgaggcatcagcttttctgattctttggtatttatgtgaagagccattgaaatgataatttggaatttattattttttttcaggggcaagtaatttccagctgtccattggggctttaagaaatggaggttctggtggtctacctgcccatcctgttttctgggtggggtctgtgacttcttctctgcttctccattcagcccatatactcacagcctgaccatccttttccttcgccacctcaggactcagcctcgttagtgaaataatgaatttagccctcggagccagctgtgctttttcgcccccgagactcaggtgcctgatgagttgcaagctcaacacaattccctgctcacaaaaagggaactcactccttcctctctctaatcttgaaatcgcataggatagtattttagaaataatgtatatgtgagccccttttattttctttttcccctttcttctttttttaacttttatgttaggttcaggggtgcatgtgaaggtttgttacataggtaaactcgtgtcatgggagtttgttgtgcggattacttcatcacccaggtattaaacccagtacccaattgttatcttttctgctcttctccctcctcccaccttccccctcaaatagatcccagtgtctgttgttctgagccccactcctttttatttttttattaaaagaggaaactgcttacaaactttggcacttcttgtctctaacgtaaacacttgggaccccgcttcacagttagtcttgacttagtcccctgtcgtctgcgaaggctgaagctgggaattattagcgtccaggttgtctagttccagtccccaaggctttcacaaactggccccagcctacccttcctgcctgtcacccagcacgtcacccacccgcactgtccagaaacccggcgaagtctcaagccacacttctacttgcaccctggtctttccagatcttggtattgcattgagtcttccttctaccggcaatgctctttctagatttagaatttttagcttcaagattctgctcagatgtcacctgttcttttttttctgaggcagactctcactctgtcgcccaggctgaagtgcagtagtgtgatcttggctcactgcaacctcagccttccaggttcaagtgattcttgcacttcagccactggagtaagctgggattacaggtatgcaccaccacacatgacttattttggtacttttagtagaaatggggtttcgccatgttgcccaggctggtctagaactccgggcctcaagtgatacaccagcctcagcctcccaaagtgctgggattacaggtgtgagccactgggcctggccgacagatgtcacctgttttgcaaccacttcttcccttattaccgcagctgctaacacgtaccatgcgtacaacggtggcgtgtctactggctctgccagcctcctctagggtggagatcagatctcagcactttctgcatcaccagtgcatacggcccatggtgaaattaacagcatccagtgtgtgttgaaggactgaaaggatgaaccacccagaagagacagtatccagcgtattcttccagtgctcaggattttctttttggcctcattccaggagagggttggcaggacaatacttgggagcacttgaaaagcaagaaactcaggagagaggtcaccatccagtgatgaaggcactaccagtgatgacatgttctgtctctacctcaacttgcagcccaggggcacctcacaaacgtgcttcatcgatgacagtgtatgtttatagcgcttgtgttgttgtgaaaataaacagcacttgaagtgtaaaattagaagtaaataaatgagttaggaattattttctccactgtttaaacaaagctacttctcaggtgggacattagcttccttggagcaaagccaaaatctggcttggttagccagaaaatgtaaacacatttctgttaatgttcagggtagaaaggagaacctctcccttaactgctgtgtgaggctggactagttattcaacctctctgggccttggacccttatctttaaaatgaggctaatagtgcctccttcattaagtctttgccaggactgaaatgtacatttcatagcatgatgcttggatcagaaaagcactccatatatattagctatttgaattatgatttgggtttcagggagtttattccacccttataaacatatcaagtggacaccatgttttggtcttttctttcctcctcaaaccaggctgtgctgaatgggaatcctcaaacagccctcagcctcagggataaggtgtcccagccatttctactgtaatggctaagagccctttttgtccagtctctccctgtcctcagttgtccaggtgaggacagctgactttggaatagaaagatgatggggctacgtgtccttattgtgaatcaaaacgtcaggtccatgttttgattctgaggtcagaatcaaaccaacctcctggttggttggcaggtccttgggacttttgtgccttcaaaatgtcaggttatttgccctgactccagtagcccagcacgacccaagtactacattcttgggcagagccagccagagccaggaggcactgactttgtctctccgtagccaaatggctgggaaactagctgggaggagaggaggtgaggccagcagcttgtgaacacacgggcgggctcactgttggcagcggggaggaggctcctgggctgggctgagcccagccaccctcaccccaggggcccaccaccccacctccccacctccccctcctgttatgaaacccacggggacaaccacacatgtgggcagccgggggctttcctcgaattgacaacagcttctcgctgtcgctcggcagaacatgagctgcttacataaacactgcctcagagacacctgcagtgtgggacgcagggagtcggaggagggtggagggagaggcagaaagctgcagggtgagagaacggctccccaccccaccatggaggggccgtctgtgcatccatacactgcacacgcgtgcgcagacacacacacacacacacagacacacacgaagttggttactttctcagctgtaaccaggaggcagggaagaaggcaatgcagtcctcattctttagagactcaacctgtgtccccagccctccccacctcctcccacacccccctccaaactcagcttggctgggaaaggaaactccccagtctgctgtgctcctgcaagctgagtgtttgcaggtgaatctactccaggtacaggagcagctcctgagggaaagggggtggagggtgagcatggagagggagggggagagggagggagggagggagggaggggcggaatccctggaatttaaggttagagaatatagtaggggactggcctggtaagatggtatttgggggcctctacggaaaacacatcctgcaggtcagaccagcatgggctctgcgggagagggtggagggtcagtgcatgctcagtgggagggctctgagaggtggcaggacccggccgtgtggcagtggccttgggtttccaagtggtgctttctcacttttctgcccgtcagtttacctgacacaccaagtgactgagattgctgcctgtgagttaccctattgctcatatctaatcacaaagcgcagacaggtggggagggcttccctctccgggcctggcacctctgggtttgggtactctggcctccttcctctgggatgctcactcggactctgctactggccagcctgagcaagtcggcagagcacaggatctccaaacaggggtgcattccctggcttcatcagagaggaggcttggagctcagggaacagagagcaaactggatgtctaggccaagctggatgccaaggggaaaatagccctccttttgaaagtattcttgcattttaactgtcatcacagttaagccaccacgggcagaccctggaggctggaagagggcatccagaatgatgttgggctggtttcttatcacagagcaccgggtagggggatgagctaaaaattatagttcttgttcccagcttagcgtggctatggggcgggtggtatctcctctgtgttccttcatctctttagagactgaaagagaggacaagcccttccccatgggaaacattttactatgctctatcctaatctcatctcagagcccactcacagtgaatagatctcagctaggaagggaagcaaatatccccagtgacgatgaagaccagacatggaggtttaactgatctgtgtgaggccacagaacgagagtgtggcctcaacgctctcaatgttgacagaacagcactcaacatattgcattgcgacatgtctgcttctggactgcctatcccaccaggccgtgagcgccccagaggtgggaactatatcttagtcacccttgtactttcaagcctcacaatgggacctgccgaaaaaagggcactcagtaaacgtcttgtgaacgcatgaattggtgagtagcagagatgagatttcaagccagtggggagagaagaacacctctcaaaaggaatgttgactccaagaaacatcaaaagagggaaagaaccttgagattttccaattccagctcttcaatctacagaagcaactgaggtccagataggatagatcacaggctcattcccatatagctaattggaggcagagccaggactaccaccgggctattgtcaccacgttatcccacgagggtcgagggtcggggaggacagggagcctgcccaggggtgcttcacaccgggggaggtgtgatttcaggccttaaggcacacacacgcttgaaaataaaactgtgtaattcaacaaacatctgcagcagcaatgcaattatctctgagatctaagcattgatcgatgggagttttaattaccaaaatttctccatcctcttccacagaagaaaaaaattttctggtgtgtttatttcatggcaaaatatggtaagattctatggcacacagaggggtatgttgcatttgggaaaagggtgttaagcaccatttttgttgtggcggttgtctccgcagatgaaaatattgttccttttgatctctcagactgaaaagtagattgccacatgcatccaaatttggcttcaagtgggaatagctctacccaaagtggggcctgagcaaggggatggggaggagagagccgcctggggctctgcccagggccaggaccctgaaaggagtggatgattgggaggggtgacaaagcacaggcactcgagcctaggggagactcagctagaaggcgagacagcagccctgagtgggccccacctcttcagtgggtgcccatgtgaccttagccacctcaactactgtccctgccatttacttcacagggcttttgtgagggtcaaatgacatgagaacttgctttgagaagctcaaagggctctataaatgtgaggtattgttatttcggcaggaggatgcagatgggggctatagatggccgccctggggttttaaaggaaaaacttgttcaaaaccgctcctgaggcagcgatcaccagctttacactcgcattgacttctctttcagggcagctgttggtgtacgtgttttgtttctgatgctgagacccttcctgaaccggatctccatcccttcactgagcaggtgcctactgtatggcaggtgcatgtgggctctggggacagctccaggtggcccgtgccctcctctccgccaggtgctctccctacttgcccttcccgataccttcctccccattctgcagccttctctcggccatgcagagatggatgtggagtggcccaggtggaccagtgagggtggggagggacccactggggctctggcaggggcagcctagacccagactctgctcaaagccactggttctccagcccaccaggagcttctatagacctcaagaccttgatgcagtccccaaagaaggggaagcacggggccagggccagggcctgggccctgcttgcccttgccaggtcccaccacccttcctgctctgctctgcctgggggaagaggtggggactgacccccatggctgcacttcccaggcttcccagatcctctggatttagtttgggttgagccatctagaggtactggcaggaaattaaagtgcaggagggaagaagaagccaggatattcctacctctccctcttggcgtccaaaagtgactgtggccttgagtgtgtccatggggccccacagggctccagtgtccccagggatgccccagtttctggactctcccaatcccacatcctccctttctccatccagcctaagggcggtagttgctcattttggggtgcctctcaccctcttttttggctcctcagaccttcctatcacctacaaggacttgtgcctttccaagtgtccaaggctggccaacttacagacctggatgcagacaggccagagcccctcagactcgggcttcctgcagctactgtatttatctgttcacttttcttatgtctgtcctgctctgccaggctgaaaacttcctgagtgcaggactgggaccatctcactcgcagttgtatgtccccagtgcctagagccatgccaggtatctaatagacacaaaatacttgttaagagaagaaattagtggaaatcccttaagttccaaatagcgttctccccatggggcaatgcttctcctttgggattcactctccctctttggaataactccccctggaatgaatctctgttgctgcctggatcacactcaagccatccagtcctacatggatgatcctgcccatgacagagggaggcagtagcatacagcaattagggatgaaactgtggagtgggaggccacgctccattactacttgtgtggccgtgagcaggtggggactattgacttaacctctccacacctaagtttccccagcagtaaaatggtgctgagagtggctactctgtcctcaggctgttgtaagaattactcaaggtaataagcgtagaagcctggctaccttgtgggtgttgaatcactgccatccctggctcaatggggcagatgaggaaggggttgtcaatgatacctgggaggcttctccaacatgtggctgtcactggttttctgtgaagattagagaaccccccagccctccatctcattcacctttttcctgcttctccctatcctttccccagttcttcagagaaaataagcatttagaactgggatccatcctatcacttttcagggaaggaaatggggacacaggaaatcacagcagctttgccaaggcccacagcctgttattggcagaactggagacatgggatgtcttagtccaactctaggaaagtgtgcgtcaacagcaccagtgacccagacagtgctggccacacccaggcagccctgcactgagcagaggggggcggagccagcagggggtcccagttgaagggaggtgggtgcttttctttcttgacctcacagatccaggatttggggtggtgtggagaatgtaccacgactttttgtcatgcacgcatggtgatgctaccatgccctattttgatcatgaacagagggaggcctcaaactggcagaaaagggaccgtggctcccggagagaaagcagccgcaaatgtgaaactatgaaggtgtattaatcgtgtctttttattctgtaatttttgtgctttgacattttggggcctcactgatcctggagggactgcccctcccagggctaattcctagaaataggaaactcctctgtgagaacaatttgcttatgaaaacctaccagtccagtgcccataccaccaaccacctcctctatcagatttttacactccaggccactatccacctgcccaaaccaccccagggtgggtactagaccactaggaacagtccttatacccagagcctattgaaatgattcatactaaccaacccaaccctgctcaccctaccccacctgttcctcccacgatgaagactcctactcaggtttttccctagttccctctgcctcccaaccgagcctggggtatcccccatgtggccctgcgagacataccccctgcctctagggatctgtgattataaaacttcctccttcatgagagccatttctgtgtctgcatgtcttcccacacctgattaaaacaaatccccgacaccatcaaaacaacaggggcatctatagaaagcagggattatgatgcttgcttaaaggttcagagattcggacctggaaggatgcttatcacaattatccttcattatatccttgatccaaacactttctgatgtgagaacagccccaaggaggcagcagaaagtcccatcagtttctcacactgagatcagcctgcatagtgtttgccacatcaccactgctttgcatcacccattaacacacccagatcactgtcccaatactcaaacccactcaaaaacccacaccagtgacctgatctccctgtgccccaaggggctctggccagatctcaacctcccacccccacatccctctccagggaaggttgtatctgcacacttaaaaaaaaaaaaaggtgagctgaaggtggcacaaaattagttccttcgacagaaaaatttgctcctgaaacactctgccaacctgctaatgagtcgtcttgaaccttgcgtggtgttacctctaattttgcagcctgctaggatttgagttccgtggacagcctcacatttggtttggaattataggctgagttgctgctcactcctattattgtgctgtcaatcttgtattagcgcattataatatggtacactgaatgcatctgttctgtatatcacagggcctcattgtcatttgttgaatcattttgtcttatatgattgttaagcaattatttcatctcaggtggcttaaattttgattactgtatactatttgcgggggatacaaaaaaaaggggggacaactccaccatcagctgatttcaccaattctccgctccagggttcacacatatttatgttggagtgcaaaggcttccgatgcccggacacgtgtcctccaatctgagaagggaaccagggaaggggctggagttgatgcatcttgacttaagggctgaagagttggcaattttggaggccagtgaagagccacgtagaaaatgtcccgctgcctgccatcatcagcagctcctcttgctcccatcctgcagagagggctcccacacagagagcagacacagggacctctttaaaatgaagatgaaatgcacctggttctaccacctagttagaagcagttatgaaggttgaagagctgttatctgagatttatagccccaaatctatgagatagactctcctaattaataagacaaggatgactagaaagttgtgaaaactacctggcagggcttggagcctgctgtcaccaccacgatgatagcactgtctttgctgctgagcctattagaatgtcaggatgtgcattcttctctcctagtgggatggcacggttcacctggctattacagagaagcaagtgcagatcgtgacttaaggctccgggaggagagttaatcagggaagagctggttgacaagactcactcagtgcatgacttgagagcaccaagagggggaaagggagaagaaagaacctcttccaaaggcagcatccacccccttgacaaagggccatttcccccagcccggggtgctttctgacttcctttgttccccgatgagcattttcttccttgtccccagccttcacataagttcaattcaacatcctctctctcttctcccaatgtcctctccttaattttgctgcatcctccaatgtgaatgtttgcctcctggtctgggatctgtcttattccctttatctcacctgaaaaaactctcccctttaatctctgctcattcaagtcctgcccatccttcaaagtatggccaagctcacctcttccagaaagccccaccctgtggtgttatctccatcctgaatcacagcagcacttactgtgagataactatcaggttacatctatcagagttcaatgcactctccccaaatgaagtggacacttgttggcagtaagaagagaagctttttgcaccaagtggtgcattcaatgcaatgcaaggagactgtgacgatactgaaatgagtattacccggccccaggagatgaacaccgtccttgcttgatgccagttcataaagagagctcttgtttattgagagcttatgagtgctgaggaattcacataaatcatctcatctaaattttccaacaatcatgagatggtttctcttatttcctccttttacgcatgaagaaactggggctcaggaggttagatgactttctcagagtcacacagatagtacagggctgacccagaattcaagcccaggtctggcagactccagcacccgccctttgcctccacgaccaagtacaagcagcaggctggcactggcctttccctgctatgactgccgagctgggttacacctgctgctggtccccagcaccaggcacacgacgtaactgtgagtcctccgagtatgtgagggagctggcactcaccttctgcctgaagcaaaggagctgtgctcttccgtttcagtgtgaaaaagcctcagaagatgcccagcttagaaggacacaagagacagtctgtggacaacatctccacttcctggcgtcctcagcactgttgctagtgaagctactctgcccaaggtctccagagagcttctgaaagaagtcaggactcatgcatgcagatgaatacgcctcgtgggtattcaccaggtcctcttgggaagccagctctgtgtcccaggcacaccgtctgtgtgcaagagaaggggagcacctgagtttgggaactgctttcgtaccagcttataggccaccccaagaaccggcctcctggcttcctagtcacagaccgcctgcagggttgacttatgcatccttttgcaggagacaggctcacttctctcctgtgactaacatggaattacgggttaaggagggaagttgtactcacctgttgattcatttattcactcacttgctcactcatcaatcatttcttcaacaatgaaacccttactagacaaatactgactccctgctccagaataactatctgttcggtgctaggactgtcaaatgagtaagcgtttcttcccacaggcgttcagggtctatttctgcactttacagacaggcaagacagaagtgatcagaagcggccaccaaccatggagttcagaaacacggcacagttctggaagaggcgaaaggcggctcttccatccatgctggtcaagaggaaattcaacacacctcacagccattgaatctgaccaggcgtgtaatacatcccatcgtcttgtcagttagcagctgtgggaccttgaaggcttcttaaattccccaagtctagactttcttatctttaaaatgcagctgaaaacaatgcctgtctcatggaggtgtaagggttaaatggaatcatgtagcaagcattcagcacatgtcaagtccaggtcaaggccaacatgcaggggcagggagaggtgtaacctctttcagtttggagccatgcaggaccctgccatttgcagccctttggggtaagactgtagcccccaaacatcctgctgccccagagcagtggcccagcaggtgcactgagagctctggtgcacctggcatgccccgactcctcacacagcagcaacagggacagtgacagggacctgagatggggtggcccacctggctggcagctggcactgggcacattgcccagaagttggggagttctcaggtaggggcagaggtgggtgtttgagggagcagttagcagcactgtctgctgtggcaggggtctcctgggtaaggtcagagggattcgaggaggcccagggatcaccccagggtggggtgggacgctgctcaagtcacaaagcaaagttgcagggtgtaggggaggggatgggactgttagtctaattgtgactcatctctccttatttttctccttatctcttgtatttatttttttcaatcctcccaagttactgggccttgaggacactcctagtgtgtgtgtgtgtgtgtgtgtgtgtgtatgtgtgtgtgtgtgtgtatttctatatatataatttttcttttttttgagacagagtttcgctcttgttgctcaggtggaagtgcaatggtgcgatctcaactcactgcaacctgcatctcctgggttcaagcgattctcctgcctcagcctcccgagcagctaggattacaggtggctgccaccatgcccagttaatttttgtaattttagtagagatggcgtttcaccatgttggccaggctggtctcaaactcctgtcctcaggtgatctgcccacctcggcctcccaaagtgctgggattacaggcgtgagccaccgtgcccagccactcctagtatatttttataatatttaccaaataagactgggtgtggtggtccatgcctgtaatcccagcacttcaggaggccaaggtgggaggattccttgagcccaggagttgagaccagcctgggcaacatggaaaaactccatctctataaaacctttaaacatcagccgtgtgtgatggtgtgcgcctgtagttccagctcctagagaggcaaaggcaggaggatcgcttgagcccaggaagtcgaggctgcagtgagccatgatcatatttgccagcctgggtgacagagcaagaccatctcaaagaacgtatttaccgaatgaagttttatgatgttctctagcactttttagtttattgtctttaaaaagaaaccctctgaagtgtctctggagaatacaaacgcatgcgcgcatgcacacgctgggaacaggagctgcttcagtaggtaactgagtgggagggaggttagcttttcactgtgacccttatctgtacacctgctaactcaaaataatttaataacaacaacaatgacaataaaaagggagtgagtgctctcattttaattgctgtctacttatttccagttaattgtcttcccctgtggtggcctgcaggggactccacacatcttctttaggacataacttattggatgcagggccaacctaggatgtttggccaacccacccacttcttttttttttttttttttgagacagtttcgctctgttgcccaggctggagtgcagtggtatgatcgcagctcactgcaacctccacctcccaggttcaagcaattctcccacctcagcttcctgagtagctgggattacaggctcgtgccaccaagcccagctgatttttgtatttttagtagacatggggtttcagcatgtttgccaggctggtctcgaactcctgacctcaggtgatctgcccacctcggcctcccaaagtgttgggattaccggatgccccaacccatccagttctaaaaggaccggccacgggagaaccctcagtcttggcccctgctatgagggtggggcttgtaagtgaggtggccgtggcttctgcctatctctggccaggcttctggagccctcctgggctgggccacaccagtttgctcaggggcactggtaccgcatccccagatttccaaccagaatctcacacatcactatgacatcatcttcctaaaccattaatttcatgctattcctgtgcccagaaacctgcaatgcctcacttctgtccccatcaaatctcagtgttctgggcctctgccaccaggcccttgtgcccagctgactggttcctcacttctgtccagcacgccaccaggccttctcttcttccatgtcaggaagtgctgggctcaggattcttacaccttattccccatgctgggagctcccatctctccgctttcctggctaacccagggctaatcctggccacaggcttactccgccaggaagccttccaggcttcggcaaactcccatatgctcagtcactatgtgatttaaccactgagaagtacctctcatagtttattcaaaagtatgtttgttttgtcttctcaagtggatcataagctctctgcattcccatagcaccaggcttactgccgggcacaatcttcaaacctcgaaaatgacttgatttgatttggactcaaaagacctgggtttgacttctgagagcctgagtttgcacagctacaaaatggggataattttcctaccatacaggatttgttgaaatcagagctcgggagagaagcacccattttggagctgggaaaaggaggaaaagaagaccatgggagtgagaaacagcaggaggcagaggctgggccatctgagccccctcaaaatccagaacaatgcaggggctgagaagaggaaggtggaagctgggctttggggagagaccccagtccccttcagaagatgctaccctgttctcctttctgctctaaggctccggggagctcagagtttagggagatggtaaatgggagagaaaaattaaaggcaagagaagtctaaggaagtcgtcaaagcacagccaagcaaacagaacccttaaaggaggtaaaaggtaatgccgtaaattacagcttaaaagcctcgttttgggcaaattgctttttaacaagcagacaacctctatcaatagcatctaccgtatgtttttataaagtgcagaaatatgtttttataaagtgcagaaatatgtttttaaaaggccggtaaataaagttcctatcgatttgaactcaagtgtaatctgtttttctgtctgccaccaacactggtaataaagcagaatcatgtaatacggtatttcagctaatgtgactatacatcactgcagggacgccctgctcggtggcgatctatcattttctattggtattgcttagctgcagaatttataaacttgctccaaattgatgcaatgttcaattttcttttccaatttatttttggttgagccaagcaatattgaggtctctgagcaagccgctgagcaccaccagatgttacctggaagacctcatgctccttgataggagtgaggagaacatgagccagtacttgccactctcaacaggcacagagacagagagccctggaaggagataggtgatggagaagaggtagcttcctcccctggggactcagcaacaattgcgctctaggaaatccaggggctgaaggtgaaaggcaagagaacatccaagagagaaactgcagtaatgaacactcaagagtctgagactttcactaagctgcagacatcagttcagtaggtctggatggggcccgcaatggcacatttctaccaagtggccagggaatgccgatgctgctggtccacggaccacactttgggcagcgattctctagaattttaggaactttatgtcaataagcaacctcaagtcatagacttacaaatttcagcgttggaaagaccccaaggtgaaatctggtgcattctccattctccattatttacatggggaaggtatcattagccctatctttcaaactcccagcttcccctctctgtgccccagtagcactgtggggcacaccttcatagtggcacttgccacatcacactgtgttgtccaccagacagagtgtgtctagaggtcactatgttcagaggccgcctggcaggtggcaggtagcaggcagtgtggcgcacagagtttggaattagacaacatgggtttgagtcctgacttttaccggcaagcatgcttggtcttaggcaagttactttaccttcttgaacctcactagtaacttgggaataaagttctttcctcaacatcttcccccttttcttttttttatttgagatggagtctcaccctgtcacccaggctggaatgcaatggagcaatctcagctcactgcaacttctgcctccccaggttcaagtgattctcctgcctcagccttgcgagtagctgagattacaggtgtgcaccaccacatccgactaattgtttgtatctttagtagagatggggtttcaccatgttggccaggctggtcttgaacccctgacctcatgatctgcccacctcagcatcccaaagtgctgggattacaggcgtgagccactgctcccggcccttcccatcttattaaataggataacatatgcagcataatgaccttgacacaataccagatgtccaataaaggtcagctgtgttatatatttcttccatatgcacttgccagatgaatgaatgaatgaatgcttatgtggcagtcaaggcaaagccagtataagtggctcacacataggaagatgccagggcagaaagtggggtgggagccatggaaccaggctcctcctgccctctgtcctacctcacctgctgtctcccacatcctcatctccctccaatgaaacccaagtaacaaatccaagaagtgttcattttggcctcttgggctggtgtgattcatcccactcagaagacaaagctgtttgggggaaggaggagtctgggtgtggggatgacaatacagttaggcatagtactgtctctagcacaaaatgggaagctcctgatgcaaaattcagggtcctgtgggcaaatgttccatttatttatagggaagtctcagagagatagctaaagcccttagtgaagcccacttaggtgggcccgcctcagacagcagaggaggaatggagctgggattataacagggtcttctgacccttcctcatcatcctcccaccatggaccacagcctccttctcagcttaagaagccagggaagggccgggcatggtggctcatgcctgtaatcccagcacttcgggaggccgaggcggacggatcacgaggtcaggagatcgagaccatcttggctgacacggtgaaaccccgtctctattaaaaatacaaaaaattagtcgggtatggtgacaggcgcctgtagtcccagctactcaggaggctcaggcaggagaatggcgtcaacccgggaggcggaacttgcagtgagccgagatcgcgccactgcagtccggcctgggcgaaagagcaagactccgtctcagaaaaaaaaaaaaagaaaccagggaaggagaaagtagagggactaagagtcacacttcattgagtcaacttgtgagaaataaaactttagtagtcagcctatttaatgctaaaatatctgaatagttttctaagtaatatcttttctaaattatttttaaatgacacgtatggattgttttaaaaatcatggcataatatacataatttaaaatctaccatcttaatggtttttaagtgtataattcagtagtgtgaagtccattcacactgctgtgtagcatcaccaccatccatctgcataatgcttttcatcttgcaaaacaaaaactccatacttacctctggtaggccagtttggtggcttcattcctggtggaataattcctggaggcctaagctacagcctacttctcagcccatctaacaattttctgtattaactagttttctgcttaaaaaaagctagagtatggtttccattttctgcaagtaaacacggactgacatcatgttttggaagtagaagaggttgtaggctacagagcctcatgtttggggttggttatctgtctggttggatttgaagacaggtaaagatcttctggttccagccaagatagagtatcaggaaccagatttaccctaccacctgaaacaatgaaaacaccgaacaaaatacatgaaacaatggtttccagattttgaacttcaggcagtgtggggcagtaatcagcaaaagaggggaaacaaatgaaggtcttacaatcaccccaacttactgcctgatagagtttctaggcagcagtacagaaagagagaacccaggaaacctgacagtcaccttgagttgaggagatagagctcaagtccaagggggttaaggtggtcatgattcacaaggcagaggcagctgtgcggggagagaactgtggaaattgcagaaggtcctctttgagtcttcagatgagtacagatcagcatgcgcatgtgagaaaactgagtccaaagaaataattccctgaaagaaacagacagaaaagtctacagggctcacacaaggctgagaataaatttgtattcccaccaggcagagtaaaaatgccacagaattcctggggcagcagggagagtattcagcagtggggcaaaattagccctagaaaaacgctgctcttgtcctatttaccaaagtttaaaagcaagtttgagaaggatcagactgctttcagtgagcctaaccacatgccagatcatagctcaagaatatttatgagattataatgacatttcacacctaatgaagtaaaaatccacaagtctggcacctaaaaaaattactagacatgtaaagaagcaggaaaatagaaaccataacaaggacaaaaaacaatcaattgaaatagactgggaaatgatacagacaatggaattagtacacaaatatattaaaacagttattataactatattccatgtgttcaagaaggtaggggaaggcttatatattcccagagacatagaaaatatttttaaagacccaattcagatttgaagagataacaatttcattgtctgtgatgaagagtacactggatgagatttaacagaaggttaactatacagaataagatattagtgaacttgaagacacagcaatagaaactattcaaaataaaacacagagagaaaaaagactgaaaaaaacccaccagaatagcatatcagtgagctgtgggacatcttcaagtagccaaatatacatgcaataggagtccctaaaattcccttttagggaatattagaaaaaatattagaagacataatggctgaaaaatgtcttaatttgatgaaaactgtaaacccacagatcccagaagcccaaccaaagaaatgccaagcacaagacacatgagaaaactacaccaaacacatcacaatcaaattgcttaaaaccagtgaagatgagagcacaggttaccattagcaaatgtgtcactggcagcccgcggcatatagtagcaaaataatcttgattatcaagtgtgattacctagaacaaagtacccattgaagataagagtttggcggaattgcacgatagattattatgtcagaatgatgaatataaagatgttggaataagatgacttcttctgccagaagtgggaaaagtaaagaaaaatggttagaagcttgaggtttaaattcttggcacagccatgcatagtggctcactctataatcccagcactttgggaagccaaggcagatggatggcttcagcccaggagttcgagaccagcccaggcaacatggtaagaccctgtctctacaaaaaataaaaaataaataaaaaaaattccaagcatagtggcatgtgcctgtagtcccagctactcaggaggctgaggtgggaagattgcttgattccaggaggtcaaggctgcagtgaaccgtaatcatgccactgcactccagcttgggcaacagagtgagaccctgtctctaaaaataaaataaaatagtaataaattcttggctcaaggctcaatcagaagagcaaggaacagttaagactatcctgaaagaatctcccacggtttgtagtttcagggccaacaaaactgaaatcagaagtgaagtctgacccagcaggttgtagaattacaacctaagttaagttcacagcctcatcaggtctcttatgggagatggtgttgactgggaaagatggaaccctgtgaatggggatgctgaattcatataactgagtcttagaccctgctgagcctccctttccagcagaagctgccccttttccccaggtcctgtcttgcaagagaatcctgattctccctgaggtcgacacttaccacccctggctgctcctgacctattctagaatcagatttcagcatggccaagggagacaagcacaaagtctgattctgaaacagtagactttcacaccaaagtaggtgccatttgttttttaatatttattggcagaaatctgagaaatgtatagtaaggtgctgatcacggaggaaagaagatcattttcaattgggccatattgatcaatatggattctggatccaaagtactggctggatcatctgggtatggttctgttcactcagtgggttatctgaaatgaaacctgaactgaatggcatcctatactaaataaagctaaggtgacagaagttccttgatataaagcaaggaatcttaatacctggagaggcataataatgttggggtgggcttacacatgtgttccccacataccctccttcactctgtcccaggagaacatactttcttcacaagcatttagacatgctttggtgagggggacaccggcattctgttttccttggttgtcttcagaatttatctttggtttttagcagtttgatcatgacacatctaggtggatttttttaaaaattctgattaaggttctctgagtatcttggacttgtggtatgttgcctttctttaacaagttcttggtcattatctcttcaaatagttctactctgctctcttttcttaatgagatcccaactatacatatgttagaccattttatgttgtctcacaatgcttgggtgctctgttctgtcccccagccttcttttctctctttatatttctttagatcatttctgttgctctatcttcaagttcactgatttttccagtttatatgttacgtctaatttgctgagaagcttaagttcctgtttcagtaacctgactagttttccaagtttgtcggaagttctgcttttttggccacatccttgaacccagcctaggtggcattggccctgcttcccatgggcaggtttcttcatgccagcctctctgcctgtgctcccagttactgcctacctactgccccctctgccctggggcagatttgctgtgtggcatcagacagttgcctgaaagttgctggtattgtggttggagagatgaaaccatgttcccaaatcccacatccttgcatcaagtaagaaaagtgccactggaacctagaatgatgtgggaacccagaagaagaagatgtcctagtctgggaggagagacagggaatggagcttggacaatcactgtcatagctggagtgtgatctgatgaagatctgaactagagaaatacataggccacggtaatactaattaatcaggaatggttgagttttgctcccgctgacctatcaattcttactccaatggctcctttaaccgatagttgcagtgttcagtggggtattatccaggctccaacgtgtttgctcagagccatcctcaggctaaggggagtcttccctgatctcccctcctcatcccagtgatggggttccttccacctcacctgctaggggtttcttgaggctcactcaggcgcactcctactctcactttcctgacattttgtgtttctgattcagcattttctggctctgggtatctggagaaccacgttacctatttcatttctcatttaccccagcagtccttggcctctttattactgttcaagctaaggctcagcagtgacacagactctcccatgcctcgttcagcccttggtagaaacagcattacacagaggttgcaaggtgacaacttatgataaggcagaattttgaaggtgtcaggtgcctcaactatgtcatgacctgttatatgacgccttaaaatccacagttagtgtctcttccctttaactcactagttctctatgtatactgatgtacttgatagtttctctctctcttcatctctaatatatataatatatatggtatatttggatatttttatatataacatatttagatattatatatagctaaatctaaaatggataatatatctatacctatctatatatatttgcgtgttatatatatacacatatatctgtgtgtatgtgtgtgtgtgtgtgtgtatgtatatatatataatccaaatatactacggcttagcgtagacattgagaggtgggaaagatttttttgaggcataggagaaacattcaaaattgagtaaaatctgttttttctgctaattgagaaaatacagccccttttcttctcctcctcttccatcttctttaaatttaagactgttcagactcctatcatgcaaagtccctggggacagatcacattgtaagctgctatcagtcaccacactgcaacgggatgtgatgcgttcagaagcacagatatggatggaggaggggaggtagaggagaatgaagatactgcttgtcgaaggagaagagagctgtgggaaaggacacactatgtggagtactgaggcaccaaaaacaaaccctttcatcgtcttactcaggcttatctctgccatttgactcttaagacctagctctctggttttagtatgtgtaaaaataccaccgagtattttgcttttcttattcaaaccttacaacaaacctatgagatgggtattattagttccattttatagttgagtaaactggcttggagaggtgagtttcaaaaccatttctatctccagtccagatgtttcctttaaacatcaaactcattaaaaaaatgcttaacatctctccctggattcacactcaccatgtccagatcagaggccctgagctcttgtactcatctcctaaacctgctcttccctcagcctttcccatatgctatgaaatgaaccatgtctcccaaaattcctatgttgaagccctaacccccagtgtgatggtatttggaggtggggcctttggaggtgattaggtcataagggtggggcctttatgaggggatcagtacccctataagaaaagaccccagagacctcactctcaacctccaccacgtcgggacacagtgagaaggtagccgttttcaagccaaggagggagccctcatcaaaaactgaatcttctggcaccttgatctcataattccagcttccagaacagtgagaaaataaatgtctgttgttaatgccacccagccagccaggcgcagtggctcacgcctgtaatcccagcactttgggaagccgaggcgggtggatcacctgaggccaggagtttgagaccggcttggccaatatggtgaaaccctgtctcaaccaaaaatacaaaaattagccaggtgtggtggtgggtgcctgtgatcccagctacttgcaaggctgaggtgggagagttgcttggacctggaaggcagaggttgcagtgagccgagatcacaccgctgcactccagcctgagcgacagaggaagactccaccccaaaaaaaaaaaaaaaaaaaaaaaaaaaaaaaaaaaaaaaacccacccagtctatggtattttgttatggaaccccaagctaagacaccatcacagaaaatggtcactcaatcctcccagccagccatcagtggctcaatctaatactcaggttctcaatcaaagtgctccaagctctggtttgcggtaagtttagaaagataaccatagacattcatgcccgagggaatgttcccctcacgccctgcacacccaagtgaaagctagaggtggccccttggctgttagctcctctttgtccctttctttatcctctggagttagtaagtccttctcgatgacctggcatagaggagatactccttgtaacagaaaatgtgtggttgaaatccaggctgaggggcagggcaggttgcgggatgataaaggggtgaatttggaggggctgggtcctgaggaggcccccttactgcccaggagggagaagttcaggaaggcagagagggacgggccccaccctgtaaactaggcctggcaaagaaactgagtcccagtatccctttgctagtccctgctgtggatagttccaaggaggtgtggcttggctaactaaagtccattgtcccagacaggcggtacagcacggtggttcattcacagcctctgaagctggcgatctaggaccctggacaagctacacacctgcttcttcatctggaaaatgggggaagtagcagttcctacctcaaagcattgttgggaagattaaatgatgatgatacataaagaatatagccctgccagcccagctctctggaggtagaaaatctgccctatgcaggctgcacacagactcagggagccaagggctgccgggggcatttggccatcattgcctcttccccaacccaaggttctgcaggcaagtgccagctcctgtctgtggagccttggcccatggaaaggcagagagaatggctctcatgtccctatctgagggtcccaaagggcttccatgagggagctgagcctccaaaatcattaattcggaaaagccacacatgaaaaggaacctgcttttgcagggggcaaaagaagtgtgttggttagcatgctgttctgggaggttctttaggtgcaccctgcttattaagcctgatcctgggcttctggaacctgcgactcaccccgttaccatggcgtctgctgagcagcacctggcagtggtgcctctcatctcggcaaagtggctatgactcctggctactttttccctagccagggtgaggaggagagagaggagggtgccaggcatctcatctgctcaatgctagaaaggaaattaaaatattgcagagaaatcgcagaattcgtgcatgcactgcttttcatttttcaaagagcttttgtgggcattatgtcacttgagccacctaagaaccctgggacagaagggatgaccaggaatgttttatttgcccatgttatgcatgaggagatcaagaacgtggagaggttaacccttctcacccgcagtcaaggtgagtgacaacgggaggagcatagcacaaagaaagctccagaaaaacaagaaggagacctggcttgcggtttgggctctatcaccacctgcctgcatgacctctggcaagagccttatctatgcttcaactttcttgtctgcaaactgaggagcaggagacctacagcaccaagcccacaggactaccatgagacaaggctaagtggctggaaacatgtgacaggctctctaaatgtaaggcacagtaagaatgacttatcgggaggtcacgaatcccacagcacagttaagaatggggaagggttggggaggggtgtgagacgactttagtgagcacctactacggaaagagctccaaatactctaattggttccttgaagtacattttctcctttgatgcccttggtgcccattacaaagattattatcttgacccgagcgcagtggctcacgcctgtaatcccagcactttgggaggctgaggtgggcggatcacttgaggccaggggttcgagaccagcctggccaacatggtgaaaccctgtctctactaaaaatacaaaaattaggcaggcgtggttgcaggcgcctgtaatcccagctacttgggaggctgaggcatcagaatcacttgagcccaggaggcagaggttgcagtgagccaagatcatgccacggtactccagcctgggtaatggagaatggagtgagactctgtctccaaaaaaaaaaaaaagatatcttatttccttttacagatgagagaactagcctaggaggttgagaaacttaagctagttggatacagaactcagatctgtctatcctatgctgatttcctggccccacctgtgaaaaatacaccagaaggcattttatatgcgtcacagggctcacaggctaaaactaggcacttcactcacatcctcattctaagcctatttactcttagtttagacataattctgacatagtcagctctcaggtttcccacaccgccacacatcagaaggaccataaggacactaatcagccttgacagcagcaagaagtgacagatgacaggaggatgataaaatgtttaaaaataattttagcagtttggggtggttttgtgtagaagcaatagccctacacatttgcttggtccccatagatatcactgtgcatgaactaagaaaatttctgccttcttatgaacgtaaaataaaacctatattccacggacaggcctggctccagagaaagaattttcacattgggtggggcagctggtgaaacaagagaggcaacacgtattcactgaagacttgtaggcagcaagagggaagcaagcgaagacagtgacacgaaatagatgatctggtgcaaaatcaccattggcttattatagacgtgatgagtgaagatggatcgggactctgtcttgtgtcagcagagtcctaggcctcggggattcagttgtgaggatgactctctctgccctcttggaactacctaggatcggtcctgcagggagtgtgttgtgttgatcttcagcttctaacctctggggagggacgcagcccctcctggtccacctaaagtcatctttaatactgcccaccgactctccacactgtgcagctcgactaaggcaacctccagagtcctaattccctgtcataggtgattgagaactaggaaaacctcctctccagggcaaggccaaacctactcaaaggatcccgggctgggggatttgcaggctgtgtaggagcacgctgacagaaccctggtgagaatacaagtcagtaactctggccactgttgaaaagaaatacttgtacttagcgagggcaccgttctgtgacagatgtttacaatgatgacactgcatcatttaacaaaggttaaatcatgttcattagactctgtttaagaagacatggccatgtgtcatgttttagaaagactgccattacaaatgattcaaataagaagtttgagtacatgaatgagccagtcagctatccagaagatgagcttagaaagaacagctcatccccaagtgcggctttactgcattgccatttttaattttaaaaacctacgtaaattttagccgggcgcagtggctcatgcctgtaatcccagcactttgggaggctgaggcgggtggatcacctgaggttaggagtttgagaccagccttaccaacatggacaaacccctaaaaatacaaaaattactaaaaatacaaaaattagccgggcttggtggtgcacgcctgtaatcccagctacttaggaggctgaggcaggataattgcttgaacctaggaggcggaggttgcggtgagccgagttcaccccatcgcactccagcctggatgacaagagtgaaactccgtctcaaaaaaacaaaaacaaaacctacataaattttaaaatcctacgtcctaactccaacccccatgtcatgtccgtaatggaccacaccaagttccctggatcacctggtagctttatggcatgaggcagatagggtgctctgaatgtgtccatgagaccttggtgaggatatgacaagccccatgttgcttcatgtaggatctgatgcctggttagcctctccccaggcaacctctccctcctgcacagcctgggtggcctggacacctggactctagcctcagctctgtcatcagccctggacccgatgaatgctgagatctcagctctggtctctgtccagctcctgtctctgcaaacttccccagggtcagaaacagcttctgcccaggaggagttaagtttccaacatgtcacagaggatcaaacagccctgagggttctgctacaaaaaagatcaagggagtttgtcaaaaggcaggtcccaggacccctactggagggagaatgcattggacatacctggaacttttccaggagaacagaagctccaaactcagggatcccagatcctgcagcatagccttgcgttcccacacgctgtaggggttggggagtggggtggaggtgagcgttgaaccttggacctttctcattacaccgtagggacctcataaataggagggccttgtaatagcctgacgggcctgaaaagatggcagtggtatttcaggtacaacctgaaacttggattccatctcgctctgatagccttctactcccatagcttaagcaagaagaatcaccccggaaaccgcgaaatgttgagagcaggactcatttacctgttatttgagagccagccatgatattgtgagtaaagttgggaaacagacagctggcgttgaaatcctggcttcatcactcatgaactgtgtgaccttggacaagttgcttaacctatgtgtacctcagttttctcatctataaaacggggataatgatggttgtgaagagtaaatgagctaatatttctaaagcacttagaacagtgtctggcacatgtcagtgtgtgccaaataaaacaaaataattgggcaaaggcaggggattgaaagacgaggcatttctaagaaacacaactgaggttcaaatgtgtggagtctctctcctcacccccagaggcagcagttcctgaatggggctgcaggggagggagtgcgtgaagggttaaacccccaagtgtgcagaaaaacaagttccatctggtccctgggacaaagcaacagcctgcaaagcccccagcccgggctcctgctcaaaggacacattgctttttaaaattccaacttgtagctgcctcgatctataaatcaacccgttctctacaccctagagctccgagaagcattcgcaaatggcagcaagatatccatcctcccagaataggcataggaaagtgcccttgcaactgggccagggttacctggtacccagcctctccgcttccagggcatcctctttgacctccttcaaggcagatattgctctcccatggcaaagagcaggcaggcaagacagagccaatggtcaaggctccagctgggagtgggacttttgcttagatgcccaacttcagtgacctgcccctggactcagttgagttcctgtctttgttcatcatcacaaaaagaaaactaaagctgcttgccctgcctcctgccactgtgactgagaccctatttttagatgccaggctgagagtggggcaaggctgattaatgagaaacatcaaatactccacggaggctgggggaaccttgcttagagaagcagcaggctgcttcccggctccctggctgatctgcacacgaggcagcttgtgcctcagtacctgctgagggaccccagggctctccgtacctggaagaggagaaggagccaggataaggctgagggagcttcttcgtggaccttggctggaggcagagtccctcagtttttaccacccctagacctgtgcccacgcctggatgatgctgaatccagcaccagcattaaccctgcagggcaggaaagtaattcacaaaaagttgggcaattcaaagttacagtttccacagcaaccagcactcagaccatttgggtagctgaagccttttcctcttagcgttcaccccccgtcccccatagcattttttccttcttattaaagtaatacacattcattggagaacatatggaaattacagacaagtgtaaaggagaaaataaaaatcacccttagtctcaacactcaaggagatccaatgttaacattttgatatattctccgttcgcctagttttttatttttgcatgcataaaagatataaatttttgaaaactggaactattgttaaatggctattttatcatttggcttccttcgcttaaaaatatattgtgagatcttccaacagccttaaatattcttcaagaccatgctttttaatggctatatggtactttttcatatggatagagcacattttatttaaccaatctattgttgaacatttaagacgattttcttttctttcccgctattttaaataatactacaatgaacatccttttacataaatttttatgtgtttctctgattaagtaatcagattagaataaattcctagagctaaaattactgctcaaacacaatggacatgctaatgactttgataggcattattgaatcatcagattcatctagaaaagttgaagcaatttgtacttttgcctgcggtgtatactcttttaagaaaagaacacaaactgtcatttagttgatttttaaataaagttatatactattttctaaaatcacattttttatattgtaaatggaatggaacttcccccatatttttaatgaactttcttctttctataatcacccattaacatcctttttttttaaaaaaaaaaataggctattcatctttttcttgctgatttataagagccctttatgcataaagataataatgctttgcatatttgtggcacatatgttctctcggtttgtcgtggggcttttattttatttatggcaattaaagtgcagagtttcaaatgttgttgtaattcacatccctctttctttttatccctttgtcctttgaccttatacctaggcagaccttttctctcctgagatcagctatgtatttacttgaatgttgttgttctagttattttgtggctgtgtgagtttggttttctgtccgctgttctaagccacacgggcttcaggtagaggcaaggactgacctttacttctctaggggtccggaggcaggagcctgcctggacaggtcagaggcggtggccaaggagacgcaggacctgacctgcctgctgctcccacctcacaggtctcagcctggcaggttcctctccacggggccctgggatgttgctggtgaatggaaaagatgaacgaggaggaggaaatagctgttccacgataacatactgaaaaaggtacacctcacgtggccctgtttcccatctgaggtgggggcggtggaggatgggagcgccagatgtatggaaagctggcaagttgcttcactcttagcacgttagaaatcaaggaatccaattccaaacctgaaattacccatcactctatttgcaagatgaagagtttgaggcagccgctgacattgcatatccccaaacaccaggttttcatgaaggagaaatgctatggaggtggaggaacctggggctctccagagatgcaggtcttcacttcagcctacccccacccctcactctccagggaccctagacacagaagtaccaggtgggagggagtgatgctgaacagagggtgttaccttaagacactgtccaggcagaggacactgcaggctgcctcctctgtccagccttgggagagtgtgccttcccacatccctatttcaatccagccttcaaacttctcactaaggctgcttggccagtttgccaagtcagttctgcaagggatttgtgcattcaccccacaggtttactgagcatctactatctgcatagccatgtgtccagccttgtaatttattcctcttcaaccagggataaagtatttccttcaaatctccctctcctctttctctctccttaaatctttaaaaaaacaaacaaacaaaaaacccctctgtcttgagtcccacatccactggccactgccttgcctcgactgtcatgttgcaaggctgcactagtcacatgggtggctgagatgactgtccatcaccatcaccaccatcatcctcatctaccaaattcttctggagtttggcattgacaggttgacatacataatctcttgtcatcttcatctaataacatgtgttcaacaaatatttactaagtgcctaccatgtgactgagactgttcgaatgcttggtatgcaccagtgaataaaccagacaaagattcctgccctcatggagcttacattctagctgtgtggtaggggtgagaatagataaaatgaacaagcaaaaaacgtaaaaaaaagaaaaaatgatatgtaagttagaaggtggtgaaggaaagtggtgaaggttagaaggtgaacacgaaggaaagaagttaggagggataagaggtctctgggctgtcagagctaggggatctggaaggcctccttggaaggtaacctttaagcaaagatttgaaggagaagaagacatgagttatgaagctatgagtgggaggagggatgcaggcagataccatcctagtgcaaaggccctataaagcatgccccatgcagtcaagaaacagaaaggaggctgggcacgacagctcatgcctgtaatcccagcactttggcaggccaaggcgagcagatcactccgaggccaggagttcaagaccagcctggccaacatggtgaaaccctgtctttactaaaaatataaaaattagcagcatggccaacatggtgaaaccctgtctttactaaaaatacaaaaattagccaggtgtggtggtgcacacctgtagtcccagctgcttgggaggttgagacaggagaatcacttgaacccgggaggcagaagttgcagtgagtcgagatcgtgccactgcactccagcctgggtgaaagaatgaggctccatctcaaaagacagaaaaaagagagaaaaagagagagagagagaaaggaaggagtgaggtaagcaagggagccaatgagaagttagtagttgaggtcagagaagtgaagaggtgatgggctggctcacaccaggtctgggaagccactgtcagcactttggctctcactctggtgaaatggggaggaattgaaggattttgagcagaggctgagctggtctgacctgcagatgtaaaggctcactctgactgcctggctgagagtatgctgggcgttgaggcaggcagaggtggtggcagggagatgggttaggaggctgttgcaatgacccaggttgggaggatggtgaccctggccagagtgctgatggtggatgagagaggtggtcagctctggatatagtttcctggtgcattggctgcatggtgagagagaaagaaagttgcggtgagccaagattgtgctactgcactcctgcatgggtgacagagtgggaccctgtctcaaaaaaaaaaaaagagatactgatgactccaacatgtccagcctgcacagctagaagactgaagttgctcttgaccaagatggggcaagactgaagatggagcaggctggggttgggagtggtgactgggtacttggggctggccatgtttcatttgaggggcttatcagacaccacaaatgcatgtgagcaggaaatcgttgttatgtggatgaaatttaaagtcatggcattggatgagaccacccagcagaagaagctgggaacaagaaaggagaaaaggagacaccgaagtgagagccagaaagagtgaaagttagtccagagagtgtgggtcatggaggccaaggggaaaacaaacaaacaaacaaacaaacaaacaaaaaaaaaaacctgtctaggaagaggcagtgacccactcagtaaaatgctgctgatgggtcaagaaagattaggactgaggattgaccactggctctcacccctgaaatggatattccacccattttaaggtgaggaaaaggaatcgcagagtgaggaagtaacttgcccaaggtcacaagctgcaagcaacagcgctaggatttaaactcaggtctgtgcaaagccaggggccttggcacttctcaaactcaccccttgggctccaagtgttccataggccaaggaaggcagctctgagaggcaacaattcatgttcctgctaggtattcgtactcaggaagcctgaggggaggggaaactgcaggtgaatatgggactgacagcgcaatttttaaaatcttctcaatccagggcaaggtgtgagaggcacgctcagtgctgggccttcttttcttgcaaatgaccatcccacccaggtaactaggggcttgaccctggaaggcacttccagttagcggccgagctttaaagcgttgcatcctggagatacttgcattttaatggcagaagggcatttccacaaccaagtggcaaagagagatagggcaggggttgcagagagaggtgaacccacccgacccaaatcagggatcctctatttttttcactcctgggtgacctgccctctgcaatgccttcctgcattggtggccccagccactcagccagctcacaggttcctggggtaggatgacggtcacctatctccccctggtgtcggctcttcccattgcagccccgggagatagagggcgatctccgcctacccgccagcgaggcctggggagccacacctaagacgtgggtccagggtccttctccctaccccatcctctgcggctctacacctgggccatggcacaaaccctccgcattgccagcacctgggagttcgaatgtgtaatggcttcttctgactcaatgtcaggttagcagtgcagacctaacccgcagtaaagaaatgagggtccctgatttgtgcacaccactgtacccccacgtaatttcctcggctgaatcacttgatactgccaggccaccattaaaccatttgtaaagggaggtgacagaaccagaggagtctcacaacccactccttccctgtattggcttaggtggctggcttcttcccagggcctggagcagtccctggaaacacctcaggatgttcggggtgtactgcaggttgctctccacccaccagaagcagtactgtggagtggttaggggcaggagctttggaggctacacagacctgggttcaaatcctgactctgttgctcatgagcagtgggaatctttctgtgcctcagtttcctcatctgtgaaatgagggcactcatgccttctgtgctgggtggctgcaaggcttaagtctgatactgttcataaagtgcttagcacagagcctggccacgtggagaatggccagcaaatatcaccatgtagtaaacactggggaccagagggctggagtgggtgggaaaaaggctacagccaggggatccaggctctagtctcaccacgccatgtaatacaactgtactttagagcaaactaatgtccgccaggttgtgaggaggctcaaacgaggtactgaggcagcacaccgatgggtgccaggttgggagccagcccagctgcactctcctgctgatcttgagagagtcgttttatctctaagggctgtgggtttctcatcacggacagggatcaacacctgcctgacccacctcccaggagtaactggagatgaagagtgtgaaatgacagcactgacgtgctacaaataaaaaggattgtcatgatagggaaagtgttttgaaaattgtacagcttaccccgttgttagcaagagaccaagcccccaacatcccgcgcttgctccatatcacggcacgcatctccctgcgtgggatctgcctattttcttgctggtctcccaagcatacagaggtctctgccctcaagaagtttatgttctcattggagagacaaacaagaaaatgaatggtgagaaccctgaaggtaataccaggggcagaggtaggcagttctccatccacctggaatccttgctagaaacacccagtgaaggaacaacaattctcagaagagaagcttagccccagggcaactgcccaatggcttggcaacgatggacagggttacagagcccttgtatagtgaagaaggtgctggaacggaagtcaggaggcctgggtggtagtctaggctctctattaatttgaaaagactacatattgtatgattccaactttacaacattctggagaaggcaaaactacggagacagcgaaaagaccagtggttgccagaggttagagggaggcatgaataggtgaagcacggaggattttcagggcaatgaaactactctgtatgatactatgatgccatcacgcatttgtagaaacccacagaatgtgtgacaccaagagtgagccctaatgtgaactatggatttgggtgatactgatgtatcagcgtaggttcgttgagtagaacaaatgcaccgctctggtggggggagctgagggtaggggaggctgtgcctgtgtgggggcaggggtacatgggaattctctgcaccatctgttcaattttgctgtgaacctaagactgctctaaaacataaagtctattaaaaataaataaataattttccctgatctgttgtttcctcgcctgtaaaacagagacactaatacctgctctgcctgccatgacacccacatggccatgattggggtctagtggactctgcgagtacaagaccaacatgtcaggggtgcgctggtccctggaagaatgagagatgccctcaaagtcgggatcctatgacaactgcccctgccagcccagcccccagcagctgctgcagccccctcctctggcagttctcacctccccaccaggcagtgggggttttggactgcagtgggcacctcctcccagcagcagctccccacagcagagctgggagctccacccacctccttctctccacccctcacccacaagccggcaagttttaacaaataacacatgatactgctcttctaaaaatctgccaaacctttctcaaaactcccctttaggccacaaccttctttcaccagtgagagcaggcaacaagtccctgtagcattcaaaatgctcttccttctaaatggctcccacaaaggccggcagctattttaaaatccaagaagcctttgctgacactcccaacataccgctgtgaacagatcccaaacatgtgaagagccctacactgacgcttgttcaatgcctttaaaacaaacaaacaaaaaaacaacccaggatgcaaatccattgagtgctcctttcaggtcccatgtgcccccttggtagatcagcgcacacagtttttttcaaagaaacagtatttgatctgagaaacatctggaacctgtttccccagcacttggctgggagctttcagtggatgtcagcggcccaatcgctgagcgtgcaccctgcctgcctgagctgccggcaagatctatcggactgggggtggcggattgggtaagggggggcgctgtttgattaaaagctgctgggggcaggttcaggtctggcaggaagttctggaatgacagagaaggccacgaggataaggagccctgggagtgaagattaagactgggaatcctcctaatggagccaccctgagtaagacagtcgccggagcacgtggccgttctgttaaggtttcccctcagccattaagtgtttaacagacaagtgataacaacaacaatggacattctcactattgcaagatgcccatcacaggcagggcaggggtgcgttctgtgtgtatccctcactaccggaacagtacctggcagaggggcagagagtggagctccatccggatctgctccagtgaatacatgaatgactgaatgacaccccctctccactgtcaacattacaggcctgttttcaggaaccgggggattccggaggcaaaattacataggtgaaaggtagttgactgcaagccagggaagctgccatccggggctggttctcccacttcccaggtttggcaagtgtgaccctgggcagcgccctcatctgtcatcaaggggataatccccgctctatccatcgccccatgttgctaggaggatctgtcctgtgaagtcctgcataggaagtgtctttgcaacctgaacatctaactgcaaaggttagaaatgctgacaatcctcactcccctttcacccagtccagttgcacccagaggagccccggatgacctggctggggacctgggctagagtgggacacagctgagtgatgttagcactttgactacttgcactgaaggagccagggacaaaggataaaatgacctgattcgtccttgcctgggtgctgcgcgccctcctcacctgccttcccacacctggctccgcctgttagcacctgagcccttcatttacaagctcagcggcctcctgtcccctctgcctctgggcctcaaacacacacagttctcctggaaccttggaaagtccaactcttcttttgtgtcttctgtccttcagactacaaatccatctctttctattgtagtgacaactgatcccatccatgaaactccagttaggtgctcggcaccaaatacagtggcatctcatgaattcttccctaaaccctcacctgatgcactggtgatctccccagggtggccccttaccctgtcctgactttaccttctgctcccagcccgcagtcctggaacgatccagatccagtggctcttccccagcctggccccatgcagcctctcccagcagtggagcctggtgactcctgctccccattcctgcctcttccctgcacctccctcctctgtgcacctttacttcttctgcaatgtccgtgacatcatcattccccacgctctgccccaaagtccttccaccctgcaatttcatgacattgcctcttccccctgcagtaggggcttggctggctgagctccagctcccagggccagcatagggcagccccctccagcccctgcggccacacctgcacccctcctgcccactatccccttcctcctcctcttccctcagaagcatctccggcacctcccacccctgacttccagtcagtggccaggtcccattggctccaaaggagctggacaccctttgaaatatcctcctaactcccaccattcacaccgtttatcaccttggaatgagcatttccagtcgacccctcaacccctccttctgctgtattttgacactgcccttttattggctccttcctgccagaatttacttatttatttagagttggggtcttgctctgttgcccaggctgaagtgcagtggcacaatcatagctccttagcctattgcagccttgaactcctgggttcaagtgattttcccaccttagcctccccagtacctaggactacaggtgtgaactaccaggcctggctacttttttttttttttttttttgagacagagtcttgctctgttgcccaggctggagtatagtggcgcgatctaggctcactgcaacctctgcctcctgggttcaagtgattctcctatctcagcctcccaagtacctgggattacaggcatgtgccaccacacccagctaagttttgtatttttagtagaaatggggtttcaccatgtttgccaggctgatctcctgacttcaagtgatctgcccacctcagcctcccaaagtgctgggattacaggcatcaaccaccataaggcctggttaacttcatttttttgtagagatggggtctctaactcctgacctcaagcaaatcctcctgtcttgggctcccaaagtgctgggattagagatgtgacccacttcgtaaatattactgaacacatactgtgcccagcccctgccagcacttaaacattcgcaggcatctcttctcccctggcaaagcggtggtgtgagtagcctactccatgggatccactcctcattcactccttggtcccctcacacgggtaaccagtggcttgctggggtaaggcagtgcgtgcgtttcctgtggcctcacccaacctctctggctggctgctgttgagcatagcagagcctacccgcaggtaaacctgtcctcctctcagagtccacgcctgctggaacactgaggatgcagacccaggtgcccagccctgccttctcttctggagtcagatggcagacctgcctctcgggcagctacctctggatgctacagcctcctcaaactctatgggtttctgtgcagaagtcggtgccaatggctgccatccctgtaaaaaacccagtgcttctctgtgtccccttcttggtgaaggcaccgttattagagttaacatataccccagcttgccagcgccatgcccaatgacacacattgtcctggcataactattaacagcatccccctttagtctcaaaagggtcctgtcttagatgagaaattatatactcaacctcattgttacccactcgcctgctcatcacagaaacccgagggtcatctggactctccctctccccaatatccccacagcccccaagctctatgggttccacgtccttaacaccttttaagcccagcccatggtccatgccatcacctaggttgcagggtgggcaccttgccttcaatcttacctttcttccattcttccacctgctgctggagtgaccttcccaaattgcaaatctgatcacatttaccagcctaaaaatcaaatggtgactctcctcccccagccaccagccaaactttaagataaactctaaactccacaccagggccatgaagttcttggctcctaaccatggatgtgcccctgccctacccgccccgacccccgacccaaccacaagcctcatccctcacctcaccatcctggctcccatctgtcccttgctgggtcccggctcactgacaccctgtgtccccatgcttgcccgctacctgtctatctccccagctatactgcaagctccgtgatagtgtctttcgtctctgaatcaatagcactgacatggtgcctgatgcaatgtgttcagtaatatttacgaagtgagtcaccgcccatccccaacaccaaatagtccatggcggctgcagtcccctgagccagtgggcctgcacttgaccgcctccacatgtaggagaggagactccacatgtagtctactggaagacgtctctgctccatccattagggtctgttcttctagaattgctgtgggtgttgggagccccgtgtccttcctcggctaatcattttgtgactgcagcagcctgtatttttctgctctgtgtatacagagaagggttggtaggggcggtggacctgtgagttccgagctctcttatagagaggagagttccaggcctctagaaaatttgggttgaaacttgtgtctccaccatgggccaatgagggcgagaaggtgctccctgggaggctgcggctagaggcctgggctggcatgaaatgcactgacccaggtggatagggcactcagggccacctgctttgtgaggagaagaaatagtgcctgggccaagcctgattggaaactccagggagagcaggacagaccgaggcagccttttgttccctccctgtaatgcaatgcacattccccacttaaaggcaatttctgcacttcaaaaggattccagctggcgaaatttaaggtggagaataagcccccagtcaagaagcttctcaggggcctttcagttttccttggcttgagaacgggatgcatttttaaatgtttgcctcttcatgtttgtcagagcgccaggggagaaacgcttcctcttacttccacacctctctcgctcagccatagctggcacgggagccagccacgttttcctgtgttactttgccttctcatgaacctgcctgacttcctctctttctctgcctgcttccccacccaccccccagctcacaccccacccctagggggaggagagagtcctgctgccctgggttcactaggtttagcagctttccttcaacagatgctgaaagggccgacagtttggctgacacagctcatagctcacactccaggagatgctctcccacatgtcattcattcattcattcattcatgcattcatgcattcatgcattcacctgttcactctctcacctagtcacccagtcagccagcatggcatctgaggtgctggtggggcccacgggtgactcaaagaaagacaacacatagtctttctctcctaacttacaaagtgcttgaagctttgagagacaggaatgagcaactacagcacaagacacagggaagtcaaaacccagtttagagggtaggaacattttaaaagcacagagaaagaaaagatcagccagggatgtaggtggagcccagagggaggcagtcagggaaggcttcctagaggaggaagcattgtgacgggagcagggtccaaagacgccaaggatggggaagtggccaatgccagaatatggaggtgggaagctctatggtgggcacagaggcactgctgcacccctctttccagggctttggagtttgctgggggcgggggaggggggggtgttcccaggcatgtccaatggcagtcactgctttggtggcattgcttcagtcaccttggaagcaatgcaccatccccacatagcagtcaccaactcgtgcccttctccatcaggcccagaagaaataccttcatgctcttctctgtcctaaacactcaggctccccgcacccttttcttgagggacccaggtagcacttgctcctccagcctcaccagtcatgccctctcccttaagggaagctccaactaccaccttccctaggaagaactatccttcctgcccacccccttccattctaaccagggaaagcttcccttcggccagcccacccctgcctgtgccagcgccccctggtgtctcccttagagcccttgccagtggcccactggccaggcccatgggctctggagttgggcagacctggctttgactctggctctggcacctttcagctctgtacttggccagattactcacttccataggacctgccttgcatttcctacctaacatcctttcacccttatctgatcaatcacaccttgacttgcattcagggcaaccatcctcctctactctcagtccttgtagattaaggggagctgtagagggtcactgctaggttcagggataggcacaagaccaaagcgagaccaatcctgtgacttttaatggatggaaaaccctatttccactggggttgacaaattggtcaaacacaaacctaaggctgttggggccatctttgtcacaagggaagactctatttacaaatgaaaacagcacagaaaaaaacaatcaagagacagattcctggtgacactgagcacctggatccagcctcgcctgaagttatccctggagttttcagttttgtgaaccaatgtttccccctcttttctggcttaagccgatttgagttgactttttgtcacatgccattaatagtcttgatgaaagaaatacttaacttggagacttaaatgaaaggtccgagtagtgcccaggaatggaataaggtggcactcactgaccactttggcaaatctctctgaatctgccttctcataggtctgttacatttccataaactatagttccatagtagtagaatactatgtttttcttcttcccacagcttcgatcaaatcttcctttgtaaaatcttcactctcccaggctttcttgaccacagctctgtgttcctcataaatctctatgttccacatccgttttctccccaccccacccccgggctgaggcaggatgggtttaacagtacaagacttcaggatgtggcgtgggtgatgtcgtctttgtgtaatgtgctgataagccagggcaacgaaaccaaatcaaaccaaagactttcccaacaggcttcaaatccctgctctggaggacaccaggtgctcagaaaagtctacactgccatctagtggatgtctgcagcatcatcagcacgcggaagggagccctttggggagaattcccttgggactgtccctggcctgtgaaagcatccgactgaccctcactacataagggacaaaccccaagacaagtgaatggatggtgaagccgagagtcctgtcccgcagagtagcatatactcctctaaaagattgggttcctgcccggcctctgcacctcccatcccaggagttagaatcagcaggcttcctttctctgctcctcttggctgtccacaggtgtgcccagtccaagggtttccagggaagagggctgacgctgtgtgcacatgggtgtgcatgcaagtgtgtgtgtgcacatgtgcacacatgtgcacgtgtgcactttattgctcgtcttcccaaaggaaagggtgtttgtcgtgtttgcaaacaagacaacctagcaaagcttcatgacaacagcctcataacttgcgagccatatcacaatctatttgctctctgatagtgaaaaacacttcaaagagaagagtctattccccgcattggagtaacttgtgtgctgccgccctctggagcttgttgtcctactgggcttagctgactgcatgaggcctaaccaaggcagcactgaggggaaggaagaaccccttgtggcccttccctgccaccctgcacagaaaggaccagaaggtcagccttggtgtgtgtgcttggtcacatcccggccacgacccttccatctccaggcatttgtgacccaagtcctgcctagattgacagcagcacctccttctaaaacacagcagaaaagaggccagtctccaccattgacactctgcgggctcagtctggcccaggagtcaagaaataaagaagcggagaccagaaggccagatcagcttccccaaaacacactctggctgcttagggcagcagcagacccatttcccacttctatgactcttccccaggctttccagacccctaaatgtaatagcactaatcactgcccagtaaaatagttatttccagttcctaaaatgctttgttcttcttttacacaactttgggcaaaagaagagcgtgtctcatgttgtgacaacaaagcgtcaagatgcactgacctctgcctgtttaggcaacttgggaagctctgtcttggtaaataccagcttctctccagcccagaagccatctgaaggcccaggcaccccgcgccttgagagaggactcctcccataccacgccttcttccacttatctgccaactccaaagcacacaccagctggtctccaccaggcttggggtcccagatctcaggggcagccaaggagctcccagagcaggggagcaggaaaaggcctgggcagaatggcctcaaccatcaccaaagtttccagtctgcagccctcccaccagcccccagccttctcctcaagtccactctaaggaaggcacaactttatggcaacagccatctgcagccaccagacccaacccagatggctctgcacgcagcttcaagtcacccagatgagcaagcctggaggaacatcaagacccccaactgtccccccgctttaacacagccctgctcactcacgtccacggcccccgggaacttgactatcggctccatccaggaggtgatcttctgtctgtagttgttacaatcaggaacaaccttgcagccaatgttccccaactctgggtagaaaacttcaaggcccctatgaagagagaggggaggttgccctgtgtcagggttttaagggagcctggggttcccaaggcttcagtctagcactattgggaatgtaaagtgaaatgggatcaaatcctaaacctgccactaactagttgtgtgaccgaagagttacttgacctccttgtgcctcagtttcctcacctgtaaaacgaagacactaataattcctccctcatggagtcagtgtgagaagaaaagtggcggtcaatggtcagaacagaacctggcacgttgtaagtcatcagaaagtataatattaattatcatcagcctttacttccctagaagaacagatatccttaggcaaacttagtgtctttaaagtaggattgagtttataaaaacaatacctatagattgcttttcaggaacattcttattacagaaagaaaagcttagcaagtcagcacagcttccttcaagggcatagaccttctctctcccctaaacaatcaagagctccccatgcctgaaatcccaccattaggtgaagaattggcttctttgggttaagcattgactgtagcctaggttctctttcaaaatgcaaacatccctcagggggtaaaacactggctcactaagactgtcagtatgaatgaaccagttcatgtatttgctccctgagaagaagggcccgaacagcaccagggttctaagaatgtggcttcctggaagggaagaaaatatgatgcagagcaaggcaacagagcctgcagggcagggcaggccgggctgggccatgacagcaccaggctggctgtaagtgcatgcttatatttgacactcaggaacacaggtaagatttttcaaagacattttttaaaactgtttttgcttgcccttctattataatttatctccatgacctaagtcctctgtagggttaacgagggttaagacatcactgagagagaaagggtgtgggtagagagtgggtgttgcaggtccccagcctttcctaacaccttgcagggctaagccgctctacagcctgccggtagccacccacagcggtccacagtgccttgctgggggtgatatctaaggggaccctgtgaggatgtaatttggagaatagatctggaaagggagctccctgaacctggggcctgggagtaggccaagagcagcttcctggtggggaaccctgcattgcccctcccaccttccacctcccacccttccagtggctcctgaagtccagccttgggcaaaaggccgctgagcccccagcacctggcagccccggaccaggacacttcggtgggccagcgcccccagtgccagaagtcacatgctctggtctcagagagtggaagccggatgagtcatgggcttgctgagcaagtttgtttcttctaactctttgcgcatttacagcaattcttggtggatggcaagattttcacagcttttggagaagttttaggtgaccagttttatcttcctagcatcatcttaaggaccgtttggtttgtttctgctgcaactccttgctgccgcagctagcgagatgcgaggcagagaggggacccaccaagggcagagagacagacagcaaacagcacaggatgggaaaactgagaggtagggaggaggtaaactgagggtggagggacgccctcacgcccataacccctctcccctttttatcagagtggaattgttgtaaatatcaaaaggattaaacaagcaaaatcatcaaattgttatttgatgaggtgggcacagagccacagagagtgccctgaaggacagggcacatgccagggaaccagggatttgggtcttgtctctgtccctctcttcacgcccatagggcactgccaggccagcgtttgaacatagcgtattgccccacctaggatgatgggaaaggggcatgtgcaggcctctgccctgctcagctgctttagcaaagtcttggagaaggacacggagacaaatttatttgatctgcagatggcacagagctggtaaccaacaattctgatgatcaaattgacttacgagacgacctggacaaacctgaggtgagctgaatcaaaaattaaagttactgagaaaatacactttaaattttgcattcaagactaggcacggtggctcatgcctataatctcagctctttgggaggctggggtgggagcatcacttgagcccaggaatctgagaccagcctaggcaacatagtgagaccctgtttctaccaaaaattaaaaaaacaaacaaacaaaaaaaaaacaccatggtagtgcctgcctgtgttcccagctacttgggaggatcacttgagcccaggaggtagaagctgcagtgagccatgattgcatcaccgcactccagcctgggtgacagagcaagaccctatctcaaaaacaacttgcattcaagccagaaaacctcaaaggtgccaccttcctgtgtgcccttgctgcttgtggtttacctgacatggaattcttctaatttccatgtggagagtttggggatctcctgatctccttgacaagacttgaaggcactctagacagtggagtgaaaagatcaggggccctggccccagctttgccatgaactaatgctacataagggactggggatgaagggcatgacttttactgggccaccccaatatatcggggacatcacatatgtatgatttcatttcatgcaaccataccttgaggcagctgttatcactattcctatctccagatgagtaactgagaaactgttggacaatacctatttgcagctgctacgtgttggagtgatctgttgtgtacaacagagaactagtactgtgggcttggctgcactttcttccccgcaccacacgttttccctagtgagctgtttcattcctccaggcttcagtttgagctaggtggtcatgtgggtctctgtcatggcaagaattagatcacaagggctgggcgtggtggctcaagcctgtaatcccagcactttgggaggctgaggtgagatgatcacttgagcccaggagttagaggccagcctgggcaacgtagtgagatcctgtctctataaaacatagaaaaaattagccaagtgtggtggtacgcatctgtagtccagctatatgggaggctgaggtgggaggatcgcttgagtctgggaggtcaaggttgcagtgagccatgatcctgcttctacattccagcctgggtgacagagggtgatgcactgagaccctgtctctagaaacgtggcttctcagctgtgcctgtatgaagggcttagaatttcagctgcccctcagtgagtgctatggtctgagtgtttgtgtctcctcaaaatttatatgttggaatttaatcctcaatatgatggtattaacaagcgggacttggaagaggtgattaagtcacccttataaaaggcaccctcataagagaggctgaagggagctgcccttcccttcccccatgtgaagtcgcagcaagaaggtgccatctttgaagcagagagcaaccttgtaccgcacactgaatccactagcaccttgattttggcgcttctcagcctccagagttgtgagtaatacattcctgctgtttagaaatgacctagtctaaggtattttgttatggtagctgaacagactaagacagtgaggatgacaaaaagacacatgggatatgaggctgcctcgaagagggggctcactgtgaaagtgtgggtcaccccacttgaaaaacagcaagccaggtatggcagtgcatgcctgtaataccggcactttgggaggctgaggcagcaggattgcttgagcccaggagtttgagaacagcctggactacataccgagactcccaactctacaaaaaataagaaacttagccaggtgtggtggcgtgcacctgtagtcccagctactcaggacgttgaggcaggaggattgcttgagcccaggtgttcaaggctgcagtgagctatgatcaggccactgcactccagcctaagtgacagacaagactctgtctctaaaagaaatgtatttaaacaggagagaccaaggcccctgagagaggttgaaggactggggatgactgcccaggttggggggagctggggatgaaggggcagggcagggcatggcacctgtcaccacacacatgaatgaccacaaagaagatgagaaactagactagtttgtgcacctcgtggatccgcactacaacaggtagggttggtgttcaagaagagcagcagggcctcggggtaagaatgtactttctgaagaacggagcttttcaacaccaaaaagcaggacgctttgagcagcagctcccatccctaggggagcttgcagggctgactggatggcagcagcaggtggggttttttgagtggattcacctcctggctgcaggtttggagaatcatggttctttccattctgcgactgagcccagggttgggaccgtcggtggttttgctggtcttgtctggggtatctcagaagcagggaaggtctgattcccgagaagcgttactcttaacaatgtctcacagcttgtcacagtacataaaattcctcccttatagattaatacctttaggcattgagtccaatctttaagagttccctggtagaccaaatgcccacaagaggagtgccttctctgggggatctcttgccaaggtcagagcctgagccgagtggggatcttgaggaggggtcagtgcaggaggtcctgctgtctcctcaggggtccgatctgtccttgatgcatttttcatttcatcatcattcatgatgctctcttccaaacaaaaatcttcagtgacaataaagacaaagctcctcttttgcgatgatggcttgaaatcaaaagacatcttcctggcatgcaaccttaaggtcataagtctctttctcagactgggggcctgctggtgtattctgggagtcctgagaatgggcccccttgactcgagtctgggagccctgaacctggggtgaaggttgtcagaagcagatagggaaagagcgtgagtgtggagtcagacaagggggctagatcttggctctgctacttttaagctatgtaaacactgtgggcagatttcttaatctctggggattcttcatctgcagaatgggggtgctaacacagactttgtaggttcgttactgacagtgaaaggagtcaaggagtccaggcaccggcagagcacctggcacacagaaggtgccctgggacttcccacgtgtgtccccatgcatgggtcaccagggcaccaacatgtgatcttggcagggcagagcctagggcatctggagcctcaggctggtcacccccaatgaccctacagacatcctcatttcccacagtgtgggaaacaccaggaactgctgaggtcctccttaaggggcccttattgtggcccaggcctgctgtaccctggcccagctgacctctcctggttacgggggtgttgaccttgcactgctcagagcgagaagcctgccagcccctcagctcactcagcagagcacctagaaaattagatcccacttgtgagaggcaaccacgtttctcttcctccttccacgtgaaaacttcacccagaactgttttcttgcttgtttgtttttttgtttgttttttgagacagagtcttggtctgtcgcccaggctagagtgcagtggcgcaatctcggctcactgcaacctccacctcccagattcaagggattctcctgcctcagcctcctgagtagctgggattacaggtgtgcgccaccatgcccggctaatttttttttatttttagtagagacagggtttcaccgtgttggtcaggctggtctcaaactcctgaccttgttatctgcctgcctcagtctcccaaagtcttgggattacaggtgtgagccaccgtgcccagcctacacccagaactatttaacaagatttttcaaaatatactgacacgaacaaagtttgttactttttgttgttgttgttgttgttgtttaggcagggtctggctctgttgcccaggctggaatgcagtggcgcaatcatggctcagaccagccttgacctcctgggtttaagcgatcctcccacctcaacctcttgagtagctgggacgacaggtgtgcatcagcatgcttggctagtttttaaactgttttgtagagaaaagagtctctctatgttgcccaggctggtctcaaacccctgggctcaagtgatcctccaccttggcctcccaaagtgctgggattacacatgtgagccacttcacccaacaaaaatgttactttttaagaaggattcaactacataattttaagagaagacatgtatttatggttctaaaagtaatgtttgtcaaaaatgttttaaataaaattaaaaagaaaaacaaacattttcatgaacagtaatgtttgtgaaaattcaaaggtacagaagagagtaagtagtcaaagttctttttcctcctctctcatttctcacacgtgggctcagtggggtgtccccctcctcagccaccaaactggcagggaggtttggcatcagtttggcctggggagtcctcaggatgacccacaagtccacacaaatgaaggcttgcttttctaaccggcagagttggtgaggagagagccgaacgccaggctttccagcttacccaaagtagaagcagcttgtgcccttggaagggaagaagccagcctcgtcacccaactccatccagtgccatgatccctaaagggccctgcacaaacgctcctgggtcctatcactgacaaaaacctctcacacaggaagggtctaatcatacaccttctttcattcaaatgcctctttgttggggttctggggagagggggcattcaggctgcagggagggatggtctctctctgggtctctctctgagggtctcagcctcctgcccccacaaagaccccccaggtttggagggcccaagcagagccgaccacatacacagccctcctggtcctgggagaggtgcattctggaaggcaggaaggagtctgtttctaaatccctttctcagtgccatcctccatcaaggtggtctccagatctgacacgtgttctgccttcccataaaatcaggctcaggagatggtgcttcttggttctggatatacccctccctgccatctacctgcctggtagcctctgtgcctcccgcctccaagcctgccctgacttactggcaaaagagggtgtcctcgtccaagagggcctcatgggcacacgggctgttctcatcctcgtctccagtgaccaccatcatgagacccagtaacagtgctgctgtgaccagcctcattgtccaacccatgggcacctggaacagaaagaactttagagcggctggatcccctgcaggggccttcctgcccactacctgtgcccccgaccccaggggcccacttggcaggatagagacctctggttaagcacagggagaaggacaggcagcttccagggctccgcagctaatccagtccaccacccggacacaagtactttggg

SEQ ID NO: 1190 - DNA, 148814 bp, Homo sapiens
atatatgtaaatatttttcaaggttttattgcaaaccaaaatcagtttatcacacacaaaaaaagttgtgtgatgggatgagggaaggattgtacgtattataaccatgttaattacagtacattaaaatggtggtttacattacaaataagcctgtaagtttaaatatactagtgttataacccaatgtacagacgttctttatacaatacatacaattatcaggaatgcaaaaaaaaaaacataaataatgcccattttacaggtgacattttaaacaatgaaaaacaccaacggctctgactgacaactggggcattggtccataaaaaccctttctaaaaatagaaatatttgtagcagcaatgctttctttaagcatctgaatacgagtcattgcaagaccatttcaataaattttagttattaaccgtatcttacaaaaaagtctacacataaatttatcttccaaatatggaagaaacaaacaatgtcccacgttgtagtgtcctgcaagtgtcacattgatgcttataacaaaatccatctgtgatcaggcataccacactcacacgacggttcacacagcatatccacaagggaaaataaagaactgaaacactgcgataggaaaagctttggagctaacacaatctcttcagaaaaggcacatttcataatattcgtcatcacagcccagacagatctgcaggagaccttttttagaacagcgtccgctttctaacgaaactcctgcctccgtctaaggcggcactctaacgctcgtttcagagatagcaccacgttggaaggaagaataaaaatgaaaacctcatgagctcactgaggagaatgtgctcttcaaaaagcttccagcgaacagtgtgcaataagattgctaagcttccagagatgtgcaaattctcttgtaagatgtcctgtcagctggcggctccaccaaaaggctaactaaaacattcggaaacacacataaaatcctttaaaaccaagccctaacagggttcagaggaaagagtccgtgggaggcgcataggaaaagcctaggaaagcctcggcagcttccttgacgctggctgtgacgaggacgctgtcaggggacttgccaatggagttggggacaggctcttcggtaaactcggggtcaaagtgccgtaggtcgttgggcccactctgtgacgggaagggaaaaacactcttgtcaagaactcacactagacacaggacagggaaatcttgaccaggctttaaataccaagtttaagtcttatatcaacttccataatcacccacttcaagcacaaaatctcaaaaggctacacacagttaaacataagaataatgttcacttgttgccttttggtgcttcgaattgataaatgtgtctaaaaattatgggagccttgttgggacacaaaaatgtgctttttatgtaggtaaaataacaggtttatggagaaaacatctgccaatgtattccttccaaccctcccccagacaattctgaattaaaataaatgccctttgggcttctctatacttagaagagagacagatactcaccacatttgggttaaaagggggagtaatcttcttattaatgagatcatcccagttaattaaggagaagaagacatgactcttaatctccatctgttgataagaaacccaagattaatttagacaggtgcattcaataagggcagggaggtctagtgcacgtcccggccggcccaggaggacaggaaaacatcactcacgaagtcatccttggccccgagccgctttgtcctgtccttctgcaggaggccctccaggaggtgtcttgcggaatttgtaatatttggtttcagctggagaggcttgttcagaatgttgtcgtacatttcagctgtgtttcggctataaaaaggcggctgaaagaaggggaaaattactttagacttaattggaagtttcatatggcacacattaccagtagagaaaaagatataaacggcaataaatattaggctcgatttgagaaactctccccacctcaatgctttcttttcccttgctatttaagtgtctactttgcaacccgtgtgtgtgtttgtgtgtgtgtgtgtggagggtgagggggtagatgttaataagtggtagtttttcaccaccacacaggttcaatgtggtcctatctagtaaaatgtgaaatgcacaaaagaaccaggtaagtgattattcttatgaactataaaataaccaatatgcctcttagctgcttttgataagcgtactggtaagggcaagacaccatggccaagcatgggctgtgtgaaggcaatattgtagggagcaggcagtgttccatggttcccaatgtgccactcaccaggccatacagcatctcatacaagacagctcccaggcaccaccagtccacagtcctgtcataaggctgcttatgaagcacctcaggtgcgagatactgaaaaacagaccagggaaacagcgtttagaacctgcgaaagcaagcaatcccacgaccacacatttagtttgaaaaagctgagagacccagagccagcttggaagatagatatctttagattccttcctgataaaactgctggactttttgagggtgactggctacctatgtgtactgacatttaggaaactgctgggcacttgatatctcttacttagggatttagaaagtttttatgatgcagatcttacttacaaacagctacttttcagtaaaggaacagaaggacttgggatttctcatgctacatcaaacagcaaatgtattttatttgcactgaactgtattaagaagtctctgagaggagtttactctttttggtagttaagtgcatgattgtacatctctctcttggaaggcgggggtaaaccaggcaccaaaccaagacagcgcctacctccggcgtgccacagaaggtggatgttgtgctgttgtgttcaatgttctccttgcagagtccgaagtcagtaaggacaatgtgtccctgtgaatctagcaaaatattctctggttttaagtctctgtaaaaaagtgaatagaaaagtagttgcacaagttaatttcacttcataagatatcctcttaaagataattgctaaaggtattagaggcattttaggttcactgtagttgtgtagtgaagaaaaaagggagcccttgttctgctcatctattctggattaggcacaatcctacttggctggttcccccttggcacttaagtcaagccagctcacgtgctaggggatctggttttaggcaaccaagttgcaaataaacacaaattattttaaggccctatgaaacagccagtgctacgtctcctttataccaaaactggtagcctgaagagctctcaggcttacctataaacgatgttcagtgaatgcaggtagcccaaggcactggctatttcagcagcatagaaacgagcccgtggttccaggaagcagcgttccctctggagatggtagaacaactgcaggagacagaacaaagtcattctgggttgcaaatgaatttaattagttttgacatacacagcaaaagaacaactgcaggaagtggccccaagtaatctattaactataaacctgacaggttgaaggaaatgctaattctggtaacattctccccaccaaaaatctttgaaaacttttttctcaaactaaaacaaagcaggctgtgcagagacactaagagttgacttctatcccccctgctcacctctccaccattaatgtagtctaggacaaagtacaatttgtcagcagtctggaaagagaagtgaaggcccaccaggaaagggtgcttcacattcttcaacagaacattccgctccgacataatatgcttctcctaggaaaatgacgattcagatttagtggcatgtttcaacttggcaccaacattccagaatcaagattattcaaggagtgtctaccgccaatgccagccccatcaagcacatctcatacctctttctttttcaggattgctttcttctgtaaaactttgactgcatagaacacttcttctgccttgtgtcttgctagaagaacctgaaatttcaatttaaaaaaatcatttttctatcctcatccagggagaatacaaaagaggacatgaaggaagtgtaccaaaagatcttcagatttgaaattacctttccaaaactgccctttccgatcactttcaagaagtgaaagtcagatggtttagcatgaggattggacgacgggccaaggttgatttgctgagaaggacttggctagaaaaaaaaaaaaagaatttcttttaataccattgcttcaaaggaagacatctataacataaacgatgtagaaaatgttacatctacaaatgactgatgcaaatgaccatacatctataaacattcaaaactacatttcatcacatttcaaatgagtatggaaactgcacacagtcatgttgtttcagacagataaaacctttttatgaaatatgccttttaaaataaccactttggaggtaaaatatgcccaggaaaaaaataaaataatactctgactcaatacttaaatatttatatcacttgttatgccataatgaagcattcctgccttgatactaatttctagaaatgctattttaatccattaatgtaggaatactaactgactcccttacagttctccacagatgcacggcacatacaaaaacttactggaggagaagggttggcattcataagctcaggctcctgaggttgggagatcttcaagatggactgaacttcagggctgcagggaataaagggcacgatttagaatccagctcgccactagggggcacaccaacatcaaaagtgagtttctggctctaccgacttctacccggataattcactgtttaaactgaaaataccccaatacattagtcagttaaagaaaataataaaccccattaaatacagaaataaggattgttgctcatggagaaaggccgtgaattcggccaacacgaaccatttatcttacatctccagttcaagccaaatcagcaaattaactttaatgtttaaaatgtgtcaaatatattagaatttaaggagaaatgagatccccaccccagaagaagtcttcgccttcccgataaacgccgtgatgagaatgtttaccgctggcaaattcaaactatactagttatttcctcaaatccggtcaaacttactgtttgcatgcataggagttattggcaatcttctgaataaagtcgttcagacccatcctcctctgcttcatgaaagctgtggatgaaggaggagaaataaagaaacgtttagacggcttcataacgtccggcgccacacacactaatctgatccgggactttcaaaaaatttccactttgcgtctcctggagcagaagtcccgcaagattcctgcactcaccgatgagaattgccaccatgcccctcatcctggagtaagtgagggtgcccttagcagcctcagttttcaccgtcatcaccaccgcggggagacagaaagacgttagcgctcaaagaccggctcggcgtatgctgcgccaggccgcgcgctcggccttataaaaaaggcaccgccgcgggggcggggcctgcgcgacagtgagaagtggccccgcccttcgcctcgcccctcgccccgccccggccgcctcgcggtttgctggcggctacgctgcctgcggcgggcggttctgtccccattgagagggcgagccccgggcgggggcgcgaggaccgcccggggacggcctggcgcagggccgttatcagtctccatcggctcctggggcaggagagagagaacgcgccggcggagggcgcggggagggccggagagcccggggtagttttccacctctctcatttattccgccgccggagaaagccgggttcgcagcgccgaagcgcttcccggcgggtgcgcggcggccacggtggcttcgctcactgtccctgcagataccctctccccggccaggcgccgtcctgcggccggactcccaccctcctccccaacccgagccggcggtgcgcgccaccctccggggtttatccctggggcgcaggcctgcgcgcgcgacctcgcccgccaggtcctcccgttcccgccgccgggaccccggccccgagaactccgacgaaagccggcccctgcctccaagccgctctggggaagtgagccaagcccccagcggggccggcggcggcgcttacccagtccgctcagcaggaaggactcgctccttttctgcgcctcggccctctttttgtggcggggccgcagcagggactcgagccgggctctggccagcgcgccctgcatctcccccatgggcagcgggcggcggggcgcgcggcagacgagagcgaccggcgagcactgacgtttccttgaaggagccgccgtgactcaggccgggcaagatttcctgccccgagtcccaaaacaaacaaatggcccttgtgcacggtcgggtcgcttccgaaaacgccttttttgtgcttttggccaaaaccaagcaaggctgaaaaatcccagaacttggaagaggaggaaggaaggaaagaaagagggaaaagggggagggagaggtcaggaatgtggaggggagggggcggaaataaaagtcgtctctgcactaaaggaagaagtacaatctgcatttcacttttttttttctgaagtaatctctgagaacattttgtccgttccgcatgtaatttttttccttgcatttttaatctctgccatgccaagaacacgtgaggaggtaacaagcgaagggaggggtagctttgcccgggggcagacctggcgtgaaccgggcatcctcgattcctctgtggggcctgctcctctcccgctgtcccacctgaaaaccctgcaggtcatgatacatggtcttaaaatcgtccctaccctccctgggtttaactcaaggctgccccagggcttcttagttttgccacctcgctcgctctttatgtgagtcccacataaactgtgactttatcctgaaagattagccgggtgactccgctgcagaaggcagggaagagagggaagctcgaggcggcggcccgggctctgcagaacagcgatgccggtgccttccagtaaccccgcggctgggggatgtctgggagccgcagcctgaccgccggcgcggggacgtgagccagtgctggccgggaagccgcgagcacggcgactgggcccggagcgggcagttacaagttaccactattcgcagggccaggtacctggcgctcgctgttgctgtctgcggtggctgccctgccatgacctcttgctaccaaaggctctgccattttaaagttgcctactggatctggcacagtcccgaaataccagctgtcaaaccaggaatagcatgtgaaacgccttttccttggtcttgggcaggggtttgttttgcaggcaaaaccacccccacttgccctaaagtgagctctagtctcaactccttggtttgctttgttgcaacagccccaaaccgagagaagggaaacacattctctctcctggagtctggctgggaaagtttgctcagtgcccacacttataaaaagcatttactggggccgggcgcagtggctcacgcctgtaatcccagcactttgggaggccaaggcgggcggatcacgaggtcaagagatcgagaccatcctggctaacatggtgaaaccccgtctctactgaaaatagaaaaattagccaggcgtggtggcgtgcgcctgtagtcccagttactcgggaggctgaggcaggagaatcgcttgaacccgggaggcggaggttgcagtgagccgagatcacgccactgcactccagcctggcaacagagcgagactccgtctcaaaacaaacaaacaaacaaaaacaaaacaaaaacaaaaacaaaaaaaacactagtacctgaaattgacatgccaacctaaagcaatgtttaggcaatttcaaatcacagtaactggcccatgtctgcttcctcttgcagggaatcttcatagaatgtgactttgttattgccagtgccacccgtatgtcatgtcccaccattcaactagcctagcccagcctagctctgctcccacctggttcctttccctcttgagagagcaaattttgctcaggctgcccagaaacatcaacctgcacacagacttttgcatgtttgttttcaaacattaaattaagaaacctacaaccagagaccctctcctacaccccaccttatgtgccttccccatgccaagtaaccccaaatcctttgaggcatctgcaaaatatagtacggtaagtacgaacctttcaaagggggttttatagcttcttctttcattcttcgggttgcccaaggatatgcaggttggggattacttctggaggctggaggtagagcccagttatggctggaataagcctccctgctacatgcctctgataagctggaactctgagatgacatgagagcacgagccagagacggctatccctgttctgttatgaaccccactttatatcaaggcaatttaagtacaggaagggagcaagctgcaaagttcaacactgggccatttattctccccattgcgacatcactcagaaaattacagtcatcagtgtcctagctttattacacccccagcacgcacacaagaaatgtaacttaactgattatcctcacaaatcagtccggaaaaaattcaaaacacatgcacaggatttattttctcagaggctctgtggcatgcattccgggaggaacgtggcattcaggtcggagggttctacgcggaatagagaatagatgcaaccgtatgatttgtggttggaaaagaaagggaacgtctgatgtgctccttcctcccctaccctaatgttcagcacttggagacggatggtcggctaaacttatcatttaaccgagagaatcaagttgttgagactggcttttcttccaaccggatacgtgatgggtggagcaggcgccccctgttctgtcccagcaacctactaagacttccgaacaggaaggtgacacacggcggaggggtgcttgaggggagggggagacgggggagctgtgtgtgacgcgcgcctgttaacactgcacaggcattaggttgccctgtagctgctattcaaactcttgatctgttcttccttcctgtcgccagcctctttctttggtccagatagtcctcctactgggaggaatccggcccctttcctcatactccctggtggcgaagtggtccgagtagcctcccgaactgtttgtaaatgcaacctagagggcgatcgagttctctgggagaacttgctccatatacgcgtatacgcggcttcccccacttgtctcctgaggttctattggtccagggaatttctctacaacaccttgtgcagtcatagaaaatatagacggcttgataggagataggctaattacctccccactcctccaagcgaattgtctcacatttatgtctcggtgctgggaaaactgcagtcaaaaccctcaagtaggaatgactgaccaggatgaaaagtttgcactgaaactaaacgtttcccagtgcatgtgcattttaatgcttcagaaaaaattttttcactcttctattttatttttttatttctttatttgtcactctatagtctgatggactataaatgctaaaacctgagagcttcacaaagatatgactttttccatttaattttaaaaggcttataaattattgatatttctcaacatattagagaaaatattttgaaaaatattttttataaggacttaaccatattcactcttaagacacttcttaaatgtatcagctgtaattgtcatgattccccgggtatgttatcttccattgataacaaggcaatataattgtttcatattgttcaaagtaccatcaattttagaacaatcctatgaagagtttaagttcccatactttttgattcattgtttgatgctcacagaaacctttccctggaacaccctcaaaaaagctcatagaaataccagaaaacataattattataattatagaaaacataattattactctagagagaaactgaatggatcagtttttgttgaaggttgtcagcaaaggcatgtctttttttttttttttttttacagaaaatgatgatgacaaatgagtttattcattatagctattatagacaagtcactggcaatggtggttatttaaatgtctatttatagacacaggttgtatagtaattattaccttccatattcataattgtcaaatttgacatgcaaaaagatgtgatacagtagataactaagagaacactatctctaatcatagtgttaaaagttattaaaacccacaaaactaattatttcatttatcgcagggtttatattttttccaagacagaggtgataatattctacacccattccttctaaaaagtgagcccataggaaaattgacgggagggtaggaacaagatttggtagtaaattttttatgtcattcaggggataaattaaagagaagccagtgggaatacttgacatgggaggaatgagaagctttttttgtttgtttgtttttgtttttgacatagagtttcactctgttgtccaggctagagtacagtggtacagtcacagctcactgcagcctcaacctcctgggttcaagtaatcctcccacctcggactcctgagtagctgggaccacaggcacatgccaccatgcctggttaatgtttttatcttttgtagacacatggtctcactgtgttgcccaggctggtctcaaactcctgggctcaaatgatcctcctgcctcagcttcccaaagtgctgggattataagtataagccactgcgcctcacctgaggaatgagaatctacatagcaagaaacaaacagatctttctcaggctgaaaacttacccatctccatcttggcaatgttgtcaatgtctgatttagtataatccaatcaatgattaaaaaaacaaaacatcagctagaatgcaatatgataggtaaggaattgtatgtatgtgacaactttatttttggttctcaggattgacctggaaaatggtgtccacagaactttacataagattatgaaaaatgatacattggtctggacagaagagtaaattggaaaaatttgtaagtcaatatttaatactattggtaaactcaagaggactgtggtggccaggtgcaggggctcacacctctaatcccagcactttgggaggttgaagcaggaggatcacttgagctcaggagtttgagaccagcctgggcaacatagtgagaccctgtctctacaaaaaatacaaaaattatccatacatggtggcacgcctgtagtcccagctacatgggaggctaaggtgggagaatcgcttgagcccagggtgttggaggtttcagtgagccaagatcttgccactgcactctcgccggggcaacaaagtgagatcctatctcaaaaaaaaaaaaaaaaggactctggccttatatttttggcatgcctttactgttaggcatttgcattttaaaaggccacttgtcaactcaaaaaatttaatttgcaatgataaaatgtcaagcattcaaacaagaaacaggtctgagagctttggggtgagaggcctcccgcaatatctggcctggtcggcctcctctccattctctccaaggtaaaactacgtgggcatctacttcccccacaagtccagcagccagaatccttcctaagacacacatattaaaggtgtaactgacacgaaggcaatataaagggctctctttcacccccactttatttacaaagggccaatagtaaataaggagtctggatttctggtggacatcttttgtcaaactaaagtgaaacctgaaagctttgatttgctcagtataaatctctctccaagtctctcccgtttgttttctttctttctttttctttttttgagacggaggagtcttactctgtcgcccagactggagtgcagtggcgtgatctcagctcactgcaccctctgcttccctggttcaagcaattctcccgcctcagcctcctgagtagctgggattacaggcacgtgccactactcccagttaatttgagtacttttagtagagatggggattcaccatgttgatcagactggtctcggattcctgacctcaagtgatccacctgcctcagcctcccaaagtgctgggattacaggcataagccaccatgcccggcccaagtctctcccatttctgagcctataatcaatctagaaggaggcaacagaagctcgggccacccctaaggacttaaggactgtttcctgtaaactctgtgtgccagttgtaacaacaaaagatacatgtaatagtaaccagcaatggaaaaaccagttatggggatgtcagtctagttggcgacaactgaggcttgctacctgtgagttttttttgttttgttttgttttgatatggagtctcacttcatcacccaggctgaagtgcagtggcgcaatcttggcttactgcaacctccgcctcccaggttcaagtgattctcatgcctcagactctcaagtagctgggattacaggcacctgccaccacgcccgactaatttttgtatttttagtagagacagggttttaccatgttggtcaggctgatctcaaactcctgagctcaagtgatctgtcctcctcagcctcccaaagtgctgggattacaagtgtgagccactgtgcctagccatacctgtgagattttagacaaggtattctctaacccttaatcttgtcagctgtatagcggggagagttatacctgcctcatataagttgtgaaaaataatggaaataggccaggtgtgatggtttatgcctgtaatcctagcactttgggaggccaaggtgggtgggtcacttgaggtcaggagttcgaaaccagcaggccaacatggtgaaaccccgtctctactaaaaatacaaaaattagccagaaatcacttgaacctggaaggcagaggttgcagtgagctgggattatgccactgcactccagcccgggcaacacagcgagactccgtctaaaaaaaaaaaaaaggaaataaagaatttagtaagcgcctctctcatgttggagttttaagtagaaaatatgatctgtgtatatttgccagccccaccctacgcacatcacaagtacaaacaacactgtcgcacagtgcaaagggttccaacaaatcaaaacaatacatcaagtaattatgggctgtgagtaaggcacttgcacagcatgggccacttaatctgctgggccaaggcgaggcctatgtgacaggaattccgtgaaaggcctgaatgataatccaacctccccctcctccattcagtctccctcacagacagtgctcctgaatgtgctgtatcaagaaacgaaatgccatgattactgaataaagacttgtttaccaagtgtttgcagcaaagactgaagtttagtgtgaaaaaagtggagagcaaaccaaaactaactcaagaaagtttttacttgctcgaggaaacaacagaaggcaaatatagacctattgagagggtggagtcattgaaagaagatcagaggccagtcatacttatcgtgctttttctaggtcaataagcttatcctgcaggaatgagaagaggaacaagatccagctgaacctagcctctgttagttttaatcattcagatctctgtggtgcacctctttcatttactgatttattgtattgatataagttgatgaacatattttggggtaacatggtattttgaaacatgtatacaatgtgtaatgatgaaattaggataattgggatatccgtcatctcaaacatttattttttctttgtgttgagaacatgctaattcttcccttttaactgtttggcaatatacaataacttattgttaactctgatttccctactgccatatcgaatgctagaacttattccatctatctagctgtactttgtacccattaatgtgaatgggttcttgacaggcactgtcttaagccctgaatctaacaaggatgtcatgatgggcagcgttgctgtactcagggagggtgtggtctatattttgtaaaatggaactgcacgttcccaaaagcaaaggtgagcttatagacatttctgattttcctcaggccccgctatgccttaatgtcattaaagtacagccttgggcacgtttgatcatttagattatctagtttttcaagtgaggaatgtgctggaaagtcttctgcagctctgattttgtacagttctatgatgtctgggaaaaaaaataaacccagaaggaacttctggaggcccagaactactctcctggcatggtttcctataataatgtcccacacccagctgatcctttagaagaacctgtccccaccccacccccaccccccacccccggcattggatccttcggtcaggaatttgtgtgcttagttatttaaatctcaggtgtttctctggaccttgagttccctgaaggccaggcagcacaatttgtgtctctcacctgcctaacattctctaatcaggtcgctgcctgcccctctgacctctcctcctaccttctccctccctccaggtttgtaccactgtggtgctctctgttccctttgcaggccaagctagtgtctgcccgagggactttgtctttgctgtgcccttcacctggaatgctttcctcctcaggctcacatggctggctccttcttgtcattcggatctcccagtaaatatcacttacaggccgggagcagtagctcacgcctgtaatatcagaactttgggaggctgaggcgggcagatcacgaggtcaggagatcaagaccattctggccaacatggtgaaaccccgtccctacttaaaaaaaatatatacaaaaattagctgggcgtggtggtgcgcgcctgtagtcccagctacttgggaggctgaggcaggagagttgcttgaacgcaggaggcagaggccgcagtgagccgagatcacatcactgcactccagcctgggtgacagagtgagactccatctcaaaaaaaaaaaaaaaaaaaaaaaaatcacagtgacgcagtggaccaaaagtagccagcagctgacctttctttgtcattcactctatttcaattatctgcatattagttttattatgtgactttttctgggtttattgttgatttacccaactagaaagtagtctctatgagatagggatatcatgtttgtttgtttaagacagggtcttgttctgtcccgcagtctggagtgcagggctgtaatcacggctcaccacaacctctgcctcccgggctcaagcaatcttcccacctcagcctctctagtagttgggaccacaggtgtgtgccaccatgcctggcttatattttatattatttgtagagatgaggtcttgcggtgttagccaggctggtctcgaactcctgggctccagtgatccgcacacctaagcctcccaaagtgctgggattataggcataagccaccgaccctggccggaataattatctatattatttgccacatcatccctggtgcccaggagagggcctagcccacaggaagtgcttgagaaataaaatgctttcataatggtttgcattaaaccccctctatggacgatatcatatgaatttggcttatagaaaagtatgccattgtaacctgttttactcttgtcatccaaccaactttcctcaagaactttagaacttttcttcctgccaggggatgacacagtcacctcatagactgttttctttctgtcttgcagccatgaagttctccataatttttgtattgccagaaagcctgaatgaacatttagcacaacccccttctactttatatccctttatatcctcccaaaatagccttctctacacaatgataaggacttgataaaagggcccctattgtgcagtcccagcctggacaaagtagttttaaagccatagcagaatggccatcaggttgtcagaaatgacaaaagccacagcacatatgcaagtggtacaaatgcttagtgccaagttaagatatgaaactacactttcatatctctatgagtgtgtgtgtgtgtgtgtgtgtgtgtgtgtgtgtattagttttctggagagacaaaaccaataggatatatctagagggagacagagaaagagatggagaaagagaaagagaagagaggagatttattaggggaattggctcatacaattatgaaagctgagaaatcccatggcaggctgtctgcaagctggagaccctgggatgccactagcatggctcagtccaaatctgaagaactgagaatccgggggctgctggtgtaagtcctagcgtccaaaggccaaaggctggagaacctgatgtccgaaggccggagaagaagcatgtatcccagttccaggagagtgagtgacctacccacggttctatctaggctcccaagcgattggacactaccccccacacccccctgtccccgcattagtgggggcgggtcttttctacttagtccacccagactcacacatcagtctcctttggaggcacccttaaggccacaccccaaaataatgctttgccagttctctacgtattccttaatccagtcaagttgacacttaaaattaaccatcacacgttctcacctttcaacttggcagccattacacatctctttgtatcacacttaatctccaaataaagacaatagcaaagtgataattctacctaatataatgcacctgttctgtgtacaacagaaaacataccagtcccttccccagaagagaaggtaaagtccttgggtgatgtttactcttctgctgatatcccataacttaaatactatgatataaaattaacaatacttaaatactgacataaagtcaataaatcttgtaaatactgatataaagtcaataaatgtgttacatgataaagacataagagaagaatgaaaacaaagatattaatatatgtacatagacgcacaacatattcttaacaaaacagggaggaaatactcatcacagttgcagtgcttggttctgtaactggtcacgtgatcatagctggtatttataactaccttcctttaccacccattctatatttcctttaccttcaacaagaacctcagttgattgtggttctttatgtggcaggtgacccaaacctacatttctgaagagtctgggccattcacagacttactcagattgagttgttgtaatttctcattgaccttaatcacaggacatggtaatactaagagacatcctaagggatctcctgtatttcagacatacacttctgggttttttttttggttttttttttgagacgcagtctcactgtgtcgcccaggctggagtgcatgggtgtgatctcggcttgctgcaacctctgcctcctgggttcaagcaattctcctgcctcagcctcccgagtagctgggattacaggcacccaccactatgcccggctaatttttgtattttagtacagacggggtttcagtatgtaggtcaagctggtctcgaactcctaacctcaaatgatctgctcgcctcggcctcccaaagttctgggatttcaggtgtgagccaccgttcctggcagacatacacttctttatctccattgtggaatagtagtccaatttctccctagtattttgaatcagttactccagccaacatcataactcccttcttagctttttgattcagaggcatgaggatcccaaagtggctgggtggtagtcttaacttccagttcaatggaatcattgttgtgtctccggaagcactcctccctctggaactaagacctccaggcctgcagatcataaagtcgtgggaacagaaagcaaaaatgtttccaatgggtcactagggggaatagtgagtggtgccactcccatttccaccccttccaccccttccatttctggacctgtggatcctggctatgggagaagcagcaccatatactggatgttgattcagagcatatacaactttctggagaaccttgcaccagccatgcaaaaaaatcatcaccgtaacttcaaaaggccattacaccattcattctattaacccagctgctccaggatgatgggaaacatggttaagaccagtgaattccaggagcatgggcccattgctgcctctctttggctataaaatgtattccttgatcagaagcagtgctgtgtctgtgtggaataccatgacaggggatagggcattctgggagtccatggatggtagttgtggcagaagcattgtgttcaaggaaggcaaatccatattcagaataagtgtctactgcagtaaggacaaaacactgcttcttccatgatggaagctgtccaatataatcagcctgcgaccaggtggctggcagatcaccccgaggaaaggtgccatatcagaggctcagtgttcatttctgttgctggcagattgggcactcagcagtggctgtagccaggttggccttagtgagtggacgtccatgttgctgagtccatgcataacctccatccttgccaccatggctactttgtttatgagctcactggatgcaagagtagttggggaaaggggctgtttggtatccacagaatgggtcatcttatccacttgattgttaaaatacccctctactgaggtcaccctttgctgagaattcatgtggacacaaatatctttacctttttttttttgctcattcagagaggtctattcacagatcacttccccaaatttctttgtcaccaattttccaatcatgttccttccaagtctctgaccatccagccaaactattggccacagcccataaattggtatataatcgcatatctggccatttctccttacaagcaaaatgaacaaccaggtgctcgaggttctgctcactgtgcgggtatcttttcagcactgtccttcagggacctgccagaaagagaccacagtgctgcagctgtccacttgtgtgattttgtgattttatatatagagatatatacatgtatgatagcatcagtaattcagcggtgttacccatagcatgagggtatgacacacaggcttcacctcacacagagacatgaaaacaataatccaccaacttcatactaagcaataaacactaagatttttatttcctgaggattccacaccttcattttcttagcacacagtagatttcagagccaccacgcctggccaacttttttttttgagtcagggtcttgctttgtcacccaggctggagtgcagtggtgtgatcatggctcactgcagcctcaacctcccgggctcaagtcatcctcccacttcagcctcctgagtatctggggctacaggcacatgccaccatgcctagctatttctttttctttttttttttttttttttttgagacagggatctcctatgttgcccaggctggtctcaagctcctgggctcaagtgatcctcccaccttggtctcccaaaatgctgggatacaggtgtgagccactcacgcaacccagacaatttttttttacagacactttttataaaactatttgtttctcagttgtgattatagaatccctttaacaaataagattagttatccccagaggattgtttgatggtttggggccaagcatttcagatactgcatattaactacctcttttatacaggtgtgtgtgtgtgtgtgtgtgtgcgtgtgcgtgtgcatgtgtgtatatataaatatacacatatatttttgtgtgtctgataacaccaactttgttccctaatcatcatttcacagaagatacaaatggaatctaaaagaatgaaaataagcttttgtataagaccacaagaaaattacagagaataaatgaaacagatgtgagcaaaagatggggatcatacataatgtctgaccttataaactacataaacatggttacttcaagaagctactactataatattacttattatttgtttatacaattttgcttaaaattacatcgtactctctacttatttagagcaaatgattgtgccaaatagataagactatttccatcaattagtatctacaattattctatttcacaactcataaagtgttgcttaaaaatctaattccttagagcacaagcacagatcatcacaatagacctagttaaagttcattcttcaaatcgtgttgtttatataccttattatatactgacataaatccagtttagcaaggtatttaataagccctgactttcctttttaaaagcagaagtattcccttttctctctttaccacattgtaagtactgttttttttggttgttttttgtttgtttgttttgagacggagtctcactctgtcacccaggctggagtgcaatggcaccatctcagctcactgcaacctccgccttccggattcaagtgattctcttgcctcagcctcctgagtagctgggattacaagcacgcgccaccatgcccggctaatttttgtatttttagtagagacatggtttcaccatgttggccaggctggtcttaaactcctgacctcaagtgatcggcccgccttggcctcccaaagtgctggaattacaggcgtgagccactgcacctggccctaagtactgtttttatatctacaatctgctcctatattcataactgatggccctttgacttttccttctatagtgggaaaacaacaatcaaagagcagaaatggggccctgtcatacatagttccttccttccttccttttttttttttttttgagatagagtctggctgtatcacccaggctagagttcagtggcatgatctcggctcactgcaaactccgcctcctgggttcaagtgattctcctgcctcagcctcccaagtagctgggattacaggtgcacaccaccaggcatggctaatttttgtatttttagtagagacagggtttcgccatattggctacactggtcttgaactcctggcctcaagtaatccacccacctcagcctcccaaagtactgggattataggcatgagccaccacgccaagcttcctggcatacacagtttttaacaccccttgtcactgttctcttcccacctcccattatcttttcttagggctttgattttcttgaggattataggtttttaaaaggttgaaagggaccttgcaaaatccctcaggactgctattccttttctatctcttcttaaaaataatgttaaagaattaatattacatacattacaaatattagaaagtacatttacataagatgtgaaagaggcatacgatggtaacagacacactagacttagctggattacttctaggaataatagtaagtgtctaaaacaggttgccttgttagaacatgatactactgaatctgagtgcttatcttcctcatatgtgccaattatgtttttgtcgaagagcaatcctttctgattttcgcagactgctttctgattatttgtctcacaaagagactgggtaaaagcatgtggctttatttttgccatttctaaaaataacccaacagctatgctgtgcactgctcaccttagcactattgtattcatgtgtttatgtgtataaaggacagttcatagtcagcatattcaatgcttttctccctctttgttttaaagttcaaagttactgtctacacgaaagttggggtatttcaccactagcctcattttatgctattcataaaatcatgagcagactttttaccaagggcaaaaaaatcttaagaaacaggaacatcccccttcccccatacaatattcctgacaaccatttattaaggtctttctctaatctttcgctggaatcacctctacttcccaaaccatctctaccactgtcaactagcatcaatcgttaaagttcttcgttaggctgtgatcaaatatcctcatgaaggttttttaaggagtagctcttctacacattctcaaggcgggtactacagtggtgctaaggacatacctatcagcgaaatgaacatgttctctttaagttccacagttaagtccacctattataatagctgacatttcttgaacgattatactaagtggcagacactatgcatagtgtttggtgttttgtttttttgtttttgtttttttttttttgagacgaagtctcactctgtcgcccaggctggagtgcagtggcgtgatctcggctcactgcaacctctgcctcctgggttcaatggattctcctgcctcagcctcctgagtagctgggactacaggcatgcgccaccacgcccggctgattttttttttttttttttgagacagagtctcgctctgtcaccaggctgcagtgcagtggtgtgacctcggctcactgaaacctccacctccgggtttcaagggatgctcctgcctcagcctcccaagtagctgggacggggcccgccaccatgcccagctaatttttgtatttttagtagagacggggtttcaccatgttggccagaatggtctcaatctcctgacctcgtgatccgcccgccttggcgtcctaaagtgctgggattacaggcgtgagccaccgcgcccggccctgatttttgtatttttatagagatggggttttgccatgttggccgggctggtctccaactcctgacctcaagtgatccacccgcctcagcctcccaaagtgctgggattacaggcgtgggtcaccatgcccggcctaagagccaaaattttaatcagtgggaaatgctgactgccacgctcatttaagaggaaaggtcaggatttcgtgagctgcattgttcactgacatctactttaacgactccagcccagcctgagctaatcttttcctaaatcctttgcattttctttctactgtcaatttacaccttaacaaaataaaggagttttagagtaagatagaatcaacttcaatcaactctcttgaattcgctggggaccctctgctctaaaatatagtactattcttgcctctggcatccctggttttaccttcgtcttcctacctccctcccacctccatccatcccccctccccccattcttttgagtgcagtggcacgatcttggctcactgcaaactctgcctcccgggttcaagcgattcccccacctcagcctcccgagtagctgggattacaggcatgcaccaccatgcctggctaatttttgtactgttgtattttcaccatgttggccaggctggtctgaaactcgacctcaaatgacccgcctgccttggcctcccaaagtgctgggattacaggcgggagccactgcgccctcctggtccacccactattaaccccttatttcctacccttcacctgcacctctttgagggccatttcattcctggaatagcctgttttcattattagttatgggcctattttccttactatgtacaattttaaagtcataaaataatttttcttcagatgttaaaaattgtgtttacatttaaccagataaaacacttgttattaagggcatatgttcaaaaatcttcttttccatttattttctctaagtcaggcatataagctgatatcatgtcttacatattttaaactaaatttgacctgaagtcacctctgttccttgaatctctacctgattgcagctcagcttagtatgttcacaaactgaaaacctaatttaggagtacgttataagtcctcactaaaaatggtagctaggttcttagatattgtaactttaagtgaaataaagtataaggaaaccaatttcaccataagctaattgatataatgaggaattaacttcctattgcatacttatggacataaaaacatcacataacttctaaataaagaccaaaacacttcaaatactgaacattgaaataaattcccggtcttgcccaggtgatctcatctcagcctcccaagtagctgggactacagggatcttctccctttgttttttttctagccccacttccagtttgtttccacagtacttagagtgagttgctgttgtttttcttctttgttctgttctctctttattttcttatgttccttcctgcacactgaagttgctgttgttttagattttctttttttgagtgagatcttctcactcagtcacctggctggagcgattaatagctgactctgggtacagtgcctaagctagccttgctctgcaaggaacagttaaaaaagaaaagaaaggagaggagaggggaggggagaagggaggagaggggaggggagaagggaggagaggggagggaaggggaggggaggggaggggaaaaattaataaaaactaagataactatttacccaatgattccacttgaggtggtagacaacccaagcttatcctggcagctcagggaacaaggtgacaccaaccttggacaggagtccgtcccatcctcaaggcacactcacactcacacccacactcatgctcactcagactgggacaacgtgaacacgccaatgaacctcaacatgcatatctttgggatgtgggaggaaagtggagttacatggagaaaacctacaaagacatgaagagaaagtgtgaactttacacagactgtggccccagctggaaatctttttttttttttctcatcaatgttataacgacatgctatatatatttttgttacaactagctgagtctcagccaatcacagcaaccaaacttcagctaatcacagcaactgagcttcagccaatcacaggatgccaactgatcagacgatgcccaaataaggcaaatttggagctttaaccagtcaagctgtttgtgtacctcacttccagttctgtctataaatgctccctgtccacctatttgcccagtggaactctctgagcctcctttggttctgagggctgcttgattggagaatcattctttgctcaaataagctgttaaattcaatttgtcaaaagtttttcttttttttttttttttgagacggagtctcgctccgttacccaggctggagtgcagtggcacgatctcggctcgctgcaacctccgccgcctcccgggttcaagtgattctcctgcctcagtctcctgagtagctgggattacaggcgcacaccaccatacctggctaatttttatactttttggtagagacgaggtttcaccatgtcggccaggctggtcttgaagtccttacctcaagtgatgcgcccgcctcggcctcccaaagtgctgggattacaggcgtgaaccactgcacccggcctacaagtttttctttccacagtattatgtatcctgtattatgagataaacttcttgggcaaaaagcaagccattaaaggctgaatatttcagcatgcctaacttaataaaatttaggacattttaacttttgctacagttaaaatccactagactttttgatctgctgccatattagtttgattcaaaataatgagagcagatttattaaaatatgaagttgcatttcatattttccttgtattttttaagtgagaaaatttcctggtatcattttagctatcataaaatgccttttaggactatggaaatgaaagatcttggacataaatgatttggataaaataagcacatgaaaatactgcctgaaaatagttttaaaagaatcctgaggaattagaaaaacgagctattgtgaaacactgttagtttagcctttagtaaaacagcagaaataacaagcaattttggtcagaacaaagagaaagagaaaattgtaagttccacaaacgcagaaacagattttgctccaattggaaagcttcagaaagctaaacccttcatttacacaatccaaggcagagtgaggggcctctctgtgttgagctaaactgagcctatagtcacacattcacacatttggcactaggacagttgtgaggataggatctgacaaacttttcactgccaaacataactcagatgctagatgagcatgactctaagtatctttacacagagagtttagaaataacatttccctactcactggaataaataacccatccttgaacttggaaccatctaaaccattgtagatggtttaagtcatgcaaaacaaagtgctttttgctttctagatcttagcttaagaatgcaatattttatctaaatgactaggcaactaaggttcgctccaatttgaggattttaagtctagccatatgtctatttccaggaagcttatcagttttgtgtctggggctccagataatggaatacagcaaattataagcttcatggttcagcagaaaaaacaagtttggggtccagtaatgtataaaatagtaacagtaatgataaaacaaaatgcattcttctttcaaaccatagttagtaaatcccatgaaagtgtaatcctagataaatgtaatcccatgtaaatgacataattctttctccaggtaaaaagagctaacataaattgaccactaattatatgttaacacagttataaatacctttactgcattatcttttttaatccccacaaaattctataatctattattactatttcatttttgcatgtataagaaatgaaaggacagagggttaaataatttgcccagccaggcacgtgactgtaatcccagctactctggagggtgaggcgggaggatcacttattttttttaaatttaaaaagagatggggtctcactatgttatccaggctggtcttgaactcctgagctcaagtgagctacctgccttggcctcccaaagtgctgggattacaggtatgagccaccgtgcctggccaagaggatcacttgagcccaggagttcaagtccagcctgggcaacagagtgagactctgtctcaaacaaagaaaacaaagaaaaaataataatttaccctaaaaaaaattaaaataataataataaaataataataatttgcccaaagtcacacaggtagtaagcattgaaatctgtggcaaactcagaaggcctgactcaagaattcacgacacaaccacaacagattgtacactaccgggcagtttcctgctgctctgtgcatggcctgctggccaactctgatgtgaggtcagttgactaaaagagatgtggttcaggaagctgagaatgattgtggttacctgttctaagatagagaaattgatttttaaaacttcgagttgaagtacgggatgccaaaaaccacgtatgagtgacagagtgagtgggtctctttctgatggattaagtcttcaaaaagactttcagaatgaatctctatctaccttaattttgggcagtgttaattgtattcattttttcaacacatttgattgtgcatataccatggacaagaaagtttgttaaaaactgaatgtataaggctgggtgcagtgactcacgcctataatcccagcacttcaggaggctgaggcggacagatcacttgagcttaggagtttgggaccagcctggacaacatggtgaaaccccatctctacaaaaaacaaaaaaattagctgggcgtggtagcttatgcctgtagtcccagctacttggggggctgagataagaggatcgcttgaacctgggaggtcaaggccacagtaagccgtgatcgcactaccgcactccagcctgggtgacaaaataagaccctgtctcaaacaaccaacaacagcaacagcaacaaaaaccctaatgtacaggaaattattttggggagtagtggaagatagctggcaagttggagactctaacttgagatgtggtactacttgtctgtacattttttttctcatttctgtctacccaaaggtgttatgtttttattgtcttaagggggcccttcatttgatggcataaaaagttatgaccagccatctgtagttcagttaataggtcaagaatatcagcagctattgttatgttgaggtcattatttatcaagcttcaacacataaaaagcaaaagtaggccgggcgtggtggttcacacctgtaatcccagcactttgggaggctgaagccagtggatcacttgaggtcaggagtttgagaccagcctggccaacatggtgaaacttaatctctactaaaaatacaaaaattagccaggcatggtggcggatgcccgtaatatcagctacttgggaggcagaggcaggagaatcacttgaacccgggaggtggaggttgcagtgaactgagatcgcgccactgagagcactgcctgggcgacaaagcaagactccatctcaaagaataaaataaaataaaataaaataaaattaaattaaaataaaataaaatataaaataaaataaaataaaatataaaataaaataaaataaaataaaatagcaaaaatagtccaaatgtcagttaacagggggaccaaatttatgggtgaacatccacaagaaacataagtggcctctagggaagccaatctttgcacagaatttttgtttaatgaggtggagggtatacaagatataggccaaaggataatttaggttcttatgactgtgtccttgttcttttcaaatcctagcttcatctctgctcccactgatgacactatgagactttggaattcttcactgtgtgtaagacgattttattactgagatagctaccgctttgtagttatgacctgagtaaacaaggttagtcaacccacaggattttcatgtgtccacagatttttactagataatttatctgtaatatcaggaggcaaagtctaccatgaatatactggccaacatgtatcagatggaaaattcttgtgtaagcagatgatgtttaacttttatcacatttttctcttttgttagataatgccatacttcggcagacaagcaattgttttctagctataaatatgagtattttgcttttcaagagaaaaaatctagaaattgttttctttactttaaaaaattcatgtactgaagtccttcctctgcttgtattaatccaatgatatcattttatatattctctgaaatactaaaatatttctgtagtccatatgttttcaaattatgaatcattttatttctacatttggtacataaactattactgctcctgagtaaatatggatataccactttatagtgattttttttcttctttttctctttttctattttttttttttttttttttgaaaacagggtcttactcctggcctcaagtgatcctcctgcctcagcctcctgagtagctggaattataggcatgagctaccagtagtgattcctaagtccccagaaatttgagctaatttttatttatttatttattcttgtatttacttattttgaagacaaggtgtcgctccgtcacccaggctggagtgcaatggcatgatcatggctcaccgcagcctccaactcttgggctcaagccatccttctgcctcatcttccttagtagctgggaccatacgtgcaagccaccacacccagcttgagctgatttttttaatgtgatgaactatgagaaaacatataggagctaaatgatgagaacttagaaacacaaagacggaaacaacagacactatggtttacttgatgatagaggatgggagggtgaagaggagcagaaaagataactattggataatggacttaatacctgggtgatgaaacagtctgcacaacaaacccctgtgacaagagcttacctatgctggcccggcatggtggctcacgcctgtaatctcagcactttgggaggccaaggcaggcagatcacttgagctcaggagttctaggccagtctggccaacatggtgaaaccggatctctactaaaaatacaaaaattagccaggcgtggtggcgggtgcctgtaatcccagctactcaggaggctgagacagaagaatggcttgaacctgaaaggcggaggttgcagtgagctgagattgcgtcactgcactccagactgggcgacagggcaagactctctctcaaaaaaaaaaaaaaaaaaagaaagagagtttacttatgtacaaaccttcaaatgtaccaccaaacctaaaacaaaagttaaaaaaagaaagaaaaataaatgtagaaaaaaatatatatatatatgaacaacgcataatcctggaaatataaggaaaaattaaattttctcctctgggaaaaatttatacagtaatgattcttgctctttaatttttgtttgaaagaaatctagacatttaaaaaaccccagtggtagaattgtcttgttaaaaagggacatcaagtaaaaggccaggggaacatcaaacaattatgtttcttacctggcaaaaccagtgtctagctaaaataatggcttgcaaatcaatcttgttgtttaaccacttcattatctggttttctctaagcaaagaacattatctgtgttgccaataatagtactggggaaaaacacacattttgaaagtatgaagaaactcattctaccttgaaattctcattcaagaggaaattataggccactgcaggaccagcgattgaaaaacaaaggtgtacaaaaacaaacaactcaggtttcaaaggctaaaaacaaagataacaggaaagaacctaaacttgtgcagcctgtttgcttactgtctgaacaaatgctgggaatgcatgagaaattctaagccctgtgaacaaaagtgtgagcagtaagatgacgggtgatcaattttcttcctttctctatttttcattttttccctatgatgagcatatgccacttttatgttataatgataaaaaagaaagacttaaaaaatgacttttgtttttccaactgtataccagtatctatctacacatagcaactgagcacgctagtcctgtcgtctggcactcacacaaaaagagtgaatgtcaaaatctaggcaattctaccagatttcacgtaatgaaactaccttgaataattccttaattcttcacaaaatcatgtttttatttaacttctatttctatcaagcaatgtggactaactacccctaatatttaactctatttaaactgtgtatcaggccagatgctggctcacacctgtaatccaagcactttgggaggccaaggcaggtggatcacttgggctcaggagttcaagaccagcctgggcaacatggagaaaccccgtctctacaagaatacaagaaattagctgggtgtggtggcatgtgcttatagtcccagcttcttgtggggctgaggcaggaggatcgcttgagcccagtaggctgaggctacagtgagctgagatcatgccactgcactccagcctgggtgacagagtgagaccttgtctcaaaaacaaaacaaaaaacagattacacactacattaaataaataaaatactctctgatgatgactgattttgaatgaaaatactccattcactggaatatattttccataaaaaatgacaaaaacattgtcattttttgtattatttctttttcttttcttctttttttttttttgagatggagtctcactctgtcccccaggctggagtgcagtggcgcgatctcagctcactgcaacctctgcctcctgggttcacgccattctcctgcctcagcctcctgcataactgggactacaggtgcccgtcaccatgcccagctaattttttgtatttttagtagagacagggtttcaccgtgttagccaggatggtctccatctcctgacctcatgatccgcccgtctcggcctcccaaggtgctgggattacaggcgtgagccaccacacccagccttatttctttttcttttttggagatagagtctcgctctgttgcccaggctggagtacagtggcccaatctcggctcattgcaacctctgcctcctgggttcaagcaattcttctgcctcagcctcctgagtagctgggattacaggcagacaccaccaggcctagctaatttttgtatttttagtagagacggggtttcaccatgttggccaggctggtcttgaactcctgatctcaggtgatccacctgcctcagcctcccaaagtgctgggattacaggtgtgagccaccacacccgacctattatttcttgtattattaaaatcatttcaggaatttgtaaaagttacagtaataaaactcgtactgcaaccatgactagaacatggcctttgtaaagaatccatttacaggctcataagatttggtgttgtggatggatggctatggagctgctcaagcttgtgtttgcacttatcagaattcaaggcagttagaaagagtttccaagtgctgatgtgctggagaagaaagggcatgctgcagtgtagaaaccacgggagaaacaattgcgtcacctagtttcaaactgtgagaaaactactagcgaactagaagaatatttaacttcctaaacctgagagatctacatcttaaagaatatagattctactctaggcacatcatagtcaaactgataaaaaataaaaataaaaataaaaataaaattacagcagccagtaaaagactacacgttacattcagcatagcaataatgtaaacattgttgacttctcatcagaaactctacaggccagaagacaagaaccaatatctttaaagttatgaaagaaagaaaaacaaagtagccacgcagaattccatatctagcaaaaatatccttcaagaatgaaataaaggtatttccatttataaagacatatcatgtagataaaagaaaactaagatatttcactgccagaagacttataagaaatcctggccaggcgcggtggctcactcctgtaatcccagcactttgggaggctgaggtgagtggatcacttgaggtcaggagttcaagaccagcctggccaacatggtgaaaccctgtctctattaaaaatacaattagccaggcatggtggcatgcacctgtaatcccagctacttgggaggctgagacaggagacaggagaattgcttatacccgggaggtggaagttgcagtgagctgaggtctcgccactgcactgcagcctgggtggcagagcaagattctatctcaaaaaaataataaaaacatgaaaaaaaagaaatcctaaaggaaaatttccaggctaaagggaaatgataccagagagaaacagattttcaggaagaaatgaagaacatcagaaatggcaaatatctggataaaaacaaaagataattttccccttattttttaaaaaatgcactgtactgtagggtttagtacatatatagataatacatatgacagctataatataaaagatgagggtagagtggggtagatgcacctacattgtttgcaaattttgacgatggtctatgaaaatttaaagtcatttattctcagctgggtacagtggctcatgcctgtaatgccagctctttgggaggccgaggtgggcagatcacttgaggtcaagagatcgaggccagcctggccaacatactgaaaccccgtctctactaaaaatacaaaaattagccaggcgtggtggcacgtgcctgtaatcccactacctgggaggctgagacaggagaattacttgaacccagaaggtggaggtcacagagagccaagattgtgccactgcaccccagcctgggcaacagagtgagactctgtctcaaaaaaataaaaataaaaataaagtcatttattgtaatcttcagagcaccactgaaaatgtgatgcaaagaggataactagaaagtcaacaggtaaattaatattaaattctaaaacctattcaaataatcctagagaagtcaggaaaggaagaataagcaaacaaagaagagaagggacatatagaaaacaaatagcaaaacagtaaagttaaatctaactgtgtcattacattaagtataaaggggctaaacatcacaagtaaaaaaaacagagatcattagataggattttaagaggaaaatctaaccacatgatgtctataagataagcaccttaactataagacacaggttgaaagaaaatggaaagaaaaatatgccatgtgaaaagtaggctttagaagattggactggctgtatctatcagaagaaatagacttaaaacaaagacttttaccagagataaagaaggaaatttcctaatgataaaatgatcagttcattaggaaataataataatcataaagatgtgtgtgtggttgggcacggtggctcatgcctgtaatcccagcactttgggaggctgaggtgggtggatcacctgaggtcaggagttagagaccagcctgaacaacgtggcaaaaccccgtctctactaaaaatacaagaattagctgggagtgatggcatgtgcctgtaatcccagttactcaggaggctgaggcaggagaattgcttgaacccaggaggcagaggttgcagtgagccgagccgagatcatgccattgcactccagcctgggcaacaagagcaaaactccacctcagaaaaaaaaaaaaaagtatatgtgcctaataacagaggttcaaaatacataaagcaaaaattgactgaattaaaagaaccaaaagacaattctaccactagaggtggagattttaaaacactcttagtaatggactgaccaactaggcaaaaaataaataaataaataaataaataaataaataaataaataaataattactctagacatagatcctactttatgagttggttaagttggtgactgggaaggatcttcatgagatgagctcttgtaggagggacactccattctttgtaacactactgatgaaggaaaagtaataaaaacgttttaaaaatgagtatgtctattgcaccactgcactccagcctgggcgacagagcaagactccatctcaggaaaaaaaaaaaaaaaaaagagtaagtctgaaatatttctattcctatttctctatgtgttctgcattagtttttcttgtaacttttttttttttttttgagatggaatttcactctttttgcccaggctggaatgcaatggcacaatcttggcttactgcaacctctgcttcctgggttcaagtgattctcccgcctcagtctcccaagtagctgggattacaggcacgtgccacacctcccggctaatttgtgtatttttagtagagaaggggtttcaccatgttggccaggctggtctctaactcctgacctcaggtgatccacccaccttggccccccaaagtgctgggattgcaggcatgagccaccacacccagcccgtaacataatttatttaggcttcaaaaattgtccaagcaacattttctttttctttctttcttttctttcttccttccttccttccctccctccctccttttctttctttctttctttttctttctttctttctttctctgtttctctctttctctctttcagtgaaagcaagtttattaagaaagtaaaggaataaagaatagctgcttcacagatagagcagtcctgagggctgctggtcaagcaccattttctagacctgtcctgtacagatttccctccctttccattttctttacataacatcaagaatcatttatgttcctttggtaatgtttcattctacattgcttcttcataacacatgtgctgtagatcttactagcagtattagccagcagatggcttgtttattgtggtggtatactgctgatggactgaaatgatggcataaataggctaattcacttttatgttttttcttctttcttcaaaagatataataaaacaagacagaaaacaattttttgacagatgaaattgataatgtttagaccgtaagtctggtctttgaaaaaaaaaaaagccatcagaaagtttctcactttccttctcaagtcctcctgtttctgctaataggcacagcctctgactcccttttatgaagaacagattatagcacagatttagcccaagctgtttctgctaggagagctgcttcttcctaagaagcgtgctatagaactgggcagtccactctccattctcctagccttggtattttctggctgcgagctttggatatgtcagctaacctattcagcttattatttcatttctaatagaggcataacaaggaaagggctgtctctcctatttcaagggattgcggcaaacactacattagatttctgtgaatactccttgtaaaagcgtgaggcataatacaaatatcagatatcagcgtgagttttctatttcattagacctatttcattagaaaaggtgaaagctctattatcactctcttaattgttttagctcctttttgcttcaccttcccttttatttctagtgtctactttgtgcaattaggcctcacggctcatgtgtgtttgtgaaaaagaatttttaaatgtcttctatttgctatgagaacataccctactctttgtctaagcgtaatttctaatcatataacctgaagcatattctccgatctcataaagtggcattcttctgattctgattagatgtacagccctaatatcatagtgcaagtatacatgccctcccataagtattctgaagtatgattcaccctaggttttcaaatctcttccttgccctagaaaacaaacttggactcatgtgtttgcccactttattcaactcctctgtcttctactccagcaaatagactcattcctcattcctcccaacacttaaatatgcttcacaatccacaaagctgtacctgatgatatatatatatatatatatatatatatatatatatatatatatattttttttttttttttttttttttaaatgacaggcaggtaatgtgcagacatcataacaaggcttgaaggaggcatatctcacacaggaacatgaaaacccaatcatcacacttataaacgacaaagggatctagtatatacgttttagatactgaaaagaagacataacaaaaggacttttagggtaaaattgattgcaaggctaggtatggtggctcacacctgtaatcctagcactttgggaagccgagctcagcagattgcctgaggtcaggagttcgagaccagcctggctaacatggtgaaaccctgtctccattaaaaatacaaaaattatccaggcatggtggctcatgcctgtagtcccagctacttggggggctgaagcaggagaatcgcttgaaccctggaggtggaggttgcagtgagccgagatcgtaccaccgcactccagcctgggcgacagagcaagactccgtctccagaaaaaaaaaaaaaacaaaaaaaaaattaattgcagtgtattcgagtgttgggttaggtaagaataaataaacaaggccgggcgcggtggctcacgcctgtaatcccagcactttgggaggccgaggcgggcgaatcacaaggtcaggagatcgagaccatcctggctgacacggtgaaacaccatctctactaaaaatacaaaaaaattagctgggcatggtggcgggcgcctacagtcccagctactcgggaggctgaggcaggagaatggcgtgaacctgggaggcggagcttgcagtgagctgagattgcgccactgccctccaacctgggcaacagagcaagactctgtctcaagaaaaacaaaaaacaaaaaacaaacaaacaaaaaaatatttccccccaaaccttgcctttgtgtagagctttactacagaatgtatcctgtacataacaggaaacaggttgtatttttccaataatacctggatcatcattagtccagaaggttcttggatcgggcttggtcaggatgttggcatgattacatggctctctcacctttaaaacataaagagaaaagaagtgatataaaaatggcttcatcatttcagctattttaggcttatagttctagagaaaggattccaaggctgaaactagtacatatggcatgtctgtgctctaattagggtggttttctcaggaccgtgctgggtatagcactgaaagtcccatatcctgggaagccttttagtcctgggcaaaccgggacagttggtccccttacacatgaagcagtttcactgggctgatggctgggttagcacatgggcgctggagctcacccagtgctatgtgcagtgcacaaactgcacagccgtatgaagaggccctggattattagcaaatttatcagtgtagacactcaatacataaaaagtgtttgaatctccacataacagaaatgatacttttagtacatattgcttgggaaaatacatattaattaaaagctacttttaattcagtagcactttaaatgctttttttgtttgtttgagacagtcttattctgttgctcaggttggagtgcagtggtgcaatctcagctcactgcaacttctgcctcctgggttcaagcgattctcctgcctcagcctcctgagtagctgggattataggcgtgtgccaccacgcctggctaatttttgcatttttagcagagacggggtttcaccatgttgcccaggctggtctcgaactcctgacctcaaatgatccgcccacctcggcctctcaaagtgctgggattataagcgtgaaccaccgcacctggcctgcattcttattttataatcataacaggatctttatattctcaaatagcagcacatgtacatatgcaatatgtattatttagtccacttagaggctcttcttagtgcagatacatgtttttaatgataaataatatttattgagcattttctgtcaggtattttttcatttttaaaaaaatttcaatagatttttggggaacagatggtgtatggttacatggataagttctttagtggtaatctccgagattttggtgcacccaacacccaagcagtgtacactgtacccagtgtgtagtcttttatctcttgccccactgtcacccttccccttgagtccccagagtccattgtatcctctttatgcctttgcgtcctcatggcttagctcccacttatgagtgagaacatatgatatttggttttccattcctgagttacttcacttagaataatggtctccaattccatccaggttgctgcaaatgctattattttgttcttttttggctgggtagtattccatgtatgcgtatatatatatatacacatatatatgtgtatatatagatatacacacacacatacatatacacacatacacgcatgtatatatatgtatgtgtgtatgcatacgcatacatgtatgtgtatatatgcatatacatacatgtatgtgtgtgtatatatatatacacacacacgtgtttttttcgtatatgatttcttttcctctcgatagatacacagtagtggaattgctgggtcaaatggtaaatctacttttagttctttaaggaatctgcatactgttttccatagtggttgtactcagatacaattaatagatttcatataacaagttccacagagcagcagtgatccatgtttttgacagctttatactactgtgatattagctttcaaatatattctcaggccaggcgtggtggctcacccctgtaatcccagcactttgggaggccgaggcgggcggatcagctgaggtcaggagttcgagaccaacctggccaacatgctgaaatcccgtctctactaaaaatacaaaaattagtcaggcatggcagcgcatgcctgtaatcccagctactcaggaacctgaggcaggagaatcgcttgaacccgggaggcagaggccgcagtgagctgagatcgtgccactgcactctagcctggacgacaaagcgagcctctgtctcaaaaaaacaaacaaacaaacaatcaaatatattctcatgaagttaaatatagatcttagtgttaaaactgcttttccatttatatatattttgtaatgtgatcatttgattactgcaaatattctatagtttcatcaactacttagtggataaattccttccattgcaacaataatcaaaatactcaagaatgacactaaggtcattgtttagtttcaccgacattttctctttataacaaggcttttgtttttctttgttgagatggagtctcgctttgttgcccaggctagagtgcaatggtgtcatctcggctcactgcaacctctgcctcctgggttcaagtgattctcctgcttcagcctcaatagtagctgggattacagacgtgctccaccacgcctggctaatttttgtatttttagtagagatggggttttgccatgttggtcagactggtcttgaacttctgacctcaggtaatccgcccacattggcctcccaaagtgctgggattacaggcatgagccaccgtgccaggcctgtgaagctctattgacgaaggaagcagtgcatgaatttaccatctggtacaagctccttctcttgtggaccagtatcaaagaatatgtggaaatcagagaaattgggatctcaaagaggtattttcacttccatgttcattacaactttattcacaacagccaagatgaggaagcaacctaaatgtctactgacggataaattgataaagaaatgtggtaaatacatacaatggaatattatttggcctcagaaagaaatcataccatatgtgacaacgtggatgaaactggaagatgttatgctaagtgaaattagccagtcacagaagaacaaatattgcacgattccgcttacataaggtatgtaaaatagctaaacacatagaagcagagaatagaatggtggtttccaggggctgcagggaggggcaaatgggaaaatgcttgagttgctattcaatgggtataaaatttaatttaggcaagacgactaatttctagagatctgctgtacaacatggtgcctagagaacattactatattgtgcacttgaaaaattgttaaggccaggtgcagtggctcacacctgtaatcccagcactttgggaggccgaggcgggtggatcacgaggtcaggagttcgagaccagcctggcaaacatggtgaaaccccatctctattaaaaatacaaaaattagccgggcatggtggcgggcacctataatcccagctactcgggaggctgaggcaaaatctgggaggtagaagttgaggtgagccgagattgtgtcacggcactcctgcctgggcgacagagcaagactccgtctcaaaaaaaaaaaaaaaaaaaaaaattttaaaagggccaggcatggtggctcacgcctgtaatcccacactttgggagactgaggcgggtgggtcgcctgaggtcaggagtttgagaccagcctggccaacatggtgaaaccccgtctctactaagaatacaaaaattagccaggtgtgggggcacacgcctgtaatcccagctactcaggagcctgaggcaggagaatcgcttgaacctgggaggcagaggttgcagtgagccaagattgtgccactgcactccagcctgggcgacagggagactctgtctcaaaaaaaaaaaaaaattgttaaaaggatagatctcatgttatgtgttctttccacaataacacaaaatctagaatagattgccatcctattttgtcagtatatcagaaaggaacagaagacatttgatacataaatatgtaagtggtctatattttataagtggaatttttttttgtaattgtaatacatttttcatttataggaaacatgattgtagatgtaagactgaaggaaaaaatgccattaaaatttaaatctcaagaaaaaaggacaggcctcttgcctctttgcctcattgaaatcctgaaagcaagatgcatcaatagcagctctacaagagccattagtgaaaatttggccagggttctcgctcttgttgcttctgctccaaccagcatggtttgacccagattatgtgcagccaatttttccatcagtatgcaaagtaagaggtagacttcattacgttgggctaagtgatcttccttgaatagattaccaaaatcatccacccagtgaaagaaaccatgctagctctttgcacgtaaaataaattaaaaagaaaataaaagaaagaagaagaacaagaaaaagaatgtgtggagcagtaacatttcctggactacattttgagcagcactgtaaaatatccctcctactgaatcacttgaacccgggagactgaggttgcagtgagccgagatggctccactgcactccagcctggcgagagagcgagattccgtctacaaggaaaaaaaaaaaaaaaaaaaaaaatccctcctacctgactaagcagcctcagtatgaatcccttctcaggatttatctactccactgaagtactacttcaattgttagaaagctcttcacaggttgaattgaaatctgggtccttgaaactttggttcctgtttttttgttttttgttttttgttttttttgggggggacggagtctctctctgtcgcccaggctggagtgcagtggtgcgatctcggctcactgcgagctccgcctcccgggttcacgccattctcctgcctcagcctcccgagtagctgggactacaggcgcctgccaccacgcccggctaattttttgtatttttaatagagacggggtttcatcatgttagccaggctggtcttgatctcctgacctcgtgatccacccgcttcagcctcccaaagtgctgcgattacaggcgtgagccaccgcgcccggtgattcctgtttttaactcactcttaaattacaaagaacaggtctactctctcttttatgaaataatatctcaaatatttgaaagtagctattatgtctcaccttagctttccatttccaagttaaccagccctcttccctttcactgctctcgaggagcttattttaagtctttttactgaggtcactctgccccagaagacatcctttccagtaagtgaactagtcctcagggagctcccaggccagggttagataatagtcacaaaactaaggagttggttttgagggacagctttcaggaaggacagccagcattatttccacatacaagtaattaaaatgttcccaagcacctataaatctaacataccatgggagtaaagaatgctttatgacttagccacttttaatattttttaatgccaaaaagttttaattgattttctacagtaactatatacctatttgggaaaattgccatatgcgagctttctttctgcattaagctccagttaccttgtttccttgaggctttcgtatgaagcaaatgccattcttacagatctcatttacttgtgaatgattatcactatttgttcaataaaatcttccccacgttgaagctgctcctgatgaagtcagggtcttcaagaattcttgttctctgtgtcattatcatacaagtatcacaccattctttatggttctcaagaaccaaagcatccgcggcaaattacccggagagctcatatagtaaattttaagcacaagtttatagaaatccttgaactatatatactgcaactgtttacaggcaatgctctataactcctatagctttaggtactttgcagaagcgagaaaatttattatcagataaagtcttggccgggtatggggggtcacgcctataatcccagcactttgggaggttgaggcaggcagatctcctgaggtcaggagtttgagaccagcctggccaacatggtgaaaccctgtctctcctaaaaatacaaaattagccgggtgtggtggcgcacacctgtaatcctagctactctgaaggctgaggcagaagaatcacttgaacctgggagacggaggttgcaatgagctgagatcatgccattgcattccagcctgggtgacaagagcaaaactctgtctcaaaataaataaataaataaataaataaaatgtcctcatgaaacacctgtggcttagcattccagcctgggtgacaagagcaaaactctgtctcaaaataaataaataaataaataaataaataataaataaataaaatgtcctcatgaaacacctgtggcttagcaggaagttggaagctaaagaagtgaccagcgcctggagtttggctcctggctgaatccacatgggctctttggttctttctttctttccctggaataaggattcaaggagaatttctccaataggatatatgccatgggagtatgattgaggaggggcaaaaacgtgatataataagaacagcaaaataacagtatgcaattttaaaatattttattatagaaagcttaaagcatacacaacagtaaactgtataataaacctctatgtacctatcaaccaactttaacaattatcaatattttgctaatcttatttttacctatcttgccttactttttggctggaatattttaaatcaagtctcagacatcataacaattatctgtaagttattaaaaaaaatttttttttttgtagagacggggtctcacttgttttcccaggctggtttcaaactcccagcttcaagcaatcctcccacctcggcctcctaaagtgctaagattaggtgttagccaccactcaaggtttataatttcttcagaatgtgtttctgacaacttttttttgcctaaccaccatgccattatcacaactaacaatttcaacaataattatgtttattaaaattaaggctcacgcctgtaatctcagcaatttgggaggccgaggcaggcggatcaactgaggtcaggcgttcgagaccagcctagccagcatggtgaaaccccgtctctactaaatatacaaaaattagctgggtgtggtggcgcatgcctataatcccagctactcaggaggctgaggcaggagaatcccttgaacctgggaggcggatgttgcagtgagtcaccgtactctagcctgggtgacagagggatacgctgtctcaaaaaaaaaaaaaattaatgaaagtaattaaagtttagttatttaataaatgacagcatgtacattctgaaaaacagaatatgtgcagtattctgcagacagaataatttgaataaaatttgaatttaaaagataccatttcaaactgtaagccccctaaaaatcagtggaccttggcttcacttgtttaaatcctcatggcttctagaagttttgggtggggggacatctttaaaaattatttttctaacagaagtcttactatttttcaacttattttctatgagtcctaggaggtagaaagagatttttcttgtctgatagacttgaaagtattgggttaggtaagtggaagaaagatcatatttagaaggtaaccgttgaatgtttaatcactattgttttgacatctagaagtattgtcataggttacaatttaaacatcagaagatgggggtgtatgagaatatcacatttagggagatgtcagttgtccagaagttttgcagagaatctggaaaataaacatgagagtaagttttctttctttctttctttttttttttttgagagagctttgttgcccaggctggagtacagtggctggctgactacaacctccgcctcctgggttcaagcaattctcgtgcctcagcctcctgagtagctgggattataggcgcctgccaccatgcctggctaatttttgtatgtttagtagagacagggtttcaccatgttggccaggctggtctcgaacacctgacctcaagagatctgctcacctcagcctcctaaagtgctgggattacaggcatgagccacggcgcctggccgagagtaagttattaatagttctactgatgtcagaaataagatgtagtctgaattccatgaattgtttccagttaatggaaagttgaattgtggtggaattggtagggaaaaaaagcagttatggtcctctgtctccattctagttcatccttatttaaagaatattactccaggcagtgagcacatgcgcgcggtggctcatgcctgtaatcccagcactgtgggaggccgaggtgggcggatcacctgaggtcaggagttccagaccagcctggccaaaatggcaaaaccccgtctctactaaaaatataaaaattaggccaggcgtggtggctcacgcctgtaatcccagcactttgggaggctgaggcaggtggatcacctgaggctgggagttcgagaccagcctgaccaacatggagaaactacgtctctactaaaaatacaaaattagccaggcgtggtggtgcatgtctgtaatcccagctacttgggaggatgaggcaggagaatcgcttgaacccaggaggcggaggttgcagtgagttgagatcgcgccactgcactctagcctgggtgacagagcaagactccatctctaaaaacaaaaaaagaacatttcttcaacaaaataaatatattcacgtatgcataaattttttaaaactttttttctttttataaaaaaatcagttttctcaggttgaaatgttaaaatcacctctgatgaagatagagaactaaaatataaaatatgggtttgtctctgattcctttttggtttataataatttgcatatggctttccatggatcactttagcagtttgtgctaaagtcattagttcttcctaagatacaaaagaaattctcaaaatgcttgtttcctattaggcagggaagttgtttttctcatctctcaagttgcatgaccaaaagtagcaaaaatactttatctctagggaagtgaaagcttgcttctcaaattgctttagtgaggctttaggaaatggcccctggctggtatcataggatataataccgtcttgcaaatagtaattttgaattcagttctttgtatctatgagataaaagagtcttcttccattgactgtcttagatgggcttatcacattcaacagtatttactgagcatttgttttaagaaactactaccctagttgctaactcattgctccctagacattgtatttggattgaggagcagaacatagacatcaacaaaacagatctggaacccgatatcatgtacctctaaatgtgaagtatgcggtagagctaatgttttgtcagagtttaaagaaggaagcaataatatgggcaaagttgttgagcaaggcttcagggaggaagtagaacctgaacaggcttttaaaaacactggcaccatttggattggtgaggaggcggtagaagggtgtcctctctgggtgggacagcacaaacaaaggtgtgggaacaaaactcaacaaggcacatttgggcaacacttggttgagcaattccatgggagtgcaagactcatgggcgaaatcattggaagccacatggtggaaggctttaaatgtcaatgtgttcttcatgccatggaaattcagaaggcttggcagtttgcaggaaagaccagaattgaagaatacaggagctgaggggatcaggggactgctataacaacagggagttgacagagcacgaactcacatgggagctctgaaagtgaaaaggcagggatgggtgtggagggcagctagaagaatgctttgcaagacttgaagaatgactgaaaactagggaagatgggggaatccaaaacatttcatggctttggaatttggtgaccaggcagatggtcatagagggtcaaagctgtccacgagctccagcaacaggaggaagcacagcattctgtgctcagactagtgtggcaggcctgcagaatgcgtgtgggcccttgttcctgtgcttggctgagggcttcctgagagcagttgctccatctctgacccaccggaccactactgcctttggatcctgggtggtgggcttcactcacacagtcgaatgggtttctcatgcctttgtccctgggctacagtcctccacttcacaccacaccggtcaagatggaatgtggccacattatctcactacagcaaacatgcccatagtttgcaaatttggtacatcaaccgccacgctcataaagatgatggtttggaccaggatagcaggagtctggtcaagagattaatgcagggtcagagatcaggagtcttatcatcttgatctctgcaagctaatgatttatccttcttcaattgcttaacattaatcacatttatataacatgaggcctaggaacaatacttgaccccacaagagattgtgattccaaacaactagtcagatgttcctccttttgtggttttatttcatttgcattcttttttattttgatatttttcagtttggcctttgtaattgcaaacagcttaaggcaattcaccacccaacccacttcacttatttatgtttcctgcctggctcagcaagcacttgaatttaaactctggtctacacaaggtcaagatattcaggtcaaatgtctattaaatcaaatgttttctatattctacacaactagtagagttcagaggatcagagatttggggacctgaagggggtcttttattaattccccccttgcattatggttgagacaatcgaggtccagagggtaacgtaacttgtgttagggaccaattaagggctggagtccatgtcttgagttacattttaagatgtcaattgagaacggatacgggtttcttaaaactcaaatttatcctcaatcttgaaatttattcagttattcatttaataaatatttgtggataacttattatacaataggcacagtgctaggagccatgggcataggtgtgaacagacagacagatcttgccctcatggaacttgttttcttttctttctttttttcttttttttttttttttgagagagtctggctctgttgcccaggctggagtgcagtggtgatcttggctcactgcaacctccacctccccggttcaagtgattctcctgcctcagcctcccaaggaactgggattacaggcacccaccaccacgcctggctaatttttgtatttttagtagagacagggtttcaccatattggccaggctggtctcaaacttccaacctgaaatgatccacccaccttggcctcccaaagtgtgagccactcttacaggtgtgagccactgcacccggtcagaacttgttttctgatgctggtagttgaggtgggtgctatggaggcaataagtacggacacatgagtaaggagtgaggcgataagtggtcattttagattctttaagggagtccatcttacctaattttttcaataatatcaccagaatcaatgatggcacatctgcatttttcagttaaaacacataacacatttaggttacaatggaacacagcttttcaatgtactaaaatggctgtttttttgtttttgtttttgtttttgtgacagagtcttgctctgtcgcccaggctggagtgcagtggcatggtctcagctcactgcagcctcggtctcccaggttcaagcaattcttgtgccttagcctcctgagtagctgagattacaggtgcgtgccaccatgcccagctaattttcttttctgttctggttttttattttgttttgcatttttagtagagatggggtttcatcatgttggccaggctggtcttgaacacctgacttcaagtgatccacccgccttggcctcccaaagtgctgagattacaggcatgagccaccgtgcctggccctaaaatggctgttttgagttgacacagagccatgtccaaacacccgtttccacttcgcctatttaaatttccctcctggctctgcaggcattggagtttcgacctgagattctatgccaggccaagatatctagattgtttgcattctatatcaaaacatataattggccagccgcggtatctcacgcctgtaatcccagaactttgggaggctgaggcgagcagatcacctgaggttgggagttcgagaccagcctgaccaacatggagaaatcctgtctctactaaaaatataaaaatagccgggcgtagtggcgcatgcctgtaatcccagctactagggaggcagaggcaggagaatcgcttgaatgagggaggcagaggttgcggtgagctgaaattgcgtcattgcactccagcctgggcaacaagatcgaaactctgtctcaaaaaaaaaaaaaaagaggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtaggggcgggcgcctgtagtcccagctacttgggaggctgaggcaggagaatggcgttaacccgggaggcggagcttgcagtgagccgagatcccgccactgcagtccagcctgggcgacagagcgagactccgtctcaaaaaaaaaaaaaaaaaaaaaaaaaaaaagaaaagaaaagaaaagaaaaacacatataattaaattattaagtaaaaattatttgtggcatggtgttttgtagattttgcctgatccagagaaaaggtaatcaatgcatgtttattgaccacatcattgatttgtaggagtcaaattatgttaaagtagccaaagttaatctatcacagaatcatagtattttgtggctagaagatatttaacagatgacttagttcagctcccttatttaatagatgggaaaacagactctgagggaggccaagtggcttacagaaggctacacagatagaagttatatatgttatttacagtacatctactgtggttaagagaggcctccttgcatttattttagagcggagttggtagaaatagttagatatagcagtttagagcatgagctctggtgtcagacagacctagagaaaatttaagtaaaacttaaaatttacttgactatgtatgtgcccctgggatattagttaatatcttttagctgtagtctccttattggaaaaattggcaaagttagagttcagtttagggttagggttagggcctctaagttttaataattggtaaaggttattattatccattttgtaccatcaacatgtcaacaggagtataatgacttagatggagtcatatactcctctcgggagagatataattttttgatagaagcctggccaacatggcaaaacgccatctctactaaaaatacaaaaattagtcaggcatggtggcccacgcctgtagtttcggctactctggaggctgaggcaggagaatcacttgaacccgggaggcagaggttgcagtgagccaagatcatgccacagcactccagcctgatcaacagagtgagactccggctcaaaaaaaaaaaaaaaaattttattaaaaaaagtttgctcaggccaggcgcagtggctcatgcctgtaatcccagcactttgggaggccgaggcaggcagatcatctgaggtcaagagttcgaaaccagcctggccaacatggtgaaaccctgtctttactaaaaacacaaatattagctgggcgtggtagtgggctcctgtaatcccagctacttgggaggctgagatgggagaactgcttgaacctgggaggtggaggttgcagtgagccaagactgtgccactgatctccagcctgggtgtccgagtgagactccgcctcaaaaaatgaaaaagaaaaagtttgctttatcaattgaataatctatatgcaaataattatggcaaaagtaaaaagacttctttcctggggttgtactcactgagccctcaccctggaatgttctttgcctagccttccacacagttctcatctccttcaggtatctgctcagctggcaccttctcagtgaaggcttgcttgtcattttgtttaaatggaaactttgttcccatttcctgctttatttttctccatgacacttacctcctaataagtaattttctaatttgctttgtttatgatctcttgtaaatttcatgagtcctaaacgggtgcttggcacatataatttttttttttttttcttgagagggagtctcagtctctcgcctaggctggagtgcagaggcacagtctgtgctcactgcagcctctgactgttgggttcaagcaattctcgtacctcagcctcctgagtagctgggattacaggtgtgggccaccacacctggctaatttttgtgttttttgtagagacagggtttcaccatgtcggccaggttggtctcaatctcctggcctcaagtgatccacccagcttggcctcccaaagtgctaggattacaggtgtgagctaccacgcccggctggcattcaataaatcttcgttacttatccctaaataataaaaaatgtgaatcataaatcccactgtacttgagctactagaattaaaggagataattattctgccaaaatgttgtgttttaacacatgtatcttcatttcttctagtgctttaatcctcctgaattcctggtgttggggcaataacatgccatggtggggttacctcagagtagggggtgcctctttaaatgcctggaggtgaatgaaagaagctattcccaacctagcagccaggctgtgacttctgacattgcatttcaatgccgtttttttctttgcataaagatgtagaaacctgtttaggctgtggtctactaccaaatgtactcattagaaaaaattgctttttttttttttttgagacggagtttcactcttgttgcccaggctggagtgcaatggcgcaatctcagctcactggaacctctgcctcccaggttcaagcaattctcctgcctcagcctcccaagtagctgggattacaggcgcccaccaccacgcctggctaatttttgtatttttagtagagatggggtttcctcatgttggccaggttagtctcaaactcctgacctcaggtgatccacccacctcatcctcgcaaagtgctgggattacaggcgtgagccaccacacctggctttagaaaaaatttctaatgactggctgttttcatctttcagattattgtctatgactataacatagtatggggctgggaaaaaataatcttcaaaactcttttcaaatatttaacttctattcaatacaatatttggatttgttcaaaaactatgaccaggttttcttgcactcatcaaaagcatatttctttccagtagtttcaatcatagctacccattataattaggaacttaaaaaatgaaataacagtgctaagttcctatccaaagggagtagggagactgggttatcaatgtattttcaagctccccaggaatctctaatttgcttaaaccaacttctgccaaatgaaagtaatacaaattgagcagtgtttatccactgggtacaggcaagaacccaaatatagctattttagggtcattgtgctgtataaggatgatataagagccgggcgcagtggctcacgcctgtaatcccagcactttgggaggctgaggtgggcggatcacctgaggttgggagttcgagaccagcctgactaacatggagaaacctcatctctactgaaaatacaaaattagccgggcgtggtggtgcgtgcctgtaatcccagcttctcggggggctgaggaaggagaatcgcttgaacccgggaggtggaggttgcggtgagccgagatcgtgccattgcactcaagcctgggcaacaagagcaaaactccgtctcaaaaaaaaaaaagggataatataagaaatgattcttaggcctaggttaaacaatgaacaaacatccactcctaggctgtatggggaaaagagaaatgttgtaaatatctctcattgcaaatgacactatattccttagtgtttttctccttggacttacctccaaaaaggtacctgacatgagaggaaaaaatagaaatcgggatttggattttatgcgaggttctgggaaaaatgttcctactctttcctatacaggaactaagtcaaattcaaggccaatgggattataatttgctttatgctataatttgtaatgtttaactttgttttagcaaaaaagtctgatattcaatcttccattaacactttagccatagaatctagactgctacgtgtaattgttaacaaacgcatggtttcttttctttgttatgaatggaactagacatctccattaacacatttgctgtttttctcatgcagtaggctaactgtacagtatttaatggtctacaggtttaaatatttcttatatgccttggcttgcacagaaagtgcttctgctaaaccagttaataatctggccatcccaagagtccagaatgttgagttaattttttacggaggttcccagatgtattggaagactcactcttggcagaccttgccaatattttttttaagattacatttggcttttcttgtatttgatatgaaacacatgttaaaaacaatacctgacaaatatgaaatgcatttttctgcataagcaaaaacaccatgaatacagcttttacaaagttttggatggcagagatacagggttttcactgcaaaactgggttagcatttaggcaagttaatcatacatctcgacaatgattctttatccaacatctctttggtattcagtgggcaggtcattaggactatgaagaaataagtgggagaatgtccagggaatgaaaaacatctatataacatgtggagaagtggatagatttagtgagtattcaactttaagaggtgcaggttctgatcccagccagatcacttgagttcttaacttctgggaagttaagaataataatgtgagtctttgagtgtttcaagaagatcctgtattagttgcttccctttgcaggtattttccacagcatttccatgtgttttctctaggtgctctggcagggcatcatatgcagctttatttttgccttttctttcagtctatattttctattctatttatttttacagggcaatgggaaatactgcaatatactgcaagtgtcctttctctttacgtgaattgaatttgtattttattgtttctttttccaggtctagccttagaaattttataatatggccaggcgcagtgtctcacgcctgtaatcccagcactttggcaggtcgaggcaggtggatcaccaggtcaggagatcgagactatcctggctaacatggtgaaaccccatctctataaaaacacaaaaaattagccaggcgtggtagcacatgcctgtaatcgcagccacttggggactgaggcaggagaatcgcttgaacctgggaggtggaggttgcagtgagctgagatggtgacactgcattccagcctggagactccatctcaaaaaaaaaaaaaaagaaaaaagaaagaaatcttataatatttacaaaatgtaattgtaggccgatgcggtggctcatggctgataatcccagcactttgggaggccgaggcaggtggatcacttgaggtcaggagtgtgagaccagcctggccaacatggtgaaacgctgtctctactaaagatacagaaaatgagcctggtgtggtggtgcatgcctgtgatcccagctactcaggaggctgaggcaggagaatcactggaaccagggaggcaaaggctgcagtgagctgagatcggaccactgcactccagcctgggtgacagagcgagactccatctcggaaaaaaaaaaaaaaaagaaaagaaatataattgtggatccagactctggccaaggatcaaacagacatttaagatatttgagggcaggagggtaccactgaggaagaatgatgctaccattaactgtctctaaaaagaggaagtaaatgccactgcaatctgctattgaggtttccctagatctggaatatcaagcatttcaattcacactaaagttcagaataataattactaataatatttttaatggagtatttacaatgggccaggcagatttattgtgtcattatctcagctgatcctcagaaggactgagtgctctcagtagtcccatttctgtggggaaggggagtcatggacaagttagcctttaaaatcttatccagtcttttattcctgctttccaggagtaaaagaaaaaaataaataagtaaaaagaaagtgggccaggcatggtgacctgtaatcccagtactttgggaggctgaggtgggaggatggcttgagcccaggagtttgagaccaggctgggcaacatggcaaaactccatctctaccaaaaaaacaaaaacaaaaaaaacaaaaaaaaacaaaaaaacacccaaattagctgtgcacagtggcacatgcctgtagtcccaattactcgggaggctgaagtgggaggatcaatcacctaagcccggggaggctgaggctgcagtgagccaaaatcctgccacttgccactgcactctagcctgggtgacagagcgagaccctgtctcaaaaagaaagaaaggaaagaaggaaggaaggaagaagaaaaaagagaacaatcttatcaaggaaggtgatatcaacaaaatggtgcaataggaagctccaaactcctataccccaaccaaaacatcagaaagtaagcataaactgttaaaccaaatctgttaaaatctggaaaacagtcaaaagtttatagcaaccaagcaaatgctgaatcctgccccccctcatccaaaaaggtgtttttttttcttttacttttaaagatttttattttgtttttgtttttttaaatagagacggggccgagtgcagtggcgcatgctataatcctaacactttgggaggccaaggctgtggattgcctggagtttgagaccagtctgggcaacatggtgaaaccttgtctctacaaaaaaagtacaaatagttagctaggtgtggtggtacgcacctgtagtcccagctacctgggaagctgaggtgggaggatcgcctaagcctcggaagttgaggctgcagtgagccatgattgtgccactgcactcaagcctgggtgacagagtgagaccctgtctcaaaaaaaaaaataaaaataaaaataaataaataaaaaataagagatgaggtcttgttatgttgtccagcctagactccagctcctgggctcaagtgatcctcccacttcagcctcctgagtagctgggactgcaggctcatgccaccatgcttggctaatttgtttttattttttgtagagatggggtcttgctattttgcccaggctggccttgaactcctggcctcaagccatcctcacactttggcctcccagaatgctgggattacaggtgggagccacctcactcagcccctaagaagacattttaaaataagtaggaaagcgttgtggtgttttcacttgctctttccccacctcctgcccagcttagtggtagtcttaggagttagcctccatggctggtccctggtccctggctctggcatgtatgtctttatttatttatttttttgagatggagtctcactcactctgtcacccaggctggagtacagtggcacaatctcaactcactgcaacctccgcctcccagattcaagtgattctcctgcctcagcctcctgagtagctgggattacaggcgtccactaccatgcctggctaatttttgtatttttagtagagatagggtttcaccatcttggccaggctagtcttgaactcctgacctcaggtgatccacccgcttggcctcccaaagtgctgggattacaggcgtgggccaccgtgcctggctgtggcatgtatgtcttttctaaactatctggagctatctgaaggactaatgcaaggtgcctgacactcactcaggacagaaaagtggagggcattgctggaaaagcttttaaggcagatatacaaactgaagctggctgagacaaaagattacacctaaagccaagaaggaaaagcatgttgtcctaaagtgctttacatttacttgctcactttatgctcacaacatccctatgaggaaggtataattgtcaccatccccattttacagttgaggaaactgaaataactgggaaaagtaaatgcagttagcttttaatcacttcatcacattgactccaaatacgcacgtactaaaagcaaaatgaaccaggtaacaactaaaacacatatagtaaatgagtaataaatcttatttgaaaattatactttaaatatatttcttttaactctagtatttattactgccttagtaacctctttgaaatagaagactgaatggaattcattcttttttttttttttttttttttttttggagacggagagtcttggtctgtcacccaggctagaatgcagtggcacgatctcagctcactgcaacctccacctcccgggctcaagcaattctccctgcctcagcctcccgagtagctgggattacaggtgcctgccagcatgcccagctaatttttgtatttttgtagagatgggttttcaccatgttggccaggctggtctcgaactcctgacctcaggtgatccacccgcctcggcctcccaaagtgctgggattactggcataagccactgcacctgaccggaattcattcttgatagcatcagtatttgctttcttcccagatagtacatagtactgtttttattatgaatttttttgtgggaaaatagagatgataaaataggaaacctttccacaaagctatggttaatattagttagaagtaaattttcatttctagaacataacattgaaaaaaggtaagaggggcatagagaaggcaaaagaatatacttcttgaataaacaagtatttctaatgcttattatttataacttagatatccccagactgtaaactgtagaagaagggactgtgtcctgagttattcagaagccaattttttgtgccttagcataacagtataggaatattggccatagtagtcgatcagtggagacttgttgagtgaatgaatgatagacatgctttttacttgtatatcaagttattactgggctctgcgcaaaggcagaagtggatcctatgtaaacagatacgggtgtttgcttatgataccttatttttaatgtaccccaagatcccccatggagaatttcaaatgctgtttataaaaggaaagaaaattcaggtcttgtagttgttcttttttttttttttttttttgagacggagtctcgctctttcacccaggtgggactgcagtggcgcgatctccgttcactgcaagctccgccttccgggttcacgccattctcctgcctcagcctcctgagtagctgggactactggcgcccgccactgcgcccagctaatgttttgtatttttagtagagacggggtttcaccgtggtctcgatctcctgacctcgtgatccgcccgccttggcctcccaaagtgctgggattacaggcgtgagccaccgcgcccagcgcgggtcttgtagttgttcttgctacaaattactgggcctgcagaagagagatactagggaggagatttacagcaaggctttgtcgcacatatattgttcttgttcgtcatcttgacttggtctgtaaacgtccctttcccttcccgttaaacttaacaagaataagcctgtatcctggattaggtggcaaaggtatttgaaataaaaataaagaattttaagaaattaaaaaagaataagcctgtagcacccagatgcataaaggaaaatggatctaaacagtttattacttaaacagctgctaaagtcatctcatccttgttccatttactccataaccacacaaacgtgacaattccatttagattggtcacatgtgcttaatgtcttaaaggaaatgaatgaatatattttctgaacactcatggaagtgatccatttttatacaaaatcaatttttgaggggaaaggtaattcctgattatcaaagaagtggccagggaagaaaagatctgcccccatgcttcattaaccaccaccagcagtttcaggtgggttctttcagaaaatgcgcatgcatatacatgaatatatctgcggtgagttcctctttgtttgtgtgtgtgcccaggtgctcacatgtacatctctggtctttattttctgtagagaatagtcagaatgaggccccagggtcaggaatggaaaaatcaggtaaaaagaaaagaaaacatctttttttttccttaaaaagaaaacatcttgtttagaatttttggaatttctttctaagcttaatctttcttttattaacactttgttctcaacttaaagccattaaaaagcctatatgcaaaaaataaaataaatcagctcaaggcataagaatttgatatacagctgggtggtaattaacaggacttgaccttacaataattagatgctgagaaagactggagcacagcagctcagaacacagcagtttatgtaactctcctggagaagagttaggctttaccccttgatgctatgaaaaatcagcctcaaagattattgaggcagatcaaaatttagagccgcacacggcacctcacacctgtaattccagcattttgggaggctgaggcagtaggattacgtgagcccaagagtttgagaccagtctgggcaacatagtcagaccccattgtgttagtcagctttcatactgctataaagaacagcctgagactgggtaatttataaaggaaagagttttaattgactcacagttcatcatggctggagaggcctcaggaaattcacaatcatgtcaggaggcaaaggggaagcaagatgccttcctcacaaggcggccggaagaagtgccgagaaaggggaaagagcctcttacataaccatcagctgtggtgagaattcactcactatcatcaaaagagcagagggaaaaccgcccccccatgattcagttacctccacctggtctctccttgccatgtggggattatggggattacaattcaggaggagattaggctttctgttcaggtgggaacaaaaagcctaatcgtatcatccatctctacaaataaaataaattaggctgagagcagtggctcatgcctgtaatcccagcactttcggaggccgaggcaggcaaatcacttgaagtcaggagttccagaccagcctggccaacatggtgaaaccctgtctctactaaaaatacaaaaatcagctgggcgtggtggcacgtgcctgtaattccagctactcgggaggctaaggcaggagaatcacttgaacctgggaggcagaggctgtagtgagccaagatcacaccactgcactccagcctggggaacagagaaagacgctgactcaaaaaaatgaaatgaaatgaaataaattagccaggagtagtggtacacgcctgtggtcccagctactcaagaggttaaggtggaaggattgcttgagctggggaggttaaggctgcagtaaactgtgattgcattactgcatgccagtctccgtgacagagtgagaatctgtattaaaaaaaataaaccaaaatcccaaaagataacttgggactgtgtagtggcttattactacattcctcaatgatccaagctactcattgaaaacctaaagtggaaaatgctttgtccacatatattaaataatacatatatttctttctccaccctgtaaaaagagagttagcaataatgctatttggttagaatatgcagtgtgaaaataaaatgatattcataataattacacagaactaattttttaaatggcaatattcaatgctggcaagggttcggtaatgctggtattctcataggttgctcactgtattttcatttttaaaacattttctgaaagctatcacaaaatattttaggagctttaaatgctcaatatttttatcccagttgtctcactttaggtaatttatctcaaataaataattcataaatctatatgcacaaagccatcttgacactatttataattgcaaaacactggtacttaatgcagaaatggttgagtaaagtatggcatatccactatttacatggtatctataaagtgtttttaatagtatggaaggccaggtgtggtggctcacacctgtaatcccagcactttgggaggccaaggcaggtagatcacctgaggtcaggagttgaagaccagcctggccaacatggtgaaaccctgtctctactaaaaatacaaaaattagccaggcgtggtggcagaagcctgtaatccagctacccaggaggttgaggcaggagaattgcttgaacctgggaggtggaggttgcagtaagccaagattttgccactgcactccagcctgggtgacagagtgagacttcatctcaaaaaaaaaaaaaaaatactatggagaaacattacctatattaagttaaataaaagaaatcacgatagagctgggcacggtggctcacgcctataatcccaacactttgggaggctgaggcaggtggagcacgaggtcgagagttcggaccagcctggccaagatggtgaaaccccatctctagtaaattacaaaaattagccaggcatggtggcaagtgcctgtaatcccagctattcgggaggttgaggcaggagaatcacttgaacctgggaggcagaggttgcagtgagccaggatctcaccactgtactctagcctgggcgatagagcaagactctgtctcaaaaaaagaaagaagaaaaagaaagaaagagaaagaaagaaagaaagaaagaaagaaagaaagaaagaaagaaagaaagaaagaaagaaagaaagaaagagaaagaaaaagaaaagaaagaagagggagggagggagggaaggaaggaaagaagtaaataaatcacaataaaaattatatttcaggctgggtgcggtggctgacacctgtaatcccagcactttgggaggccgaggtgggcagatcaattgagtccaggagttcgagaccagcctggccaacatggcgaaaactcgtctctgctaaaaatacaaaaattagctgggtgtggttgtgggggccggtaatcccagctacctgggagaatgaggcagggaaaattacttgaacccgggaggcagaggttgcagtgagccgagatggcaccactgcactccagcctgggcgacagagtgagactccacctcaaaaaaaaaaaaaaatgtatttcagctgtgtatagaacagataagtcaatgtaggaaacaatgtttattgtgttcatgtagtgggagtacggatgctcttgttttctatttcttcaatttttaataatattttaatattatattcataatttaaaatttatctagcatctatatctctaagtttatctatctacatactttatgttttcattttttaaccctctatctctatactttagtataaaaagaatagctttgtgaaagtttaggaaatggagtagagagatgagtttcatgattacaaaacgttgtattattattaaaaaagaaagatgtgcatttgagcccgctttctcatacttctttcagtgtaaaactattgatgaacttgaatgcatttgtatcccacttatagtcttcaattctaatttggtgttctggtagagtttctctggacttttgcaaaaataaagctctctcatactagttcaagagatggttcatgttgcgtcactgggtaaagaggaacaggtagtgtcaaagttcccttctgaggattctcctttaggtcccatgagcatcaatcattatttctattgactagtttccccaataactttctcccaaagtaaatgaaaatccacatgccagggcagcactatgttgaacttgtcaaagaccaatactgaatatgccagacacggttatcttcagctaccattttgaaggcctgaaccctcatagaggtattaacgaactcgaaattgcatacttgcatatgttgtaatcattttcaccctgctttccaaaaagaaaaagaagaaaaaagcaataaatatgggatttaaatataattcatgcagaaataggccaaaacattcctaaagactctaaatttattcctaatcacactgatgccaaactaaattggcatggttattctactagattctgattctttttttttttggccagaaatttgctggaaaaacacagaactggaaaatccatccaagattaaacagaggaaaaatattagaaaaaaatattaaatagaggaacaaaaacctattttagttgtagttataaatttctagaaattcatctttgaatttagagaaatacatcagtgtcatagtaaaataacctttattctttatagacacccttttctgaaaccaagcagttgtattcaaaacaagtccaaatttaagcaagaaaaaattgttttaataatagaacattttaaaaaaccaatgtatttctggccaagagtggtggctcacgcctgtgattccatcactctaggaggccgaggcaggcagatcacctgagtgatcagaagttcaagattagcctggccaacatggtgaaaccccatctctactaaaaatacaaaaaattagcctggtgtggtggcatgtgcctgtaatcccaactactcaggaggctgaggcaggagaatcgcttgaaccccagagacagaggctgcagtgagccaagatcgtgccactgcactccagcctgggcaagagagcaaggctctatttcaaaaaagagaaaataaaatacaaataaaaaaccaatacatttctagcttgtaactagaaggagagacaaaaagaccaacttaaaaatagtaagtgtaatgagagtatgatgtgaaggagctgttaagtgatctcaaattaatggtgctcagaaatgtgaacttctggaattcacgtttaaagactaattggagggccgggtgtggtggctcatgcctgtaatcccagtatttgggaggccggggcgggtggatcacctgaggtcaagagtttgagaccagtctggccaacatggtgaaaccccatctccactaaaaatacaaaattagccaggtgtggtgatgcatgcctgtaatcccagctactcaggaggctgaggcaggagaatggcttgaacctgggaggtggaggttgcagtgagttgagattgcgccattgcactccattctgggcaacaagagtgaaactccatcttataaatagataaataaataagactaattggaaaacttggaaattatttagaagacagctccaaggatggcaaaatgagtcaagtattggaaaaaaagaccaatgaggagaggcaaacaagacataattaattttcttgaagagaagaccaaatgacaattgaagaagacagtctatgaatttatagagagctttatatacagacagggttggttatcatcgctgagtataaaacaagggaaacaggcttggtgtgtagcataatggctttgttcgacacagtaaagctaactaaatgtcaaaataagatgcaggtggaggttgagcagtcttttctaaagccatgaataataagatagcagcttctttgtatggctctgactgaaggtgagagatgtgctatgtaagctttcacatcgcttccagggctaagattcaggtccttggggaatatcttcctgaattcagggagttaatgccaactctgaaatcaaattactggaacatagtaaagaaagcggggggaggaagcaactagaatcaagatgaaaatgtaacttcaaaccctgtttagaaaaaaataatgagattactttaaaataataaaatttattattaaaaatttagagaagttttgacaaggaggaagtggaaaaaatagatatttttatttatttatttatttatttatttatttatttatttatttatttttgagacagtttccctcctgttgcccaggctgcagggcaatggcacgagctcggctcactgcaacctccacctccagggttcaagtgattctcctgcctcagcctctcgagtagctgggactacaggcatgcaccaccatgcctggctaattttttttgtatttttggtagagaaggggtttcaccattttggccaggctggtctcaaactcctgacctcaggtgatcctctctcctcggtctcccaaagtgctgggattataggtgtgagccgccgcacctggccatagatattttagataaggaacaagatcaagcattaaactgtgaacaaggtatttctaattaactaattttttttttcaaacacagccttaggaaacgtgactccaaccatggagagtttaggtcagccctgattttgaggccacatgctccatcctcacaggtgggtgaggtcccttagttggtattgtttgatgattctattagttcttgacttttctgtatatattttaatgtacagtaaagggattgtagtattggcaggtttgtcccaaaatagactgtgagtcagttatgaaggagggggattccaggaactagaatttaagagtgaggaagttaaacacaaatttacatatgactcagtactaacacattttacataatattgggtactttctcttcctgtaattgcctctatgcttcatttgttgttttcaccaatagccctaaataagtggttttaaaaaacattaagggaggctggtagatcacgcctgtaagcacttttgggaagctgaggtgggcgaattgcttgagcccaggagttcaagaccagcctgggcaagatggcgaaactccgtctctacaaaaaatacaaaaattagctgggcatggtgacacgtgcctgtagccccagctacttgggaggctgagatgggaggatcacctgagtctttgaggttgaggctgcaaagaacaacaatctccccactgcactccagcctggatgacagaccgagactctatctcaaaaataaataagtaaataatgaattttaaacacacacacacacagacccacacacaaccattaagggatgactaatttggggtgtcttgccagcaattcaaatgtctaaaatagccttattctagcattgaatgttaaagcctttttctttagacagactaattgcagaatgaaatggtttgctacctgttgagctccaattctccccttctcaaaaaatcaagaggctatgaactcgcaagtgttaatgggattcagatagaagccatcactgctattttaaattttcctgtgtctcccactaacattatatccaaacatcaaaacatccacaacaatcatccccaaggttgctgctgtattatttataaatgaacacattgttgggtgaatacattccacttttgaaattaattttctttttctttttcttttttttttttttgagatggggtctcactccgtcacccagtttggaatgcagtggcgcgatctcagctcactgcaacctctgcctctggggctcaagcgatcctcctaccttagcctcccaaacagctaggactgctggcacatgccaccatgcccggctaatttttttgcatttttggtagagacaggatttcaccatgttgcccaggctggtctcaaactcctgagcccaggtgatctacccactctggcctcccaacgtgctaagattacagtcatgagccactgtgcctggcctgaaattaattttcactggtttattttcataaaataacgctggacacagtggctcatgcctgtaatcccagcactttgggaggccaaggcaggcagatcacttgaggtcaggagtttgagaccagcctggccaacatggtgaaaccccatctttatgaaaaatacaaaaaattagccaggcgtggtggcatgcgcctgtgatcccagctactcaggaggcagagggaggagaatcgcttgaacccgggaaggcagaggttgcagtgagccaagatcgtgccactgcactccagcctgagtgacagtgaggctctgtctgaaaaactaataaataaataatattttcataaaataaactcaatttcagttacatacagttttttaggaaagtgcttttcttttgtagctttgttttttccgtcctattgcatagtctggcttcactgaaatagctttccaccaaaatattctcttctctcaagcaatagtatactgaagagaacaagtaagttatttatttgcaagcccataggatttaaattagaataaacttgtccttgagaataatatactctaaataattcatatgagtcacaaaattttataccagaaaaagtgtgtaaaaaacatcttattccccaatattatgattccctcagtttgtatgacttaataattctttttttagagtataattgttccagagttcagaaatttttaaaagagattatctgtatctctgggaaaagattgacttccagctggaaagataatcttttcttccattttcccaccttttgcatcagaaaagtaaacaaccgatttcctgactaaatacacctggattatttctcaagagagcaagaaatgggttgatttatgcattagaaaagtgaccataaggtcgtggagaatcaatgactttagatgtaggaaggatcttggaaatctagttcaactccctcataaatgacaaggattagatataaaaagtgcttttaagaggcctattagcatcaggaatgaggtaagtcccttttcagcattaattacagtaactgctgtataaagaaaggggattctggcaactgctctccacatggcagaaattcaggacagacttgaaatcaaagaagtaggggctaaagtctaatgaactgacataaaactttttttaattggaactaaagaatattaattctctcacatgattcccaaagtcagtgtttttttttttaattctctcgaaactttcatgcatcaaaagatggttccaacatacaagcatggaaataattagtgcttttaattagtacaactgggaaataaggcataccagccttaataagggtctccaatgtggaacacattaaagtaaaaacaattttttcctaatatcaaagtgcattctaccgactaacagaaaatgagttactctgcaaaatggagagtataatcggattcagaacaagttcaaagtattaagaaaggagatgccatgaactgtgggacttgagaattagatcgtctcagacggccaccaatctatttttcagaacacactatccatatcgtagggtttaactattaaactgtaaatattctaaaatacttcataatgcctattttgtgaatcagaattgaagatgaaaatggtcaaatatattagaagcatgctaaacagcatttcagaacagtctaacagctgaacgcatacttggcaagaagagagctgctgtcacattacctcagaccaacagtagcaagcacatctggaatcctaatgatcccaggagcttttgggcatttgaaggacagccatctggtgcaaaggaagtctggacaaagtgtcccacccaacagaaagaacctcattgtgctgctatgaaaagcagctggccccacttccctctgataatacaccaccttctcaactggtgagtgatcaagagaaatccattatgtgcacaaagtgctcactagctgacctggatctaaaaccatgacaacctggcagataagacgcagtcagagatatatttgtgaaataaatccctttttgaaagggcgtcagcaaattctgctacctctgtctaacctttcagcaactgatgtagatagtatcagcctatgggctcttctaggtctcaattctttatctgtaaaattaagagattgggctacgcacattttacggccctttttagttctaacatcccatcagcttgtgattttacagaaaatactgtagcgccaaaagaatggatgaccaaagaacaagggatgacagcagacatttgaaggtggcccctgcatgttgcttgatggcattggatcattgaggggacaaggttgcactcaaagatgacctctcatttgtaaatgtgtcttatcatcttgcaagcaaattaagccagtgttatctttgctctaacctatctgcaaattatgcacagcatgttgggtctgccccacattaaacacactgcaggactctcaagtagatgaaggcagacatgcagcttcagcagaccatgatggtgaggcagtggataagagaaatgattgaaggtcatgagagggaggagagcatgacagggatgggaagcgaggacatcagggcacagaaagccctagtcaggagggaactgcaggccaggcgcagtggctcacgcctgtaatcccagcacgttggggggccatgatgtgcggatcacttgaggccaggagttcaagaccagcctggccaacatggtgaaaccctgtctttaccaaaaataccaaaattagacagggatggtgaccgacgcctatagtcccagctactggggaggctgaggcaggagaatcgcttgaacctgggaggcagagattgcagtgagctgagatcacgccactgcactccagcctgggcgacagagtgagactccatctcaaaaaaaaaaaaaaaaaaaaaagagggaactggagagtttaaacacctacaggaggaggaatttaggataattgtaagatccaataaataaccatgtcagtagatttatggaggaatggagctagagatgtatagtgaaagagtctaaaaatataatgtagggaaaggcattttggccagttaaatattgttcggaatcctggctctgccgctgaatatcctgtatattcctggacttgttaaataatgtattttcctcatcagcaaattggaaataatgctatctcttacatacagtagttgtggaaattaaatgagataatgcatgtcaagtgctgaagatacttattggtgcacagtagacattcaaaaatgatatattagttgtcattattcctagtactgttattcttgttagctgaataatgagaacaaatattgaaattccccagaatggttgtttgtgaacaagtagagagaaaaacgattacatcaggcaccaagattaaaggaagtgtcttcgaggttagtagatgatgacagtgagggcagaggaagggtgggtgtggttgagcaaagttggcgaagttcttgaaagtcaagttagtgcccgccgaactcttggctctgagccagacaagactggagaagaagccctttctgcttgagggcatcagagaaaatgtttcatctttagtagaaaatcaaatctcaattaaggcagcactttcctgaagatgtttcttttctttttttctttttttttttttttttttgagacagggtccagttctgtcactcagactggagtgcagtggcatgatctcggctcactgcagtctcagactccctggctcaagcaattcgaccacctaagcctcctgagtagctgggactacaggcatccactaccacatccggctattttttatattttctgtagagatagggtttcaccatgttgcccaggcttctcttgaactcctgagctcaagtgatctgctgccttggcctcccaaagtgctgggattgcaggtgtgggtcaatggacccaggctctgaagatgtttttttctttttagagatggagtctcgctttgttttccaggctggtctcaaactctaggcctcaggtgatcctgccacctcggcctcccaaaatgctggtgtgaaccaccctgcccagcccaaagatgcttttggtctgatctatctggggaatgctgagcctctccctcctcggaatttgtaagagtgcacacccaaatgcaggctctacgaagtctgtcttcctagattgaaatcacatgtagccaacaaacttgtttatttatttatttattttttgagatggagtctcgctctgtcacccaggctggagtgcagtgggacaatctcggctcgctgcaagctccgcctcccgggttcaggccattctcctgcctcagcctcccgagtagctgggactacaggcgcccgccaccacacccggctaattttttgtatttttagtagagacggcgtttcaccgcgttagccaggatggtctcgatctcctgacctcgtgatccgcccacctcggcctcccaaagtgctgggattacaggcatgagccaccgtgcccagccttgttttattatatgaagttacaatcctgtgtcacaagatgggagggcagagggaggattttgaggaaagcttaatgaccgaatggtgtttactgtcaggagtcccagaggaaagggagagaagggattaatgtggctaagtgagaaacaagataggccagagacaagtgaggttaaaactgcatgaagggattgagcaagtggaagcaatgaccaacgtgctggtgctcatgaaccgcagagggaagaaagggagcaactaggaattttgaaattaggaataaggctgggcgcggtggctcacgcctgtaatcccagcactttgggaggccaaggtgggcagatcacctgaggtcaggagttcgagaccagcctggccaacgtggcaaaaccctgtctctactaaaaaacaaaaaattagccaagtgtggtggcacgtgcctgtaatcccagctactcgggaggttcaggaaggagaatcgcttgaacctgggaggcggaggttgcagcgagctgagatcgcgccattgcactccagcttgggcaacagagtgagactccgtctcaaaaaaaaaaaagaattaggaataagagtgagggaaatgggcaacttgggccagtagcagagctgttttgaacatgggaaatttacccacagttgctttatagtccttcagacatttagaattttaaatttttttaatttaaatttaattttttttttttttagaaatggggtcttgctatgttgcccaggctggtctcgaactcctggcctcaaacaatcctccctccttggcttccccaagtgttgggattacaggcgtgagccactgtgcccatcctagaattttttaaattttcaaaacagtaatctgtccttgagtgtgaactagattgtactgacaatctgaatagatatttcaactaatggttaaaaaacaaacaaaacacccaaaacacatcttagaatgattctcatgtcttccaaataaaaatactttaaaatgttgtcaatacttttacctatttagcttatgcctttggttatagaaaatatagaatcaatgataatgaattaataagaaaataaaaatagatatttcaactaatggttaaaaaacaaacaaaacacccaaaacacatcttagaatgattctcatgtcttccaaataaaaatactttaaaattttgtcaatacttttacctatttagcttatgcctttggttatagaaaatatagaatcaatgataatgaattaataagaaaataaaaaatatattccatctttaatatactgatggttcagttttatttctaaattgtctgagatggaagtatattaaacataaatggtgaaagtataatggggacaattcattatgtcctttggaaacattttcattgtaaattccagttgtatttattttttatttatttatctatttatttattattatttgttttagatggagtttccctcttgttgcccaggctggagtgcaatggcacgatctcggttcactgcaacctccgcctcctgggttcaagcgattcccctgcctcagcctcctaagtagctgggattacaggcatgtggcaacatgctcggctaagtttgtattttcagtagagacggggtttctccatgttggtcaggctggtctcgaactcctggcctcaggtgatctgcttgccttggcctccgaaagtgctgggattacaggcacgagccaccgcgcccggccataacgtgcagttttaaagtattatccttgatgaaattaaattgttaccaattttccaacctgcatgattcattaactctgcactaatgaattatactgcctgacttattcccaggaagctctagatgttgctcatcaatctatggataattgttgtttgtggtttttaagctccattgcatttttatctatatagatggagaattaagtcttgatgtgacaaagttgaaaaataataaaaccaaagttcagaaaactctaaacaatagttttatttatttattttaataatattcatttatttattttatttatttttaaaattatacttcaagtcctgggatacatgtgcagaacatgcaggtttgttacacaggcatacacatgccatggtgatttgctgcacccatcaacccatcatctacattaggtatttctcctaatgccatccctcccaccccaccccctgacaggccctggtgtgtgatgttcctctccctgtacccatatgttctcattgttcaactaccatttatgagtgagaacatgcagtgtttggttttctgttcctgtgttagtttgctgagaatgatcatttctagcttcatccatgtccctgcaaaggataagaactcctttttttatggctgcatagtattccatgatgtatatgtgccacattttctttatccagtctaacattgatgggcatttgggttggttccaagtctttgctattgtgaatagtgctgcaataaacctatgtgtgcacgtgtctttatagtagaatgatttataatcctttgggtataaaggattgggaaaagcatagtatctgggctggatagcaccgtccctcacggcatagtccctcatggcttcccttggctacgggagagagttccccgacccccttgcacttcccgggtaaggcaacgccccccacctgcttctgctcgccctccatgggctgcatccactgtctaaccagtaccagtgagatgaaccaggtacctcagttggaaatgcagaaatcactcgccttctgcattggtcttgctgggagctgcagaccagagctgttcctattcggccatcttgcccgggaatcttatttattttttgagatggagtttcactcttgttgcccaggctggagtgcaatggcgcaatcttggctcactgcaacctctgcctcccaggttcaagtgattctcctgcctcagccccctgagtggctaggattacaggcacccaccaccatgcccagctaatttttgtatttttagtagagacggggtttcgccatgttggccaggctggtcttgaactcctgacctcaggtgatccacccgccttggcctcccaaagtgctgggattacaggcgtgagccaccatgccctgccttaaacaatagttttaaaaacctctaggacctgtagtttgttttttgtttagagatgaggtcttgctatgttgcccatgctggtctggaactcctgtactcaagggatcctcttgcctcagaatatcgtggactaaaggtgtgaggcaccatgccaagccctgtggtttatttacactgtaggctgtaatagtttagctttccaggcagtgactatgtcttagaattaaagataaagacagttgcttgagatgccttagagagggctgcagttcaatgggagaaaatgccagaattatttttctgtgagaatatttcaggttacagtctagattagacaaatagcatctttaaggttttgtcaacaatagatattcaggggaaataaaaccttcagaatcagggctaaaaatctaaaaattctgtcctagagaagggcaaacttgaagatttttacttcacttttcctgctagtttagctaaagaaatatgaaaatgggctgggcatggtggctaatgcctgttatcccagtgctttgggaggccaaagtgggtggattattgagcccaggattttgggaccagcctgggcaacatagcgtagaccttgtctctacaaaaaatatttaaaaatggccaggactagtggctcatgcctataatcccagaactttgggaggttgaggcaagtggatagcttgagcccaggagttccagaccagcccaggcaacatagtgagacctcatctgtatcaaaagaaggtaaaagaaatacaaaaacaagtcttaacaactaagcaaagaaataagtaccttgacttgttctcacttgttctataagagttacactggcacaagctcatctaatgatgtagttgctttgaaatctctacttccttttttacttctttttgctgaacaaaaatatttaatgaacaggcttggattaataagtttggtgatggtgtccaatgaacacaaatgaccacgtaaagggtagtagtagattggacaccttatacatagttcagaatcatcatatgatcttcatggttgaggcttgtttcttttcttttttttcttttttttttgagatggagtttcactcttgttgcccaggctggagtacaatagcactatctcggctcactgcaacctctgcctcccaggttcaagtgattctcctgccgcagcctcccaagtagctgggattacaggcatgtgccaccccgcctggctaatttttgtatttttttttttttagtagagaaggggtttcaccatgttgttagggctggtctcgaactcctgacctcaggtgatctgcccacctcaacctcccaaagtgctgggattacaggtgtgaaccaccacacctggcccttgtttgattccttttaggcttgggaaaaaagggtgaagatgggggaggacagaagcagagataaacgaagtaaatgttcatacattctctcacttgaacctctcagcaaccctgttaagtttgtatttgtatttgtatttatttatttatttgacacagagtcttgctctataccccaggctggagtgcagtggtgtgatctcggctcactgcaaactccacctaccgggttcaagcaattctcctgcctcagcctcctgagtagctgggattacaggtgcctgccaccacacccagctaatttttgtatttttagtagagacagggtttcgccatgttggctaggctggtctcaaactcctgacctcaggtgacccactcgcctccaactccctaagtgctgggagccactgtgcctggccaagttcgtattatgattcattttataaatgggaaacttaaagacacagctggcaaatgtcaaagctggactttgaactaagatctaacaccaaaaccatgcttgatgcatagtagggccagtgatttatttttttttttaatattaggtaatagcaagtaatatgcccagagacatgatgggctgacaaagtattgacgggtcttgttcttactgtcccttctatgccccagtgctcaacttccccttaacccattccttatccttccccaccaccattccacccccaataaagtcacccaagacaggaaaaattgttaactattttcagaatactttggtaaagttgaggaaggggaaggaaacaaagtcttccagagcagagggggaaaatccctcttttgatgaaacatcctgtgtagcaactgtgaagcctggatttccccaggatgaggttagagtagcaggctgctgcttgtcacatggcctcagttcaaagtcacacctgtgggggcctcccgtaaaatttacctatatatggccctccacaaagccacaaacacagaactcaaaatggcattcaccacttctgagatgctgaacaggaaggaatagcactgtttttacaaattaagtgcacagtatatgtcacaaggaggaaataaaccctatgagtttgaacttgcacatcctctcaatactgaaagattaattttggtggctgaggttaataatacggttattcgtgtttggatatgaatgtaactcgaccgattgggaaagcaggtgctagattgatgtaccatgcctgagacccatgagtcattgtcactgatttacaagctggccttgccatgaaaatggaagccagagccaactctatgtcatacaatttatgccattcactaaaattatagataatttcagcctgtgcatttgcaaaacagtctatgccatttttgctttaaacatcttttgtacttggtctctctgacttgtctaaataagtattatcattcataataaccattaccaatccattatgcaacatcatgaaaatatatacagcttttagatttaatccatgaaataaagcctatgacttctgcttgcatctttgataaacggccaagttctcacagctgttatgatttcaattatgaagaaaattggaacttttgcattcttcagtggctaaaaatcactcagaaaaaaacacttgttcacataagctatttttttccctcgtgtgtatcatgagccttgggtctgattagtgtagttgattaaagcaatgtgccaaaaggcaaagggcccttgttaaagcccaaggaaggtcagctagattaacttcccaagtttactgaaaatctgttctattagtagtcttcagccaaattaggcaagggagtacaaacagatcagtacaaatccagtctttaatgctagcaaaatgtagctcaaaccacagttaacattgatacaaggtcaataatgtcatcttcccatacagagacagatgacacacatgcagaagcatcttagaaacacctgctctcctccgcctttttttttttttttttttttttttagatggagagtccctctgtcgcccaggctggagtacagtagtgaaatcccagctcactgcaacctgggcctcctgggttcaagtggttctcctgcctcagcctccccagtagctgggattacagtcatgtgccacgacgcccagatagtttttatatttttagtagagacagggtttcaccatgttggccaggctggtctcaaactacctgcctcggccttatttacaggttttgtctcctcatatacaaccaatctcaacatagagaactccctaactctgatccaggtaggctctccctcatcaagagattaagagttctgaagttaaatgaactacaaaatgaactacagtttataatccattgcctcacatccaaagtgcttcctctccctttctttttatccccctctcccttcaactactattctctgaagcttttcagttctctcaaatcttaattttatttttttcctccacaagaacaaacttggtaaataaccaagattgttcgtggtttcaggctcctctttttaatcatttttctcatgtcagtaatgagagctcctgagttaatattatgctttcccaaacctggaatcctcgtcttttttgcagaagaagaatcaagcgtattgtacgaaatctcaagcatatttatccttaacaaggtcaaagtcagaaaccttaatccaaaaccataaacctcctgcagaaaaaatctctggaattcaactctctctcgtctattctttattcctactgataccacttttgtgattgaaacatgaaacagatcctcatctcctgaagatgatatatagaaattgttttaaatgccttgtgaaaacccttaataacccgaattctgttccccagttgagctatattttccttgctccaaatttaccatgtcattccaggcctccaggcctttggttatttgtcccatctgtctgggcttctcttccccgcccttccttaccttactaacttactcatccttcacttcttagcttagatttctcttctgctgagaagccttcactggcccctacatcgtcagctatgggaaccctcttatgtgtagtctctatctccccctcttctagcacttgtcacagtgtgttgtaactgcgtggttgcttggattttccccctgtcctggaaacacagcctagggtgcttactgccaagcttatgatagaaactctcaataaacaccagctgagagaataaaccaaggctttgctgtgtgctgggagaggattcagcattctggtatccgtaaccctgttacataggtggtcactacctgaaaggtctgctttcatgctggtgtcagatttgcttgttttaaaaataactcagggctgctgatacatgcaattctaagccaagaagagaaccgtaatggtcatcaatttctttctttcttttttgttaccaccaagttaatgcatttaacgttttctaatctacaaagacctataacctctgctccccacgttacttaactagagagctacctatctgctactcatcaaacccagccagagatgccaagttcctgaattttttttctcacatagaaatctagatgaatcccctgaaatggtcattttaaaatcaagtcaaaaggaaaacaacaggaaatactcactagagtaaaagagaaaagtgaatcgaggacagacttgtgtatttacaactctcaaggccaatgaacattggaaaagcaaactaaaatgatagatagcaagctgtggaatttggcttgaccttaaagaggattttaatatgctcttatatcactgtctgctactcaaggtcgataagaaaagcgtggttttcttacggaacagagctgagtcacttatataataccagtgcatttcagttgattgtgatgattttttcaagagatgatgtcacacaaattgagttttgcttgaatcttgcctaaaaatagtttgatttatttactaggtcaaaaagacaaggggatctaacatcaatgacaagtaaaaatagaaagatttatttatcctgaacactatggacaaatgtgtgtctcagcacatttaggtgtttatccaaggctctttgtgtaagtagaatgaaccagaagcaatttactatatgtgaataagaaatatcaaggtgatattaatggtttgtatttcccttttctgtagaagatttgtaagaagagtcttttcaggtccccaaaggtaaactttaggattaaattatatggttttaagaaattatcactaaatctttcccccattttttttaacccttaaacatttttgtttgaaacagggtctcactctgttgttcaggctgcagtgcagtggcaagatcatggctcactgcagacttgacctcctgggctcaagctgtcctgcctcagcctctcaggtagctgggactataggtgtgcactactatacacggctaatttatttcatcgtattttttgtagagacagggtctcactatgttgcccaggctagttttgggttcctgggctcaagcaatcatcctgccttgggctcccaaagttctgggattacaggtgtgagccattgcacccagcccttagaatcttcatatttttgtttaatttgttctttgtagagtagttttcactacagggatgttacttggtaaattaaattctatcatttcaattaacaacccaagaaaaatatatgtataatgataaactttgaggaaaaagagaaataactgcaaaaaaaatgaattggcatgcagttaaactttgcttatcccttaaattttgttcctgcttatagatttttagtagttcatacaaagtcttcttttaaaattttaaaagtctcaaaactactaaaacaggatattattttagtggaaaatagccatatggtttctgggaaggattttactaaaggaataaatttaattagaagcaggaaagatttggttacatacaacaaaagccaacaaaatatgctcaaccccaagggtaagtgtaactgctggctagagatttccaggagaggacagggagtagttttcctagaatattttatgtcctaaatagcctggatgaagtcccttattcccttccagactcatcactgggaacgcggcacactggtgggctatgattccctggagagcttatgaaataaaaatcaagtgagctacgagtgcagccagaaacttgctttacccacaagtcctgaccctgaaacttaatttttgtgacttgaattgtgtctctctgtttaaaatttatttatttagagatgaggttttactctgtcacccaggctggagtgcagtggtgcaatcattgttcactgcatcctcaatctcccaggctcaagcaatccttccatctcagcctcccgagtagctgggactacaggtgggtgccatcacgcctggctaatttttaaaattttctgtagtgatgggagtctttctacgtgacccaggctggtcttgaacttctgggctcaagcgatcctcccacctctgtctcccaaagtgttgcgataacaggcgtgagccaccatgcccagctaaattatgtttctaaatacagcagaactatgtacttcgtgataggtaaagctattgtttggttgattcttagagaagagaaagggagtccatgctatctctttccacactctaaatcctgagatataaatctttagattcttgatcctcacccctggaagagaggtcagcagtgactcgaacaggggtgacctcctggctctaggagccccaggaaacaggattggaaacatggaagtactcctggaggagaaggatttagcttcctggttatcaggctctctggctgctcacacaatgtgcgcgttgcacagacagtaagccagttataatcgaactctttcacatgaaattcttctcttgggaacaagggcttgatcaggatctttttgggagagtgtgctgattttagctttcagctaacgtagacattctctctctgttagcacaagaaacaaatctggttcatttttgtaaatttaacaaccgagactcagatttaaaaaaaaattgattgcgccactgctctccagcctgggcaacagagtgagattccacctcaaaaaaaaaaaaaaaaaaaaaaaagccgcagacaggattgtaaggtaatttaaatctacatagaaataattcatctaagtttatttagtctgatcatttgttttacgtgctttctcaaggataacatggttgaaaatttagtgaaaaataaggactattgtgggtgataagcttaggaatcaccagacacctctctccagagaccataatacatcatgccaagagcaaaaaactgggagaaatgagcaatttgaagtactgttattttaatccccataagcctatataaaattttttttgatataaattaaaagaaaccagaaatctataaagccatctggctgatttaagtatattttttatagcatctttttaagaaagatcagaaaaactcaagacaatataaaagtatgtcagtatggaaactattcctagctgatcattttacttccaagccttctgggcttcaaagggacagctcaacaattttgagaagaaatataaaagtaacaacacaccttcttgagcctaacagatggagtaagacatttgaaatgctgaacaagagacatgggtcagaatccatcccagaattgtatgaagccagcttaattaaaagtgctttctaggctgaagcagagcatcacttgagctcaggagttcgtcttttgtttttctttttttttttttctttttgtggagaacggggtctcgctatattgcccaggcaggtctcgaactcctgggctcaagctatcgtctcgcctcttgcctccctgagagctgggattacagacatgagccaccgcgcccagctgagctcaggagttcgaaaccagactgagcaacagcgagaccttgtctctactaaaatttaaaaaagaaaaaaaacaattagctgggcatggtggtgaaagcctgtagtcccagctacttggagggctgaggattgcttgagcccaggaaatcgaggctgcagtgagccctgattgtgccactgcactccagcctgggcaacagagtgagaccttgtctcaaaaaaataaaaaatttttttctacagtgcccctctattattgtctttgtaatttattgtcttcctcctttgtaaaggaggaagaagaggcagtaaccttatatttaattatgtcaacaactcagtgttaattcttctgtttgcagcaccgtggctaataacttcaaatcgcatggatccttccagaggactctggcttcactaggcctttaaaacagcacacagtgccttggcttcagcatttggtcgctgactaagcacctttcaagctgccttcaattgaaagacggacagcggactctgaggaaatccttgctcagccaaatgtatcccatatgagagggcaaacttaatgagaatcagtccctggcatgcagcgcctctggaatgtgcgtgatttacagccagcatgggctacagagttttctgtcctagtctctccttttctgtcctagtctctcctttttttttttttcaaaaaaaaaaaaatgcatcaacaaagtatcaattttagctaataaaggcaaaaagaaaaaagagcacactaactttagcacatgtatgcaaggtcccgggaggagataagaaaatgaacacattcgattcacaactgcaaggagcttagagaatacatggacacgcacacacatatcacacagggcagagcaaactgattgacaggcagaagtacaaagtgctgtgggagcataaatattgtgttttccattttcctccaagtgcctttatttgtagcaatggaatggtctcatggtgcaaaatcatatttgtgatgctgcctggcttcctatcaatagggtggagttgtacctgttcactttctacgagtgaggctcctggtgagtatggtgttttccccaaacgcacaagtaatagattaatatgggattgaaacatttaaacgatataaagaaagctaatgtcctccttgactcatctcctccacctaatcactggccagttctaatccctggaaggtggtaatcaccattgtcatttgatatacatacttccacgtcttttaatttacatttacccacacatatatactcacactcatagataaacacacatatatacagacaagaagaaagaaatacaaagtttaaaaaatgtgataatggtatatacatgttcatcttcaacttgcttttctagcataatataccatgggatatgtcaatatatacaaatctcattttttttttcttttttgagacagagttttgctcttgttgcccaggttagagtgcagtggcgccatctcggctcactgcaacctccgcctcccgggttcaagcaattctccagcctcaacctcccgagtagctgagattgcaggcatgcgccaccacgcctggctaattttttgtatttttagtagagacagggtttcaccatgttggccaggctggtctcaaactctgaccttaggtgatccacctgcctcggcctcccaaagtgctgggattacaggcgtgagccaccgtgcccggctacaaatctctttgtttttaatcactgtatagtgttctatggtatggatatgtcataattaataatgctctacaagtttataattttgttatctcctgatgtttccattttttcaccatttccaacattgcaatggatattactgtacctatctcagttatcacataagcaagtaattatctggggtagatgtggagacatggatttgctaaattaaaaggtaagagattcccagctgggctcagtggttcatgcctataatcccagcactttgggaggctgaggtgggtggatcacttgaggccaggagttcaagttgcagtgagccaacatcacgtcactgcactctagcctgggtgacagagtgagactctgtctcaaaaacaaacaaaggcaagagattttgattttttttttttttttttttttttgagatggagcctcgctcttgtcacctaggctggagtacaatggcatgatcctgggtcactacaacctccaccacctcccaggttcaagcgattctcctgcctcagtcttccaagtagctgggattacaggcgcccgccaccacacctggctaatttttgtatttttagtagagacagggtttcaccatgttgaccgggctggtcttgaactcctgacctcaggtgatctgccctcctcgacctccaaaagtgctgggattacaggcgtgagccactgtgccctgccttcagtcttcttgagttggctattactaggaagtatgagaaaaatgtccctctctgacagaatttgcccatttttctttctatttgttagttatttctttaaatatttccatgttatgttaagtgcatgaagatttgtgaatgttttatcttcttggtagatatttttcttcaacatgaaatattcctctttggtcctttttcctttttttttttttgtattttgtcgatatttatattgctaaaactactttccttgtattagactttatctggaacattattattttccaaattgccagatccttttacaaacatagtttacaatgtccccagcttttgctgtgatcattttggactatggtttccacatcaaacttatcatcctacctgccttctctttttcagagatacttaattatcccttatctacacaatggtatactttgtcttctagcacaattataagctaaagtgtgtgtgtgtctgtgtgtgtgtgtgtatgtgtgtgtgtgtcatttaaggcagaaagtagagatgacattacatggtcaggctgccatcttgatacgatcctatgttttccttaacaccagatttccttctccacctccacttcaaaactttcctttccttccagcttggttgatctagatactaaaggtgccgtgggagatacaatacagagtagagtttgtgaatacgtttagtcagcatacacctctcgaaaaactacttttggtctccatctctttgtggcctataagttagtttcaggctgaatactacaacatgtgttccagtagcatgcattatttagtaacagcttacacagctctaagttatcatctttcccacctcattcccaggaagatttgtttaatttataagcagtccatttcagacagcactcctcgggatatcacaatattgctgttcttctgggtgattcattggcattatgaatacccttgtttcttccatgggtaaaacatgtttcaaggccactaactgggctattggcaaggcctggtacaaactaagtgcaatgtaactcttagcaatttgtgaccattaaacatagcatttataatgtgctagttttaaagttgaacaaaacaacaacaacaacaaagcaacccacagcccgtgtctacggccataccaccctgaacacgcctgatctcagaagctaagcaggatcggacctggctggtacttggatgggagactgtttgggaataccaggtgctgtaggcttcgctgggcgtggtggctcatgcctgtaatccccgcactttgggaggccgaggcaggcagatcacctgaggttgggagttcaagaccagcctgaccaacatggagaaaccctgtccaggcatggtggcgcatgcctgtaatgccagctattcgcaaggctgaggcaggagaatcacttgaacccaggaggcaggggttactgtgagctgagatcgtgccattgcaccccagcctgggcaacaacagctaaacttcatctcaaaaaaacccaacaaacaaaacaaaacaaaaaacccacaattagttcataaaagacttgcacttaatttgccttcttattttatttaaaacattcttacctcgttttctatattttatctttacatatagaatacagagtttaattttattgtacttttccttttacctccctttttttcttgtttattttcacttataggtcattaaatgccaagcataggatctcagacgaaaaagggattcagggttaactagctgaggcctatcatatgatgtttgagaggttttgtggcttgcctgaattcctccattgacctgtggcagagctggcacaagaatatgggtcacctgactccagcacatgcacatcaatttacgtttacaaaagagtttttaaaatacaatctcatctactaactactacaaaactactggaaagaaacctgacggtgagtacatattacctcaatttttataggagagaacactgagcaggacaaatgaattaatgatttgcctaaaataatctgcatcgggagatgtcaggagaacaacctggggtctttactaccggcttctgcatctcacagcctctccaccttctcaccttgcaacttcactttctaaaaggacagagttgccttttcaatgatttatttcatcatttcataatttcatccctataaaaacacaaaatatagattttttttttttttgagacagggtctggctctgttacccaggctggagtgctgtggtgccatcttggttcactgcaccctcctcattcctgggctcaagcaatgctcctacctcagcctcccaagtggctaggaacacaggaatccaccaccatgctcagctaattttattttatttatttgtagagacgagttggtctcaaactcctgggctcaagccatccaccccccttggcttccctggggttacaggcatgagccactgtgccctgctgatgcatattttaacgattaaaataataataataaaaaaaacccacctggcatggtggctcacacctgtaatgccagcactttgggaggccgaggcaggcgaatcacctgaggtcaggagtttgagaatagccttgccaacatggtgaaactctgtctctactaaaaacacaaaaattcgccaggcgtggtggcgggtgcctgtaatcccagctacttaggaggctgaggcaggagaatcacttgaacctgggaggcagagattctagtaagccgagatcgcgccactgcgctttccagcctgggtgacagggcgagactccatctcaaaaataaaataaaataaataaaaaggcttaggcctgtaatccgaacacccaagcgggggcagatctcttgaacccagaagtttgataccaacctgtctccacaaaaaataaaataaaataaaataaaattagctgggcatagtggtgcatggggcgtgtagtcccagctacttgggaggctgaggtgggaccactgcttgagccctggaggtcgaggctgcagtgagccatgattgcaccactacactctagcctgggcagtagagcaaaaccttgtctcaaaaaaaaagtaataaaataaagtatgtgtcattttgatttgtgataaccttaggaaaaagccagcaaagtctgggaaccaggtaatcgattgcaaattggagaatgatttacctgctatctaagataaaggaaaagggtaaatcacaatgttgctttaaattcctttcagctttgtttattgtttccttttgtgtggaatttcactgttgcattgatttaaacccagctcctatcaaatgggacatagagtaggccctcaagtaaacatttagcactaggcatgtgtgctctgtataggatatgtagaaccctctctctgcttctaagtcataaatagttctttagagtctaagaaattggcaaactcaggctgggcgcagtggctcaggcctgtaataccagcattttgggaggctgaggcaggcagatcacttgaggtccggagttcaagaccagcctggccaacatggtgaaaccccatctctactaaaaaaaaaaaaaaaaattacccgggtgtggtgtcagatgcctgtaatcccggctactcaggaggctgaggcaggagaattgcttgaacctgggaggtggaggttgcagtgagctgagatctcgtcactgcactccaacctgggagagctgtgtccattcatttacatattatctatggctgctttccctagaagggcagagctaaatagaagttagagactgtattttaggcaaaggctaaaatatttactatctggccgtttagataaaaagttgactctatcccttgcatcaggagcgataaatagatgctcttgcatttagcgtctttattgtttttcatgacaaacctagagttgaaccaacatctggctaaaaagcaaatgcaccatgacaaatgttcatggatcagcaaagtgctaacccagttatggaagtctaatatagtgttacagagtcacaggcttagctaatatgtaaatcagcaaacatgagcaataatgatttatatttgcatggcattctatagattatgaaacatttcatatcaatctcatttgatttttccaataaccgtagaaagtagacaagtaggctgggcattgtgcctcatacctataatcccagcattttgggaggatcacttgaagccaggagttcaagaccagcctggtcagtatgacaacaccctgtttctacaaaaaaaattttttttttttaattagccaggtttgttggcgtatgcctgtggtcttatttacttgggagggttgaggtgggaggatcacttgaacctaggagtttgaggtaacagtgagttatgattgcactactgcactcaagtcagggttacagagcaagactctgtccccctgtctccctgtccccgacccccaccccccccaaaaaaagggccggcgtagtggctcatgcctgtaatcccagcaatttggaaagccgacgcaggtggattacctgaggttgggagtttgacaccagcctgaccaacatagagaaaccctgtttctattaaaaatacaaaaattagccaggcgtggtgttgggtgcctgtaatcccagctactcgggagactgaggcagaagaattacttgaactcaggaagcggaggttgcagtgagccgagatcgtgccattgcactccagtctgggcaacaagagtgaaactcaaaaaaaaaaaaaaaagaaagaaagaaagtagacaaattatgaaacagattcagcgacattgcgtgataactcagagtgaaaaggaactcagatttaatgtcttcagtcttttagcagctaaatgattattttatctctggaaaatggttaccttgctaaaaataaaaaaggtgagcggttattaacgtttatcattctatgatgcactgacttggaagatcacttacaattaactgtactttgtaataacatgttctgtcttctaaatattgtatttttatgtcagtatgatggtaaaaataatataagcattttatataatggttttaaaaatcaaaataaatatgggcctaattaagttataagttaaaaatataatcttaaatttttgaaatcttagaaactgcaagatgaatcagttatctggttttcttggattaacaaaatttttaaaaaacaactcttggagtagcagggaaaataagtcttagtaaaaatgtgagtatatatgagcttgagaaaaataatgaaaagtatacatagtgctctgtaaatggatcaaatcgtgttgaactaaatatttcaatggaagctacgaacatgtagatgactattacaatcgttgtatcatctaagacttgatctcctgtgtgatcaaaccacttctgaggaattgccagtttaccaacacattgctgtatcagtcttggacccacgtaaaacattaatacaacatactgcatgattcagctagatgacattctggaaaaggcaaatctatggagacagtaaaaagatcagtggttgctaggggtcagggtaaggaggggatgaatagtggagggcagaggatttttagggcagtgaaacttaactgtatgatactgtaatggtggatgcatgttattatacattagtccaaacccatagaatgtataacaccaagagtgaactctaacataaaactctgctagggaatgttgatggcaaagtaggttatacgtgcatggggacaagcgtatatgggtaatctctgtaccttctgctcaatgttgctgtgaacttaaagctgctctaaaatataaagcctactttaaaaaaataacataatgagctaacaaagaccacaattctaggtcttcctcagaagctttataaatatgcattaaaaaattattttttgggtatactctggcagaaatacaagaaaaacaaaggcccagaatttttccaggagaatagatccagagcgaacatgaacttacttcacacccagattgagtttcccatgaacatgactcgttctcctgagggagaacccctctttggaaagcatgttcacccaggcatgtttgacacaaggaagactcgaagtctggctcccctggagggatgtgcaccatggaggagccggtgtacttcaggctgggactctgatgcttgtccacactgaccattgggctcttgatccaccttcgtacctgcaatgtgcaaaaggaaagaaaaaacaaatgtgtttgactccctttgatgtttattggggatttggtgggaaatctggtgggatgggagctcatgaaaggagaactcggtctcacaacctgtctatctttcaaactcaacacaattcgaattggtcaatgctgttcagtctctttcctagagtatgcattacatggctggtcatttcatcttgctgagtctgtctccgcatttttttttcacattatttttttcttttctttttcctcctgcttccagtggggttagaatttttttctttttagagataggggggtttcactctgttgcccaggctggtcttggtgttaaaagatcctcctggaccagcctgccaacatgatgaaaccccatctctactaaaaataccaaaattagccaggcctggtggtacacgcctataatctcagctgcttgggagaatcgcttgaacctgggaagcggaggttgcagtgagctgagatagccccgctgcactccagcctgggtgacagagcaagactgtctccaaccacaacaacaacacaacaacaacaaaccctcaaaacccaaaaacaaacaaaaacaattaccctggccaggcgagatggtttatatctaaatagcactttgggaggccaaggcaggaggactgctttagcccaggagtttgagaccagcctgggcaaaatagcgaaactttgtctctacgaaaaaaataacttttttttttttttaaagaaaaagatccttttgcctcttaaagtgttgggatcacaggtataagtcactgtgcccagcctgtctcctcatttgtaagattcaggtaataatatttcctcccaagctgtgaaaatgctaccatgttttacaatgttcaagtactttgcctggcacatgtttggtgcccaatagatagtgactattttactttgacccttattattatgattatgatgacagaaatttagttcacacatttctaaggtgaattactagttattcttacaagggaaaatactaatctcatagtttacaatctaatccattgctaagcaaatacatattcactattattattgttattgagacaggatcttcctctgtcacccaggatggaatgcagtggcctaatcatggctcactgcagtcttgaactgctgggctcaagcaatcctctcacctcagcctctggagtagctgagaccacaggctcgcaccatcacactactaatttttttttttttttgtagagatgaggtctcactaagttgcgcaggctggtatcaaactcctgggctcaagtgatcctcccgcctcccaaagtgttgggattacaggcatgagccactgaatccggcccatatatactactgcacaactttgattataaaagaaattgcttctggctaagaaattagctcaagtttgtttttaaagttctaaaactcaccacttgtcttgcttgcttgtaaaatccctataagatacagaaagaagtataaagctattctaatattaacaggcatggtatttatacagcatttcaaaaatcaaggcactttttaaagtgtttgatgtgtatagtttttaatcctcagaacaggcagggtgaggtggctcacacctgtaatcccagcactttaaactttgggaggctaaggcaggcaggtcacttgaggccaggattttgggaccagcctagccaacatagcaaaaccccatctctacaaaagaaaataaataagtaaatgaagaataaaaaattaattaattagtcctcagaaaagttttataagaaaggtactattttcaatcccattatacagatggaaaaacaaacgcatagagatgtgaagcaaatttccccagggcacagtgttgttatggagtaaaggcgggatccaggcaccttgaatccagagtttataaacatgcaattttcttttctttctttttttttttttttgagacagagtctcgctctgttgcccctggctggagtacagtggcgcgatctcagctcactgcaagctctgcctcctgggttcacgccattctcctgcctcagcctcccgagtagctgggactacaggcacctgccaccatgcctggctaattttttgtatttttagtagagaccgggtttcatcgtgttagccaggatggtctcgatctcctgacctcatgatccgcccaccttggcctcccatagtgctggtattacaggcttgagccactgcgcctggccatgagcatgcaattttctaagaagcactgaagtgttgttaagacttatggtcactggtgcttgaaatttattttgatttactatttcactttcatgctcttcaaaactcctgaggattcttttatattcaaccaattagtgaaattagcctatagcaaaaggacaaagaagtaaaatcacagtactgaattttagttagtgatgctacaattattattattattatttttgttgttgttgttgttaaagggtcttgttttgttccccagattggagtgcattggcacgatgacagctcactgcagccttaacctcctaggctcaagcgatcctcccacctcagccctcccaagtagctgggactacaggcgtgcaccaccatgactggctaattatttttaaattgttttgtagagacagggtcttgctatattgcccagactggtcttaaactcctggccttaggcgatcctcccactttggcttcccaaagtgttgggattacaagtgtgagccaccatgcccagcctgcaattaactttttaaaaaacactgaggataaactaaaattgcaatagcaataatgtttaagcaatttattatattacttgatagaatattttgctatcactaaaattaagtattatgaagactgtgaaaatatgaaaaatatttagaacataattatatgagaaaagccaaatacaaaactgtttaattgctataatcacaaatgtaaaaacatatgtactaactataggccgggtgcagtggctcacgcctgtaatcccagcactttgggaggtcgaggcaggcagatcacctgagcccaggagttcaagaccagcctggtcaacatgacaaaaccccatctctacaaaaaacacaaaaattagctgggtgtagtgttgggcacctgtaatcccagctactcaggaggctgaggcaggagaatcgcttgacccctggaggtggaggttgtggtgaaccaagatcatgccattgcactccagcctgggcaacaagagtgaaaactctgtctcaaaaaacaaacaaacaaacaaacaaaaaaaatatatatatacacatatatattttatatatacatatatattttatatacacatatatattttatatatatacatatatatttatacatatacatatatacatatacatatatattttatatatatacatatatatatatacatatatatatacacagaaacactatagacataaagtaggagagttaagaggcaaaatagaaactgctgtgtttattgttagtatcatgggtgttttatctgtttttacaactcttcgtactttaacttttaaaagaataatattttatcagaatcataaatgtatatatatatatacatttctttaaaaaatagagtctcaccatgttggtcaagccaagctggttagaactcctgggctcaagtgttcccctcccagctcagcctcccaaaatgctgggattacaggcgtgagctaccacatccagccacaagtgtcttttaattgctttatttatttatttctttattcatttatttatatttattaagatggagtctctgattgtcacccaggctggagtgcagtggcgcgatctcagctcactgcagcctcctcctccctggttcaagtgattctcctccctcagcctcctgagtggctggaattacaggcaccgtgcccccacgcccagctaatttttgtatttttagtagagacggggttttgctatgttggccaggccggtcttgaactcctgatctcgggtgatccacccacctcagcctcccaaagggctggtaatacaggcgtgagcaactgcacctggcctatatgtactcttttcaatagccatttaaaatatctttgtgaggccggttgtggtggctcacacctgtaatcccagcactttgggtttgggaggctgaggcgtgtggatcacctgatctcaggagttcaagaccagcctgaccaacatggtgaaaccctgactctcctaaaaatacaaaaattagctgggcgtggtggtgcacacccgtaaccccagctgctccagaggctgaagcagaagaacggcttgaacctcggaggcagaggttgcagtgagcctgagatcatggcactgcattccagcctgggtgaaagaaggagactctgtctcaaaaaaaataaaatatctttttgagtttactatcctaaagttaaaattttgggtttccttaaatatttctgtcactatagggccccttaagcatgttagtaggtatattaagaatgtttcgctgattcattaatggaagtctaaatgaaactttaaaagtttgagactccaatagaatgtatcttcttaatgttagtactaaatgtgtttttgatcagtctaaaaagtgttcaatttcattagagatggataatgttttttattattcttattcagatagttttgggcttgaagtctggtaactgttcttgctttgtctccaacgttgtagtttaaaatcaatctttttactctggcttactttcaatgtctcttttgccaagtagatttaactttagggttactgtgaacaggatttaaacagatgataaatctattcaaatatatttgtaagttgtatgcctggactaagaatctttgtatcttgaaatgtatatctcccctgactccctgaacacccgcactctagagcttgagttatggccaacaaaataaaattttttttaaatattcttttttcatgttatttttatttctttttgttttttatttttatattttctttttcttttttttaatatgttacagtctgaatatgttcatagtgacttttctgtttgtttggttggttttttttacagagatacagtctcactctattccctttgttggagggctgtggcacgatcatagctcacttcaaccaagagctcctaggctcaagctatcctctcgcctcagcctcccagttacctgggactacagatgcgcgccaccacgttcggctatttattttttggagagacggtgtctcattatgttgcccaggctggtcttgaactcctggtctcaagtgatcctcctgccttggcatcccaaagctctgggattacagacatgagccattacacctggccagaataaaattattaaagggacatactatttatttaataaaataagtaaactataagtaagaaggaaaataaagcatatgaatgatcaggatcattgcgggtggagggctcaattttaaacagtatgagccaggatactatcggatactccctctctgtccacacagaatgtagcaagggatatggagaaatactccctttctccagaagcatcagagaaaaagtgttacttacaaaaatgaatccagcaacacatttctaaccggactgttgctgaattttactgcatgctttgtcttaaaaaggttttgtctccattggcttagtccttatactggcttcaacgtgtcccttctttatgactccttgacacttttcaccagctttgaagcctcacaagtgatttttacaggcccaattaaggacagagtttacgatgtttgcttgctcttgagagagtggctggaccgacccagtgaatgcacaggagttaggcaaggtgcccttcaaaactgctgagtagagaaatcctcccacggcccctcggggaattcaagctacaactggcccattgtgtttcctcaggctgcggattgctttactggagggagtagctgactgtgagtggctttgggagcccttcataacaatggctggaggagagctgcagcagctgtgtgtgcgagaaacacgaatgcccggatgccagcggcagcctgggctcctgggcctcctgggccacctgggccctagttttattcagagctacacaactgtttgtgaagcgcattgtaaacaaacatagacggggtgagacatcctctttatcctgaataaatcaagaattcccaggccgggcgctgtggctcatgcctgtaatcccagtactttgggaggaggcgggcggatcacgaggtcagtagatcgagaccatcctggctaacacggtgaaaccccgtctctactaaaaatacaaaaaaaattgccgggcgtagtggagggtgcctgtagtcccagctactcgggaggctgaggcaggagaatggcgtgaacccgggaggcggagcttgcagtgagctgagatcgcgccactgcactccagcctgggcgacagagcgagactctgtctcaaaaaaaaaaaaaaaaaaaattccctcacttggggtttataggagactgttctccaaaccacaccagacttttagaagcaactacctctacagataccggggtgaaccagtaaggcccttcatttaactagacagaaactgagtgaacagtgggtaaacaaaatattcaaccaaattctttgctaaatccagtccaccttggttttattaatgtctttacttggaaaaaaaaaaaaaaaaagccatccaaaagcaatccctcagtctagaaaattgccagatgtgattaaagagattggctggcttctagggattttccacttgtggttttttcctattatctaagagcaaacagatattactattaatttaaaatagtttagctgataatgatatcaaccgatacaggaaaattatagagagtttaggtacttaggtgtgaactcaggtggcaacacctactctcattggcccccgtccttttagggggaagagctgactctcttaaaaagccaagagagcttgaagttgccttctgtaatttccaaacaggcattttttttttttaattatagagaactgactttgcttacttgacgcctcaataactttcaatttcgagagagtcagcccagttttctagtgaaattacttggataggtcaatagattataaaaagggaggccaggtgaggtggaggccgaggcaggtggatcatttgaggccaggtgttaaagaccaggctggccaacatggtgaaaccccgtttctactgaaaacacaaaaattagccaccatggtggcgtccacctgtaatcccagctactagggaggctgaggcaggagaatcccttgaacccaggagccggaggtggcagtgagccaagatcgtgccactgcactccagcctggatgaaagagtgagactctgtctcaaaaaaaaaaaaaaagagagagagaaagtaagagacctgcatgcctatgcctctcccagagggtgcatgctagcaggttagttacggcatgagtgtaatttaggagaaggctcctggaagcaaattcatctcacactgatactggagcctgaagctgcttcatagcatgtctcctaaaatataacagtgctgtaatattcagtaatattaatcagatatcttcaccccagctatatgtcatcatcatgtatctgtcttttctctctctcttttttttttttgagacggagttgtacttttgttgaccaggctggagcgcaatggcgcgatctcagctcactgcaacctccgcctcccgggttcaagcaattctcctgcttcagcctcccgagtagctgggattacagacgtgtgtcaccacatccagctagttttgtatttttagtagagacagggtttctccatgttcgtcaggctgatctcgaactcctgacctcaggtgatccatccaccttggcctcccaatcccaagcctgttgggattacaggcgtgagccaccgcaccaggcctattactgtcttttctctagtgtttgtagtgtttattgcttgtataaaacaacaggacttttatgctaactggtcttgatattaagcctatgtcacctttccaactggatcataagcatgagaatagcttcttaggccttaggaaaaaaaaaaattccagaggctagtgtatgggcttacaaacaaactaggtaataaaaataggaatctcttgattgcttttaatatttacttatagatctcaacaagttttgctaacatcctccatcaaggtaatacagattttctatttaaatatttctctttaacacgcaagacctatcctggagcaggcaccctgagaagatggagtgacttttagaattccctgaccttctatgctgttgtccttgggatctcccagtcctttcctctcaccttgacctagttgcatcctcttctagattctcaggggccaacctgtgtctccaggcctagtccggaggatggagtggtggggaggactctggggaagtgggaaaacggagacgcaatgcgtccatgtaccctatttaatgttgctgctcacagcaggcagcaccccagctccgtctcttcagaggacagtgcttgcctgttcttctagctcagtaagtataaagtctccctcctcatcctccccattgaggaatccaccccaccctgtcccaccccaccccaccctacactgccaagtgttaaatagataaagtgcaggaattcatcaacgtacgtttttctttggaaatacaggtgaagtttttctcatttctttaaattgtgggactctgccaggtgcggtggctcatgcctgtcgtcccagtgctttgggaggccgaggcaggcagatcacctaaggtcaggagtttgagaccagtctggccaacatatagtgaaactccatctctactaaaaatacaaaaattagtcgggcgcgggggcacatgcctgtaattccagctacttgggagactgaggcaggagaatcacttgaacctaggtggcggaggttgcagtgagccgagattgcaccactagactccagtctgcagagtgaaactgtctcaaaaaaaaaaaaaaattgtgggactcattcttttcgtttgaatttgtctttcctcgatatgtactttttttagatataaaaaattgttttaaaaagagaaagtaggaaaattattttaggtactatctctacgggacagtgtatgttatttgcttttggaaattaaggctcagggaaaatagaaatgctggtgtaatcagtggagaagaacctggctatcctgtccgtcaaaatccactgagctttggaaacaacttcctcccctctttcctccaagaaatccccttttccagtgttttttttgtttgtttattttaggttcaagggtacatgtgaaggtttgttacacaggtaagctcatgacaccgggatttgttgtacagattatttcatcacccaggaattaagcctagtacccaatagttatcttttgtgctcttctccctcctcccactcttcaccctccagtagaccccagtatctgttgtttccttctttgtattcatgtaagttctcattccagtgtttttctgtttgtttgtttttttgagatggagtcttgctctgttgcctaggctggagtgcagtgatgcgatcttggctcactgcaacctccacctcccaggttcaagcaattctcctgcctcagcctcccgagtaactaggactacaggcacacaccaccacacccagctgagttttgtatttttagtagagacagggtttcaccatgttgaccaggctggtctcgaactcctgacctcaggcaatctgcctgcctcgacctcccaaagtgctgggattacaggcatgagccaccgtgcccagccttttttttttttttcttgagacggactcttgctctgttgcccaggctggagtgcagtagtatgatctcagctcaccgcaacctcccgttcctgggttcaaggaattctcctgcctcagtctcctgagtaactgggatcacaagtgtgcaccaccatgaccagctaattttttttttttttttttgtatttttagtagagatggggtttcaccatgttgaccaggctggtctcaaacttctgacctcaggttatctgcccaccttggcctcccagagtgctgggattacaggcgtgagccactgcgcctggcctcattccagtgttgttgttgtttttttaactgtctctctctctctaggctactgtctctcagcatattaaacaccttgttcttgcaatatctctaaaagctagcgaacagactgcaagcaaaacatcctctttacacccacaaactcttcctttttcccgcagccacctttcaccaccacccaactcttctctcttagccgagcttcatgaaaaaataatctccatttcctcatctcacattttctcctcaacccatttgctcattaaatggcaatttgttcattaaatggtatttatggattgcttaatatttgcaaggactaaagcgaagaacataataacaaaagtctcatttcataaaatgaagcttgcacaaagatgccaataaacctcattgtcaaatccaatagacatttctctgtgcttacttcatttgcatatactctgcagcatttaaaagctttcacaaaggttcaacaactatttgcctggcattatgtggttgggacagaaagaaatttaatgttgaccatcgaaagaggatgcttgcatttcagaggggctgatacatgagactgcggtttatcacagcaggtctaccctccccagagctcagtttctgcccttgtaaaatggagataataattatgcctactttacaagggttttgtgaggactaaatgagatgatgcaggtaagcccagtgcttgacaccaggtgaatccttcacaaatatttgctattgtggttatggcttcattccatggaaagagttttatacaaagggccattggagaaaagatggagggtacttggtccagtcaggaaaaatcagggaaggctttctggtggaagtgatggttaagttgaatcttaaaagctgagttacactttgggaggccgaggtgggcggatcacgaggtcaggagatcgaaaccatcccggctaaaacggtgaaaccccgtctctactaaaaaaaatacaaaaaattagccgggcgtagtggtgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagctgagttaaaggaagccaggtgaagagaaatgggaaagatatttctagtagaggggatggcagaagcccaaatacagaggcaagaatctgctgagatgaatagaaaacaagctccaaaaaggagaggcaagaactaaagctggatagaaagtttaggtcatggggcaatgaggggaccctgaagtatttatttttatttatttatttacttactatttagggatggggtctcgctgtgttgcccaggctgatcttgacctcctgggctccagtgattctcctgccttagccttccgaagagctggggttacaagcatgagccgctgcacccagctcactgaagtattttaagcaggagagtaggatggtcaaatgtgtttttctttttctttttttttgagacagagtctcactctgtaacccaggctggagtgcagtggtgcgatcttggctcactgcaacctccgcctcccaggttcaagagattctcctgcctcagcctcccaagtagctgggattacaggtgcctgccaccacacccggctaattttttgtatttttagtagagatggggtttcaccatgttatccaggctgatcttgaactcccaatctcaggtgatccaccacctcggcctcccaaagccctaggattataggcgtgagccaccgtgcccagcctcaaatgtgtttttcaatacagtatgaaggacggatttaagatggtcaagatcaaaggagctagatgagagtcaggaatggattagaaaagaaaggtaagggccaaacaagaatagtagctttgggaatggaaaggaggaaacaataatcaaatctacttttagctctcaagactatatcctcttctccatccaagtacaggttgagcatcttaaatctaaaaatccaaaatctgaaatgcttcgacatctgaagctctttgagtgtggacaagatgttcaaagaaaatactcattggagctttttggattttcagattaaagatgctcaaccagtaattataatgcaagtattccaaaatctgaaaaaaaaaaaaaaacccaaatctgaaatacttctggttccaagcattttggataagagagactcagcttgtatcttctcgattcctaaagccattccttaaatggtattgcccttttagtcttttcttttcttttcttttcttttcttttcttttgagatggagtctcactctgtcacccaggctggagtgcagtggcgcaatcttggctcactgcagcctctgccttccaggttcaagtgaatctttcacctcagcctccaagtaactgggattacaggcctgcaccaccatgccctgctaatttttgtattttagtagagacggggtttcaccgtgttgaccaagttagtcttgaactcaggttcaaggttcaaggtatccacccaccttggcctcccaaagtgctggtattacaggcgtgagccacagcgcctggccatctttttttaaaaaataaaaataatctgtggctgggtgcattggctcacctcatctcttaaaaaaataagtaaataaaataaaataatttgttatttaaattgattgatcagtcgattgtagaggtggagtgtcactatgttgcccacactggtcttaaactcctggcctcaagtgatctgcccaccttggcctcccaaagtgttgggattacaggtgtgacccactgtgtccagcctccctttttaatcttaacctcactgataccacagcttctttccaaatgcaaaagctgtcttgttgctacctagctttaaactcctcagtttggttcctcatctctagcagcagtggctttcaaacctgtttcatcaggattgatgtattataagaaagcccatatgactgaaacaattggttccccactaaaacctatcctttttacatgaaatgcactgacatctcctattctattctttcaaaatgctgattgcaatctattgaactgatttcatgaaccactaatgggtgccacacaaattgaaaaacgctcatctaaatggtaaaatctaaatatcttggcctgggagaccaagtctcctagggtctggacgcctatcttctattgtgcccggaatgcatccagacctccattatatcatttactttgcagttctcttaaagattgttctcctgaatctttgattcccttgaccagccttgtccacctggaaactcctgctctaagtcacaaacttgggaaagccattgtctggcttcttacccattctttcatccatttgggtattcatttgtttaagtgggagcacacattcattgctttgcttgtgtatttcccttattagaatgtgagtttcataaggactgagatattattttctctcatatattcagtagtgggacatttataatttcttctgtgtgttccctcttcctagcttattcctgctctattttctgtctgtgttcactttgtgttgaagctcacaaggaaagagactcactattacatccccagagcttagcacaactcccaacatacaggcaatgctgaagaaatggttgctgattggctccatgctaggtatttttcaaggcacagggaatgacaaataagaggcaattctgtctttaggaactcagagccttgcaggaaagcccaacaaggaaatcaacaattggaagacagtgttaaagcgagcatgagttcatctctggggagaagtaggaccgggctgtgatggggataggtgaaatgcagcattttggagagagaggaaagcatgtttcaaagcatgctcatagagagggccaaccttggggtgagtatgtgtggcaagccagaaagccaaaaagctaagtgggtcagacatcaaatgacttgaatgtttggatactgaaatgtcatccttaactcacagggagggtacgctgaaggattctaaatgttagcatgatctgatcagatttgctatcttctaaatgaattgggcccaggggaaaagcatcctaggttagaggaataagcactgtccacagattagatggaccccacagattgaggccccttctggagacagtgcttattccaggggtctccaaacccgggtaacacaggacagctttaaaaatgcaggctcagctgtgcatggtggctcacacctataatcccagcactttggaaggctgaggtgggtggatagtttgagctcaggtgttctagactagcctgggcaacatggtaaaaccccaacactacaaaaaatacaaattagccaagcatggtggtgtgtgcctgtaatcccagctactcaggatgctgaggtgggaggagtgcttgagcccaggaggttgaggctgcagtgaactgtgattgtgccactgcactccagcctggcaagagactcttgtctcaaaaaaaaccacaaaaacaaaaacaaaaaccagaaccaaaaaacccagggtgaggtgcagtggctcacgcctgtaaccccagcactttgggaggaggccaaggcaggcatctctactaaaactacaaaaattagctggtgtggtagtgggtgcctttaatcccagctactcgggaggctgaggcagaagaattgcttgaacctgggaggtggaagttgtggtgagctgagatcgtaccactgcactccagcctgggtgacacagcaagattctgtcttgaaaaaacaaaccaaccaacaaacaaaaaccgaaccaacaaaaaaaggaaataaaaattaaaatgtagtcttaccagtggcttttaacatttttaaattttattttcaagctctatgtgacctagatgaagggcagggaaggctaaatggagcacgaaatgaccagggtcctggaggtgtgagaggtgggcagacccaggcaggtgtgagaggtgggcagacctgggttttttgggcaatgggaggaggtatcactataaaataagacagagtggaaatgccatcctacagcctcacttggagctctctacagtattgttcctcaaagacatcttcctttcttcctttctccactcccctaagtcccccacatctaaaataacaccatatagctcttaaactccgtaataacctaggtatattatgaattaaataggtttctatgggtaagaataaggttaagtgtggagcagaaagggttactaaacagcaagtataatattgttttttctattattctgaggttaagcagtcaatttacaagtgatttggatttcctcacaatttactgaacaaagaagaaaatctaagatataaaaagggttttctacagaaatgaataataaactgaattaagagaattggattccagttctagcttcgtaactaccttgagcaagacactgaattcatgtgaacttgaaggcgcttatccgtaaaatgatgatcttggagcatccaagaagtcctttccgactgtgtcacagattcaaagctcttcgttccctgaagtcctgctactgtgacttggaactctctgtttctatggtgtgcagcactcagcacaagtttgttgaatgaacaaatgatcaaatgacatttgcccttccctgcctgacattccagtcacattcttccataactttgcatttcttccattagataaataaacaaacgcaaaaaatccacaaggcttttaagataattttatgcccttaagggcagttgtttaaaaatctatttaaaacacaaagataaagactgaatgaaagtctcattattagagcgctgtacattgcttaattaaattgaaagtggtaaatgaaaggtaagatgattaacatccaaactggggtcttattaccactctctgatgttactgcttgttcgttgagtcctcttataaaagaaattgcacagtacactcaatttcagttttatacaaaaacagctttcctccaaattatgcttgtgctgtattggtaatggtttctatttctgtattctatttttttttctcacttcatgttttataaatgaagaaaatgttaaggtttaattgttccctgaaaacaggaggacagtcaaagctaacaaaaagatatctatgaagtacctattatgtccaaggattgtgtgaggttctgaaattatggaagataaaagaatgtattgagaataaattggaaatgttcaaagatcctatggaaattgctggaattaaaaaaggctcagttttcaaccatagaatcagaagcacaagaaaaaaaaaaccaaagaggaaaagaaaactggctgtgacctccgtacaattgagacagaggaaaatgactgttaacatgaatctgtgtaaatggagaaggaaaaaggatgcatttcaggacagctacatttaaataatcaaaataatttaaaaagtgtaggcaaggtagtgagacttcctttctacagaaaaaattaactggatgtggtggcatgcacctggagtcctagctactaaggaggttgaagcaggaagatcacttaaactcagaagttcaaggttactggctgggagcagtggctcatgcatgtagtctcagcactttgggaagcctacatgggtggatcacttgaggtcaggagttcaagactagcctggccaacatggtgaaaccccgtctttattaaaaatacaaaaattagctggacgtggtggtgcgtgcctgtagttccagctactcaggaggctgaggcaaagaatcacttgaacccgggaggtagagattgcagtgagctgagatggtgccactgcactccaacgtgggcaatagagtgagatcctgtctcaaaataaataaataaataaataaataaataaaataaaggcaagagtaaaaatcaaagaaacattcttgcaacattatccttggtgataccacaccctacagatatgctgtattcttttaatagatatcaatgaactgacttgttaaagaaagaaagtggaaatgtagtatataacccaaaatgcattacattaatatggccctcattaatcccctcccccccaaaaatagcaagtcattctgctatatgggagaatttcatacatgaaattttacaaggataggtgatttataggaacttctgattattatgctttttgccattcttttattataaaaccagcactcaaaaagaatcaggtattggttctacatacgaatttgaaatgagcaggtgtgcagtaagcactatattacagtctggttaagtaaaatataaacacttagctttgcttagaaagcctactgttgggaaaagctgggtgtggtggcttatgcctgcaatctaatcccaatactttgggaggttgaggtggagggatttcttgaggccaagaggtcgagaccagccggggcaacatagtgagatctcatctctacaataagataaaaaaatatagctgagaatagtgatgcacacctgtagtcccagacactcagaaggctgaggtggaagggttgcttgagcccaggaggttgaggctgcagtgagccacgatcatgccattgcactccagcctgggcaacaggcagaatgagacactgtctcaaaaaaaaaaaaaaaaaaaaagttgtttcttcctggcccattccatcttcaaagtgccttttctctgtataaggacatatcttccacatagggtatagttcctagtaccatttgattacctatcttactcacggctgtcttgaaggcaaacagaaattcctaagtatttgttgaataaatagatgagtaaaggagtgaatagatgctttgtggtggtaatttagcttatttttaaaatatatatattttttaatttttttgtagagacaaggtctcactatattgcccaggctagtctcaaactaccgggctcaagcgattctcccaccttggcttcccaatgtactgagattacaggcatgagccacctcgcctggccaatttagcttcttcatttgtgttcctccctagattgtaaattctttatggattctttatggataaatatttcactggacatctttatgttgcttgtaatgccaagcacagtatcttgcatgcatgacactgttcaacacatatttgttgtattaattgaaagtgtgtgcctgtcaccctgcgaggtctgaatgaaatagcagatccaggccaggtgcagtggctcacacctgtaatcccagcactttgggaggccaaggcaggcggatcactttaggtcaggagttcaaggccagcctggccaacatggtgaaaccccatctctactaaaaatacaaaaaaattagctgggcgtggtggtgtgcaccagtaaccccagctacttgagggctgaggcaggagaatcacttaaacccgaaaggcagaggttgcagtgagccaagatcgcaccattgcactccagcctgggtgacgagcgaaactccatctccaaaaaaaccagaaacaaaataccagatccaatctttggaaatttcacaccctcatctgctcaagcttcctggaatctggattataaccatgttttaaagtccccattccaactttcttatccacctacccgttcatagcttagtttttggtcattttagtgtttatcttagtattttagtactgttagaagatctgatttcaagtgttgtttctaccacctattagatgtgtggtcttgagcaactaatttaatctctaaatctattttctcatccattaagagtactgagtatatctatgtaacaagtggtaaggatgagtaggtggtagtaaaagagaggcatctgaatcctctgcaagcatttaaaagaaaaatacatatatgagttacttaatgttgtaattattcacagttagctttccaaagataaaactggctaccaatttgttctttttttttttttttagagacagattctcagtcggtctcccaggcaggagtgcagtggcgtaatcacagctcactgcagccttgaatcccatggctcaaatgaccctcccatcttagcctattgagtagctgggactacaggtgcaccaccacacccagctaacttttaaattttttgtagagatgggggtctcactatgttgcccagggtggtttcaaattcgtggtcttaaatgatcctcccgtctcggcctccgggatcaggcacaagccaccaagcctggtccaattctgatatgctataaccagaactggactaggagagttgctcacgtgcctaataaggtttaactatatacttatatacttaactatatacttatgtttgtttgcatttgagccatgataggcccactcaattttctccttgtgggatgagagagactggtttaaaagcagttcaagtggaaaattcctggagttttaaattccctctaagccttataggaaatgtataatccattctctggactacttgggtaggttatatcagtagaagcattgaggccagaaaaacagaggtgataccctgacctctgtcgtgttgagtcagatctggagtactggctctagacttgttctgattttatttaattttatttatttatttattttgagacagggtctcactctgtcactcaagctggagtgcagtggcatgtgttcttctgattgtaataggggtattgacaaactaggaacgctctaagagcagatagaacagtgaaggagattgaaatggttaatttgtgtgtcagctttacaatcagttaacttctaaaagagtttatcagtgagcatgctggctcatgcctgtagtcccagcacttgggaggccaaggagggcggatcacttgaggtcaggagttcgagaccagcctggccaacatggtgaaaccccctctctgctaaaaatacaaaaaattagctgggcatggtggcgcacacctgtaattccagctactcgggagtctgaggcaggagaatcacttgaacctgggaggcggaggttgcagtgagctgagatcacaccaccgcactccagcctgggcaacagagtgagactccatctcaaaaaaaaaaataaaataaaagagtttatctttggtaatttgggtggtccttatctaatcaattgaaaagcattaagagtaaagctgaggttttcctgaggaataataaattatgcctcaagactgcagcctaagacttctggcctgccccacagatttcagacttgccatctccacagctgcatgagccaattcattgaaataaatctcttcatatatatcatctaatgattctatttctctggagaaccctaactgatacagagatcacactagaaagatagagataaaaactcagaaaggccaggacaacagtttttgaatatttgaatagctgctatgtgaaagatgagccaatggatggcggtaatgggaagacatatttgggcttcccatgtaccaaaacttaaatgtgtcttttgtttaaagaaggcagctgagccggtccaagtgcaatggtgtttacaactgattgatcacaaccaattacagatttctttgttccttctccactcccgctgcttcacctaactagccttaaacatacatatatacaggctgggtgcggtggctcacacctgtaatcctagcactttgggaggctgaggcgggtagatcacttgaggtcaggagttcaagatcagcctggccaacatggtgaaaccccgtctctactaaaaatacaaaaattagctgggcgtggtggcacgtgcctgtaatcccagttactcaggaggctgaggtgagagaattgcttgaacccagagggtggaggttgcagtgagcgaagatcacgccactggactgcagcctcagtggcagagtgaaactctgccttaaaaaaaaaacaaacataaatacatatacatatgaagaaggcagctgccctacagaggacacatcaaagaagtctggccgggcacagtgactcacgcctgtaatcccagcacattgggaggccaaggtgggaggatcatttgagcctgggagtttgagatcagcttgggcaatacagtgagaccttgtctctacaaaaaataaaaattagccaggcatggtggcaaacacctgcagtcccaggtactcaggaggccgaggtgggaggatctcttgagcccagaaggtcaaggctgcagtgaagttgaggctgcaatgagccatgatcgcagcactgcactccagcctgggcaacagaacaagacgctgtcccctgccaccaccaaaaaaaaaaaaaaaaaaaaaaaaaaaaaaaaagcctgaccaatctttcactcttttaagtgccaaaataatgcattttgggtttcaggcattaaatgagtcccttccttatagctctttatctctttacaattttatttccagtttggtgttcatctggggtattatgctattttatcagtgccaatccattcctttatatgttcaaatattctttttgtttatttgtttgttttcgagatggagtctcactctgtcacccaggctgcagtgcagtggctcaatctcagctcactgcaacctctgcctcccaggttcaagcaattctcctgtctcagcctcccaggtagctgggactacaggtgcacaccaccacgcctggcaatttttgtatttttagtagagacagggtttcaccatgttgaacagggtggtctcgaacaccagacctcaagccatctgcccacctccttggcctctcaaagtgctgggattaaaggcctgagccactgcagccggcccatcacatcagtcttatgcctttacatactcagagcttagctcacacttagaagtgagaacatatgatatttggctttttctttctttctttctttcttttttttttttgagatagagtctcactctatcgcccaggctggagtacaatggaatgatctcagttcactgccaccccacctcctaggttcaagcgattctcctgcctcaacctcctaagtagctgggactacaggtgcacaccactacacctagttaatttttgtatttttagttgagacagggtttcaccaacaggccagtttggtctctaactcctgacctcaggtgatctgcctgccttggcctcccaaagttctgagattacaggcatgagccaccacacccagccaatatttggttttccattcccgagttatttcacttagaataatggcctccagctacacccaagttgtggcaaaagacattattttgttctttgttatggctgagtagtattccttggtgtgtatatatcacattttttttatccactcattggctgatgggcagttaggatggttctgtatctttacaattgcgaattgtgctgctataaatatgcatgttcatgtgtctttttcgtgtaatgacttcttttcttttgggtagagacccagtagtgggattgctgaatcaaatggtagttctacttatagttctttaaggaatttctctactgttttccatagtggttgcactagtttacattcccaccagcagtgtaaaagtgctcccttttggctgggctcggtggctcacgcctgtaatcccagcactttgggaggccgaggtgggcagattgcctgaggtcggcagattgcctgaggtcaggagttcgagaccagcctggctaacatgttgaaaccccatctttactaaaaatacaaaaaattagccaagcatggtggtgcatgcctgtagtcccagctactcaggaggctgaggaaggaaaatcacttgaaccagggaggcagaggttgcagcgagctgagatcctgccactgcactccagcctgggcgacagagtgagactctgcctcaaaaaaaaaaaaaaaaaaaggtggtcccttttcaccacatccgcaccagcatcaatttttttttttttttactttttcataatggccattcttgcaggagtaaagtggtatctaattgtggttttaatttgcatttccctgataattagtgatgctgagcatttttttcatatgtttgctggctgtttgtatatctccttttgagaattgtctattcatgtcctttgttgactttttgatggggtttttttttctttcagttttcgtttccttgtaacacatctattctgtaaggataaagatgtctgtaaaataagagaccattaacttgtgctaaaggtcagtattttttttaagggataaaaagataaaatttgctgggaaacaaatgttaggaacaactgactggtattggctgagaggacggagttgctgaagagtttgccttccaaggtggactgtcccacttcaccagtaattttcttgtgaaaagtgttgactaaaaccaaaccaaacaaaaataagtttttaaagaattaaagtgagttttctttagaagtcttattgcaggctgtagactgatgactacagtctggaagtagtttgtagagaggtttcgttagtaacctgttttggctaatattttaatctatttatatacaggtggtggaggtttagtatgtataaaattgtattagatttgtttagaagttatattaaagtagaattatattaaggtttgaacgtaagagtatatttgggctgcgcctcgtggctcatgcctgtaatcccaacactttaggaggcctgtctctacaaaaaataaaataattagctgggcatggtggtgcacacctgtagtcccaactgcttgggaggctgaggtaggaggacctcctgagcctgggagattaaggctgcagtaagccgtgattgccactgcactccagcgtgggtgacagagcacagagcaagaccttgtctaaaaacaaaatacaatatttttttttttttttttttttgagacggagtctcgctgagtgcagtggcgcgatctcggctcactgcaagctccgcctcccgggttcaagccattctcctgcctcagcctccagattagctgggactacaggctgggacacgatgcccggctaatttttttgtattttttagtagagacggggcttccccgtgttagccaggatggtctcaatctcctgaccttgtgatccgcccgcctcagcctcccaaagtgctgagattacaggcgtgagccactgtgcctggcctaaaaacacaaatttttaaaaaagagtatatttagttatctggttataggttatagaagtataattattaattttgttagacattattttgtgtgtagaaaaagacaaggactagggctttttattttttaaggaatatagtgatttaggtaaagagaggttgggggcatttgggagttgtatgtcttattttgttttgtctctacagtattttcttggagaagtctttttttgttttgttttttgagacggagtgtcacagtggtaccatcttggctcactgctacccccaccttctgggttcaagcaattttctagcctcagcctcccaagtagctgggacttcaggcacatgtcaccatgcccagctaatttttgtgtttttggtagagatggggtttcaccatgttggccagactggtctcaaatttgtgacctcaaatgatccacctgcctcgggctcccagatagctgggattacaggcatgagccaccactcccagccttggagaattatatgttatagagtcaggagttttgtaaaattatgttggcaagtagaaatgaataaatataatttttttatgtttgttattttgtcctataaatttttttgttataaattaattgtctggttgtatttataagattaatgattgtttatatagataagaaggctttttttttttttttaaggaagattggtaattttgagttgtaggagtaaggaatgagtattgggcctagtgtgtatatttgtctatttattggaaaatacgttttggattgtatttattttttatttactgtgatttggttttttatatttaatataatattttaataagactactataaggatagtataggttgtgtataatagtatatatttaatagtattaaagtgagttgtagattggaaaatgtgataatgacttaataaagttagaatatcaatttgtacattttaagatgaattgtgtgtttttgtatttacatgtattagagtttttttatggaaagtaattttgtactatgcaagagacataggggaccctgtgctctattttgttttgttgttaaagtatcttttggagagctgtatgttgtcacagagtcaggagctttgtgaagttactttgttggcaagcagaaatgagtaaacatagcttttcatgtttgttattttgtcttacacaaagatgccatctccttacctaacctaagatgtgactctaatagataaaatgataaggaacataaactaagacaagagatctcttgggatgtcttcagatcatgagggctaaacatgactcagaccggaaggttagtgtttaccaagacccttcttacagctggggaaaatgaaggcaaattaagtttagcctaagctaaaacaggagcaacttggttatggtaaaaagagatattgccctatgggaagggctactacaagaattctttccatacttaaacttcagtagcaatctgacaagtttttaagtggagtctgaatgtaaaacattcagagagaacccttggtcagtagcaggatagaggttgcaataaacacagagaactagtggcatttcaaggaacagtgaggagacaggtctggttgaagcagaagctcttttgtgagatcagtagaaaatacgcctggagaaaaagcctgtttaaaactaaacatcttttccaagggtaaaacataaaatccttgaaattaggctttctaatgggcaaagagatgtcttcaaccattttatgatgagaaatacattggttcatcctcagaggtctctgaacaaaaaggggaacacatgtgaaggtagtcatgagggagcctctgtgaatcataaggagaactgattgcaaaaccagaagccagcagaaacaaaacaattcataaaattacagaggcggtattcggaagttctaaatacttttttttccatctcagaaatgcttggtatcctaataatattttctttgtgatacgttttctatactcttagtaattttccctggtcttgatctcatcattaaagaggatgaaaccaacaccaggaaatgtccataagcaggaaaccacatttttattccatcactcataaagcatcattcataataatcagtgtcagtttagctatagcaacagatgctaacatacacatagtaagagcctacaaaggctcttttaaatgtcagtttaatttaaaccttaacctcagattttttccacagatacagtgagaaaccacaaagatcctcctgtcctaatgctccctccatactctgcaataaaagttcttgttttggaaatagagaaacctgtctgaatcagcagtcttggcttgctgtgtcctccatgaccacaccacatgttccatacctttagccttcataggggctggaaaaaactctgtctcccttgtctacccattttcactgtggagttcggctgcacatttcaggtggaaaggaggtagtgtactaaaattgcaaagtatttcttttaattggcaatgaatttaaacaatattcattgattcttccactatgaacaagctagtgttccctgggggataaacagatgaataattggataagcctttactactcaggaagtgtatagtctagaggagtgcagtccaataggaatagaatataaaccacagacacaatgtaaatgttctaatggacacattaagtgaagtaaaaagaaacatgaaattaatttcaaacatatactttatttaactcaatgtacccccaacattatcattctaaattgtacttaatataaaattattaatgaaatattttatattctctttttttttccatactgtgtttaaaatctggtatgtattttacatctaaagtacatctcgattcagactagccacaattcaggtgctcaatagtcacatgtagctggtggctaccacatcagaccctataggtctcatatgtagcagagaaaaagacatacagaggctgaggcgagcggatcacttgagcacaggagttcaagaccagcctgggcgacacagtgagacctctgtctctacaaaaaataaaaaagtagctatgtggcctggtgcagtggttcatgcttgtaatcccagcactttgggaggctgaggcgggtggatcacatgagatcaagagttcaagaccagccttaccaacatggtgaaaccccatctctactaaaaaaatacaaaaattagctgggcgtggtggcaggcacttgtaatcccactactcaggaggctgaggcaggaggattgtttgaacccgtgagggggaggttacagtgagccgagaccacgccattgcactccagcctgggcaacaagagcaaagctccttctcaaaaaaaaaaaaaaaaaaaaaaaattagctatgcatgttggcatacatctgtagtcctagctactcaggaggctgaggtgggaggattgtttgagcgcaggagttcgaggctgcactgagctatgatcttgccactacactccagcctgagtgacacagcaagaccctgcctctaaaaaaaaaagaaaagaaaagaaaagaaaagaaaaagacttgttggagcctactcccactctgtggagtgtacttttgtttcaataaatctgtgattttctgtcaaaaaaaaaaaacaaagacaaatgacagcaatacaagctccatttggtttgggatgaggaggacattttccatggaagagatggcacttgaaattaatgttccaaataatggttgtgagttgagcaagcagagacagaaaaaatgaagagtgtagttcacagtgaaggacccgtagaagcaataacttaggggaggaaaatggcagggcgctgcagctctgttcaatacatggagcttctcattgtgcctcagataatgacagaacttcttaaggaggcctgcgaagtcctagctagtttattttctactttgctgttcaaacatattccctattttcaggctctctgcttgagccacagaagtctctgggccacctcctataaactactcatgtcttcccacccagggctttacatgtgcagggccctgcctggaacttatctggtttggcccatcattgtttctagcacctagcagagggctcagcacatattcagtcctcaaaaaatatattgaagtgaatggatgagtgatttgagaggcaggtagggaagaagatgatgagaaggcaggaaaggttgcttgagggcttgttgctgagggccttgggtgccacattaagggtttgcaatgaattcagtgagcaaaccaggtccatgcctctaatctacatcttaataggacttgcatattagatactgagctgcagctcagccacgtgtgggatgatttggagtgaaaggtaggcagtgaagcgccctgttaggagccctctgaaggagtccagaggagaatcaatcaggcctccttactgtagcagagcggtggatgtaggcattagttacacacttaaaataaaaattacaggaggctgttgaactaagctcctgcactaggccccaacagaccggactaaaaatcaaaatggagtcacctatgctacagttccacatcagcaaacccaaactaagttgttatctgaccttacgagaaatccaaagagagataacagccaatatcccacacagcccagtttcagtcttcagttggcatgataataaagccttctttgctttgatccttatgcaagaaaagtggcctaaagacacctaatgttaatcagttgtttttctattgttctgtctccctgttctgcctcacaaggaaagtagccttaaaatgacgaataactctttgttctttgtttctttcttcaggcctcctctgtctatataaagctaatcccctttgcttagctgattggaacacttattctattttatgggatgaactgttgcctgattctaaaattgcaataaagccaactgaaatctttaaactacatttgtggccaggcacgatgggtcacgcctgtaatccaacaactttgggaggccaagacaggcagatcacttgaggtcaggagttcgagaccagcctgaccaacatggtgaaactccgtctctactaaaaatacacatacaaaaaatagccaggcatggtggcacgtgcttttaatcccagctattcaggaggctgagggacaagccttgaacccaggaggcggaggttacagtgaactgagatcacaccgttgcactccaacctgggtgacagagcaagactctctctcaaaaaaaaaaaaaacactagattttttgaaattttgttttttgacacatattatggcaagacaacaaatcattttgtagaaattgtacactcttagaggtgaagcaaacttttgccattttatagacaaagaaagtgagactcgttttacagatgaggaaagtgacacccagagaagttcctttagtgaaacctcaaagacttcattactctgcacaaatggaatttgttttgaaatgaagcccagggggccgggcgcggtggctcatgcctgtaatcccaaaactctgggaggccgaggcgggtggatcacctgaagtcaggagttcaagaccagcctggccaacatggtgaaaccccgtctctgctaaaaatacaaaaactagctgggggtggtggctggcgcctgtaatcccagctactcgggaggctgacgcaggagaatagcttgaacccaggaggcagaggctgcagtgagccgagattgcgccactgcactccagcctgggtgacaaagtgagactgtctcaaaaaaaaagaaaatgaagcccaggaataggttatatgttctaggagaaggaattattttacaaacattagattaagtagatacagaaaagtgagagaaaaagatgaaaaggatccaaaatgcatttgaataggaaagaaatggctgtaaaaagcttttggcagtagacatgactgaccttaaaacacttaagctagtcacttactctatcaagaattctgacttgaacagtcacttaaatatttccgtcttttaaagaaggttggaagtactactgatacatcttcccaatgatcaaaatgtcagagttctcacttgacagaataaaaaaagacaaaagagggaaattaaatgacagcaccatgggcacggaaggtgattccctaaatcgtatatcatcttcataattggataactctcttgtttccagactgtgctttcagataaactccctgttttcatctgtgtgccataaaagacacgaagagggagagaatatttttaagttctgaagaattaagctcctgcaatctgtactttaggatctagataatgtaaaatggctcataatttgccagtttctaataagctgtacaaatctcactattacattgaaaacaatttgtatatttcaaaaaatgtcttaaatagttacaacttaccaagataacattgcaaaggagtattagccttaatatttcaagaggctttgctggtcaatgtccccaaatggtaaaaacttaaggttagaggcaaatgagagagttagatcagtgtttatttatttgccaaactactattaaaaagaaaaacaagcaaaaacacctaggctgtatgattgacattcatacagccttgattagatagaagtttcactttacaaacaggttttgacattgtgtagataaaactttgatatcaaacctttaaacctcaagatttgataatatttactttaataagaacttctatcttctacttaaatgtcaaaaagaacagaaatcagaccacttactaaaaggaagcagacttggaatccacattggttatctttcgtgagttaggaaaaagttaatagtataaggccaaactcaaggaagcctgaatattaagatgatttatggagacactgaagacataaatcagatataattatctgatttacaaaaactagtcatttcacctcctcaaatggcctcataattccttgatgacgcatggcagaaaagtgctcatgtcaaactaaaatgcagacaaatggaaagataaatggccacatcccagtaacaatttgacatcccattattcctcttgaggatttcacctgtgtacatccagaaggtgctaggtgaatgaaaggcattcggtttttaggattttagcaacacacatgagaaaaggttcacttttgcgcccactgacaatcagatgaagattcaggtcatgttgcaagtttttctgaacatgtggctgtgcagatagctcaggtcctgagcaaaaacaacagcaaagaaccctttggcagtgaagcctatcttggcctctgatcccttggtccttcctactcaccttcctgtctttatttttcttcagcacgtttcccatctaatatactgtgctgtattttttttcattgtgatgaaatatacatcacataaaatttaccactttagccatttttaagtgtgcagtttggtcacattagtacaatgacgttgttgagcaaccatcaccgctatccagtctccaaaactgttttcatcttcccaaactgaagctccatacccatgaaatagtaattcctcatcccccttcttccctagtccctggcaaggaccattctactttctgtctataaatgggactactctaagtacctcatgtaaattgaattatacagcatttgtccttttgtgaccaagtattttacttataaatttgtgtttattttatttcatttttgaaatggaggctcactttgttacccaggctggagtgcaatggcattatctcggctcactgcaaccctcgcctccagggttcaagtgattctcctggctcagcctcctgagtagctgggattacagatgtgcaccacccccccaaccagctaatttttgtatttttagtagagacggggtttcaccatgttgaccaggctggtctcgaactcctgatcctccccccttggcctcccaaagtgctgggaatacaggcgtgagctaccacgcccagccagtgaatctttattaatgtgttagataacaaagtctagaggaaagctaataattactgtaaatttctcagtaatgatgagcataaacgatatggtgccttgaacaactgtcatatgacatgaaaatatctatgatttttattagtgacaaaattgcaggtcctggtaaaacgattgtggtttttggctacatttataattggagagactagatttcagctagagatgagtgaaaatgaatatgtaattttttttttcatccaagttctgaatttcctccattgacattctcctgccccccaagggatgtctggatgctgggttaagagcccttggctgggtagctggatagtgcagttggggaagagtaagctattctgcatggttggagaatggagtccaatggatgaggaaggagaagcaggagaaagaagaagagacgagggggcagagagctgagccagggccccatctcagctatataaatataagggtaaggaattagggctctgttttgagagtcacaataaaccactgacatattttaagcacagggatatcaaggtcccacttgtattttagaaagcccttctaggaccaggtgtggtggctcaaacctgtaatcccagcactttgggacgccaaggcaggtggataacctgaggtcaggagttcgagacaagcctggccatcatggcgaaaccttgtctctactaaaaatacaaaaattagctgggcatggtggtgcgtgcctgtaatcccagctactgggggactgaggcaggaggatcgcttgaacctgggacccggaggttgcagtgagctgagatcgtgccactgcactctagcctagacaacagagtgagactccatctcagaaaaaaaaaaaaaaagccctatagatggcaacctggaggattctatggggaatagttgcaggaggccaggagcaggacagtagcaagaggccattaaaaagatggtagcagttctccaggtaaggttcaaggtggcctgagcttgggaaatggcaatgcagacagtcagtaaggacatgggagtgggaacccatggcaatttagaaggtagaattaaaagtggattctcttttactcctaggatgaagaatctgaatgtaagcatgagaacaaagaagttcacttcaattttctcaagttcctgctgtaacagatggtcagcatagaatgctcagcgaaaaaccacagtagttgccagagaagtcatgtgatgtaatgggaagagaatctcaaatgtcatcagtcgacgtgagtcttcttatctgtgtgaccatggggaagttacttatgcttcctcatgaccagtatcctcactggcaaagcaaggctaaggacaccagcattcctgagttgtgagtcacaagggagagatgatcattggacattttgtaaatttttcattttgtttatcatattattgtttttataggcgagatattgctgtgttggccgggctggagtgcagtggggcaattttagctcactgcagcatccaacttctggttcaagcaatcctctcacttcagccttccaagtagttaggactacaggcatatgctgctgtgctcagctaactttttcattttttgtagagacaggatctcactttggaaggcagctatgctcaccactacactgccaacaccaggatctcactttgttgcccaagctggtcttgaactcccggactcaagcaaccctcttgcctcagcctcctaaagtgctgagattacaggcgtgaaccacaccatgcctggcccattttgtcaattaagtgttttggaaatgctacttgttcattataatcaatcagtaaaggataattattgtagaaattagtatttactaagagttgaaaaagcattcagctcttttttttttggcagagctagctgaggttttattttggaccaaaaaaaaaaaaaaaaaaaaaacagttgaattgttttgtagctggaggcatgggcaagggggggtccccaagcagtaaacttccccgcacgtgggctgagggctaggactgagcctcaggtgggtctcctgttccctgtcctaccctgcacaggggcctccctcctgggctctggggcagccgcaagaggggcaggctgggaggggctgccatggctgttcactcgggcaggacatcagaggacttggacaccagcttcccattgcgggtctcgatcttcttcacaaccacagccctggtggagctgatgtggctgaaggagctagagttcaggccgtagctgaggctgggacttgtgaggcccccataggctgagcacagaccacctgcatagccgctggtggtcttcgtatggatactcacattctgtatcccagactccagccggcatttctagccctccagcagcttcctgtaggttgcgatctcaatgtccagggccagcttgacgttcatcagctcctggtacacacgcagctatcgcgccatgtcctgctaggcccgctgcagggcggcctccagctcagacagcttggcgttggcatccttaacagccagctccccatgctgctcggcatctgcgatggcagtctccagggaagccctctggcctttgagaccctcagtctcagcctggagccagctgatgttccggttcatcttggagatctctgtcttgtttttgagacagagtctcactctgtcgcccaggctggagtgcagtggcacgatctcggctcactgcaagctccgcctcccaggttcaagggattctcctgcctcagtctcctgagtagctgcaattacaggcgtgcaccaccaccccaggctaatttttgtatttttagtagagacagggtttcaccctgttggtcaggctggtcttgaacttctgacctcgtgatcagcctgcctcggcctcccaaagtgctgggattacaggcgtgagccactgcgcccggcctagatctcagtctttgtatgctgcaggtcatccccgtgcttcccagccagcatctgcagctcctcatatttgatctggtacatgctctcagcctcactccggctgcggttggtgatctcctcgtactgcgccttgacctcagtgatgatgccgtccatgtccggggagcggctgttgtccatggacagcatcacagacgtatccgagatctgggactgcagctcccgatctcttcatacagctgcctcaggaagttgatctcgtcagtcagcccttccaggtgagactccagctctaccttgttcatgtaagcttcatccacatccttcttgatgaggacagattcattctccatctctgtaagcttattgatctcatcctcaccagcccctgcatgttgccaagctctgcctccagcttcagcttctcctggccccgagtctccagctgccgcctaaggttgttgaagtagctctcgaacatgttgtccatgttgctccaagctgtcttctgctgctgcaggaggctccacttggtctctagcatcttgttctgctgctccaggaaccgtaccttgcctatgaaggaggcaaacttgttgctgagggtcttgatcttccccttcttttgggtgcgcaggcctggatgttgggatccacctccagattaagtgggctcagcaggctctggttgactgtgacggcagtgatgcctcccatgccgctggccccaccatagcctccacccaggctaccctggaagctgctgctgcccactcaggaggagcttgaggagctgatgcaggtactgggcccactcgtgtaggagcggctgctgaaggcccgggggccagagatggacaacttgtaggacttctgggtcaccctgatggacatggtggaggcaggagtggaggcaggcgggctgaaccaggcagagattccagaaggagtgaagaagctgcttcttgatagcattcagctcttatttatttatttatttatttatttatttatttgagatggagtctctctccgtcgcccaggctggagtgcagtggctcaatctcggctcactgcaacctctacctccttggttcatgtgattctcctgcctcagcctcctgagtagctgggattacaggcatgcactaccatgcccagctaatttttgtatttttagtagagcaggggtttcaccatgctggccagaatggtctcaatctcctgacctcgtgatccacctgcctcgacctgccaaagtgctgggattacaggtgtgagccacagcacccagctctcagctcttaatttaattgcatttaaagaaagcaatctgtgcaattcacagtagctggcagccaggataacccagggaaacctcatccttacaaaaaaattacaaaaaaaaaaaaaaaagccaggcatggcagctcatgcctatagttccagctactctggaggctgaggtgcaaggatcgcttgagccagtgaggtcgaggatgcagtgagctgtgattgtgccactgccttctagtctcggcagcagagctagaccttatctcaaacaaaacaaacaaaacaaaaaaaataatagctgagtaagtgtcatagatcacatggaacaaaagctggctctggaaacatatgcagaatttagctaagtgtggagtaagggtgaaattgtgagcaaaacaagcttcctgagagatcagaggtggggagttatgccaagaagtgaagggagtgaggtaaggtatgctgatgtgtgcagaacagggaggactttgaaaactatgcagagtggttggctgacatacagtaaaactcataacaagtatgctcattagcataattattaaactctggcttagtaaaccacttaaaaaaaaagatttccaatgtggaaatactcaatgtttggatatgcctgttcattctagtttaggcatttccttctgacaggtttttagagcctctggtagcttttccaatccctgtgactttttttttttttttgccctgagtttggaggagtcggataatgaaatttaaactaaagcatgttagcatcacctatactcaagaaggtccaaatacctcaattcttcacaaaataaaatgcttttttaattcaaaaaaagaaagtaagtcaaaaagagagagagaaaaaaaacacacagcagataactgagaaaataagagagtttattgccactaaaaaaggaacctggcttctaacatcatatttgccatttctctatgtgactctagggaagtacttttctctctcaatgccttcttccctcaggaaaaccttattactatgagaaagatgttaatttgtctaaagtgctgtaattttttcatggggatgttaaggagggaaaggcagggagaaagaagatggggagagatgagttaagagatgagttaaggtgaaagatggtggtggcaggcggggcgcaatggctcacgcctgtaatcccagcactttgggaggccgagacgggcagatcacgaggtcagaagattaagaccatcctggctaacatggtgaaaccccaactctactaaaaattcaaaaaaattagccaggcgtgtggcgggcgcctgtagtcctagctactcgggaggctgtggcaggagaatggcatgaacccgggaggcggaggttgcagtgagccgagatcgcgccactgcactccagcctgggcaacagcgcaagactctgtctcaaaaaaaaaaaaaaaaagaaagaaagatggtggtggcttgcaccaagggataggccctggagataaagagaaaggagttaaaaataaatgtttggtttttttttttttttttggagatggagtctcgctctgttgcccaggctggagtgcaatggcatgatctcggctcactacaacctccacctcctgggttcaagcaattctcctgcctcagcctcccgagtagctgggattacaggcatgcgccaccacacccggctaatttttgtatttttagtagagaggggggtttcaccatcttggctaggctggtcttgaactcctgacctcgggtgatctacccgcctcggcctcccaaagtggtaggattacaggcgtgagccaccgcgcctggccaagaaatgtattttggaagtaaacacagtagaatatgctgatgaattgcactgacgttgggagaaaagaaagagaaataatttctagatttctcactctcacaaatgagttatgtagtagtatcatttactgaaatagagaaaaataggaagaaaaatcaagagttgggttttgaacaggactagctcaagatgtgtgtgagacatttcaatgggaatgtttagtaaacaattgggaacagaggtctggcattcaggcaactaagtttctgaataacagattacatttaaagcacaggaatgaatgaacctgtgtgtggaggaggagggagagtggatgggaaagtgagaaagatggagaactacagtaagagggaaagggcaaaaagatgttcagaggctggtgagccaaggactgagtttgagccatccccacattattggtaagacagagcaggaaggcctgaaaggaaactaagaaatcacccacaagtaggaggagaggctggagtgctgggccacagaagccacaactgagtattccaaggaggagcggtccacaggaaggaccaccttttcttctcttctcttttctcttttcttctcttctcttctcttctcttctcttctcttctcttctcttctcttctcttcccttctcttctcttttctttttgagacagggtcttactctgttgtccaggctggagtgtagtggtgtgatcatggctcactgcaacctcaaccttctgggctcaagcgatcttcccacctcagcctcccgagtaactgggaatacaggcatgtgccaccagcctggctattttttttattattatttcctggagacctgagggtcttgctgtgttgcccaggctggtcttgaactcctgggctcaagcaatcctcccatctttacctcccaaagcactgggattattggcatgagccaccactgctctggtaaactgaaagggaaagttaagatatggatggataagtgtcaagaaggcaaaagaaatacgaaacaaaagagcttgatagtaaagaaaacagaaggatggaatgccctccaagtttttgaggccttaatgagaaatattttagtgaatggggaataataaagagattctaaagatcattcagagtgttgatgagttacatggattatgattttgaatttcaaatggactttaagtctttatgtaagacagattagaaaacaaaatttcacattaaattgattaaattaggtcaaaactcatcaataactaattatacattggacataagtatttccatatctttttgtccctcagtgccttgtgcatatgtaactaaaaaagcagagtaatttggtgtcatttgatttaatgagatcctgcgcaaatgaaatacctttttaacactgaagttagaccattgcagtgctccagggacaactatctatagaagataaattaattatgttcactacttcctaagcctatagaaacaactaaataactaaatgagagaatcaacctgttgatgatgtgcaggtcttttgagaaatgacctttaatcaataaaatcccagagcacagaggtttcatagcagcttgtcttcagaccgactcatcagtaaaatcacaacttacaccacaacaaaacgttcagaaaagtaagctatagaggtaggtcataattttgaggtctgtcttgataatatctaacatattttgagtgcttagtgcgtaccaggcattggggctaaatactttacatgcgttaggtcatttaatcctcataacagttctttgaggtattattgttattattattattattttattattttgagacagagtctcactctgtcgcccaggctggagtgtagtggggtgatcttggctcactgcaacctccacctcccgggttcaagcaattctcctgcctcagcctccccactagctgagactacaggtgtgcgctatcatgcctggctaatttttatgtttttagtcgagaaagggtttcaccatgttgaccaggctgatctcgaaattctaacctcaagtgatccacccacttcagcctcccaaagtgtcaggattacaggcatgagccaccgtgcccagcctgaggtattattattaaatccattttacagataagccttagaaagttaaggcttagaggccaggcacagtggctcacgcctataatcccagcactttgggaggctgaggtgggcggatcacgaggtcaggagatcgagtccatcctggctaacacggtgacacccatctctactaaaaataccgaaaattagcggggcgtggtggcaggcgcctgtaatcccagctactcaggaggctgaggcaggagaatggcgtgaacctgggaggcggagcttgcagtgagccaagatggcgccactgcactccagcctgggtgacagagcaagactctgtctcaaaaagaaaaaagaaaaaaaaagatagttaaggcttagaatattaaatgccttgcccgatgttaccatgctcggaaacaatttagttaagaggccaacactgtttgtctgatctcgtattaggagtccttaatgttcttctcctgtaaatgttcagatttaaaaaaaagatcatagataaattcagtacagttggatacagtttgaaaaattattttatattttagtgaaatagaaagttttagccaggtgtagtagtgctgggtgcctgttgtcctagctactcgagaggctgaggtgggaccatgacttgagccaaggaggttgaggctgcagtgagctatgatccagccactggactccagcctgagcgacacagcacgattctgtctccaagaaaaaaaaaaagaaaagaaaagaaaagaaagaaactttgacacagtttctctttgccactcttcatattgagaggtgaagtttattttccttccccttgaatctgggctggcccaatgacgttttgttttgttttgtttttgattaataaaatgcagcagaagtcacactatatgacacccaggactcggccttatgagatcgtcagcttccacaggctctcttgaagcactccctgttagaagccggcagccatctaagtctatcttaagaacatgttactgtgaggatgcccaagctatgtggagagagaaagaggccaatagagatgcactgacaccaaacaagaagctttctcggactttctggctcagctcaaccaccagctgaatgcagccaaggaaagactcagccaacgtcacagggagcagaaccctccaaatgagtgacactgaattcctaatccacagaatcatgagtaaataaatgacagtagcttttgctcatcaaattctgggtagtttgctttgcaataatagtaacataaatttagtagagttggacacaatttgaaagaaatacaggctgggtgcggatgctcacgcctgcaatcccagcactttgggaggctgaggtgggaggatcactcgaggtcaggagtttgagaccagcaaggccaacaaggtgaaaccacgtctctactaaagatataaaagttagccgggtgtggtggcagactgaggcaggagaattgcttgaatctgggaggcggaggttgcagtgagtggagattgcaccactgcattccagcctgggcaatagggaggatcacttgagtcttgaagttcaaggttaaagtgagcaatcatcgcaccactactctccagtctgggggacagagcaagatcctgtctcagagagagagagagagaaagagaaagaaaaggaaagaacaaagagaaaaaaaaacaaggcagtttacaatgaaaaacacataagaggagagtgaaaataaaaacacaagattaaaaccaagttcagtgactaagaagttatttctaaagatttgtccaatttgttcactgaaatttatatttaaatttacctttgagtttcctggcaactgaggcaaacctaagagattatatcatgctaaatgtgatttccttcagaaaagaaaaatctttaacctactactaaattattaagagcactttactacatggatccctttacagggaacagtgaatgatagagaagacaatgacttcagaagagatgatatttaaccaggcacggttgctcacacctgcaatcccaaaacactttgggaggccaagacgggtggctcacctgaggtcaggagtttgagaccagcctggtcaacatggtgaaacccccatctccactaaaaatacaaaaattagctgggcatggtggctggtgcttgtaggcccacctactctggaggctgaggcacaagaatcacttgaaccccagaggcggaggttgcagtgaaccaaaatcgcgcccactgcactccagccagcctgggcaacagagtgatacttcatctcaaaaaaaaaaaaaaaaaaaaaaagggaaagaaaacccggtttctactaaaaatacaaaaattagcccagcgtggtggtgtgtgtttatagtcccagctacttgggtggctgaggcaaaagaatcacttgaacccaggaagcagagattgcagtgagccatgatcgcaccactgcacccaagtctgggtgacagagcgagaccctgtctcaaaaaaaaaaaaaaaatgttatttacaatacagatgtgtctcagatgatggaatttaaaaaaatttattcaatgtattttgctgttttttcagagatggggttttgttctgttgcccaggctagagtacagtggtgtgactatggctcactgcagcctccacctcctggactcaagtgatcctcccacctcagcctcccaaagtgctggaattacagggatgagccatcatgtctagcacatgatggaactttaacataaaccaaacagaataaaatgcaaagaactttcaatttctatatgagttttcagattaactcccctctttctcctccatagaccttaggcatttcaccatcttttggctttctgtttcaacatatacttattgataaccccccaggggccaggtcctgagggtttaattgtatgtaaaagagaaggaaggtccttgtcctcatagagctcatagtccaggaggacattaattaatgctgaaggcattcattaaaaagctttaccaatatgcaattgcaaactgacaggtgccataaaaaatagcacaaggccgggcgcggtggctcaaagtgcctgtaatctcagcactttgggaggccgaggtgggtggatcacctgaggtcaagagttcgagacctgcctggccaacatggtgaaaccccatctctactaaaaatacaaaaattagctgggcatgatggtgcatgcctgtaatgccagctactcaggaggctgaggcagaagaattgcttgaacccgggaggcggaggttgcagtgagccaagatcgcaacactgcactccagcctgagcaacagagtgagactccgtttcaaaaaaaaagaaaaaacacacaaggagctataatgagcatgttatggagggacacaatccaagtttctggggaagggagttggggagtgaaggaagcttgtgatttcttttttcctttagagacagggtctcactctatctcccaggctggagtacagtggtggcatcatggcttactgcaacctccaccttctgggttcaagtgatcctggcacctcagcctcctgagtagctgggactacaggcactcaccaccacacctggctaattttttaatttttttgtagagatggggttttgccatgttccccagctggtctcgaatccgctcgcctcagcctcccaaagtgctgggattacagatgttagccactgagctcgacctggaagcttatgatttcttattttctctttcccaccttaaaacctgacacatcaaagtgctcaattcatgttggctgttgatgatgagaatacaaagaaataaaagggggggggggcggaatttcaacactaattctgaaataaattctgaatctgttatttcaaaggatattaactttagaaatgaagacacattagaaatttgcattgctctgagttttgtaaaagaatgaaatgtataatgcaagacataactgccaaggtactagatgaaaaaaaaattatacattctgaaattccatctgatagagatcagttctgaagggttaatctcaattgcctgatttaatgtgtttgctttgcaccagatgaataataattagcaatggcttcaccaacttattagtgacaacgtagagaaggtgtgggcccttttacgtaaaagctgactaatagacaaataaattagatatgactgttttgccaaagctgataactaaggccctgtatacaatgagtgccaagtcctggttgtttctacgtaacatttaatctttgaaggcaagtggttgaaggagaaagcaattatattgacgttcgttgtagaaattcatttacagattgttactacaattgtccctcagtctctgcgggggattgattccaggacccctgcagatcctaaaatccatagatgctcaaccccctgatataaaatggcatcgcatttgcatatagccaatgcataccctccctaacatttaaaatgatctctagattgcttataatagcaaatacaacataaatgctatgtaaatagttgttatactgtattgcttagggaagaatgacaagaagaaaggtatgtacgtgttcagtacagatgaaaccatcctctttttttcccaaatatttgacctgcagttggttgaatccacagatgtggaacccgtgaatacctggaagcagttaaaatcactccaagattttctttaaattcttctcttcatcaatactctctctattccaccaagtaatgatatcataattacacatggtagctcttccccaagacccttgattaaattgtttttattgattcatcaagcatatattattgagcgtctactacacaccaggcacacagacagaactgtgaacaaggcagacaaggtcctgcacccagcacgtgtatattctaggtttcagagaagctatgtgaggctgtgaagaggattcttttttaatgtctttatttttatactacccctccacagccttaccccaatcttttaaaccacaccggaagctatgtactcatcgtttttttcctgtaattttttttacagtacaacctaaataaatactggcccagaaagattcagagttcaaagaaaattcagctgctttcggaaagatcattctatgggaaagatcacatttctgagtaataaacattataaatacatattccgatttatttttaattctcaaactattaactttcatttttcccctctggcatattttaatttttgtcctacagggacttgagtctaaatatgttttaacaatttgggggacttttcttttttcaccttgctatttctagagactaaaatctttgagctaccaaggtctttcaaactggctgatgtcactctaacaaactcagagatagcaagatgttccttaagccactgggttagaacgagaatcctttgttttctatgggcacaatcctaggaatgtttcttctcttttttttgagacagagtctctctctgtcacccagcctggcgtgaagtggtgccctctcagctcactgcaacctccaccccccgggttcaagtgatcctcctgcctcagcctcctgagtagctgggattacaggtgcacgccaccacaccctgctaatttttgtatttttagtagagacaagatttcaccgtgttggccaggctggtctcaaactcctgacctcaggtgatccacccgcctcagccttccaaagtgctaggattacaggcgtttgctaccgtgcccggcaagcctaggaatatttcacttcatgcttttctcttttgccttgctgtgagcttatcctccagagacaacagagagagagaaagagagagagacaggagagagaaagtggaagaaccacatgaccagtcatttcccgaagcaaatggcgttttgggtgaatgccctgacctaggagggaaaaagaggccaaggttaccctaatgttacagaagtagctaagtgaattcttctccgaaaaacgtcacagcaggctctagaaagcaattagagtaatattttggcacctcgaactaccaaatagaagattcctctactgctctagttacatctttgattttcatttccctttgttgtaaatacttacaatgtcatttcagaatgctgcagagaaatagatgtgagagtaaacaaactataataataatcctttctccacatgccatggcagctgcaggaggaggccaacgcagcaccgaacttgccttactgtctgcttttcctgtcctcctcctcctgcacctccttcacctcctccacctccttctcctccactttcccacatggtcttttataaatttgccagcatcactgtgcagtttgccagagaaacctggccacttgctgggtaagcctgctcttagaccaaggaccagggtaggtcactgctgctgtcctcatttctgggccagaaggattcactgagagtgaggtccagaaccacctgctttcccattacagaggatgtggatctctatagagacactgcgtatcccttcagttaaagctcttcgaagactctttttaccctgcgagctgaactttcttgagccccatagaatggataaaaatcttcatccccaggttggtgaggagccaatgatttcacgctcaaacaagctgacaagctaggaatcctagctttccttagcaggcaggaaacagcatcccactcataagtcaggagtcttttctgccaatgttaggaatgttgatatttacctttatttttggacttatttctaaaaaaaattaactagtatgtaaaaaaaaatcacactttaaaaatatgcttctacaatatttgctctagcgaactatctttagcttgacctaaattactaattaaacttttctattgatccaattcccattactgttcctgcctttatgctttcatattcggaaatctccaacatgcattttgatggctccaccccccacgttcctcactcctgccccctcattttggttttgctttaccttgttaagcacttacagatcataaaatatgggtgagctcagaatatctcttactccagtgttacatatggcacccgcatttcagcaccagccctttaaaaaatggtgcagaatttcaaggaactcagctacactttccattcaaaatccctcccaagcactgtagctaagagcctatctcaggattttcttgagagctgctggggaggcaaaatatctatctaacgaaaatggctcatcatccacattctgcagtactgagactaattccccagcactgccaaacctagactgctgaactccctcatccaaactctctaagacttagtggtcaaagtgccaaaggcatccgtcttactcacactctgtggctcctaagaccatgctgaaaagtgaggataagtaataattgaaagacatttttaggattctagttgggaggatacataatgcagatactatatagtttttgtttgtttgtttgttttttgagatgctgtctcactgtgttatccagcctggagtacaatggcgtgatcttggctcactgccacctccgcctcccaggttcaagtgactctcctgcctaggcctcctgagaagctgggattacaggtgcccaccaccactcccagctaatttttgtatttttagtagagacgggatttcaccatgttggccaggctggcctcaaactcctgacctcaggtgatctgcctgccttggcctcccaaaatgctgggattaaaggtgtgagccactgtgcccagcctactatatattactgaagttagtaattcatattaatgcaaaataaaaggagattagtgaatcactgctacgtctgtcttgtttggcctgacaagaaaagtatcatagaagagaaggtgtgttatgggcattggatcagcaaataagctgaggtcaagcttccctaagtacccaccagctctgaaggggaagtgacagcttgtctttgagccagatttaggttacatttcagtcttaatttatatctaatccatatctaaacatagagagaaataaaatgcattagatttctgagccaccaaagcctgtttaaaggaagacggaggaggaaggagaagagggcaatgacttaggggcaagtaatagaaggatttgttcttttattttatgcattcttttattcaacaaatatgttttgacaagtaggggatacagtgaacaaggtaactggttttctgtccttaaagaccttccagccagttgtggtggctcatgcttgtaatcccagcactttgggaggccaaggcttgtggatcacctgaggtcaggagttggaaaccagcctggccaacatggtgaaaccctgtctctactaaaaaaaaaaatacaaaaaaattagctgtgcatggtggtgcacacctgtaatccctgctactcaggaggctgaggcaggagaattgcttgaacctaggagccagaggttgcagtgagatgagatggtgccactgcactccagcctgggtgacagagtgagactgtatgaaaaaacaacaaaacaaaaaaccttcctgccctgtgggagctacagaggaataagcagtactaatgtaacaatgcagtgtcactgggaccatgtgctgtgttgtgggcgcaggctcaagaggaactcaaacagcttagattttagccattccgaagaaagcacagtagcagccactggagtctccgccgtgttccgggaagcatgatcaaacatatcttgaaaaaatctaaagcagacttcagatttgttagaaagcattcctaccgctctcagtagtgacttggagaatctacctcttcatagctaaggctataacaacatcaacaacaacaacaacaaaacacctctttgggttgtcttcacaagtagtttccaattcagtagagccaatcctgcaacagtattggcatcatcgcagtgcactccagtgacgcaaatggaaagactgctgctggtaaacgaactacctgaatttgaattctggctatacctcttcctaggtctacgatttttaacaaatcagttaacctctgaccctcagtttccttggctataaaatgggcataatgaaggattgtgagagttacctgagtaaagtgctttgaacggtgctgctcaataatgttatccctctgagaagacatcgaaagtttcccataagaaaagggcctttgttattccaatttggatactttaagcaggcaaaatagaacagtaaaaggaaaacaaatgtaaagggatgctgtttatgaaatagttgtgaagaataagcacttcagaggagcttaatttaacttctcagctctgctagagtaaacattgtaaccagactaaaaacctttcctttgttcctgcagttattagagaaaggaggaggccagagaagtcatatcatttcacttctctgaacttcaccctggattatttaatgttgacaggcattcgggatgtatagagattaaggacacagactctggagcctggtgctgggatccaaaccctgatcctgtcactaactagctatgtgacttggggcaagttcttcaacttctgtacacctcagtttcttcatctatgaaatcacaataataaaagtacctatctcaggtatttttatatatgataatttttttttttccttgagatggagtctcactctgtcatcccagctggagtgcagtggcgagacctcagctcactacaacctccgcctccctggttcaagcgattctcctgcttcagcctcctgagtagctgggattatgggcgcctgccatcacacctggttcatttttgtatttttagtagagacagggtttcaccacgttggccaggttggtctcgaactcctgactttaagtgatctgcctgcctaaccctcccaaagttctggcattacaggcgtgagccaacgcgcccagcctgtgtatgatgatttaaatgtgtaatgtacttaaagctcttagaaccatgcccagcaatattaatgccatttaagtcatagttattagaaaagctactgttattaaagaataatgcaaggaattgttcaaatgcatataatcataaaatagagagtcaaggctgggcacagtgggtggctcacacctgaaatgtcaacactttgggacgctcccttgagcccagaaactcgagaccagccagggcaacatagtgagaccttgtctctgcaaacaaccaaccaaccaaacaaacaaacaaaaataacaacaacaaaaatacagagtcaaaatggaacggtcttgtcaaagttggtagtcactatgccgttagtttcatgaagataaaacatggttattttgttcctactctatttgttgaaaaatgaatgaatgaggcatgaaagacttgactagtttgatgttgagaacttagcaaaaaggaaagcacacgagatctggaagtgaaaacccaaaacatgagtcctggcttaacctcattctaatttgacaggtgatttaccacaggtactcagtttcctcatctttgaaagagggaagtcagagggagaatttctgaggttcattccacatccaaaattctgcagcgttagatagcctttcgaattttacaaaaggtaatgtaatcatggctatggaagtttttttcacataccttgtgtatttccaaaaaggattatcgagttggagacaatgtcatttgtttgcgttttctaaatcattatgtaagaatctgagccacaaacagaacaaatctttaaatccatgaaaatggattacctttagctggactgacaacttttaaaactcttggattgggagaataaaactgataaggacatttttccattcatcttaaatgaatttttggagactcttaagagtaaaatataatccatatacatctaatgctaatttatcatgaacacttaaagaatgaaagtagaactcttatccagtttagttcagcaattctctgctaaatgaaattaagctgctttagttgagcttttaaaatatgaggatgagaagcataaatccaaaggattttgtagaactagcatccggactgtctttcttcagattatgttcctagaatctgggttccccagggcagcctctcattactgtcagtattaaggactagaaaggagctggaagaggcttggccgcttttataggtttttggtagtggcataaagatttcacttggttgggggaggggggtagggggacagaagagtctgttgtggaaactaaaagaaaagaaggggagagtggtctgaaatcaaaaagtctggattacgtatacaagctttgagttgaacaaggtttaaattttagctctgctactttttagttatgtgaccttgggcgaatggtttaatctctctaagtcacactttgcacatttaataatgtttcttaccttatagggttactgtgaatattaaatgagctaatacatgtaaagcattcctacccagaacatagtcagctctaataaatagtgactgacagacagctacaagggcagataacctatattctccttcagtttcttatgctccctctggaatgtctcagaagcataggaagcactgtttaagcctcctgcaatcaaaaatcattctttttaattagccctaatagaccctatggtttttttttttttttttccaaaatctattcatagtttaatgtgggctatggacaaaggttcactttgtaagactgtctagctaggttaaaaataaaatatgcagaaatgtgtggaacttcaacaatagaatataagaaaatgaattattctgaactgcaaacaaaggcattgtagtatatgaatgtgtatgtgaagtaaaagtttggaaagtataaacatcagtatggtaacagttactacatctgggaaagggagaaagattggagaggaggtgggatataccttattattgttttaatgttttatagatgtatttacatattgtttaactaaaaacaaacaaacaaaaaaagcaaagtcatgtacaagcagaaataaacatttagaatacagaatttgtggaataaaccaaagtagacaaaaatcaaagaatttatccctggggcattcaatgacttgatacaaggtcaccttctacttagttaactgtccttgaggagtaaggagagcgcaggggcaggagagatgtctgatcctgtctccagcaactgatagacccaggttagaagttagatgaagctgcctgccagttatcttggtagaaacttctttctgcatgtactcagataagacatcagtaccctgggtggttctctgcaaaattcaaggtctgcagagtcaccaactgaagtctattggtaaacttgcttttaagcaaaacaaaaccaaatggcaaattagtatttctattagtacattttgataacaaagaaaataaaagacaatttaaaatttatgtaacttaaatctacattgcttaagaacatctgactgaggagttttagaatatccccaataccatgaaataaatacagtaattaaaaggcaatagagtttaaatactggataatgggctatggcatttttaaaattagcaaaacatttgtttattattgaaaattagggctgggcctggtggtggacatctgtaatcccagcaatttgggaggctgaggcaggaggaccacttgagcccaaaaggtcaagaccaccctgggcaatatagcaagaccccgtctctaaaaaaaagaaaaagaaagaaagaaaattaattttcataaagggctcttcccttggaaagaaatattttagctacagagaaaaactaagaagccttgtggagctctgtgaagttgcactgacttgctttcacttagcttgcagctcactagtgagatttcacatggtactcccactccaagagcaggggccaggacaggttggtttcattttggtttgaatgcatatgctttggcccacagacttggagaaagattttgctttactgatgagaactcagtcaagggtgcttgggagccttcgctggccctctagctgggcctgacatgttgcctgcatttctagccttgccttcccagcttgcccatttggtgcagggagatagtccagcccaccctgaaattcactgtgttctgcggatgagttaactgaagggctgtgtttcaggagtggcacagaaaggacctgaatgaaaggaaggaggaatgaatggagagaaccattttggtggaattgccctagggtattaaataggatggggcaactggggactggaggatgttccttctcttacgttgcttaggaaacactgtccttaagagtgtcagtgtcattcctttaacaatcattcatttcttacctcccgcttgtgtataaatttgcagatttacacagaccaccagtgtggccatcccagtgaactgagtttattgtgaaatatacatgcaaaaaaatccttttttctcacctacaaccaatgcaacattattcatactttgagttgaagaataaggagtttaagaaataaatgcatacagcaacataaccctgaattatcactcaaatacagacctcccactgctctctcccaaaaaaaaaaaaaaaaaaaaaaaaaaaaaggcagttattctaagcaaaagcaaaaattgaggcaacttaaaatagacaattttaaatgctggattccatcatttctgtaaaaggtcattctactcctttgctatttataccacagatagagacacagcaaattattggctgaatggatttgggaaaccagaagctgctgcttctgacgaacgaagatgataatgcatcacttgagactgagtggatgaaaggtgtagaaaagttgaacccttcaaagatgagaggaagctgctaaattagcccctgactaaattactagccataattgtactcaagccagttctctttgcgactgccttgtaatctttgttgtggcttgagagagaaaaatccccattcccagctcaaacccgtttaaggcatctcagcccaaccccctcctcccaatgcaactcttcatagccccctgcccctcctccaacaaattctaatcaagtcaggtatagttctcagctttaccactgccatcagaagcacggcttacattaagggtttagcaacaaaacctcaggcttacttcaggcaaacattcaaaagcatttaagagaagcacagaaaacaaaagaaataagcaaaacctgtccttacccgcttcttaaaaaattggaaggctgagcatttcttgactgggaatccattcatgtctttgtttaccattttccaccgtggggaattcacagttatagatccaggttggcacccgcctggttagtgcatatctgtttccccggtttacctcctgcagacagttaatgaagactgagcgggatggagaatctagcggggctcagttcttcactcgcgcattctgcagcaccagctactgcagcaacctctccccactttcagttgccaccgacagcggcttttctccttccatcattgctccgaaacatatgcatcaccgctgcaggaccctgggggccggacggtgggatacggccaatctccggggagatgctgtggctcttaccgagcgggagaagggtacgcctccccgcccccagctacctggctgctcttccgcggccggcgcggggagcgagtcgctcttctccaggtgatgcgctcctggaggcggcttgagagaggagagttgtttttgattgtgcaagttccagtgggagctgtagttaagcagctgagagaaggagtaagaaagagcagaagccagagggagggagggagaacagcgccagaaaggcagagggagcgagaaggcgaggctggaagaagcaacggttcatgaatatct

SEQ ID NO: 1191 - DNA, 8459 bp, Homo sapiens
atgaagggacaccgatttattgagtagcagagctgagggaaggcgtaggatggctccagcttccggtcagtggctacatggtcagttcctgcagaaagagatggtcatgttgggggaagcaccccgcagtggagccaacatcaggacctctcgaggcccttggggacagctcaggggtagggaaaggggccagtgctcactcaccatgatggcgttgacgatgtcactgtggttgtctctcagagcccgcacggccttggccctggacacattggcctgcgccatcaccagctcaatgtcacgcagttccagccccgcctcgtccacctggagttgggggagcagggaagtggctggagctgcttgaggtccctggggcagagcccccatgtagcgcctcccaccaccccctgcgaggccctggagcccctgcacttcacctcttcctcctcctcctcttcctcttccttgcactccagcctcacccggggcctgggtgctgactcagggaccaaggctgagggctctgagggcaccttaaacttctcagctgcggctttgtgcacttgctgggacaggtcctcaatctgcaaaatggaagacagctgtgtcagtagagcctgtcccccccttgtcccctatccctcggatcccccattccaccacagccgccacccagaccttggcctcgccaaagaccacataagtgtctgaggctgggctcttgaagacatcaggcttggcgatgacaaagaggatgttcttggacttctggatggtgatcctggtgactccctgaatctgccgcaagcccagctttgacattgcctgggagtagagggcagaggggggctcagacctggtgttgacccacgtcgggggaggagagcagcacagtgcccaggaaggcaaagtctccaccgccaacttccccaagaccttgggctggtggttggtccttccccatgagcctcagtctataagggccttctcatgacattccagcctcagctgtttaggggaaggtgtgtgggttactggcatggacccaaaggtcccctgatggatgggatttcattagccatggagtgtgagggtcttggtaaggacgttccccacacagatggtcccaggcctgaggtcccagagggagccaccagcccacctttcgggccttcttctcactgcgactctgcttggctttggcgatggtctcctcactgccgcctgctggggcctgagaaaaggtgagggctgagcatccatgggtggggtgtggggccctcccagaggcccaccctcttccctggactgggcacctgggctggacactgcacggtctgaggagccaagatgtcctgctcgtccagctcggctgatgactccccgtggctatccgaatgctggcccgagcccagggcccgaggcgagtctggggaaggggagaggtgtgaggatggccttttgcttctaggtggcggggaagggggttcaggaccctggccctgctgccacatcagggccagaggaagcagtgccagctctccatggtggctgtggggtctgggccccccacctcgccacctcagaggccctccagctcaggacagctctaaggaggagtccagttgacccaagccccagggcacttcactcccaccctctgccttaccttcctccaggctgtcctcatcctcttgctgctcgggggctgagagcccttgagggccagctgggctctggggcccagagggaggaggcacttggcaaggcggcaagatctgcaaggccaggtctttggcatccatggaggccaccttggggctgaggagtggggagtgaggcgagaggctgactcgcggcccagtccccagaggctgtgtggttcctgagacagcagcagcggcaggctggactcctgcctggggcggtgggaggcccagagagcctgggggctcctcgtcttccacagagtcttcctgggggtcctggcacaggcagggggctgggggctccagtgggggtagggctgccccagcaagggtaccaggagcagaagggtcagggcccaggggcctgtccacgggcgtgctgggctgacccttggcaaggttttctgggggctgcagcaagggggtgccaaggacactgggtacttcgtggggttgctcaacactgcccagacccagtacaggctccggctgctgggaggttggtgcagacgtgggggcaggcgcgtcagggcagcctctgtccagactggacacagcccctactgaagactctgggcaggagtccagactggcctctgtggccacagctgagggaagcgtgggctccggggtggacttgccactcaggcctctttcctccctggctgggctcaggagccgggcctggctgacctcagggcaggcagcaggaggcgcatcggggacctcccttgcacctccaagtgctgacctgggtccatgttcctgtgccagtggcttcaggcctccttcctgctggttctcaacctccagggtctccttttggggtgagtcaggcttagccccatcacctgtgtgcgctcgcgcttccagacatgcttcccgtccaggcctagaaagggcttctgctatttcctccccagcaccagaggccggctcagggagactgagggcctccatgcccaaagtggaatccgcatcttcctgtgcggcccaaggtgtcccagcttctgcagctggctgtgggtcatcctgttggacctggtccaaggctgcaggctccgggactgtagggagggctgcattcttctcctcaggtgctggcctggggcctaaggcctcacctacttcctgctgagccatggtggccacaggctctgtccctggggcacagcctgcttctgcctgcaaggtttgaggggtggccacagccagaggctctggacctgaggtggggcctgtgtcttgcagaggcagaggtgctgtcatagcggagtcctggggtaaggtgaggccctcttcagcctgctgggacacaggcgtggctgcagccacaggctttggggctgacgagagatctgtgtcttgtaggggcagaggcggtgtcatagcggagtcctggggtaaggtgaggccctcttcagcctgctgggacacaggcgtggctgcagccacaggctttggggctgacgagagatctgtgtcttgtaggggcagaggcggtgtcatagcggagtcctggggtaaggtgaggccctcttcagcctgctgggacacaatcgtggctgcagccacaggctttggggctgacgagagatctgtgtcttgtaggggcagaggcggtgtcatagcggagtcctggggtaaggtgaggccctcttcagcctgctgggacacaatcgtggctgcagccacaggctttggggctgacgagagatctgtgtcttgtaggggcagaggcggtgtcatagcggagtcctggggtaaggtgaggccctcttcagcctgctgggacacaagcgtggctgcagccacaggctttggggctgacgagagatctgtgtcttgtaggggcagaggcggtgtcatagcggagtcctggggtaaggtgaggccctcttcagcctgctgggacacaagcgtggctgcagccacaggctttggggctgacgagagatctgtgtcttgtaggggcagaggcggtgtcatagcggagtcctggggtaaggtgaggccctcttcagcctgctgggacacaagcgtggctgcagccacaggctttggggctgacgagagttctgtgtcttgtaggggcagaggcggtgtcataacggagtcctggggtaaggtgaggccctcttcagcctgctgggacacaatcgtggctgcagccacaggctttggggctgatgagagatctgtgtcttgtaggggcagaggcggtgtcatagcggagtcctggggtaaggtgaggtcctctttagcctgcctggggacaatcgtggctgcagctacaggctttctgccagaggggaggtccagccctccttcttccttcaagttctgaggagagtctggacacaatgtgaggcttgtttcttcctgtggagttggaagtttttctgcagtgacagactcttggcctaagatctcgctgatgccctcctgggagggctgaggcattgccatggcagcagattcttgtccagcggtggagtctgtttcttcctccccagcctgtggggtcactctggtagccacctccacctggaggcctggggctacctgcagagtgtgaggggtcacagtggcagtggactcctggcctaaagcaaggccctcttctgttacttctgagatcaattcctgtctctgggacagataggcccctctgtctgaggtctgaggagcagcctccacggcccaggacacagtcccatcctgagcctgcagccccttggccccacctccgctctcctcctctgtcttctggacactgtcctggagcaaagtggcctgggcatggggctccccgctgtacagcctctcatcatctgcctctgcgtaggaggctgagtctgaatcagaggaggctgcagaggtgtcgtcccggaaggcaaaagcctcgtccatgccctccgtgatggacaggtcagacagtgactgcaggaaggaggcagacgtgctgtcctcctcaccctccccagccaggtccccacctgggtcgggatccgccacagcctcctcttcttcttcctctggggatagcggtgtcacctccactgcctccacctgaaagatgaggctgccctggaagggtaggagggctgcggggatcattgggtcattggccaggaagtccaggtcgaagaagtggccctcctggccccaggaggagctgctgtctgcagagaggctggactcagaggacgggggctctggggtccctgctgggtgcagctctcgttcatccaccatggacccctgcggggacaggccccagcctgaggggaagtccagcccttcagccggagccagcaggctgagggaacaggagggtgaagaggcccagctgtccccatcggccgtaatgtaggagcccgagggtgaggcggggggcgagtccagcagctcatcccgcagctcagcctctgagtccctggcgtccccgtggggcccacaggcaggaagcagggcataggtggtcttggtgggggtggagggaggcgtgaagaaggaatcagggtctgggggaggggaaggcacagaaagatcaccctgagaacacagctcggggggtgggtctgggcttgcgtgcccaccctcctggtccctgagcgctgtccgggcagctctgggtgacaggagggcctggcacgtctcctctcccatcacaatccggggctccagggtggccgggagaggagcctccgtggacagagcctgggaagacaggccctcagggaggagcatggggcttgggccgccctcccctgggtccgcccaggccgagggtgccccaccaggccctgcatcccagctggctccctcgggctggggccgggcacccggcttgctgggcaggaacgtgagggccaggtggctgggccctggggtcagagcacagggctcccgccggtcccctcccaggatggtggtggcagcggccgcatcgcaggacagatctgtggagatagagaagatcatgaggtgcccctggatgcatctcccaggcaagggccaggcccggggagatgaattccggctgcatagggcccagaggaaggtggatccaggaaggcaggagagaaaagagaagaccctctgcacgctgcgtttgagggagaacttccaggagttttgacagcagagagcagatgctagtggtttcctagagaggggttttgagggaagtgttgctgggagtcatgaacagacctgtctggcggcttttctcaaggacacctcagcaaagaactagcatttcagcctctctggggagactggattgcagtttccattccacagaatcagtgtggttcagctgggctcggtgggaggggctggtggtgggaatctgccaggcagtgccagtcccatcccatgacctcccaatagatgcgccacatgaggcaggtggcaccagcacgacgcgcgcagctcgaacactctgggcttcatgcctcgctctgcctcctctctctgctgtccttgctacctacacttgaggccaacatgtcagggtttcaccaggcccctctgaccctgctcccctcctgcacccagggagatggggaagccaggggccaccacacgcagccaagtttctggagaacagagatgaagtgtcccgtggaggctttgctggagcatctggccacaagggcagtggtgggcaggaacggagaccatggagcccagcaagagcacaggacagcttcagagggccaacagcagcctctggctgagtcctctccttggtggcagccaccccatgggtgaccaccagttccttcccgggtgctgggagttcccaccctgccctgtgggccttctctgggtcccatgatgcactcccccaacccgctgggcaggcttcagtatgaggaggctctggtactcagtaaacgtctgtgagctaacacacctccagctgagaaaggagtccataggaagtagccctcatgggtcagaaaggacttaggggactcaggaagatggaagaaaacccctccgaggttgcggcacaccagaccgctatggttttctgcctcctggactcttactggcctgtattttatcacaggcgagatcacattgcacattcagttttgaatctagctattttcacccaacctaatctcataagcattttcctgtgtgctctaaatgctcataagcttcattttaaatgtctccattatgtccactccctcacttggacctaggccaaaggcacctctgtttgaagcatccaatgaaggcccttcagagcccaggccaggtcttgcccaaggtgggggagcggcggcacacaggggccagctctccaggctgcagatgcctgcctggtggctcctgctctcccgcactcactggtgaccaggacaacatctcttgcacctcagctttctcatctacaaagcagagccaggattagagttgaagctgaaagaagggggaccctgttgccaggctgctccagctcccctcagcagcatcagagccctgagccctgaaccaccagccaaaacttgtcacccaagggctttgctgctggggtgatgggacatccagggggtcctgagacaagggggtcctttgggttcttgcatgcctgacacccaacatcaggagtgggcgtggctggtggggcatcactgggtgccctgaagctgggctcttggttctggcccctggtgtggcccccagggcaggggaacggctgagctgttgggatggagcagaaaccaaaggccaaaggtttttataactcattcaaggtcaccaagcaagccagaacagagccagcacaagaccctggggctgggaagtctgggcctgcactccctgcctcccacctagagcagaggcagcagcctgtgtcaccccaaaccaggccccaggccccagcagtggtcccatctctgggtgacttcttgcccacagcaaggtgcccttggccctacccacacatggctgacctccacgccaggactgtccaggctcggctctttctaggccccgtagaccccatcagcctccaccagcatttgttgacccagcctaaggacaggtggtctgcacacccagggccattgctaatcaggccacctcccccaaggccttccaccttccagacccaacttaggctttattccaccacctggccctccatccgggcttcctaggctctggccagtcctgctcctccctccagagccatgaccagtcgccggcccaggacagaccgggtgcaactgaggaccctcccggtggtcacctgatcgtactgggggtatcagccggacaccccgcctccagaacccgctgcctctgtccagagcggcccagccccagcaggctggcagctcggtgcaaacaacgggatgcagcgggcgggatgcgagccccacgatccctgggtcggaagccaagggcttaagcccccacgttctttctggctcgcggcgggcacttcgtgcgccccaccttccccgcagttctgagagaggcggtagcagggttcagatggagggaaggacagggcgcggaaaggggaggggactcgaggggggccagggggatgggggagaggggtgaaaggtgagcgatggaaagagaacccgggctggagaggggagaggctgaaggcagggaaagagtggccacggcctcacctgtgcggggcccgggtcggtccgcctcgggcagcagcagctcggcgcgggcagcctccccaggcat

SEQ ID NO: 1192 - DNA, 76726 bp, Homo sapiens
caggctgggaagtcggccgccgtaaagatggcggcaaattgaaaaagttggagctgctcccgcgcgcgctcccgcgcgcgctgagtgggcggagcgaacagggggctggacaggtgcgttctcgcggccgtgcagaagcgaagtaggggtaggagcgtttccggctctcctgaaggacgcggggcggggtgggggtggtgcaaggcaggcgcgttctcggccgtcctgaaggggcaggatcttcagcctgtgggcggtgctctcgccgtgagcggggccaacgggccgtgttctccctgaaggggcggggtctgatcgctgcgggtcggattcccttgggcctgaaagtgaggatgagcgacaaccgtgggcggggcctgcgctggggaaggtggggcctgggcggggcggagggggctcgggcccggaagtgcgggtgtggggcgcggccggggcggagacttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaaggtgagcgtgcgcgggggcgtcctactgctgtggtcggcgggcggctgggttgaggggccagggtggggtgggcgggtgttccttggggcccgggggggggggcagtgggccagctggcggggcggggcggggcagggcgagaccccggacaatggtcaggtgggctttcgcggccgggcgggcaggaagcgccgcgcctttcctctggcccgggcagcggctcgccccgacctcggccccagacggccttccctgcgcgtcgggacctggggctgcagaggaagtgggcccggcgaggggccagaaagctgtccagggctggaactggagctagtgggctgtgtggttaacgtggagacgtttgctgctcactggacttcgtttttggatatccagtaaaagcaagggtggccttcaccttatggccagctcactcgtccactatcactcagacctaaaaccattgattgattttagtgacgctagctacatttggcagtgggatttaggacatagttcatagtcaaaccccagtttatgtagttttacaaaatgtggctttaattacagtaaagggttatagtagtcgataaagaaacattttaagactggaaaaacgatgtggattgaactaccattaaagtggaaaatggattttaataaaatgtatctttttcaaataaatgctttataatcttcacgtcttggctatcattttctttttgatgtgtgtgtgcgcacttttatccacaagtttaaagcagacctcgataattcctaactatgattttactaccctgaactctgcagggaagtgtcctttaattgacagctactcaccaccttgtttgacagagtgccccatttaaaagtcctgtttgaaatagaatgtagccaggtggccttcagggagtcctgtggtgctggttctctactttctcaactcattgtttcatgttagcaccatgcatgtctaatttaggtgcagtataatttgcggttatctacaaagatgttttaagtctggaaaatagctcaagatagtgattcagcctgcaggtgttagattagagatgcgtgctgcgcacagaagagggaggagccaagcagtgtaaaaggagttagctggaaaggagaggtgctaacccggtggctgcttagtagggaccatcaggcccgagtgtggatgatgctgagctttgcggaaagtgagccatgtgctctgtggaatgccgggatccaagagcgcgctaaggactgatgacctcattgtgcaccgcttacaggagtacctggcccatctacctgtgtgtgataggcaaggatggaattgagtgatttttttttctagagctgtctatcagctttggtagaaacatgaaacacccagcaaatagggagagagagagagaagcagtaagactgtttttggggtacaagtgaaaaaacagtaaaattatcaagaattttccagttgggtaatgaaaaaatttaggcataaacaggttaattattaatttcattttctcactagaggagataatcagttgttatgtagttgcttaagccaggggttttgtgttttttctgtattctgccacttgtcttagcttgtttcctgtagacaagccagacaaggagctttggggcatggattcttctccaggtcatgacttaacactacctcgtgtactctgccagttgcaagctggcagaaccttcctgctcagctaccacattcaatgtgagatcacctccagtttaataacttcggtggttaaatcattctcattaaggtaaattgcattgctctaaacttatacacaaattcagacataagtagcagaagtgctgacaatagttttatgaaggtacagtttggacgcttaaattcttctaagttagcttcttcaaaaaatgcagaattaggctgggtatggtagctacgcctgtaatccagcactttgggaggccaaggctcgatcactttagctcaggagttcgagaccagcctgggcaacatggcaaaaccccatctatacaaaaaatacagaaattagccaggcgcggcagcgctcgcctatagtctcagctacttgggaggctgaggcaggaggatcacctgagctcaggtgggccttttttttttttttctttttaatctcagacacttgtcttggtgtctgccaagcagtgattcaggcttttttttacctcggcccattttcctcaggacacaggaatcagtgagttggcagagaacctatggaccaaagtgagtctcacggaaacttggccccagtgtatcactgccctttctcaagtcacctcagcacatgtggtgatgatgactgtacacctgggtttcctcaagtgggccatggttcgtttaacaaatgtctgttgagcccctcttgtgtcccatgaaactcactgggtgatggggatacaggaagagcttgtggcccccaggagctgatggggagatggatcactcatgggtccatctgaaggaatgagtgcattgacagaaaagtcctctggccactaaaggtgtggggcctggggagtagaagtgaccacttggggctgctcttctgtcctgatgtctacagagtgtctactttttagcctacaagttctgttttggggtttggagaataaggctcctacctacggtatggactcatgttctgtgcattgtggcactatgtaattcctttttttttgagatagagtttcgctcttgttgcccaggctggagtgcaatggcacgatctcagctcactgcaacctccgcctcccgggttcaggtgattctcttgcctcagcctcccgagtagctgggattacaggcgtgtgccatcatgcccagctaatttttgtatttttagtagagacggggtttctccatgttggtcaggctagtctcaaactccggatctcaggtgatccacccaccttggcctcccaaggtgctgggtggctgagccaccgcacctgacagtaattcctttttattagaaacttggatgcacttaagttgggttgtgtggatttttatactcagatcacagcccaaaaaagctgtcttgtcagggttgggtgtaggtaatcctaacactttgggaggccgaagcaggcggatcacttgacaccaggagtttgagaccagcctggccagcatggtgaaaccccgtctctactaaaaatacaaaattagctgggcgtggtggcatgtgcctataatcccagttaggaggctgaggcaggagaatctcttgaacccgggaggtggaggttgcagtgagctgagatcatgccactgtactccagcctgggcaacagggcaagactccatctccaaaaaaaaaaaaaaaccatcttgtggccttaaccttgtgggtctcagcttctctgctgcctctggtcttcggttgccccaccaggtggctatgatttcacactgatcaaagttaaatatttttacattcatctagtttatttgcattgtttaaggtagaaaaaggttataggttgagtgtagtggctacgcctgtaatcccagcactttgggagactgaggtgggaggatcacttgagcctaggagtttgagatcagcctggacaatgtagtgagaccctatctctacaaaaaataagaaaattagctgagcatggtggtgcatgcctgtagttccagctacttgggatgctgagaagggaagatcgcttgagccctggaggtcgaggctgcagtgagtgtgattgtgccaccacctgagtgacagcaagaccctgtctcaagaagaaaaagagaaaaaaaaggttataaagttccctagaaatgtaggactagatattaaataataaataaggaattattaattttgttgggtatgataattaagttctgatctgataggcatgtattctgagatatttgtaggtgaaataatatgatttctgggatttgctttactcaaaatagaagaaacaaaggggatagctgaatgctttggtaatggttatatattgttctgtctacttttatgtatttttgagaatttccataataaaaagtggaggggaaaagatcctctaggttacaggccctgaactatcagctgctgtagtcactgctggaccagtgtctgtgaggaactgaaagcttggattggaccagtaccttttaaaatttggtcactgcaggcaccaggaagccataccttctccatgctgacctgatgcagacataaatgtgtgtgtctgtataaccgaagtgaaagtttaaaggaaccacacttaaacgctctgattttttaattctatttttttttctttctattacaactggtggttggccaggtgcggtggctcacactggtaatcccagcactttgggaggctgaggtgggtggatcacctgtcaggagtctgagaccagccatggtgaaaccccatctctactaaaaatacaaaaattagctgagcgtggtggtggggcctgtaatcctagctacttgtgaggctgaggcaggagaattgcttgaactcgggagatggaggttgcagtgagctgagaatgtgccattgcgctccagcctgggcgacaagagtaagactccgtctcaaaaaaaaaaaaaaggctcatggtcatgacccactaaaccgattctataactgtcacaagccatacttgggttcagaaggtgaattggggctgctatattttgttttatttttcctcttgggtagctattgcagtgattcttggatggcaacttggtaactcagggtcaggaggctggagaaccaggcaggaggtgctcagcagagaacctaaggcagccagtaggtgaggccagaatgatcggcaacataaggctggttacttttctgtcttgaagagttaccatttacatagtatgtatttgttaattttcaacatattgtcagattctgtcataatttagattcagaaagcacatcagaaccttccagggctgctctgagcatcctttcagaggaagatagtgtaaagcaaaacgtttctcttagcaatattattgcagtgaagggcttccctgcagacgagaagggcgtctgcagtctgccccactggggcgcttactcttgatcttccagttttttcatttccgtcagcagtgccccctccttgttgtcactttgcagtgtaagtaaatggtcatgattaagtcctataaacctaactattgagcatttaaatcaccctctattgttggtttacgtggtggcgatacaagtttttagtgagataacttggtcatgccttgcctattatgtgcttagcccactgagaagagggttagggacattgcactttggaaagtaggtcacttacacctaaaattagagactaaaggcagacctaggatgtcagaagagacatggggcaggcagcagccacttccagccaggttgagaccgggactgtgtcctgcagttcagaagcagagatgaggtggagaggaccccccagtcctgggaagtccttgggctgggaagttgggtgttggttctgtatgcacttgaagccactggaggtgttccacatcatgcattcacttgtccattaaactattgtttattagcaccaatggtgtcagacacagatgctggagactgaaatgtgtacggtgagcctgtggctgcagagcaggaagtggagcccggggatggatggtgggagcaggctttggtaagagtgatcaggaacacctttatgaaaacttcaaaagcaaatgtaaagaaaaaaaatcatgtaacgaagtcccctgtgcccatgtgtgggcagtcagtttcatgtgcaccttctcctcattcctgcttcctgcctgtgtgggccgaatagtgtcccctcagagtcatgtgctgaagcccctacttccaggacctcaggatgtgactgtatttgaagatggagtctttttttttttatttgtttttattttagacggagtcttgttgctctgtcacccaggctggagtgcagtggtgcaatcttggctcgctgcaagctccgcctcccaggttcccgccattctcctgcctcggcctcctgagtagctaggactacaggtgcccgccaccacacctggctaatttttttgtatttttggtagagatggggtttcaccgtattagccaggatggtctcaatctcctgactccgtgatccacccacctcggcctcccaaagtgctgggattataggcttgagccaccatgcctggcctgaagatggagtctttaaggaggtgattgaggtaaaatgaggtaattgtgtgggccctaatccaatctgatggatgtccttataggaagttattaggacacagagaggaatgatcattggaggactcatggagaaggcagccatctgcaagccaaggagagacctcaggagaaaccaccctgctaaatttaccttgatcttggactttcagcatctagactctaagagaataagtttctattattgaagccactcaagtctataatacttagtcctggcagcccaagaaggctaatgcaccaggtgattttgaagcaaaccctagagttcagtttgtagatagaagtgcagtagtaactcatcaagacagaagagtaacaagccttatgttgctggtcattctggcctcatctgctggctgccttagggtctctggggtgagttctgaggaccaagtctacactgtcaacatggccacggacgagctgctcagagtgacaggacaaccctcactgtgctgtatgtaaaccataaatcacagcacactctttgtggttgggagaacatgtatggtgttttgggagctggcacagtcagggatgtcattcatttcatctgggacaggctttgtgctctgggatctgtggcgggagcagtgagcccagccatgtcctctgcatgcatcgctgtgtccttgtgaacagtggatctttgttagcgcgcttcgcactccttggcttttttatctttcaatcaagaacagcaactgctcttcaaatgattctacaggtatgagggagtttacatttggatttgtcaatggaaccattaggattttttgtttgtttgttttgtaaaaataagaacttttttccttagccttgtgtctgtgccaaaaatgtgacctttttttttctcccaagtgtgcccaaacagtaacaattttttgcttggattatgttaagaattagggcatttgaccataggcattagatgtatgtgcaatgaaagtgatcccctttaataagcataataggaacatggaatttgggcttttgtttgcagcttaggatgatggtgtgtcttgtaacccaaggaggtttttcacttttctgaaagtgagaagactggtcagcctaaacccgtggtgtcactgttcttaagggaaacctagttgaggagtgggagataaccatttcacatgttgtttttgtaccttggagaaaaaaaagagagaagcctttatttaaatctttatgtctattctatagtttaaaattccatacaggtttttttcaaaaaatcaaatttgcttcctgtgtgttgtcaccatgagctctctggtcaggtgtggaaactgaaatgtttcccttgttggtttatgtggtggggtacatttttttttttttttttttttgaggtggagtcttgctctgctgcccaggctggagtgcagttgcatgacctcagctcactgcaggctccgcctcctgggttcaagcaattctgcctcagcctcccaagtagctgggactataggtgcgtgttcccatgcccggctaatttttttatttttggtagagatggggtttccccatgttggcaagaatggtcttgatctcttgacctcatgatccacccgcctcgtcctcccgaagtcctgaccaatgtgtgcctctgtgtgccaccgtgcctggccaagggtacatgttctttttttttttttttttttttttttttgagacagttttgctcttgcccaggctggagtgcagtggcgcgatctcggctcaccacaacctctacctcccaggttcaagcgattctcctgcctcagccttcccaagtagctgggattacaggcatgcgccaccaagtccggctaattttgtatttttagtagagacggggtttctccatgtgggtcagactggtctcaaactcccaacctcaggtgatccacctacctcggcctcccaaagtactgggattacaggcgtgagccaccgcacccggccaagggtacatgttcttaatgagatgccttggtcaggtctaagtgtcagttatggtgcatgttgattttctgtcagatgtctgaaaatgccctagatatgattatgtctagctaatttattactgccattagatacatcacctttacatagcttttacttttcatgctactgggtatagacaataaccatagcccacctgcctgtgcacttctaatatcaggctgagttcaagttcctttctaaggctccccctctcacttagtattgtccgtctttcttgaaagaggtatgtgcagcctccgtgtttgctttttccagcacattcttccaccctcagcattttatgatgaaaatttttgggacaggcacggtgctcacgcctctaatcccagcactttagaaggccaaggcaggcagatcacctgagatcagaagttcaagaccagcctggccaacatggcgaaatgctatctctacaaaaatacaaaaataagcagggcatggtggtgtgtgcctgtaatcccagctactccagaggctgaggcaggagaatcgcttgaacccgggaggcagaggttgctgtgagccaagattgcgccattgcactccagcctgggcgacagagggagcctctgtctcaaaaaaaaaaaaaaaaaaaaaatttttgagtacaccaaagttgaaagaattttgcagtgaatacttgcacctagattctgccactaacgttggctatacttgttttttttttttttttttttgagacggagtctcactctgtcacctaggatggagtgcaatggcgtgatttcggctcattgcaacctccgcctcctttgttcaagcgattctcctgcctcagcctccccagcagctgggattacaggcatgtgccatcacgcctggctaagtttttgtatttagtagagatagggtttcaccatgttggtggggctggtctagaactcctgacctcagatgatccgcccacctcggcctcccaaagtgctgggattacactcatgagccaccctgcctggcctggctatacttgttttatcccatatctagcatttgtttatcactgtacctgcccatcaactcattttatttttctgatgcattcctcaataaattgcagacattgtttcactttgatctaaatacattagcatgcatgtcattaactagggttcaatatttgcttacagttttcttttgatgtaaaattatgtaacaatgaaatacacactttttttttttttttaaacagggtctcactctgtcacagaggctggagtgccgtggtgcaatcatggcacactgcagccttgacttcccagactcaagtgatcctcccgccccagtctcctcagtagctaggactaaatgggtttgtcaccatgcccagctaattttttttattttttgtagagacgaggtctcactgtgttgcccaggctggtcttgaattcctgggcttaagcaatccttctgtctcggcctgccaaagtgttggtattacaggcgtgagccactgctcctggccaaataatacacatcttcagtgaatattagctaaattttgacaaatgcatactcctacgtaactgaaacccctactaagaaataaaatattacctaccatcactgagaaaattcccttatgccccttagaaagtccttcccccaaggtagtactgttctgatttttttccaccataggttaattttgttcattctagaacttcatacagatggattcatacagtatacattgtgttgtgcagggatcactgtactcagcataatgtttttgagatttatccatatattgctgcatgtttcagttgctgagtaatattttgttgtatgtttatgctgtgatttgtttattcatttgttggagatttagtttctttctagtttgtgtatatatatatatatttttttgagatggagttttgctcttgtcgcacagactggaatgcaatggtgtgatctcagctcactgtaacctctgcctcctgggttcaagtgattctcctgcctcagcctcctgagtaggtgggattataggtgcccgccacgatgcctggctaatttttgtatttttagtagagatggggtttcaccatgttggccaggctggtctcgaacccctgacctcaggtgatacacttgccacggcctcccagtctactttgtattttgaaaaagctgctgtgaacatttgtgaatgagtcattatgtgaacatgttttcatttattttgggtaaatacctaataatggaattgctgaattttatgggaactatatgtttaactttataagacactgccaaactttctgctaaatttttgtctcctaattctttgtttttttctctttccagagacagggtctcattctgtaacccaggctggagtgtagtggtgcaatcagagctcagtataacctcaaactcctgcagttctcatgcctcaacctcccaagtagttaggacgataggtgtgtgccactatgcccagctaaattttttttttttttgagacggagtctcactcttgttgcccaggttggagtgcaatggtgcgatctcagctcactgcagcctctgcctcccaagttctagttattctcatgcctcagcctccctggtagctgggattacaggtgcccgccaccacacccggctaatttttgtatttttagtagagatggggtttcaccatgttggccgggctcctctcgaactcctgacctcaggtgatccagctgccttggcctcccaaagtgctgggattataggtgtgagccactgtacccagctgggctaatttttaaaaatttttatttttatgttttattttttaatggttgctttatttatttatttatttactgagatggagtctcactctgttgcccaggctggggtgcagtggcgtgatcttggctcactgcaacctctgcctcctggtttcaatcaattctcctacctcagcctcccaagtagctgagattactggtgcccaccactatgcctggctaatttttgtatttttagtagaggtgaggtttcaatatgttggccaggatgatctcaaattcttgatctcaagtgatctgcctgccttggcctctctaaaagtgctgagattataggtgtaagccatcgtgccctgccctggctaactttttaaaaagtttttgtagagtatcagtattttagtatgttgtccagggtggtcttggacacctggcctaaagccaccttggcctcccaaagtgctgggattacaggcatgagccactgcatccagctaatcctgtcagttattgagagagagggtgttaagttctctagttattattttggatttgtttttccctttagttagttttggcttcatgtattttgaagctctgttgttaagtacatacacatttaggatcataatatcttttttttttttttttttttgagatggtagtctttctctcttacccaggctgcagtgtagtgctacgatcttggctaactgcaacctccacctcctgggttcaagtgattctcctgtctcagccttctgagtagctggaattacaggcatgcaccaccatgcccaggtaatttttgtatttttagtagagacggggttttgccatgttagccagcctggtcttgaactcctgacctcaggtgatccacccgcctcggcctcccaaagtgctgggattacaggtgtgagccactgctcccagcccataatgtcttgttgaaatgaatctttttcattatgacatgaccatctttatttctagtaagacttcttgtcccaatctcttgtctgatattaatatagctacaccacattctttttttgccttagggactttagcaactgccgaagagtctcgctctgtcgccgaggctggagagcagtagtatgatcataactcactgcagccttgaactcctgggctcaagtgatcttctgcctcagcctcccaggtagctgggagtacaggtgtgcgccaccatgcctggctaatttttttttttttagagatggggtctcactatgttgcccaggtcgtctcaaactcctggcctcagtgatcctcttcagcctcccgagaagctggggttacggccttgagccagccacacctggctaccccactttcttatgctgcatgtttgcatggtgtgtgtctttcaacaagtctggagttttaaactgcatgctttataaagagcattttgttacagcttgcttttttatctagtctgatagtttctgccttttaattgtgaagtttacataattgatgtcattatgtttaagtctatcattttgatatttgttttctctttccctttgtgctttcttcctttgtttctcctttttgattatttttaactctgttctattgctactggcttttttgctgtaactcctctatatattgctatatatatccatgtcttgtcacagattaccatccattaatatcatttctttcttgtacactgtaagaacctatcagcagtatcattccatttgtactccctcctgttttttgcaaactttttggcatatattttctttctatacgtgttataaatcttacattagattttttttttgctttaaacaatcgacttttcacctttttatattgaaatgatttaattatatatacgtagtagacttaaagcacacagagtatatacagagtacacagagccctcatacgccttccacccagatccctcaagtgttaacatttctgaaccattaagaataagctgtagacataatgccccatgaccctttaacacttcaactgtaccttccttggtacaaggacactctaaccacaccattctgacatcattaaaatcaggaaattgacatccatttgatcttgctacgtaattcatgaccccacccagacttgctgattgttatgatactttctttatatagctctaggatccatagattttatagattcaggatcatgtgttgcatttggtttgcatgtctctttaggctctttgaacttgaaatggttcctagtcttttcttgtctctgatgattgatatttttgaagattacagatcagttagtaggatgtctctcagttgggtctgttttttcctcatgagtttatgtgtttttgataggactgccacacagatgatgtattcttctcattgcatcatatcagggaaaataatgtcgatttgtcccatgttggtgatgttaactgtggttacttggttaagatagtcttgccaagtttcttcattttaaagttcttatttattcttattttacttacaagactgtagttctctagtatccttatttattttgaagctcaaattgtcccaaactcagccagtgggaagcactttaagctggctctggtctcttatttgtatttttatttattttaattattattactttttttgagatggtgtcttactctgttgcccaggccggagtgcagtggcacaatcttggctcattgcaacctctgcctcccaggttcaagcgattcttctgcctcagcctcccgagcagctgggatttcaggtgcctgccacccatacccggctaatttttgtatttttagtagagacagggtttcaccattttggccaggctggtctcgaactcctgacctcgtgatccgcccacctcggcctcccaaagtgctgggattacaggcatgaaccaccgcgcccggcctattttaatttttaattgcagtaaaaaagcaaacgcataacaaaatttactatcttaaccttttaattttggccatgttgcccacgctagtcttgaactcctgggctcaagctgtcctcccacctctgcctcccaaagtgctggaattacagggctgagctacaactcctggccagtcttaacctttttttttttttttttgagatggagtcttgctttatcacccaggctggagtgcaatggcgccatcttggctcactccaacctccacctcctgggtttaagcgattctcctgcttcagcctccccagtagctgggatcacaggcgtgcaccaccaagcctgtctaatttttgaatttttattagagacggggtttcgtcatgttggccaggctgactgtgaactcctgacatcggctgatcggcccacctcagcctcccaaagtgctggaatttcaggcgtgagccaccatgcccggccagtcttaaccatttttaagtgtacagttcaatagcaccaagaatattcatgttgtgcatctggcatctttttgacaagcccttgtctttctttaaacactttcttacatttgctaaaacaagatgtttcagctaatcttgttctttcctgtcccagccctggaaccagacagtcgtccaaggagtcctccttgcttttagtggaaatggtatttggaaaccaaatagctctttttctggatctatttatgtattaaacattagagttcacactgatacctctaattccagtccatgacacagaatttattccagtcatacccctttccacatttataccttgcttttccaacagtgagaaatctggttcctgttttcttcagtgtatttgcttttttgctcagtctccccataggttaacactcctagctgtgctaggcaaactcagctgaagacatgctgctgttccctccccacagtttgctgttggggatgctgtcctaaagctgaactaagaaatattcccttccccttccccttcctggattcactggccaaaagcttgggtttgatgaaagggagggggaggtgaggatgaaaaaagggtaaaggtcagttacacagctcagccctgaccaacatgttcctgtgccttgctgaacacattggcttaagctgggccctgggtatctcagttttccccatgtcttgcatgttgaggcagagttggtcccagacatgccttctctaatcctatggcatgtgtgccagtccagaggtggcccaggacgtcctggttccttaagcgtggccctgatgaaggggaagggatagtgagaagacacaggataaaaagccagttagagagctcatctctggacatgcttcccgtcttgtccttgacatgcatgctgacccactgctgggccttgggcattctgcccttttcagcttgacagactgatgctgcccccacctccccatccgaaagccatgatttgacatttttaaaagaccgaagaaaagaaagaaaatttatcttttctgtttatccctccttttatcatttttagcacttttatttcctctggaaaatttccatctggaataatttacctttggccttgtcaacttaaaaattcaagaaatgtacatatttggaaaggatactttatttcttacaaagagttgcaacctgtaggctggccatcccacaggctgggaagcgtagcctttggcagagcctgaaaggtaggcacttcagaggaggaggggttggaacaggaatttgtgctgaatgggtttgtgctgaccaagtatatacatattcaacaggttataggaggagttatgaatattcatggagggggtcctgatgcatgtgtactgaacagacatgcaatttattttattttatttattttttttgagacagtttcactcttgttgcccaggctggagtgcaatggcgcgatcttggctcactgcaacctctgcctcccgggttcaagcgattctcctgtctcagcctcctgagtagctgggattactggcgcatgccaccaggcctggctaatttttgtatttttagtagagacggggtttcattatattggtcaggctggtcttgaactcctgacctcaggtgatccacccgcctcagcctcccaaagtgctggattacaggcatgagccactgtgcctggcccaaacatgcatcttttttttttgagatggagtcttgctctgttgcccaggctggagtgcagtggcgcgatcctggctcactgcaacctccgcctcccaggttcaagcgattctcctgcctcagcctcccaagtagctgggattacaggcgcctaccaccacgcctggctaatttttgtatttttggtagagacagggtttcaccatgttgaccaggctgatctctaactcctggcctcaagtgatctgactgtctcggccttccaaagtgctaggattacaggcgtgagccacctcgcttggctaattttttttgtatttttaggagcgacagggtttcaccatgttagccaggatggtctcgatctcctgacctcgtgatccacctgcctcggcctcccaaagtgctgagattacaggcgtgagccactgcatctggcccaaacattcatttttaaaagaacttttaggttcaggggtacatgtgcaggtttgttatataggtaaacatctgtcatggggatttggtgtatagattatttcatcacccaggtactaagcgtagtatctgacagttattttttccagacaggcatgttctttgcattccatgttcactttgaggtggagacaacattatattcaggccccatacctcaaaaggtgaagcaaggagacagggcactcaagtgcacagcctctataaactggctagaaccagtctgtggctggtggtcttcttgtcaggagagagttactgaagtcagtctcttatacagtcacagctatagttttggcttgtggaacaggaggtcagttggcatctggtggtgagttgcagttgttttcctattgcttatccaggacagtgcttgtttggctgctagagaaaaagaagaaccctgtggcagttagaacagagttgatcttgaagagtcagactgtgtggctgaatccttacctggcacggtcgtaggtcttgtttataatttggtgtctttttttccccatgatcttcatgaacgcatgtaatttggtattttattgccacagagtccattctgtcagttttgtggtctctattttaacattaatgctggtcagttgtgcctgaactacaaaagggagggaatataatgaggtgcgtcccaaggcatcttgtcatggctggaaccaaaacaggctttgttcagtcagttggagtgcttaggattttatttttagttcttagcctgaagaccttgcttagaatttttcatggtgtaggtctgacacattgtttcaccttttattatctgaaaataccttcatttcatcttcatttttgaaggatagttttacagcagcagtccccaacctttttgacaccagggaccggtttcgtggcagacagtttttccatagaccaaagtggggaaaaggttttgggatgaaacttccatatcagatcatcaggcattagattctctaaggagtgcgtaacctagatccctccaacacacagttcagggtttgtactcttatgagaatctaatgcagccactgatctcacaggaggcggggctcaggtggtaatgcttgctggccctccactcacctcctgctgtgtgcggcctggctcctaacaggccacggacccagaccagtctgtggcctgggggctggggacctctgttttacaggatatagaattctaggttgactgttttctttcagcattttttattatttatttatttatttattttgagatagagtctcgctttgtcacccaggctggagtgcagtggcgtgatcttgctcactgcaacctccacctcctgggttcaagtgattcttttgccttagcctcctgggtagctgtgattataggcacataccaccacgcccagctaatttttttttgtatttttagcagagatggggtttcaccatgttgatggggctggtcttcaactcctgacctccagtgatctgcctgcctgagcctcccaaggcgtgagccaccatgcccagcttcttttggcattttaaagatgaagactcattatcttctggcatccattttttctcttgagaagttacctgtcatttttgttgtactgaatgtcttttatttgacagttttaagaatttcttttttttttttttgagatggagtcttactctgtcgccaggctggagtgcagtagcgcaatctcagcttactgcaacctctgcctcccagattcaagtgattctcctgcatcagcctcccaagtagctgggattacaggcatgcaccaccatgccaggctaatttttgtatttttaatagaaatgtggttttgccatgttgaccaggctggtctcgaactcctgacctcagatgatctgcctgcctcggcctcccaaagtgttgggattataggcgtgagccactgcgcctggccttttttttttttttttttttttgagacagggtctcactctgttggccaggctggagtgctgtggcgtgatctcggctcactgcaaccttgcaacctccgcctcccgggttcaagtgattctcctgcctcagcctcctgagtagccgggactacaggcatgcaccactgtgcccggctaatgaaaaaagttttttaaatatagatggaatctcagtatgttgctcaggctggtcttgaactcctggcctcaagccatcctcctgcttccgcctcctgggattacaggaatgagccaccgcacctggctgggttttatactttggtttggtagatcagttttgatctttgtccttactcttagggtaaatttcttagtcctggaatgtatgttttactcctaagatgtggcctttgtggggtttcaaatggatagtctcaagtgtttaaggtactgattaagcccctttaacttggcaggacttggactccaaactcttatctaccctgcagctagggagagctaaaatctcagctttttttttgagacggatcttgctctgttacccaggttagagtgcaatggtgtgatcatagtttactgtgaccttaaacttctgggctcaagcaattctcctaccttagcctcccaagtaggtaggactacaggcatgcactatctggctaatttttatttttgtagaaatggggtctcactatgttgcccaggctggtttcaaactcctgaactcaagtgatcttcctgccttggccgcccaaagtgctgggattataggcatgagctcccgcacccagccatcagcttgctccttcaaccttcaagctatcgtgtcctttctgggcttgtgggagtctcacctccgcttacgcagttcagggttcagccaaagatttgaggggaccttatactcagactttgggttccttttttagtgggttcctcctttcctatatttccctctcaatttccagcttctttagcagtctcaaatcctcctttaacctgtcaggccaataaaattgcagcttttttttctctgctccactcctctgagactggggcatactctcaggagtaaagcaatataaaagtggatcttgcccagtgatgttcccttctttcaagggtcatataaattccaagcttcttttttatttcttgtttgtctccagtgtctttagaagattgtttttcacattttatctagagttcataatctcggtctgtgagaaagttattttgatacagtctacttctctcttaagggaataagaacttctttgggtttattttttcttgacagtgtgttttggagctctttcattatagatatatagtttctttattcttctttagggtggaatggcatttttatctgtgggctactgtatttaaacagcagccctcctatggacttttaggttgtcattttgcttaaaaaataatgaagcaattaattttctaacctgtcatgtatgtaatgcatctgtaggattaattcccgaaaatgcacttgctgggaaacataagtgcatttgtaattttagtagatgttaacaaattgttttgtatggtagaaccaaggtttattctttttttctttacccacctctcaagagaacagtttttattaggtgaaagtggtatttgctaaaaattttgagtattttccaaaatgaacttgttaagttttcttactaaaaaatacatttgtatctcagaagaaagtagcaaaatatattatatgaaaaaaatcacacccactagaaacaactgttattagtctttcacgttgctttcctgtttgtgtatgcttttctgtgttagcagtaataatacagtcttattaccttggtatttatttcaaacacttgcttagtgcccactgtgtaaagagctttctggggagctgtcactgcctgcctgaatctccctcactgtctgagggtggtcttagtgctcatgaggtcgagaatatcgagtgctgtgtcagaagggcagaggtcaggtggatttaaagctgttgcaccaaagccaggtgtggcgacatgcctgtagtcccagcctactcatgaggctgaggtgggaggatggcttgagcctaggagttagagaatgcagtgagccatgattgtgccactgcactgcagcctgggtaatagagcaagaccctgtctctaaaaaataaaaaaaataataaataggctggcacggtggctcacgcctgtaatctcagcactttgggaggccgaggcgggcggatcacctgaggtcaggagttcaagaccagcctggccaacatggtaaaacccccgactctactaaaaatacaaaaattagccaggcatggtgacacatgcctgtaatcccagctactcgggaggctgagacagggagaattgcttgaacccggaaggtagagttgcagtgagctgagatcgcgccactgcactccaatctgggcgacagagcgaggctctttctcaaaaaaaaaaaataaaataaaataaataataaataaataaaactatgcatcaagcaccatctccctgtcccctgggtatgcctttggaagtgcagtttgcagagtgagtgagatgaggcaggggagtaggaggaggagctgaggaggagaatggggcaggggaagatgagacagggaggaggaggaggggaggagaggggaagggatgagagagggaaggaaggtggagtcattgttcctgctgttgccttgcgtggctgtgacagctgttgaagctgtcttctcacagttttgcacactgtgggttatgattcattagtggcatgtgaaatcaaccatgtaggtagcaacctttttttcatgtaagaatttaaaggatacaagtataaagttaaagaacttaaggaaaaattttgctagattcattttgaattagagctgtcacgtatttcttagctatctgcatggaaaacacctagaagcaatgacagtccaatagcagtggagcacacctaggactttattgtagtctgaattgtatgtcaagtagtgtggttacagtaagtgaggggatgtagctttttgccacaaaatctgtactttggaaggtgaatgtgaagcaatgagaacaaatggagattattaatctgtgctgtggttggcgttcagaattaggccacattttagtatgtttcatgtggggatcattatttttttttggaccagctttttttttttttttttttttttttttttgagatggagtcttgctctgttgcccaggctagagtggagtgcagtggtgcgatctcggttcactgcaaactccgcctcccgggttcacgccattctcctgtctcagcctcccgagtagctgggactacaggcgcccaccaccgtgcccggctaattttttgtatttttagtagagacggggtttcaccgtgttagccaggatggtctccatctcctgacctcgtcatccgcccgcctcggcctcccaaagtgctgggattacaggcatgagccaccgtgcctggccttttctttagagtttctgatgaattgcttttcttttttctttcaaaagaaacattaaattttaaaaaatttcagtagcttttggggtacaagtggtttttggttacatgggtgaattgtatagtgatgaagtctggcttttattttattttttgagacggagtctcattctgttggccaggctggagtgcagtggtgcgatctcggctcactgcaacctctgcctcccgacctcaagcgattctcctacctcagcctctcgagtagctgggattacaggtgcccaccaccacgcctggctaatttttatatttttagtagagacggggtttcaccatgttgaccaggttggtctcgaactcctgagctcaagtgatccaccagcctcggcctcccaaagtgctgggattacaggcatgagccacctcaccctgcaagtctgggcttttagtgtacccatcacccaaaaagcgtacattgtatccagtaggtaatttttcatctctcacctccctcccactttctccctttctaagtctccagtgtccattatatcactctgtgtgcctttgtgtagccatagtttagctcccacttataagtgagagaaccatgcccggcccagacttctttttttaaatgttctaataaaactttatttacggctgggtgcagtggctcacacctgtaatcccagcactttgggaggctgaggagggtggatcacctgaggtcaggagttcgagaccagcctggccaacatggcgaagccccatctctactaaaaatacaaaaattagccgggtgtggtgttgcgcgtctgtaatcccagttacttggaagcctgaggcgggagaatcgcttgaacttgggaggtggaggttgcagtgagctgagatcgtgccactggactccagcctggatgacagagtgagactccgtctcaaaaaacaaaactaacaaaaacaacaacaaaacacaagaaaaccccactttatttacaaaaacaggtggcttgcctgtgtggtagagtttactcagcctttttctagagaatgccttgttattgtgaatgagattcagttttattatggtaggcagtgagattactgggaaatctttttttttttttttttgtcgtgtgcatctttgtttagtcattattttgatagctctgtatcagttttttttttttttttttttttttttttttttttttttatgagacagagttttgctcttgttgcccaggctggagtgcaatggcacaatcttggctcactgcaacctctgcctcccaggttcaagtgatcctcctgcctcagtctccgtagtagctggggttacagacatgtgccaccacgccctgctaattttgtatttttagtagagttgggggtttctccatgctggtcaggctggtctcgaattcccgacatcaggtgatcctcctgccttggcctcccaaagtgctgggattacaggcatgagccaccgcacccggcctctgtatcagttttgaatttagttctgggtgttttccttacacctaaagtgtggactttttggatttctactgagtagccagttcagcaaagtctcttcagctgattataatgttcaggaaagactcttcagctgataataacttctggcatcaccattcagcagtcagtcaaacattaaatgattacctgtaggcattgtggagtttcatctctgcatgtccaggccagcccttagtcaaggcccaagaaacatgtttttatcgtcaagaacttctaggctcttagtttacataatggaatcttacagattttcctttgtttgcttgctgaacactgtcattgtcaccctgggatttcttttctctgcttcctgggttggttccactgtttcttggagtccacatctttttctctcttggatgatcctcgttttgctgggagtagatcctctagtatgtttttcaaaagggggtttttagagtgtaaagatcccaaggcactgcaggtgtgaaaataactattttgcaccttgattgacagtttggttttaaattaacttccagatttaaattaatttccacacagaattttaaagggattaccatattcccatttatcaggatacatctgatgctgatctgagtcttactgcttttacaggtacttttttttgcattttcttattggaaacctaagattctcttgaaattctgcagttttgtgaagatgagtctaaatgttgagggtttgtctcttacattcagcctacttgttactgtgctttttctgtccataaaattgagttcatcgttgttgtcttctgatatttgtgtccctctttgattctgcctgctcttattctcctcttaggaaactgttagactcgatggacccagcttctgtggcctttaatttttctcatgttaaactttttaccttttcactttatgttctaagacagggttggcaaacttcatgtaaaggaccagacagtaaatatttcaggctgtgtgggccagggggcaaaattgaggccattaagtaggtacttatataagagagaaagcaaattttcgtaaatttttttattgatgaaattcaaggtataataattgagtacaattttttgtaatatggttctactactgagaatggaattctttttgggggctaacattttgcttaatcagggttcaaagttggtgattccctttatcgaattggtggcaaatgttcatctgtaaaacatttgcagctgtggccatcagcagcaggcaggcattggccaaccccgcagttctccttcacatcattctttgggctctccgctatgtccttgttattattctacgaattttttattttggcagtcatatttgtaatttctaagatatatttcttgttctctgttctctctttttcttttttttttttttttgagatggagtttcactcttgttgcccaggctggagtgcaatggcgtgatctcacctcaccgcaacctccgcctcctgggttcaagtgattctcgtgcttcagcctcccgaatagctgggattaacaggcatgcgccatcacgcccagctaattttgtgtttttggtagagacggggtttctccatattggtcagtctggtctcaaacttctaacctcaggtgatctgcccacctcagccttccaaaacgctgggattacaggcgggagccactgcacccggccgttttctctttttcatagctatctagtcttattttatggatgcagttcttctcaagtgtctctaagtatactagctagaatgtaggttcctgtgcctgtctcttcccatttgttctttggcttttctctctcatgctgaccgtggggatcactgtgtttgtgagggaaggttggggttgactagtgttcagagcatgtgggttttctttttagtcatgtctatttccctggaatccttcccctccctgcagtagccaaaatagaggtgaggctgctcagctgagtggcacctctttctgtatctccctcctggtttgcctttttccctttgagcctacctgaaggtcagggtcagctggttctgccctgtataggcaacttttaggaaggagcaatctgaaattgtgactctactctggtttttaaagacagaaagtgacagtccagttaataccggatattgactcaaatctagttctgatgctgcttttccaactttatgacagtttctacatctgtggtatatggaataataattgaagcactaaattttattctgaagcaatcagtctttttggaatcaggaaatattaaactttatttgttacaggttaatgaaatagaattgtatgaaagtaccatttttatagccaaaacactgttgaaaatcagcactttgatttggttcaacctaatatttaaaaaattatattgtaattgttatgtttatttattgatctgtgaatatagtcactctaaccagatttttttttttttttttttttttgagatggagtctcactctgttacccaggctggagtgcaatggtgctatcttttcttactggaacctctgcctcccaggttcaagcgattctcctgcctcagcctcccaagtagctgggataacaggtgcccatcaccacgcccggctaatttttctactttcagtagagacggggtttcaccgtgttggccaggctggtgtcgaacttcttacctcaggtgatccacctgcctcagccttctaaagtgctgggattacagacatgagccaccgcacccagccaaccagaatatttaattaagtagccctccctatttgcaagccattctggaattatcagagttctaagagccttcaccagcaacagatccaacttctgcttttctagattaggaaatttgccttgaagaagtgagcttggccagaggcacgctgtttaatttcaaagtgctgctgactcaaactcatgagtcctggaggcaggtagaggcacttgtaggctgaggacccgtagagcccggtgtgccctgcccaagccccacctgggaatggagttatctctgtaaagatcttgctgcctttgagcaagcactgcaaatggggtaactggaacagccttgtcgcgtgtttccacccttcgtatgaggcaggtaccatgggtcttcaccaacagcacggcctgttgtctccaggaaatggtagcccctcacagtgctttctgtctgcttgtttagctttggcatttgaatgtgcagaatggtggactttgaaattaatgtccttctgttgactgcagaatttctgctggaaatgcagggaggctgcttgtggggttcgcgtgctgtgggaagtagggaaaatgagctggtttactttgtgtctttttgtgcatgcagactgtttggattttgccaacagtttctgggtgctgcctgctttttaaacttttaaaaaattgtaaacagcttcagtggctttgcagaaggaagctgtggtttctggtcttcctgttcagtcatgtttttttcagagggagggctaacatctggccatatttttcaacaaattcagaagtgagtagagaatgcatagtagctgtcggcagaggaggaaccagaatctctccaaagaaattcctcaaacagaatttcacacagggtattccatggagaatgaggtaggtgcaagtccagtgtggaaagcgccatttagaatgatgatggtgtgagtcccttgtgggtggctttcatggctgcttcccagggcttgcccattgtgagctagggtagcccagtctccatgacccctgctttgggaggatggggtgggtggagggttcatttgctggcttcctggtctgagaccctgtggcaaggggcgtgtatggagaagtgccgttccacccaggtggggagtataggttgttggattcatccatcttgactcaaggaagaagaagccacaggttttacatcttccacggagaagtaattttcctatggatttgtggtcgggacccaagagcctggttgaaaaatgatgtagggagatggccaagcaagagagcacccaaagctggaatttcatccacgaagcctgcaacactagtggggttctgcttgagactccaccagcatggatcctggccaccgccagtgtggcctcctgtgggcactaaggtgcctatgcctttctcactgaagcaaacaggcggtagtgggcagagctctggttccccttgaaattcgctctgtcagccgggtacagtggcttatgcctgtaatcctagcactttgggaggtggaggtgggtggatcaggaggtcaggagatcaagaccattctgactaacatggtgaaaccccgtctatactaaaaatacaaaaaaattgccgggtgtggcggcacgcacctgtaatcccagctatttgggaggctgaggcaggagaatcacttgaacccgggaggtggaggttgcagtcagccgagattgcgccactgcactccagcctgggtgacagagtgaaactccggctcaaaaaaaaagaaaagaaagaaattagccgtgtcctgagatgcgggtgcacaccggctgtgtcatacttatcatttagacctctccagcaccgaggaaaggtcctttttccattggtaggcaccaaagcacttaaaaaaaaaaaaagctaatctgtcaactgacactgcagggagtgctggaagtttgtggaaattcacataggcaggggtgcaatgtgggtgtccacagaggagttctttgtcatggagcttgtaggaggggatttgtcgtagtgcctcggatgtgcaccttaggcagtgtgatttatgaggatggcaggtgtctctctgggactatagcctatcactgtccagctggacagaatcatcgctccaggttccactgtcttctcagacccaggcactgagtttggtgcctcttccagtcattttccctcattcctgctgggccctcatgtggctgtgcagttgcggtttgtctgtctccctctttagactgggggttccctgggggcagggacggtggcttctacagccccagtgtctggcgcatagtgaatactcatgagatgtactgaatgttggccttaaggatacctaggcctttttataatactttaaacatctttgttcagaggcggttttgttttattagataaaacccaccttgtagtttattcataagggttaaataatttgcgcaaatgaaaatgcctgaaccctgtagcagagacatgctgggtactgctcagtgtgactaagtgttcttctctttcttccttcatagactttttagcactttctccagagtaatactgagctcaatgttttgcatggagaatgcagctagaaggtatagccatactatttactttggtccccaagtagaggccactgtttcatgagtctgcttttgctggttcttttagtggattcatttctccttgtaaattaataaacaggtgccctgacttataagttagtttctgagaatttgttgagcagatccagttactccagatcctgttcacccaagtgagctgataatgttgagcttcagatttaacaaaactcaagacccgcagttggcatctgagggccagccttgcccagagcctgagccttggctttgtgtgaggagggcattctcactaggtaagccctagtaggccagatttagttttagttttttaactcagaagtacattttaggtttccaactttaagagttgttttaagcttaagacgttaactttgtaagaatttgtaaggatctaggcatcttccagagtgagtttagaaagttctgtatagttatctgaggtggcatatattccatatggatgtctttgcacagcgctgcatggtgactcagagccctgtgttccctcctcctggctccgtactgtggactctggcaggtcccttcgaccctcacagcctcagtttcttcaggagagacttaggctgggatagactccacacctcactttggtgctgggactccactcatggaagagaaatagcacttagcctggtttccttctggggactgaattggtcctttggtctctgaggttcaaaggtgacaagatcatttagtggtgatgaacaggcatactcaatcaaatacatgttgaatgaagaatggttgcctgggctaatcccaccttttaaattctatgtgtccatctatagtacattctagtgagttaaagaacccatgatggtttactggaatcctgattctgtacattaaaaatatgctaaaccatttaattatttccctcgttccttccagacagggtctcactctgtttcctaggctgggtgcagtggtgtgatcacaactcactgcagcctcaacctcccaagctcaagtgatcctcccacctcagcctcctgagtgcctggaactacaggctaatttttaatattttttagagacaggtctcgctatgttgtccaggctggtcttgaactcctggcctcaagcgatcctcttgctttggcctcccaaagtgttggaattacaggtgtgagccactgtgcctgccctcaatttattttatttatttttttcttgagacggagtctcactctgtcacccaggctggagtgcagtggcgtgatcttggcttactgcaactgctacctcccaggttcaagcaattctcctgcctcagcctcccgagtagctgggactacaggtgtgcaccaccatgcccggctaatttttgtatttttagtagagacggggtttcaccatgttggccagggtggtcttgaacatctgacctcaggtgatccacctgccttagcctcccaaagtggtgtgattacaggcgtgagtcattgcacctggcctcgatttattttttaactagaactttcctttaaatttattttctttctttttttagatttaaagagaacagggccttgcccaggtgcagtggcttacacctgtaatcccagcactttgggaggccgaggtgggtagatcacttgaggtcaggagtttgagaccagcctggccaacatggtgaaaccccatctctataaaaatacaaaaattagccaggtgtggtggtgcacacctgtaatcccagatactcgggaggctgaggcaggagaatcgcttgagcccgggaggtggaggttgcagtgagccgagatcacaccactgtactccagcctgggctgtatagtgagactccaggtcaaaaaaaaaaaaaaaaaaaagagggccttgcttagtcacttaggctggagtgcagcgggcagtcatagcccactgcagctttgagctcctgggttcaagtgattctctccccccagtctttcaggtagctaggactacagacgtatgccaccacgctcagcttttttctttttaattaataattattatttgttttgagatggtcttgctctgtcacccaggctggagtgcagtggtgtgatcacagctcactgcagccttgacttcctaggctcaagtgatcctcccacttcagcctcccaagtagctgtgactacaggtgtgtgccaccatgtcctgctaatttttatgttctaatttttgtattttttttaaaagatgaggtctcaccctgttgcccaggctggtcttgaagtcctgactctagtgatcctcccatcttggcctcccaaagtgttgggattacaggtgtgagccactgcgcccagccatcagcttaaattttgtgttcaaaagcaacttcttttccaaaaatctgaggtggcttcttgttcagttttgtatctggaatagcagagagctcttccccagcaccggctgtccctcctaccaccccctgcagctgagagctgagcaaacattacctctgaaaagccccatcatcctcagcgagaacagcagctaccctgcattccgtgctgaatgggtaggagtggcagagggaggctgcagcagatgtgcaaagatgcatttctttacttaatagtgttaatattccactttctaggaaggcttacccatcaattaaaattatttgagacattaaaaaaagaaacttagggtagctgctattgaagactaaggactagggccagagagacgcctgcctccaagtagtccacagaatctgcttgttaaaatgttcgtgatttggaggcccaggtagaaggggcaggttcctctgaagcgccttggcatgccctatctttggcgttccggggtcgccctcctctgctagtctgtgagcagtcagaaggttgtatctcctgttcattcctctccttgtctcttgctgctcagaacagcagctttaagaacagggtggctgagccctaagtgtacctttggagcatcctgtgtgtcttcagcattgattgactgtttttactgtggatttaatttcagttactttactctggtcttactacttcggcttgactgtgacatcgttgagggcaggggctgtgtcacctctaaccaaagggcctccccagatgcctagcctggtccaagcgttccatcaagagtcagtaccagcgtttattgctgtccagtctgtgcaagctccatgctggctgctgggtaagagccaagggcagccaggcctaatggctcatgcctgtaattccagcactttgggaggctgaggctggtggatcacctgaggctgggagtttgagaccagcctggccaacatgttgaaaccccatctctactaaaaatactaaaattagccaggcatggtggtgggtgcctgtaatcccagctactccagaggctgaggcaggagaattgcttgaaccggggaggcagaagttaagtgaaccaagattatgccattgcactccatccagccttggtgacaagagcaaaactccgtctcaaaaaaaaaaaaaaaaaaaaaaaaaaagagcaaaggccagaggaggaaagagctgagctcgatgtagggaagaattgatgtgatgcttgggcaataagaggcatctacagatggccgtcctggtttccttgccctgcaagagttcctactatttctcactgcctaactgcagagggtctctctttaggggtgggattgtaggacgggggagcgccagagtccttcccagtgcagactgtaattctgtgtggagactataattttatgacctgtacatcaacattaaaataacagtgtaggttgcatgtggtttgtgggacctgttgatttggtgtgggcttcttggttagaggttgatcttggcaaatctcctgtctcagagttggtttcctgttgctcccataggtagattagtaactagtttggctaacaggcagctttcagaagagccaacaaatggagccaggctgcttgcccacactgtcagattcagagctcagtcactgtccatgacacagctagttatcatttaggaggaatgagctttgggggctagcaggcagaaatggtttagggacagccattttcctgtggctgatgtgagattatccatgtctgtggagatgcaagcttccgaaaagctgggctcatgggccaaatgcctctgtatttccataacctccaggccagggtcttgcacatcatagggcctgggagaataagtgagtggtcaagcatacacatttgaaaagtaattcatgtgccatctgtcacttgagagtgccagaagagaggaaatcacaggcaagcaaagcctggtgtgtttttagtgaggctagagaaacatgattttttgcatggctaaaattgcatcactaaattttgagggccgtttttaacttacagtttaccatgatttcttggctgacaaatcataggtgaccatttctcaccattctcccatgagaaccccgcactgcaaactacctgtcatgtccaaacttgtcctggggctcaaagcttgtcagggattaaggagaatgaagcccgaaagtgccttagggacatcctgtcttcactgctgtcatagagccagggcctgggcagcacaaggccacatgctttctgagcccaggccagtcccagcaagctcttatggaagcacttttttttttttttgttttgagacggagtctctctcttgttgcccaggctggagtgcaatggtgtgatctcagctcactgcaacctctgcctcccggattcaagcgattctcctttctcagcctcctgagtagctgggattacaggcatctgccactacacccagctaatttttggtattttaagtagtgacggggtttcaccatcttggccaggctggtctcaaactcttgacctcaagtgatttgccagtcttggcctcccaaagtgctgggattataagcatgtgccaccatgcctggcctttttttttttttttttttttttgagatggagtttcactcttgttggccaggctggggtgcaatagcacaatctcggctcactgcaacctccgcttccccggttcaagcaattctcctgcctcagcctcccaagtagctgggattacaggcgcccgccaccacacccagctaatttttgttatttttagtagagacggagtttcaccatcttggccaggctggtctcttaactcctgacctcaagtgatctgcctgcctcaccctcccaaagtgctgggattacaggtgtgagccactgcacccagcttctggaagcatttttaaaaagtttttatttttcttgagacaaggtctcactctgttgcccaggctggagtgcaatggcatgatcacagcttaccgcagccttgacctaccgggctcaagcaacctcctgcctcagcctcccaagtagctggtactacatgcgtgaaccaccacacctggctaatttttgtagtttttgtagagatggggtcccaccaggttgccgggctggtcttgaatccctgagctcaacaatctacccacctcggcctcccaaaagtgttgggattataggcgtgagccgctgcacccagcctgggagcactttctgtcccctctgtggttcgtcttagagcggatcatcttgtaaggatgttggtgatcttaattttttatgcttttatattttgcctcagtttaagtgtaatcagcaggaagcagaaaatatattcatcattttcaaaaaatatttaaaaattcaaatattaaaaaaatacagagaaaagttaacaaagctactgtatacatcatctggctccaactgttaccaactctgaggacctttagtcatccttactccatgctctcccctaccaccggatgtactgagcagcagagaatgggacctgggagggggcctattccaggtcaaaggggagagactactcctggtcaacggggaactactctgggtctatgagaggactagttcaggtagatgagggactactccaggtcaatggggaaccactctgggtcaagggaagactattccaggtcgggcaaggggagctattccaggtgaagaaggcggatgcaggggtgggtccagtcagcccaagtgagagaggaagcattttagcagattatagggctttaagcctgggtcacaggtgtgtcacctgttgggggcacgaatgaagagcttaggctgtgatgctggtccaactttattatagtctgtggtagtgatgagtaggagacagtctgattatatacatatatacatatatatatatatgtatagacagcagtggaagaagagataaattttaacttattgtcaaggtaaatacagtcataaaattaactggtatatattttgcttgttcacaacatatcagacgtgctcagaactttatgtagattattgtattgattgcctgtggcacttctctaaggattgttagcctgttgtgcagatggtgagagctcatccaaccagtttgcttagtaagtggtgcagcccaatgcatgccggagcagagatcatgcctaggacctgaggaacatctatctttactggtagaagaaagagagctggcaaagggtgcgtgagatgcaggaaacacaggggacagagtgacagaggcgtggtggcagcgttagtgcacttctctggaagcaagactttctgttgtgttttttgttttcgtttttattgaaagagcttcctgattccatgtctgttttagtgggtgaatggaataaaaacccagctatgaaagggtgaaataaataaaggtaagaaggaagctgaggagcagaaagctcagccttggctgtcaggaggcagcagggtcaggaaaaatgttgggttttgctctttgaggatttgttttatttggggtggcttttgtttgcttatttacttttcccgctaatgctggagagctgagcatgatggtggtggtggggaggggctcatacagggcagggtccaaccccagcctcattagggaggcagctgcagggcctgctgggagccactggacgaccaatttctgcttttttcaggagtggttactgaatagtgtagtccttggctgcaattgtctgtgaaattggtgggtttgaggaggtgtccttataggaccacaggttctgctacaccgttttatattggattttgcatatgggtgaatttcccatatgctggagagagacagaaatgagagcttttaatgaaagtttggtggtttattgtatatatgttttgttagtttctgtgtttggtgataaggggggtctgagcttggcctactgtgggggtttcggctgccatctgtgcactgggtcaccctatcctggcaggcacctgcaaaaggagtgttgtcatctcctcctgcgtttcctctgttgagagttatggaggagatggtggggaataagttctcactcttagtcacggctctggtttttgcaggcctgcgtgatgtttccttgctgcggctgcacatcagtgtcttgttttctcgggtttatgttcctttgggtgactgtagatagggattgtagcatgatctctcagcacaatttgggattgcttccccccagacccccaccccccgccgccattgtcaaaggtggtgatgaaaagctttcttacggagttattgtgaatgaagtgtcaggtcttttcctgggttctgcaggcgaggcttgctgtaatcctctcttgctctctcactgattctcactctttaaggtgactttgattgcaggattagccttcagaaccctcatgaaatgctggatagggtgtgaagtcatcagagttaggggctggccagctgctgatcagggcttctccccctacttttttttttttttttttttgagacagtatcttgctctgttgcccaggctggagtgcagtggcatctcggctcactgcaatctccgcctcctgggttcaagcaattctcctgccttagcctcccgagcagctgggattacagacatgtgccaccacacctggctaatttttgtatttttagtagagatggggtttcaccatgttggccaggctggtctcgaactcctgaccttaagtgatgtacccgcctcagcctcccaaagtgctgggattacaggtgtgagccaccgtgcctggcctggtttctcccttgttgatctgcattggagctcaacacactcagtgtccccacttggagtgttccccactggggaaagaattgcataaaaaacatatgctccacttgttgatgctagcactggccacaccttccacctgccttcctggagttctcagaaatgaagtgtcccagctgagctggaaagagttggagtgatgttatgttttatcttctgtggggaatctcccccttctatcattgtcttgccagataaggttacctggcttctatgtgttgtaggaacaggtgaagaacaaggtgcctccatgccagaggctgcatggcagcccagccccaccgtgccggcctgcgtgctggctgtggtccctcaggcttgtgtgctgttggtacctttctcaccagtctggcagtcagtgatccctgttgcatgggggccatggtagtagttttggctacttctgtttgttaaccataggtacaacacaaagcatttgtaaataatgaactccaatcattgccgtttctgcctgcagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaaggtaagtcgtcatgggccacaggacgtgcctgccaaacgacagtgacggtcatgcttgtatccaccagacactcttgagtttataagacacagccacacaaacaccttagtagttgattatcccacccattgtcttgtctatgctgataaatttaataattggataactgaaaacccagattctgtctgctgaccccagtttatttttttctgtagtagcaatgccaccttctttctctcgaagacttggctgtgtgagtagtatgtgctgctccaccagaagagggttaaagagctgggagaaaactcacatctcctgtagtttgcagttgaaaagagttacctggtcaaggccatgaccttgcaggtctaacagtcaccgcctagaattcagaccatgtgtttgaggctcatcattgggtctcaaaggcctgaggccaaaatactgtgcataaaccatgtgacgtgcataagttgatttttaatccctcccctaaaatgaaaatatatgaataaaaaggtataaagccatgaggtcagagagaataggaaaggagacaacagtggatgaggtggtccgtaaacatggaagaaggaaaccgctgagggtgagatgagttagagctaatgcagccagacccgagttcctgcagaggacccagagtccagggggctcaggaggggcatggggcagttcgaatgtccatgggagggatttccactctcacctggctcagccagatgattaactcatccccacccactggaagatggggctttggacgtgcagaaacctggtacaggggcaggtggggagagaccaagacagaagataaggaagtcaagtcaaagcctgtatgtggaatggagagaattcccaattcctttttctttcaagcttctagaatgcctgcaaccaggcctttcccacaaaggaattcttggaagggtgctcattggggaagttaagcagcccctactggcccttgggtttacccaaccaaccagcctgaataaactccaacagtcaggactcccgccaggcatccgacgtctgtcagctttttggagcctcatttcaaacacaggcagctgagtataagtacacatttgaggacaactttcaacctaaaggcagagctcaagacaaatacacaaacatgaataaacagcaacaatgcagaaaataggggaagaaatgtaaaagtatataatattttcagaaagataagaggaaatattgttgacagtgacaacaggattctacttttaaataaaaaggtgagaggaagagcttctggaattaaaactgttaattaggccaggtgcggtggctcacacctgtaatcccagcactttaggaggccaaggtgtgcggatcacttgaggtcaggagttcgagagcagcctggccaacatggagaaaccccgtctctactaaaaatacaaaaattagccgggcgtggtggcaggcgcctgtaatcccagctacttgggaggctgaggcaggagaattgcttgaacctgggaggtggaggttgcagtgagccaagatcacaccactgcactccagcttgggtgaaagagtgagactgtatgtcaaaagaaaacaaaacaaaacaactatgttatttatatatctttaaaaaattcaatagaggtgttgaaagataaaagtaaaaaaaaaggccaggtgctgtggctcatgcctgtaatcccagcactttgggaggccaatcacgaggtcaggagattgagaccatcctggctaacacagtgaaaccctgtctctactaaaaatacaaaaaattagccgggcgcggtggcgggcacctgtagtcccagctactcgggaggctgacataggagaatggcgtgaacccaggaggtggagcttgcagtgatcccagattgtgccacttcagcctgggcaatagagcgagactccgtctcaaaaaaaaaagtaaaaaaaagtcccagaaagaatattcaaaaaacaaagaaggttaataaacaaaagatgagaaagagaaatgaaattagatgaccaattcaggaagttcaacatctgactcccaagaaaaaagaatgaagggaagagtgagaagaagttattaagacagtaaaggaagaacattttgaataattgactgatggacatgactccccccattgaaaggatcctgtcatgatgactagacaggtctctaaaacctcaactcacagaagcctgttcttagaagttactggaggatgtgctgcatcaaaacataaggggaggccgggcatggtggctcacgcctgtaatcccagcactttgggaggccaaggggggcagatcagatgaggccaggagtttgagatcagcctggccaacatggcgaaaccctgtctctattaaaaatgccagaaaaattagccaggtgtagtggcacacgcctgtaattccagctacttgggaggctgaggcacgagaatagcttgaacccgggaggcggaggttgcagtgagccgagatcgcacccctgcactccagcctaggcgacagcgtgagacgcggtcttcaaaaacaaaacaaaacacaagggcaaaccaagaataggaagacacggattcatagcccaaggggtctgccagggaaaggaacaaagataattcccaggatgacaggaaagtgaagtcccaggaaattaatctaagaaacaggccacagaagctctgggataagtaagtatagactatatgtttgggtagaataatgtattgagaagttgctgaagaaatagaatagtacatagaaacaaagcaaatagaggtgtggaggaattgataataaatcattaaaaatgaaaacttaaatgttggaaactcctgtttctgggaagatgaagtagacattcttttccctgttcttctagttaagtgcatctaaaatctaaaatccttggacactatatgcaataacgtaagaacactctgaaaggtaaagagaacgcagaccacccaggacccagaaaatgacccagtagtgatttcttcaggttgtctttttgcctcatgtagcccagactatgagccgaagaaactggcagcccagaaacaccaacaggtacagacagaaccccctgccaaagccagctccttctgaccaaaggaccaggaaaggggcagcctagcacaaaacagagaatatttagacaactgctcagtgcaaaccaaacatgatagaaaggactgtggtcctacctctgtgcctgctaccagaggctaagtgagggccacttactcctccagagaaagttgaatagggaccatggacttttatccctgttgggcagtaacaaacccctaaggaaccttgtgtggttctggagtgttagtggagaccacattgggtggggcagtaatgaggccctcctattccttccaaccagggaagaatcagtggaagccacatggggaaccagaactcttatcatacccagcagtaacgaggaaggagccctccacgcaggaggccaagtagggaatctgacctttgacccctacttggtggtaaaggtggtgttgtcgagcgccgtggcccatgcctgtaatcccagtactttgggagactgaggcggacggatcacgaggtcaggagttcaagaccagcctgaccaacatggtgaaaccccatctctactagaaatacaaaaattagccagttgtggtggcacacgcctgtaatctcaggaggctgaggcaggagtattgcttgactccggaagatggagattgcagtgagctgagatctcaccactgcactccagcctgggtaacagagcgagattccatctcaaaaaaaaaaggtgccgttcccttcccttctgagggcctaggttaaattttctagcatttgtattgttgaagtcctgaaaagagaggagaaagagggaagggctgaaaaacttttcaaagatcttatgggttgaaacgtttggcaaaggacaaacttaaaagattcagaaagctgagcaaacgccaaacaagataaatccactactaaagcccatcatagtagaatttctgaaaagtaaagacaacaacaacaaaaaatcttgaaagtggcaagaaagaaacactttactcataggggaaaacagaaagcagatttcttgttacacataatgaggaccagtggcacaacattcttcaagttctgagagaccctgagaatcaaaaggataatgagagaacacaagcaactccacacacagtgggccaaaaaatagaccaattccttgaaaagcacaaactcctcccacagtcatccaatatgaaatagatcatttgaatacccctataattattaaagaaattcagtatctaatttgaaaactcccattaaaaaaagtctttaggcccaaatggtttcactggagaattctatcaaacatttaaagaattaatgtcaattctacatactcttccagaaaaacagaaagggagggaactcttctgttctctcttctcttctctgctttctcttctcttcttcttcttttttttttttttttttccttgagatagggtctgtctctgttgcccatgttagagtgcagtggcatgatcatggttcactgcagcctcgaccttccaagctcaagcagccctcccaccttagcctcctgagtagctgagactacaggtgcctgccaccatgcccagctaattttttattttgtagagatgaggtctcactgtgttgaccaggctgtcttgaactcctagactcaagcagtcctcccacctcagcctcccaaagtcctggaattataggcatgaaccactgcacttggaatattttctgactcattttgtaagggcagtattgccctgataccaaaccagacaaaaaacagtgcaaaattaaaagaaataacagacaccaatacaaacataaaattcctcaggaaactattaggtaacatattcagcaatatagaaaaaattatacctactgtggctgtgagaataaacaacaaaaaaattatacaccgtgaacaagtggagtttgttctgaggatgcaaggctggtttgatacttgaaaatgtaatccattggcaggagaatcacttgaacccaaggaggcggaggttgcagtgagctgggattgtgccactgcactccagcctgggtgatggggtgagactccatcccaaaaaaaaaaaaaattgtggagaaattttaattaacatttcttcaaatatttaactttatttttttctttccttctagggctcccattaatcacatattgatatttattttatttttcatgccctttcatttttctctcatttttcctattctttactcttcccaatgccttctgggaatgtttcaaaccactctccgtcttatgaattcattcctcaactgtattcattcaaccctgaattaaattgtttgtttctactatatctgattggtccttttttataactccttgtccctatttgtttccagtgccctcctacatgcccttgagaatatttattaggattattgtaaattcttgttttctctggcttatcagttcttctccctccagaattagttgtttagtttgtgatcttgcctttccagtgcttgaggtctgtgttccacagatctgtctttattttttccattccctccagaatatcagctatagtttttttgttttgttttgtttcgttttgggatggagtctcgctctgtcgcccaggctggagtgcagtggtgcaggctccgctcactgcaagctccgcctcccgggttcacgctgttctcctgcttcagcctcccgagtggctgggactgcagaagcctgccaccacgcccagctaatctttttttgtatttttagtagagatggggtttcaccgtgttggtcaggatggtctcgatctcctgaccttgtgatcctcccgcctcggcctccaaaggtgctgggattacaggtgtaagccaccacgtctggcccagctgtagtttttatattacgttctgagttccatctatagcccacttgcttctgaggcatctccaggatgagattcaaaggagggaaaccccaattgctgtaagttccccatcttgactcttgacttccttacagcataaactacacttctggtcctcaagatttagcccaatttgactgggctgtctttttatgttcagtagaattagactatatcacagaaccaccaaacattttttactagtttatggagagaattaccattttctagaggtagggaagagacattagtgacctcatatggcaaattactatggagaatataattatttccaaattttcctagaaccataatactttgtgattgttacagtgattcttattttccttccttccttccttagacctcttaagtataccctataatatgatttttaattcaaaagttattaaaattttgttttgaagatttcataactaaactctaaccgatccccaagatgactagaaaagcctcttggttttacaaaactagtttggatagtgctgttctgaaggtataatagaaattggtgaaattatttgtggcctgtctttgtgttcttgctgtatcaatatttgtatcttatcagatacctttacatatgtctagccttttctttctatctgacattaacttattcaacaaatatatgttgaacacttgctccactatcgttatagctgctaggtgcagctagaagtgacagctgatagagcaatttctttagagtagtttgtgcagtttcagttgaaaaatcagcgcctggtttccattcaggccctgctattgtgcatgggaacttgaatcaccttggaacttttgtattgatttccataaatgggaagttagatgaattgcttaataataccatatgtttgcagaaataaaagaaaaatcaccgcttaaaaaaatgtaatccatcatattaacaagctaaagaagaaaaatcacataattatatcaatcagtggcagaaagtttatttgacaaaattcagcacccattcttgattaaaaactcagacaaatggggctgggtgcggtggctcacgcctgtaatcccagcactttgggaggccgaggcaggtggatcacaaggtcaggagatcaagaccatcctggctaacatggtgaaacactgtctctactaaaaatacaaaaaattagccggacgtggtggcgggtgcctgtagtcccagctactcgggaggctgaggcaggagaacagcatgaacccgggaggcggagcttgcagtgagcccagatcatgccgctgcactccagcctgggtgacagagtgagactttgcctcaaaaaaacaaaacaaaacaaaacaaactcagacaaacaagatatgtttttgaacaatgaatatgtggatatcaaaattaaatcaataccattcacaatcacttaaaaaatgaaacacgggtataaatcttacaaaacatgaataagatttgtatgctgaaaactatagaacactgatgaaagaaatcaaagatctgaataagtggagagacacactgaattcatggattggaagactcaacctaattagtatgttacttgtccctaagttgatataaatggaccaactccttgaaaagcacaaactactactacaagtcatccaatatgaaataatttgaatagcttgtaactattaaaagtgaattctacaattcctatcaaaatttcagcaagaattttttgtagatataaacaagactattcttaaagtgcagtggcacgatcttaaatttcaagctattcttgaaatttaaatggagaggcaaaataagtagaatagctaataataattttgaaaaagaagaaaatgagaagagtcagcctgtctgatttcaagatagatcatactgctatcacaatcaagactgtggtatctgcagagggactgacacagagatcaggggagcaaaatgaactagaaacagatccacacatatatgcccagctgattcttgacaaaggttcataagcaattcagtggagaagggataggatagccttttaacaaatggtgctggagcagttggacatttgtaggcaaaaattgaaccttgccctgaatttcacaacttaaacacaaaaattaactcaaaatggatcataggcttaaatataaaatacaacttctaggataaaacatagaaaatcttcaggatgcagggctacgcagagttctgagacttgatacctaaagcataattcataaaagaaaaaactgataaactggacttcatcaaaatttaaaactcttgctctataaaagacaatgaaaacatatgctacagactgagaggagatatttttaaaccacatatctgacagagggttggtatctacagtatataaagaactctcaaaactcaacagtaaaacaaacaatccgattaagacataagcaaaagacaggaggagatacttcaatgaagaggatatacagatggcagtaagcacatgaaaatatgctcagcatcattagccatcagggaaatgcacattaaaaccataatgagctgccaatacacacctaacagaatgtttaaaaaaagtagaacacaagatgctggagaagatgtggaggaactggacccctcattcattgctggtagggatgtaaaatggtaccgccactctagaaagcagtctggcagtttcttcaaatctccacgtgcaactacgaacaacttggcaattgcactcctaggcatttatcccagggaaatgaaaatttatgttcacatgaaaacctgcctactaatattcaaaacagttgtattcatagtagcccaaaactggaaacaactccatgtcctttggtggataaatggttaaacaaaatgaggtccatccatgccacagaagactattcaataatacaaagggctgggcatggtggcacctgcctgtagtcccacctactggggaggctgaggctggaggattgcttgagcccaggaagtccaggctgcagtgagccatgatcatgccactgtgctccatcctggatgacagtgagaccctgtcttaaagcaacaacaaaggaacaaactacacagcaacctggatgggcctccagagaattatgttgagtgaaaaaagccgttcctaaaggtttcacactgtatgttcctttctgtaacatctttgaaatgacacagttgctgaggtggagaacagattagggtttgctaggggtggagagaagtaggtgtgcctataaagggcaacaggaggggtcctcacagtgatgggtgctctggctgtgtttacatccatgtcctggtgtgatgtgctgtagttctgcaagatgtcactgctgggggcaatagggtaaagggagcgatggatctccctgtatcatttcttataataagagaatttacaattaccttaaaataaaagtttaattataaagaaattgcaatttgactactacttggcatgtcagtgagagaatgtagataataaaatgatgtaaaaactaagtaatgattaagaaaaattatctaagttgtaagaaaagagagggaaagtgggaatggtgatacaattggaagtcaatatcttaaattgataagcaataggaatataagcccattatttagaaaaatggctctagatcctagaagaatcagaagacttcagtgtggctgcctcttggaagtggtttgtggatggggttgtcccagttagtaaaggagattgttgttgttttgttttacaattttttgaactttatttgcctttttaaactgtatacatttcataaaataaaaacaatcacaataataaaatccaccagtgataggagacatttaatcccacatactccagtgtggtgtttatgggaagtattttgtttttagaatgaacattaatgaacaagttgagagggatttaatagtagcttctgttttggaatgcttactgtgtgcagcaacactatttaacattttaaatatatttttctcatttaatcttcacaaaaccttcataaagtagaaacattcctctgggaggccgaggcaggcggatcacgaggtcaagagatctagactatcctggccaacatggtgaaaccccatctctactaaaaatacaaagattagctggatgtggtggtgtgcacctgtagtcccaggtgcttgggaggctgaggcaggagattcgcttgaacccaggaggtgaaggttgcagtgagccgagattgtgccactgcactccaggctggtgacagagcaagactgtctaaaaaaaaaaaaaaattctttctgtagtttccatcacaagctgacattttccccagtaggatttggtgcagtgcaaggctcacgtgggctcacctagtgactatgaatggactcatagcaggcttgctgtgtggttttaataatgggacagggtaattaatcacatttgtgataacaaacccaagaagctcttctcagatttgttattattttttgagacagggtctcactctgtcacccaggctggaatgtagtgacacagtcatgactcactgcagcttcaacttccctgggctcaggtgatcctctcacctcagcttcctgagtagctgggaccacatgttgcaccatcacacctggctaatttttgtatttttttgtggtgatggggtcttgccatgttgcccaggctggtctcgaactcctgtgctcaagcgatcctcctgcctcggcttctcaaagtgatagattacaagtgtgagccaccatgtccggcctattatttatttttatctaattgaatatgtaatttatgtacatggttcaaaattcaaatgataacagagattcttggtgaaaagaaatcatgtgcaccctccgtgggaggaattgctgacaccagcttcttgtgtctttacagtctgtccatatatgagcttacacatgcatttgtttcccaaatgattacacggtatacactgtttgcaccttgctttttacactgaacagtgtatcttgatttatcgccgagtgttcacattagcacacataaaactgcctcgtccattttaatggttgcatgatattccattagatagctgtgtcatattctatttaaccagtgatttattaatacatatttaatttattttcaactgttatgtatgttttactgtacctataggataaattacaaaagtggagtttctagatctaaggctaggttactttttaatttgacagacatttccaaattgctcttcataaagggttgaagtcagtgcatacgtgaggactctgtgagtgtgcaggcggccctgtacctctgcaggttcttcacctgagtcaagcaactgtgggttgaaagtattcaaaaaaagaacaataaaaaaaccactacaacaataaaaaataatacaaatttaaaaaatacagtgtaacaactatttacataacatttacattgtattaggtataagtaatctagagataatttgaagtacagtcttggccatataacaacatattggtcaacgacagaccacacatatgacaatggtcccatgagattataagggagctaaaaaatttccattgcctagtgacatagctgtcttaacattgtagcacaacgcatcaccttttctgtgtttgaatgtatttagagtcacaaatacttactattgtgttacagttgcctgcctgcagtattcatacattaacatgctgtacaggttgtagcctgggagcaataccatatagcctaggtgtgtagtgggctataatgtaccatctgagtttgtgtaattacactctgtgatgttcactcaatgatgaaattgcctaatgacatatttctcagaatgtatctctgttgtcgagtgatgcatgactgttacacaggaggagtgtaggttatgtgcaactaatactgccatattgtatgaggaacttgaacatctgcagattttggtatcccaagaggctcctggaaccaagccccagcagatactgagggacaactgtacctgtttctccaccctctgaggaacgcagtgtttattcaaactttttggtctttgccagtctgatattcttaaaatgttttctcattatagtttgtacttataagtgaggttgagtgtctttcaaatggtcaaaagtcaggtctctttcagactacctttctagatccattgcccattttttctgttgggttattgcttcttttcttatatctttgcagtagctctcagtgtgtcgggtaagttagtcctctgctgtaaagttagttttaaatgttttcccctagtttgtcatttgtctttgttcatcattgtcttcaattggttctcttgcagcagagcctgaaactggggatcatgttccactgatctgtaaagggcatgctcaagagaaagagtgaagggggtagggtagggcagaggggaaagatgcctgaaaatcatagactcgggttaatttcaacctgatcatgctctaaagcctagaatgccacagctcggtgaagacagaagtagctcagggtgttacccatccaccctcagagcagtggggggatcctgggtgagacaccactgcctgtactacactccaccctgcacttcctcatccacatatttctcacgttaagttcattctatccagactcagcttctccagaggcatttggtcatgatttctggaaacctttccagatgaactacagccctgactacttcagtgggtcccaaggcctcattccacccactggggacatagcaccatgtagcaactattggtttagatgtatactgcatcctaaagaagagggggcatcctttcagggtgtcatctcccagctggccacagctctatcaagatgacagctccaggatgcttgggtatttatttatttatttatttatttatttattgagacatagtctcgttctgtcgcccagcctggagtgcagtggcgtggtcttggctcactgcaagctctgcctcccgggttcatgccattctcctgcctcagcctccctagtagccgggactacaggcgcccgtcaccacgcctggctaatttatttatttattgtgagacggagtcttgctctgtctcccaggctgtagtggtggcatgatctcagctcactgcaagctctgcctcccgggttcatgccattctcctgcctcagcctcccaagtagctgggaccacaggcacgtgccaccacacatggctagtatttttgtatttttagtagagacggggtttcactgtgttagccaggatggtctcgatctcctgacctcgtgatccgcccacctcggccccccaaaatgctgggattataggcatgagccactgcgcccggccacgcctggctaattttttgtatttttagtagagacggggtttcactgtgttagccaggatggtcttgatctcctgacctcgtgatccacccgcctcggcctcccaaagtgctggggttacaggcgtgagggtattttataggacattgaattccgtgatcatgtgcctactgctgtacctcctttagcactaagtgagtcccttgatccaaggtgatgatggtacttgctgtcccacatcggaaaccacatgctccacaagcccttggagagtaggttggcagctgctgcaggcaggagaggcaaacccttatgtggaggacatgctaatttttgccagaacaagtgtttcttattgcaggatcaaaggagttctgaagtattcagctggccagcagacaggacaactggttggtctcttggaggggatgatgccttatcagggctgcagaattggtatcctgctggcaggtctgccacggtgaagggctgtagtgtatttgcttgtgcctaagtatgtgaaccaggcttggggttttctttctgtcagctgtgtattgggaaccctttctgaggctgtgggtgtaatttaagggagaggcttcagaacaggtccgctgggaagtgtttaggtttgggccacctgttcctgcagctggcactgttagcacagtcctgcagtaagaacgtgaacatgtactgttgtccatcccacatgaacatcagtagttcctgattggtttgaggaagaagtgtttaccgcatcagtagctacaaaccatgtacccaagattgtttatccacttgaataaagattccatttagctcagtttgtggcagtctacagtcatctaccacaatttatccaccataatttctataggagccagactgggcatgagatgggggcccctaccctgtgtcatttatgttttcaagagcagcattaatctctgcttttcccactgggaaatgatactgtttttgatttactatggccaggggtcaggggccggataaatttcaggggcttccaaatggccttttctacttatagctcttattctttagacaaaggaccaatggaaggattctgcaaagtgctaagtatgtccgttcctcttgtattacgtctcttatattcagggaagtgggcagatggccaccagtggagtctttacccagtggatgtactttcaggtggacctggctgggcttcatgtattatctgactcccatatgttcctactctgcagaggacctttttgatagtttgggtccctaagtatgtgcattgtctcagaccctctatttcaaaaacctctgaagacttgcagttcctatggtacttttacccaggtgaatgaagtccctttgggaagagctggggaaatcactgtggtgtgtacttgccttggtgttgcaggtcgactcccacgcaggcttggtctctccttcagtcagtgtttctgagtctgagagctgctccagatctagaaacggagtcagggattgatactttgcattgtagaagctcaccttagccttctgcttattccgttttgattttcttgtttatatatagtaagcagcacccttcttggcttcgtatctgtcctgcccatggaaactccagcattctgtgagccgtctccatagatccctgcatggatcccaggctcccctggctactattttgactttgctgcctattaccagctgacacctacacctgctctgtgcgagtcagtgctgctccctggcttctgctagggaaggtcttattacccccttgctcctggggagcccagttctgtacacgcacacctgatggttagcttccccttcggaggctggccagtacagagcttcccagtgatgcctgtagaccttctgcacactcattagtgccatggttgatggaatgccatcatgttctcctgagggacatgggccacgggtgggctttcctgtcattttgtatgtcgattatagtatgtctacttccctgagcctttcgatacctggatccactttgccacagcagtcccacaatctctgctttaatatgagccatcactttggctgaactttgaagagcctgccagcagtatctgagaatggcctctggaccccttctcagggtgttaaatgctgtgttatagtacatgccgtagtagagaagatctctcattcagcttaatattctgtccccctggatccagcaccttgaggtcctctcccaggtgcattccccagctctgtcagaactcgttagacacatcccgtagccggtgtcagccatggaggaggacagggcagattctggggagagcaagcagtatctcatgagattcccatttcatttgaggcctatgtgttatattcaagcaaggagtgtgtggggggcttctgtcgtacaacaaaaggggataggtcacttctgtaggcacagtgttaagaagaatttgaggactaaggttctcaaaggcatttacccagctatccccatcccaaatctcagaatcctgttccttccctgttagggcccagaccctgccacgggaactttatcaatcaaggccaataaagagaagttatggggagactgatttaggatcaatattaaaaaaaaaaacacttatatcttgtcagaagttgtttttagaagaattttctgtttagagccaactcccctaccccaccccctagacaaggtgcttgaggaggtggtgagcctgccagcgtggagctgtgtggttggcagtcaggcaagggtgtgtgagaggccacctggccataccgtcttctttcactaatcccagaactgatggagctgatggctggctggtcagatgtccccttgctctctcactgcttcaccgtggtcctctctcttgtagctgtgctcttggcttgctgggacagtgggtgtgggctgggcatggcattgccataggggcactgggtgttggccaggggacacccaggagacagggttccccagggcagatggggagcccattttgagaactgtccaggaggcatacataccgtatcctattcagatattagaacaaggattagagctgtactttttctttattgacaaaagttgttttcctactataaatatttcacagtgaaaaaaatctcaaatgagtaaagattcatccctataggaagaaagtagaatcgtgaatcctctttagagatctgtgagcctgagtttttgaagcatcatggccagattttggataacaccaaagaaaagcaagataatgatggtgatgtcgtgtcaccccagccacagggaggccagggagaattcctgtacaattctgtaaacataattccggggtacttttgtttcagcaaagcacttgacatatgaccccatcttagtcagtattttttattacccttttgagaacagagaataatatttgtggatgatacaaaactaggagggatagcaaatgaaattgaataaagctaattagatgaaattttttattgtagtaaaatatacataagatttattatcggccgggcccggtggctcatgcctgtaatcccagcactttgggaggctaaggcgggtggatcacgaggtcaggagttcaagaccagcctggccaagatggtgaaaccccgtctctactaaaaatacaaaaaaattagctgggtgtggtgacgggtgcccgtaatccgagctatttgggaggctgaggcagataactgcttgaacccaggaggcagaggttgcagtgagctgagatcgcaccactgcactccagcctaggtgacagagcgagactccatctcaaaaaaaagatttactgtcttaatcattttgaagtgtagagttcaatggcataaaatcaattcacattgttgtgcaaccatcagcactatccatctccagagcttcccaccagcccttactgaaaccatgttcctgttggacaatgcctctccatctccctcccacagcccctggcaaccaccgctttactttttgtctctatgatttgactactctaggtatcttatgtaagtggaatcatacaatatttgtccttttgtgactggcttatttcgcttagcacagtgccctcaaggttcttccatgtcgtagcatgtgtcagcatttccattgcttttaaggctgaataatatttcattgtatgtgtagatcacatttggtttattcatttatctgtcaatgaacatttgagttgtttcttgctttagttgattgtgaatcatgctgctatgaacatgggtgtacaaatgtcttttcaagcccctgcttttatttcttttgtatatatacccagaagtggaattactgaatcatatgctaattccatgtttaattttttgaggaaccaccatattgcttttcacaggagtatcattttacattcccatcagtaatgcacagggtttcaatatctccatatctttgccaacaattgtaattttcccttttttaaatagccatctaggctgggtgtggtggctcacgcctgtaatcctagcactttgggaggctgaggcaggaggatcaattgagctcaggagttcaagaccagcctaggcaacatagtgagaccccacccccgtcactattaaaagaaaaaagtagccatcctagtgggtgtgaagtggtatttcattacggttttgatttgcatttccctaataactattgatgttgaaaatcttttctcatgcttggcttattggccatctgtgtatctttagagaaatgtcaagtcatttgcccagtttttaattgggttgtttggtttttggttgttgagttctaggacttctttatatattttagatattaatcccttatcagatatgattggaaacattttctcccatactgtgggttttttcaccgtgttgattgtattctttggcgcacaaaagtgtttaattttggtgaagtccagatttgtttttcttttgttgcctgtgcttttggtgtgatagccaagaaatcattgataaatccaatatcatgaagcttttcctgtgttttcttctaagaattttatagttttaggtctcacatttatatatttgacccattttgagttaatctttgtaaatattgttaggtaaatggtctaaacttcattcttttgcctgtggatatccagttttcccagcaccatttgttgaaaagactgtcttttccccattgaatgctcatcatggcacccttgttgaaaataatctgaccatatacacaagggtctttcttgggctctctttttttctttctttcttttttttttgagatggagtctcactctgttacccaggctggagtgcagtggtatgatctcgactcactgcagcctctgcctcttgggttcaagcagctcccctgcctcagcctcccaagtagctgggactacaggtgtgcgccgccacacccggctaagttttgtattgttagtagagacggggtttcaccatgttggccaggatggtcttgatatactgacctcgtgatccacccgcctcggcctcccaaagtgctaggattacaggtgtgagccaccgcgcctggccttgggctctcttttccaatccattggtcagtgtctgtctttatatcacgctctttccatgactgtggtggtgtagtaagttttgaaatcaggaagtatgaaaatagttgaaatttattactgataaatgtaagcagtatctacatttggtttatatgagcagataggaagaggatggaaaggcctcagctaagggcaggtctgtggaaacattccaaaatgttcactgatgacaggctaaggatgagccagtacttggatgtgctgcttatttgttctgaaactgctctaattatcagaagggtcttaccagcactatagagattggggaagccaatacatacttttgcattcttccctccccacttccatcctcaccttatgaaatataaaacttcttggaataactatacatttccttatggagctgcccagcacacgcaattctgaagtttaggttgcccatctgactaagcccaagatgaacttgtatttgccaccgtgccctgagtgtgcttcagccagttactcttctgcctgtttcctgctccatccagtgagaaggctacattgcatagcaagcagcaggtagactgactcatgtcaccgtgtttacgttgcttggattcggaaatctccagagtgacctccttgcttggttcccagtcagagaggtcatctgtcagcaaagacagtttcccaacctttatactttttgtttccttctcttgcataattgcattagctgagacttctatatgatgttaaatcatagtgataagaggggacatctttgccttgttcctgatcttagggggaaggtatctaactttttgccattaagtatgatgttcgctttagggtgtttttttttaatactttaagttttagggtacatgtgcacaacgtgcaggtttgttacatatgtatacatgtgccatgttggtgtgctgcacccattaactcatcatttagcattaggtatatcttctaatgctatccctcccccctccccccaccccacaacagtccccggtgtgtgatgttccctttcctgtgtccatgtgttgtcattgttcaattcccacctatgagtgagaacatgcggtgtttgtttttttgtccttgcgatagtttgttgagaatgatggtttccagtttcataaatagatgtttttaattagttcaggaagtctctattcctggtttgctgagagcttttgtcatgaatgggtgttagatttgtcaaatgctttttctacatctattgctacaatcatatgatttttctttagccagttgatgtgatggattacaacgatatatttttttttgagacagagtttttgttctgtcacctaggctggaaagcagtggcacgatcttgcctcagcctcctgagtagctgggattacaggcacctgccaccacgcccagctaattttttttttttttttgtatttttagtgtaaacggggttttgccatgttggccaggctggtctcaaactcctgacctcaggtgatccacctaccttggcctctcaaagtgctgggattacaggtgtgagctaccatgaccagcctaattttcttatttttagtagagatggggtttcaccatgttggccacactagtcttgaactcctgacctcaggtgatccacccatcttggcttctctaaatgctgggattataggcatgagtcactgcccccgctacgattgatatttgaacattgaattagccttgcacacctgggataaatcctgcctggtcgtggtgtataattattaatacattattggattcaatttgctgattttttgtttaaaagttttggccaggcatggtggctcatgcctgtaatcccagcactttgggaggccaaggcaggaggatcacttgagcctaggagtttgagactagcctaggcaatgtggcgaaaccctgtctgttaaaaaaaaaaaaaagaaagaaagaaagaaaaaacaaaaaatacaggctgggtgcggtggctcatgcctgtattcccagcacttttgaaggccgaggcgggcggattgattgagctcaggagttcgagaccagcctgggcaacatggcaaaaccccgtctgtctctacaaaaaatacaaaaattagctgggcctggtggcatgtgcgtgtagtctcatctactagtgggaggatcgcttcagcctgggaggttgaggctgcagtgagctgtgattgtgccactgcactccagcctgggcaacagagcaagaccctgtctcaaaaatgtgtatgtgtgtatatatatatatttattttagtggttgccttagggtttgcaatatacattcacaactaatcaaaatccactttcaaataatgctgtgctgcttcacaggtagtgcaaataccttgtaaccaagtattcccagttcactcctcccactgcttataacattgctgtcatttatttcatttatccttaggctacagtcacccaatacacaaattttattttgaacaaattgttaatgtgttagagcaattaaaataagaaaaataaaagattaattttacctacatttatttcttctctgatgcttttccccttctttacatagatcagagtttctgaccaaatcattttcattctctctgaagaagttcttttaacttttcttgaaatgttaaatccctgagtttttgtttttctgataaaaatctttatttctctttcacttttgaaggataatttcactggatacagaatcaaatagttccctcctctctcttcttgcttggatggttcctgaagagaaatccagtgtcattcttgttcttgccattttataggtaggatgtttttttcctgtggaaaaaattcccagatttctgcaaagagagaatcttcctttctaattttctttttgtctttgatttctgcagtttgatgtgatttgcctcagtgtaaattacctgctttttaccgtttcatgttctctgaccttattggatctgtggatgggtgtctgacattagtttggggaacttctcagctctcattactccaaatagttattgtgttcttttctttctcttgatatcctcattgcacatatgttacactttttgtaactgtcccacagttcttgcatattctgttttctttctttcgttcttttttccctttgcttttcatgtttggaagtttctgttgacgtattcttaagctcagagagtctctccttggctgtgtccagcctcttgagcttgttgaaggcagtccccattgctgttacaggacttttgctttctggcatttcctactgattgttgcttagggtttccatctctgcttatgctgcctatctgttcttacatgatgtctactttttccgttagagccattaccatattaatcgtagttgttttaaattcccaatctggtagttccaaaatctccactatgtctgagtctggttctgatatgaggaacttaggcgtcaggttaataggccttagtgtgaggtacgtttggctggctgggagttgggctgtgtttactgtttgctgcccttgtgatgctgggggataaaaatctcctgtgtatccttgtttttgtcttccattgtttttgggttttcttcaagattccttcttaaatagagtctgaggcctgcagttcttataggtgtgcatccctgttattacacaggggtcctgttgatgtggctttcaggggagaggaagtgttctgtagtcctgggattaggtctcagtgttttagtgaacctgtgtccctgggccgtggccttcacatgtgcttctcagttttgtttttttcctcccccttaggagagacataaacgatagaggaggcaggaattgggtgtttccttacccctaggtggttaggctctggtaaaatagttttccttgaggaaagccctttgttaaggataacagaatgctctggtcatgcctttttctttctttctttctttttttttttttttttttgagatgacctctgagccctttatatgttggttgggaaactggagtgcagtggcaccatcatgactcactgcagcctcaacctcctgggctcaaatgatcctcccatctcagcctcctgagtagctggcaccacaggcacactgccgtgcccaactattttgttgttgttgttgctgttgttgttcttgttgtagagatagggtctcaccatgtttcccaggctggtctcaaactcctggcctcaagcaaacctgccgccttggccatccaaagtcctgggattatgggcatgagccaccacacctggcctggttatacttttaaatgatgtattcttccctcctcctaccagagtatgaggagatgtttctccagtctcaccctgagagcctggtggggctcatggaggtaaaactcagactggtatggggacctccccagtgactattcccctggagtttttgtctcctactggtccatgctcagtctctgccatttgtcagttcccctttcctctctgctggtgctggctctagggtttctgccccgcaatgagctgtgattcttagcattgcatatctgtctctccatctttggggttattgttttttcatgtgacctcaattatctgatggatctgagaacagtcattgattttaagtttgccagctttcttgttgtgaggatgggagtgatgacttctgagcctttacaagctggacaggaaattggaaagtcccatttcattcttttttaatagagaacttaactgtgtgaggtaatgaacaactgagaaatgttgagtgcaagaagcctgttcttgggaagaatcagcaacccattttaaaaaacagaaacattgaaaatgttatggtggttggtaagatgcaggcaggagcacagcaggtacagtgctgctgcccacagccttctacacctgaggccctgcattatggaggtttgctaagccaagtgcctcatggccatgtgtgaccaaaaaaacctttttactaaatgttttgtgctgctataacagataccacagactgggaaatttataatgaatagatatttctaggctgtgcatggtgcctcacacctgtaatcccagcactttgggaagctgcggtgagcagattgcttaagtccaagagttcgagaccagcctgggctacatggcaaaaccctgtctctacaaaaattagccaggcgtggtgacacacacctgtagtaccagctactcaggaggctaaggtgggacaattgctttgagcctgggaggcagaggttgcagtgagccaagatcacgcctctgcaccccagcctgtgtgatagagtgagaccctgtctcaaaaaaaaaaaaaaaatcgtatcgttctggaggctaggaggtttaaggttgaagggcacagctggtgaggggctgcatctgcatcttatgttatcccagggcgaaaggtggaagggcaggagagggaagggggtcaaattcatcctttcatcaggaacctgctcctgagataacaaaccctctcccaggataacagcattaatgtgctcacaagggcagagctctcgtggcctaatcagctcttttctttcttttttttttttgagatggagttttgctcttgttgcccaggctggagtataatggcgcagtcttggctcaccacaacctccgcctcccgggttcaagcaattatcctgcctcagcctcctgagtagctgagattacaggcatgcaccaccacgtccagctaattttgtatttttagtagagacggggtttctccatgttggtcaggctggtttcgaactcccaacctcaggtgatctgcccaccttagcctcccaaagtgctgggattacaggcgtgagccaccgcacctggcctaatcacctcttaaaggccccacccttaacactgttgcatgtggggactaagtttccagcacatgctttttgggggacacattgaaaccatagcacttcatttctctatttatgctcatttctcagctatgttgacctttgcaattgaggaagtttattttttagtgaagttgtgcatgatgccattgttttcagtttccccagcagtgacgagaaaaccctgaccatccctgttttagaatacagattctaccaaaactagtagttttggtactagtagtttgggatactcattgcaggacttttgatgatgaccttcactgtagaatagtaggagatggggcagcactgtcctcagccagtagagatttctgtaagaacccaggactctcttcctagagttgggcctccacgcgagccggaatggagacccatgggcctggtggcctgagtatgaagcacttggtttgtgctctcggtggtagtgatggtggtgttggctcagctcccatttctcatggcatttttttcttcactttctttcagtatttaggtcagttaacgtccataccaggatacctgaatccctccagtaggactgaaatcctgcatttcatagacaatgcaaaggtaaccctatcctcttaaccctgtgcactagccctcagcccccaccagcccttggtccctgtactcttggcctcgtggctgtgaggaatgagccagtcccatcacattatgggtacacttggctcttggccataaagactattccttagtatggacattaagttgattctcgacacttgctccatgtgattttgggctgtttccaaaatttacactttcaagatatttcaaaccatgtgccgtaagtctgaatctgaaggcagttccagaagaatctcccaaatggtttgaacacattggtgtccctggaataagcactgttctgaggggaataacactgaccttattcactcagcatttgtcacatgtgtgacatcggccagcacaatattctcaggagaagcgccccatgccggttgacagctgagtctgtatttctgatgccctgtggttccttccagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacaggtacaggaggtcaggggtcaggagggtccttgtcctaaggagtacatgtgtgaattttatgaagttctggagacagtttttgcagcttcgtgttgggtgctgctgtttgtcacgaccaataattgtctttcctgtctctgagatcagccagaagagggcttgagatcagttaccagacactgggggtgactgtcacactaagagcctttggggactcaataatactgggatacagtatttaggactggtatcctgttcctctgcccggtggggctcctattgactccctctgggtacagtggagttgcccctctgcccaggtgtggtggagcctagagagagtgcagtggatagggacctcacctcagcttgactgatattttgagctctgcacagtgtcctcaaacctgggacagaaaagatgagacccagacctcccaggagctcttggtcatagaggttactctctgtgtgtccttgccgtctgctgctttcacaatgggatagaattgggcagaattgggcagaattgggcagaatgttatttttggctgtggtgagtacagtgctgcctcactggacccaagcccaagctgcccgttaatttccagcagcttccagcccaggcattcaggccactgaggatgaggggagagaccatggttcgccctacctgtattttgcccctcccagtcctgagtttcgaggctggtgttgcagtggggacagtatcctgggctccttggatctctgctggtgactgggttgatcccaaagcctttcatttccagagggccagtggcagggtgtgaaggggtcacagtgggtctgcctagaccacacactgtgttttaggtagcagagaggggaatttgttgttccacttaaggtcagtagttcattgagaatctggcgagtgtgttcattattgaccccttgagccatgaagctgccagcttgagtgcgctcttgagagcagtccactgaaagcctgtgagtctagatgcttggggttgctgtggtcataaactacacagggaacactggcggggtttatgaaggtggctgttgctctgttttgttctctgtgtagcagtagcttagacttgcgtacaccctccccaacgcaggcacacaccacacctacacacatgtacattactcaccctatctggcttagaaggctgggttggtggctccttccagccatactatccgacaccatggtgaccctcctgtttttctacctttggaccctgcgggaggccttaggcctgggacatccttagggacaaggagtgaggagactggtttctgactcgcttcttgcaggtgtttcaagctggtagggaggggagataggctcctccctttatttcttctgctgcatgacagtttctcagctttaattattagaacacattgctaaaggaaatggatgacagattttttttaatggagagagaatgagcgccataggagaaactttccaaaattagatgaaaaacaggacttctggtctttgagagaacttttgatttaaaggaagagagtgaatccctgtgtcctgggggccatcttccttgtttttgtggatgcaccggagcagttgtgtgtcccctgtgttacataaggtgtgctgtgtttattttttaatttttaaaatattttaaaaatttttgtaaggatgaagtctctctatgttgcccacgctggtcttgaactcctggcctcaagcgatcctcctgccttagcctcccaaagtgttgggactatgggcatgagccactgcactgggccgccatgctgtatttaggattaggcatccagagttctcagcataagagactagcaggtgaatagctaacgtttacttggtgcctgctatgtgcaagcaagtctctgtgcctctttggaccaaaagtacgctggtatttgggatagcacaggagtggggaagttgggggccaggtctagctgcaatagggtccatgtggcaggagctgcttggagggtgatgacttgagttggtgccagatggggcagggtcacccgtgcacccgtggtagcacttcctggatgatataggagaggcacacaactcgctgcccgcatccttaggctgcccaccctgcttccttgagaactaccacaggcacacaccagggagccaacatttaaaaatgtttaaaaggtagagatttcttaccaaactcataccaaaaaaagaaaaaaagtaaagggaaaccagtaaatttttttttttttttttgagacggagtctcgctgtgttgcccaggctggagtgtagtgccgtgatctcagctcactgcaagctctgcctcccaggttcacgccattctcctgcctcagcctcctgagtagctgggactacaggctcctgccaccacgcctggctaattttttgtatttttagtagagatagtatttcaccgtgttagccaggatgatcttgatctcctgaccttgtgatccgccaccttggcctcccaaagtgctgggattacaggcatgagccactgtgcccgcctttttttttttttgagacaagtttggtgcttgttgcccaggctagagtgcaatggtgtggtcttggttcactgcaatctccgccccccgagtagctgggattacaggcatgagccaccacgcccagctaatttttttgtatttttagtagagatggggtttcaccatgttggccaggctggtcttgaactcctgacctcaggtgatccacccgccttggcctcccaatgtgctgggattacagccatgagccactgcgcctggccaattattttcaataatatattttatttacccctccgtacccaaaacattattacatcagtatataatcaatataaaaatcgttgagctacatagcattctttctttgcctacctctgaaaccctgtgtatagtttgcactcacacatttcaatgtgggctcatcacattttgcatactcagtagtcctgtggccagtggctgccatagggacagagcagccccaggagtctcactgtggggtttgaggtacagtttcttatggagcccttgtctctgtgcatgcgctaactttgcatgtggcctgggacggccttcttctccctcctgaggctggcctgccctctgacaccctggcactagtggcacttctaggttttgttttcagtcttgaagtcctcccagggtggtccgaactgatggtgagagccctgcttcctggggattggcctcacttctgccatcaggaaaaccactgagttactccatgtatttcaggagaacctcatttgtctagggaggcaatgggtaggatgttagaaacaagggcactggggtctgaccgtctagattgccatgtggacagtgcaactcacacgccctcaggccaggcctttcactttcccatgcctcagtttacccatctgtaagaagggaactccccagaacacatggaaacctcctggaggtgactgttctcagggttgtatatgtggtctgttgtatatgaacttgaagcgtgtgaaactgcaggatgacatgcagctctggtgcccttggagctcaggggtcgcgtgttcccacccttatttagagaagcgaagtgtgtctggtgcaggcccttcacctgagtcgttctgtgggtgcctgagccaggtaaaggtcctctcagcctgtttccatggcggcctcagctgtttcctcaagtgcccccatgcctgcccttccactgtgctaaactgagatggtgttgacttctcagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtgagactttctcgccccacttactcagaactggctcctcccagaccctgctcatggccagccccaccctggccacacccagcacagtgctgggcactgctgggtgccccagctacttcctctgccattgcctgtccctgcctcaccctagtctccacccagccccacctctctctgctcaaccctgccccaggcattgcccccatcctggccctgcccacagctcctctgcgcatgactgcatcccaggtcctgccccaggcccaggctccccaccggttcccacccctgtgccttctgaccctcctacctccaacccccagcaacttctctgagaccacctggccactgagctttttgcttatcattcttcaaggtgcccccacgctgatgggcgggcagcggcggtcacctgtgcatcctagacctgcctggtgttaaggactgtgcttgcagattcctcacaacctggaagagccaagggctgggcccttgtaggctaggatttggggccccctcagccacccaatagctgtggggccttggcagtcacttaacacctttgtttaatttccatatctgtaaaatggatgctagtgaccacccaccttaaatatcctctaatgagcatttctcagtgttggtgctactgtcatttttagccggataattttccattgtgggaggctgccctgtgcactgtagggtgttgagcagcatcccagcttctccccttgtgacagctgaaaatgtctccagatattgctacatgtcccctgggaggggtacaaaaattgccccagttgagagcctctgctttagacagcacactgttataaaactgttttatagctgttagaaatgcctccaggtgggctgtgatactgatggtatctcctctcacctctttcctgggctgggatagggttgtgagggtgttgataggtcaggttaatggaaagaagacgttggactggcagctaacacttgtgccctgcacagtcccctcacacttgcaataccacccctgggccacatggcagtcctagatagagtcctggggcagttggctgggtctctcttttgacacccctttgggtcagtgaaaggcagagggacacattctggtatccactcttcattcatgtttattgagcatctgggctgccccaggtatcctggaagccgcctgggaaggcgcagtctccagccagactgaccgagcagctgctgtcccccactgcaggtcgctgcggaggagctttgctgtctgctaggccaggtcttccaggttgtttacacggagtccaccatcgactttctggacagagcgatatttgatggggcctctaccccgacccaccacctgtccctgcacagcggtatgttgagtgagagtgggcagcgggtgggagcagggacaggaggggctactgcagtggcccccagctccccatgagttactcctggaatagcgcagttactgccgtgacatggtggccttttgtttccagactttgctgttcacattagcccatagggtttcatgaaggcagaagtgtcacctgtccttgagagagttgcaccaggtcagcgctatggcttcctggaataaatttggggtctgtgaacacttttttggaaccacttgtggctaaagtcacttcacttaactcggaacaaagagcttggagaaggctcctagcactggggcctgtgatggaattggggaggctgagagtgggtctggggagcctccttttcagtatgcccagactatggctgctcttaatgtgaaactccttccaggaccatggccagacccatgggaagctgctcaggctgccctgggaggccagctggcagtggtggagcagtggcagatggggaagaatggaaggtaccccagagctgtctcttcctgcatggcccacacagcattttcaggagtctgttagtccattgaaaacacttcatcagcaagctcacttgagttaagtcttcaaaaacatcatctgtttttcagatgtattacttattgaggattaatgggttatataaattgaggtgcataaaaagctgttggaggctgggtgtggtggctcatgcctgtaatcccagcactttgggaggctgaggcgggcggatcacctgaggtcgggagttcaagaccagcctgaccaacatggagaaaccctgtctctactaaaaaataccaagaaaaaaaaaaaggctgttggaaacagtgcggcttgttgagtacaatttcttctttttacggagataagtcccagccctctgccctttccccagtaactcgcacatctcagtgaagagagtaaatggtggagaagcctgtgctggtgtgagggctgctcctcagtgcctccttcttccctttcttgctgctggtgccagagccctttgtgggcactacacgccttgtgttggcccagcagctgcagagagacagctgctgagctctcaggcatcctctctatctcatttagtcctcggtggcccagcgagataggtgcaatcttcatccccattttagagatggggaagtggaggcttagaagtcaacagcttatccagaggaatgtaccatatgagtagcagatgatttatcgagctgtaattaaacattcagttttagtgcgactggtttggcccttgtgctttaaaattcccaaagggcctttttttctttaataattttttttttactgagaagtacacaagtcatacatgtacagttgaatgaattttcataaagtaaacacatcatgtaacaccactactgggggttgctgaagtgggcttcttcccctgccagcctttcccaagacctccccgtgggatccacacacagatgtgcacacgttacgcacatgcatgcattctctgcttatttctgccttggagttttgcttgctgtgttctctctactacagctatgccaaaacatagcagcataaacagcagaaatatattctcttataattctatacgttaagagtccattgtgggtcccactgggctaaagttgaggtgtccacagggctggttccttctggaggctccagagaagaagccatttccttgtctttccagctcctaaaggcggctgcatgccttggctcatggcccttcctctgtcttcacagccagccacgtgacctcttccacagtcacatcttcctttgactgtcagcttcctctgcatttcaggactcttgcaatcacattgagcccacccaaattctccagggtcatctccctatttcaaggtcagctgataagcatcctttactcccctttgaaattggtaacatattcaccaattccagggattaggatgtggacgtctttggggggtcattattctgccctccatacttaccttgttcctagtgccagaaatgtcccttttatctctcagcctctccctctgcttcatttaaaatcttaccctctctgcaacactcacctgcctcgctcacaaagctttcactcactgtctgtgctggtgtgaaatgtgccttcctcaggtttgaaatagcaaattacagtctgtgtcacacggacctaatgtcatttgttgaatgtagctgctcagtgccagaccctttgctggtctgagggtcttgggaatcctgtggcttcactgggttcagatggggagtcagactgcccggctctgactgtggtttctgctgtgtgacctgggccaagttgtgtaactctctgacttacttcctaatctacaagtgaagacaggggtgatatatgcctgggttaaaggagacaaagccccagtaaccctgcctggcacatgagtgatacctcaaagacagcttttgctggctctggccatgggtgaatgtgtacttcagcccagcgtgcagcaggatttgcatttgccaggatccccaggaggggtgtatgtgggctcaagtctgggaagccctgccctgaggcacacagcacattccagagtgcgggcagcttgatgaaggacagcagggtccctgaagaccagggctgccgctgtctcctgtaaatacagcagtgggctggactcaaaatgcctccccactatgtccctgaaagtcatcttagttttctgcatcttccttacagatgactcttctacaaaagtggacattaaggagacctacgaggtggaagccagcactttgtgagtgcacatgccaccaagccctgcggtgggacacgcaccaaatgcgttgtctggtgttgtccaggctgcagccagtcagctcccccatctcagctcaccctcgctaagccatccccagacccactgtacccagcttagtgaatggctgaggcctggctcgccgccctctcctcgtagacttctagagcccttgctgtccctcttgtctctccctgcctaccttcccatggcctcccaagagtgagcttgtaataggcatgttggatggagctgttcccctgcccgagcctgccgaggcgctggccttccagcccatctctgccaccacctggggctctgtagtagttcacccactcgcgctctccattcctgccacctccccaaccctggctccttcccctgcccaacaatgctgcccactgccttgacctgtgtactccctctcttcactcagagcccaactcagagccatgcccccggggagccccaggaccaggccaagctgaccaccctgcatgcccagtcagctctcctctcatcatcatcatcatcacttacattcctctgttcaaggacagggacccacacacacggcatggactaggtttcctgaaacgtgtgtgggatggagggtcggggaagccacccgctcacataccacattctttcgcagctgcttccctgaatctgtggatgtgggtggtgcatcaccccacagcaagaccatcagtgagagcgagctgagcgccagcgccactgagctgctgcaggactacatgctgacggtaggcctccgctgcagggacgctgggctgcatgagggagggggtgccccagggaggatggggggaaggggaggaggaggaggagcagtgcagggcaggctgcagtgagtgaggtcacctagagcactcttggtcaattttgctgacatcactgccttttcctggggatagtctaggagagcatcagtcagtggggctgagttgggagtgctgtggccgtcagggctggactgtgggcctgtgcttgggtcctgggggaggggagggaacggtggcccctgcaaggccacatggccagacatttttatcctccccatcttatatagttctgtcattgcaaactcaagtcttcctgatttgcctgtgtgcctgtgtgtagcctaagggcacaggcattggccccgggccaggttgccaacttccaccctgccctgctggctcctgtccctcccatgcactctgtgttccagctcaggagagtggagctgcccgggtgccttggtctcctctgggtggccccgtgccaggtctggtaggatggggacacattgtggtcattctgatgccccagcctgtgcagaggtgaagccagagacagctggtgctctggctggggttagtggctgtggcaaggtgggcccgactgccgactcttgcctactgtgcccagccccctatctggctctgctctcttgcagctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtgagtgggccctggaaagagggtggcttgtccaaacctggcttggagaggctgatccctcctgggaatgtgcacacggacccctcagtgggtgcagcaggggctccatcagggatgggagatttgaaccagagatggcatgagagcagagtccagagatcggggaatctgctgtgattagtcagaagggcttttcccaggtactgttgggggcccaccgacaggccttcattctcctgggaactcaagctgagctgggtgggccctgccaggaagtagcagagatcccccaggagcagggctgggagtgaacacaaccctgagatttaggaaaacagtgctggaggagccagagaggcatgggttttggtgaatgtgtaggacttcaaggcggaaggaccagcgtttgccaagacccctaaaatgctcggcacattaggtcagtgcggctagagggctgtgtggtctgagcagcagagttggatgttggccccacacctctcaggggcggtgacttagctgtggtttccctctgccgacacttagaacacagcaagtttgcggtaatgtgttgctagtagccagttgaaggcttctgggtcctggcctgttttccctgcaaaccaaggaaggtgggtttgttaaccatcgtaccgacctggcagtggcaaacgtggattgcctgcccagggctccccgctcttaggagcgtgaagggctggaggctggggcagcctgtctgtacaataggttctgtctaagcagtgcctgccccttctgtgctgggccctgcgttgcctcctggcatgggactctgtctgcccctccacatcggggagtagagattctgagagacacactaggcttcccaaataagagggcagccctctgagttgggacagtcacctaggtcatggcagggaaactggactttggcatgaggcctgcctctgaggactgcacccttgttgccgggtgccagcaggtggctttgagcactgctctgggcctcagctttccccactgtaaaatgggtcctttgtgaggactaatagagaatgagaggaggccacaggttcttggcctgtgctggtgccttgaggccagggagtgtgcatgtggcagaggcagtaagctgtcagggccagcagcagtgtctgtcaagagttgaggttttagccaaactgtctggccccaggaagcatgatttcaaccaggatgctagatgcagtgagcatggcatcagggtccccaaggccatgcaccaggggcagctgtggccctgtcagggggctttgagccctgagagaagagctgagtgggctgagccgaactggaggtgccatgctgggtgttgtgtgtctgcaggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagca

SEQ ID NO: 1193 - DNA, 76284 bp, Homo sapiens
ggcgcggccggggcggagacttcgggcccggctggcgggcggcgccgggagcgcgggggcggcgggcccgggtcgagcatgtagcggctgctggcggcggggctcccggggcgggccgggcgggccgcgggagccgcacgcggcgatatggaagaggagggcaagaagggcaagaaggtgagcgtgcgcgggggcgtcctactgctgtggtcggcgggcggctgggttgaggggccagggtggggtgggcgggtgttccttggggcccgggggggggggcagtgggccagctggcggggcggggcggggcagggcgagaccccggacaatggtcaggtgggctttcgcggccgggcgggcaggaagcgccgcgcctttcctctggcccgggcagcggctcgccccgacctcggccccagacggccttccctgcgcgtcgggacctggggctgcagaggaagtgggcccggcgaggggccagaaagctgtccagggctggaactggagctagtgggctgtgtggttaacgtggagacgtttgctgctcactggacttcgtttttggatatccagtaaaagcaagggtggccttcaccttatggccagctcactcgtccactatcactcagacctaaaaccattgattgattttagtgacgctagctacatttggcagtgggatttaggacatagttcatagtcaaaccccagtttatgtagttttacaaaatgtggctttaattacagtaaagggttatagtagtcgataaagaaacattttaagactggaaaaacgatgtggattgaactaccattaaagtggaaaatggattttaataaaatgtatctttttcaaataaatgctttataatcttcacgtcttggctatcattttctttttgatgtgtgtgtgcgcacttttatccacaagtttaaagcagacctcgataattcctaactatgattttactaccctgaactctgcagggaagtgtcctttaattgacagctactcaccaccttgtttgacagagtgccccatttaaaagtcctgtttgaaatagaatgtagccaggtggccttcagggagtcctgtggtgctggttctctactttctcaactcattgtttcatgttagcaccatgcatgtctaatttaggtgcagtataatttgcggttatctacaaagatgttttaagtctggaaaatagctcaagatagtgattcagcctgcaggtgttagattagagatgcgtgctgcgcacagaagagggaggagccaagcagtgtaaaaggagttagctggaaaggagaggtgctaacccggtggctgcttagtagggaccatcaggcccgagtgtggatgatgctgagctttgcggaaagtgagccatgtgctctgtggaatgccgggatccaagagcgcgctaaggactgatgacctcattgtgcaccgcttacaggagtacctggcccatctacctgtgtgtgataggcaaggatggaattgagtgatttttttttctagagctgtctatcagctttggtagaaacatgaaacacccagcaaatagggagagagagagagaagcagtaagactgtttttggggtacaagtgaaaaaacagtaaaattatcaagaattttccagttgggtaatgaaaaaatttaggcataaacaggttaattattaatttcattttctcactagaggagataatcagttgttatgtagttgcttaagccaggggttttgtgttttttctgtattctgccacttgtcttagcttgtttcctgtagacaagccagacaaggagctttggggcatggattcttctccaggtcatgacttaacactacctcgtgtactctgccagttgcaagctggcagaaccttcctgctcagctaccacattcaatgtgagatcacctccagtttaataacttcggtggttaaatcattctcattaaggtaaattgcattgctctaaacttatacacaaattcagacataagtagcagaagtgctgacaatagttttatgaaggtacagtttggacgcttaaattcttctaagttagcttcttcaaaaaatgcagaattaggctgggtatggtagctacgcctgtaatccagcactttgggaggccaaggctcgatcactttagctcaggagttcgagaccagcctgggcaacatggcaaaaccccatctatacaaaaaatacagaaattagccaggcgcggcagcgctcgcctatagtctcagctacttgggaggctgaggcaggaggatcacctgagctcaggtgggccttttttttttttttctttttaatctcagacacttgtcttggtgtctgccaagcagtgattcaggcttttttttacctcggcccattttcctcaggacacaggaatcagtgagttggcagagaacctatggaccaaagtgagtctcacggaaacttggccccagtgtatcactgccctttctcaagtcacctcagcacatgtggtgatgatgactgtacacctgggtttcctcaagtgggccatggttcgtttaacaaatgtctgttgagcccctcttgtgtcccatgaaactcactgggtgatggggatacaggaagagcttgtggcccccaggagctgatggggagatggatcactcatgggtccatctgaaggaatgagtgcattgacagaaaagtcctctggccactaaaggtgtggggcctggggagtagaagtgaccacttggggctgctcttctgtcctgatgtctacagagtgtctactttttagcctacaagttctgttttggggtttggagaataaggctcctacctacggtatggactcatgttctgtgcattgtggcactatgtaattcctttttttttgagatagagtttcgctcttgttgcccaggctggagtgcaatggcacgatctcagctcactgcaacctccgcctcccgggttcaggtgattctcttgcctcagcctcccgagtagctgggattacaggcgtgtgccatcatgcccagctaatttttgtatttttagtagagacggggtttctccatgttggtcaggctagtctcaaactccggatctcaggtgatccacccaccttggcctcccaaggtgctgggtggctgagccaccgcacctgacagtaattcctttttattagaaacttggatgcacttaagttgggttgtgtggatttttatactcagatcacagcccaaaaaagctgtcttgtcagggttgggtgtaggtaatcctaacactttgggaggccgaagcaggcggatcacttgacaccaggagtttgagaccagcctggccagcatggtgaaaccccgtctctactaaaaatacaaaattagctgggcgtggtggcatgtgcctataatcccagttaggaggctgaggcaggagaatctcttgaacccgggaggtggaggttgcagtgagctgagatcatgccactgtactccagcctgggcaacagggcaagactccatctccaaaaaaaaaaaaaaaccatcttgtggccttaaccttgtgggtctcagcttctctgctgcctctggtcttcggttgccccaccaggtggctatgatttcacactgatcaaagttaaatatttttacattcatctagtttatttgcattgtttaaggtagaaaaaggttataggttgagtgtagtggctacgcctgtaatcccagcactttgggagactgaggtgggaggatcacttgagcctaggagtttgagatcagcctggacaatgtagtgagaccctatctctacaaaaaataagaaaattagctgagcatggtggtgcatgcctgtagttccagctacttgggatgctgagaagggaagatcgcttgagccctggaggtcgaggctgcagtgagtgtgattgtgccaccacctgagtgacagcaagaccctgtctcaagaagaaaaagagaaaaaaaaggttataaagttccctagaaatgtaggactagatattaaataataaataaggaattattaattttgttgggtatgataattaagttctgatctgataggcatgtattctgagatatttgtaggtgaaataatatgatttctgggatttgctttactcaaaatagaagaaacaaaggggatagctgaatgctttggtaatggttatatattgttctgtctacttttatgtatttttgagaatttccataataaaaagtggaggggaaaagatcctctaggttacaggccctgaactatcagctgctgtagtcactgctggaccagtgtctgtgaggaactgaaagcttggattggaccagtaccttttaaaatttggtcactgcaggcaccaggaagccataccttctccatgctgacctgatgcagacataaatgtgtgtgtctgtataaccgaagtgaaagtttaaaggaaccacacttaaacgctctgattttttaattctatttttttttctttctattacaactggtggttggccaggtgcggtggctcacactggtaatcccagcactttgggaggctgaggtgggtggatcacctgtcaggagtctgagaccagccatggtgaaaccccatctctactaaaaatacaaaaattagctgagcgtggtggtggggcctgtaatcctagctacttgtgaggctgaggcaggagaattgcttgaactcgggagatggaggttgcagtgagctgagaatgtgccattgcgctccagcctgggcgacaagagtaagactccgtctcaaaaaaaaaaaaaaggctcatggtcatgacccactaaaccgattctataactgtcacaagccatacttgggttcagaaggtgaattggggctgctatattttgttttatttttcctcttgggtagctattgcagtgattcttggatggcaacttggtaactcagggtcaggaggctggagaaccaggcaggaggtgctcagcagagaacctaaggcagccagtaggtgaggccagaatgatcggcaacataaggctggttacttttctgtcttgaagagttaccatttacatagtatgtatttgttaattttcaacatattgtcagattctgtcataatttagattcagaaagcacatcagaaccttccagggctgctctgagcatcctttcagaggaagatagtgtaaagcaaaacgtttctcttagcaatattattgcagtgaagggcttccctgcagacgagaagggcgtctgcagtctgccccactggggcgcttactcttgatcttccagttttttcatttccgtcagcagtgccccctccttgttgtcactttgcagtgtaagtaaatggtcatgattaagtcctataaacctaactattgagcatttaaatcaccctctattgttggtttacgtggtggcgatacaagtttttagtgagataacttggtcatgccttgcctattatgtgcttagcccactgagaagagggttagggacattgcactttggaaagtaggtcacttacacctaaaattagagactaaaggcagacctaggatgtcagaagagacatggggcaggcagcagccacttccagccaggttgagaccgggactgtgtcctgcagttcagaagcagagatgaggtggagaggaccccccagtcctgggaagtccttgggctgggaagttgggtgttggttctgtatgcacttgaagccactggaggtgttccacatcatgcattcacttgtccattaaactattgtttattagcaccaatggtgtcagacacagatgctggagactgaaatgtgtacggtgagcctgtggctgcagagcaggaagtggagcccggggatggatggtgggagcaggctttggtaagagtgatcaggaacacctttatgaaaacttcaaaagcaaatgtaaagaaaaaaaatcatgtaacgaagtcccctgtgcccatgtgtgggcagtcagtttcatgtgcaccttctcctcattcctgcttcctgcctgtgtgggccgaatagtgtcccctcagagtcatgtgctgaagcccctacttccaggacctcaggatgtgactgtatttgaagatggagtctttttttttttatttgtttttattttagacggagtcttgttgctctgtcacccaggctggagtgcagtggtgcaatcttggctcgctgcaagctccgcctcccaggttcccgccattctcctgcctcggcctcctgagtagctaggactacaggtgcccgccaccacacctggctaatttttttgtatttttggtagagatggggtttcaccgtattagccaggatggtctcaatctcctgactccgtgatccacccacctcggcctcccaaagtgctgggattataggcttgagccaccatgcctggcctgaagatggagtctttaaggaggtgattgaggtaaaatgaggtaattgtgtgggccctaatccaatctgatggatgtccttataggaagttattaggacacagagaggaatgatcattggaggactcatggagaaggcagccatctgcaagccaaggagagacctcaggagaaaccaccctgctaaatttaccttgatcttggactttcagcatctagactctaagagaataagtttctattattgaagccactcaagtctataatacttagtcctggcagcccaagaaggctaatgcaccaggtgattttgaagcaaaccctagagttcagtttgtagatagaagtgcagtagtaactcatcaagacagaagagtaacaagccttatgttgctggtcattctggcctcatctgctggctgccttagggtctctggggtgagttctgaggaccaagtctacactgtcaacatggccacggacgagctgctcagagtgacaggacaaccctcactgtgctgtatgtaaaccataaatcacagcacactctttgtggttgggagaacatgtatggtgttttgggagctggcacagtcagggatgtcattcatttcatctgggacaggctttgtgctctgggatctgtggcgggagcagtgagcccagccatgtcctctgcatgcatcgctgtgtccttgtgaacagtggatctttgttagcgcgcttcgcactccttggcttttttatctttcaatcaagaacagcaactgctcttcaaatgattctacaggtatgagggagtttacatttggatttgtcaatggaaccattaggattttttgtttgtttgttttgtaaaaataagaacttttttccttagccttgtgtctgtgccaaaaatgtgacctttttttttctcccaagtgtgcccaaacagtaacaattttttgcttggattatgttaagaattagggcatttgaccataggcattagatgtatgtgcaatgaaagtgatcccctttaataagcataataggaacatggaatttgggcttttgtttgcagcttaggatgatggtgtgtcttgtaacccaaggaggtttttcacttttctgaaagtgagaagactggtcagcctaaacccgtggtgtcactgttcttaagggaaacctagttgaggagtgggagataaccatttcacatgttgtttttgtaccttggagaaaaaaaagagagaagcctttatttaaatctttatgtctattctatagtttaaaattccatacaggtttttttcaaaaaatcaaatttgcttcctgtgtgttgtcaccatgagctctctggtcaggtgtggaaactgaaatgtttcccttgttggtttatgtggtggggtacatttttttttttttttttttttgaggtggagtcttgctctgctgcccaggctggagtgcagttgcatgacctcagctcactgcaggctccgcctcctgggttcaagcaattctgcctcagcctcccaagtagctgggactataggtgcgtgttcccatgcccggctaatttttttatttttggtagagatggggtttccccatgttggcaagaatggtcttgatctcttgacctcatgatccacccgcctcgtcctcccgaagtcctgaccaatgtgtgcctctgtgtgccaccgtgcctggccaagggtacatgttctttttttttttttttttttttttttttgagacagttttgctcttgcccaggctggagtgcagtggcgcgatctcggctcaccacaacctctacctcccaggttcaagcgattctcctgcctcagccttcccaagtagctgggattacaggcatgcgccaccaagtccggctaattttgtatttttagtagagacggggtttctccatgtgggtcagactggtctcaaactcccaacctcaggtgatccacctacctcggcctcccaaagtactgggattacaggcgtgagccaccgcacccggccaagggtacatgttcttaatgagatgccttggtcaggtctaagtgtcagttatggtgcatgttgattttctgtcagatgtctgaaaatgccctagatatgattatgtctagctaatttattactgccattagatacatcacctttacatagcttttacttttcatgctactgggtatagacaataaccatagcccacctgcctgtgcacttctaatatcaggctgagttcaagttcctttctaaggctccccctctcacttagtattgtccgtctttcttgaaagaggtatgtgcagcctccgtgtttgctttttccagcacattcttccaccctcagcattttatgatgaaaatttttgggacaggcacggtgctcacgcctctaatcccagcactttagaaggccaaggcaggcagatcacctgagatcagaagttcaagaccagcctggccaacatggcgaaatgctatctctacaaaaatacaaaaataagcagggcatggtggtgtgtgcctgtaatcccagctactccagaggctgaggcaggagaatcgcttgaacccgggaggcagaggttgctgtgagccaagattgcgccattgcactccagcctgggcgacagagggagcctctgtctcaaaaaaaaaaaaaaaaaaaaaatttttgagtacaccaaagttgaaagaattttgcagtgaatacttgcacctagattctgccactaacgttggctatacttgttttttttttttttttttttgagacggagtctcactctgtcacctaggatggagtgcaatggcgtgatttcggctcattgcaacctccgcctcctttgttcaagcgattctcctgcctcagcctccccagcagctgggattacaggcatgtgccatcacgcctggctaagtttttgtatttagtagagatagggtttcaccatgttggtggggctggtctagaactcctgacctcagatgatccgcccacctcggcctcccaaagtgctgggattacactcatgagccaccctgcctggcctggctatacttgttttatcccatatctagcatttgtttatcactgtacctgcccatcaactcattttatttttctgatgcattcctcaataaattgcagacattgtttcactttgatctaaatacattagcatgcatgtcattaactagggttcaatatttgcttacagttttcttttgatgtaaaattatgtaacaatgaaatacacactttttttttttttttaaacagggtctcactctgtcacagaggctggagtgccgtggtgcaatcatggcacactgcagccttgacttcccagactcaagtgatcctcccgccccagtctcctcagtagctaggactaaatgggtttgtcaccatgcccagctaattttttttattttttgtagagacgaggtctcactgtgttgcccaggctggtcttgaattcctgggcttaagcaatccttctgtctcggcctgccaaagtgttggtattacaggcgtgagccactgctcctggccaaataatacacatcttcagtgaatattagctaaattttgacaaatgcatactcctacgtaactgaaacccctactaagaaataaaatattacctaccatcactgagaaaattcccttatgccccttagaaagtccttcccccaaggtagtactgttctgatttttttccaccataggttaattttgttcattctagaacttcatacagatggattcatacagtatacattgtgttgtgcagggatcactgtactcagcataatgtttttgagatttatccatatattgctgcatgtttcagttgctgagtaatattttgttgtatgtttatgctgtgatttgtttattcatttgttggagatttagtttctttctagtttgtgtatatatatatatatttttttgagatggagttttgctcttgtcgcacagactggaatgcaatggtgtgatctcagctcactgtaacctctgcctcctgggttcaagtgattctcctgcctcagcctcctgagtaggtgggattataggtgcccgccacgatgcctggctaatttttgtatttttagtagagatggggtttcaccatgttggccaggctggtctcgaacccctgacctcaggtgatacacttgccacggcctcccagtctactttgtattttgaaaaagctgctgtgaacatttgtgaatgagtcattatgtgaacatgttttcatttattttgggtaaatacctaataatggaattgctgaattttatgggaactatatgtttaactttataagacactgccaaactttctgctaaatttttgtctcctaattctttgtttttttctctttccagagacagggtctcattctgtaacccaggctggagtgtagtggtgcaatcagagctcagtataacctcaaactcctgcagttctcatgcctcaacctcccaagtagttaggacgataggtgtgtgccactatgcccagctaaattttttttttttttgagacggagtctcactcttgttgcccaggttggagtgcaatggtgcgatctcagctcactgcagcctctgcctcccaagttctagttattctcatgcctcagcctccctggtagctgggattacaggtgcccgccaccacacccggctaatttttgtatttttagtagagatggggtttcaccatgttggccgggctcctctcgaactcctgacctcaggtgatccagctgccttggcctcccaaagtgctgggattataggtgtgagccactgtacccagctgggctaatttttaaaaatttttatttttatgttttattttttaatggttgctttatttatttatttatttactgagatggagtctcactctgttgcccaggctggggtgcagtggcgtgatcttggctcactgcaacctctgcctcctggtttcaatcaattctcctacctcagcctcccaagtagctgagattactggtgcccaccactatgcctggctaatttttgtatttttagtagaggtgaggtttcaatatgttggccaggatgatctcaaattcttgatctcaagtgatctgcctgccttggcctctctaaaagtgctgagattataggtgtaagccatcgtgccctgccctggctaactttttaaaaagtttttgtagagtatcagtattttagtatgttgtccagggtggtcttggacacctggcctaaagccaccttggcctcccaaagtgctgggattacaggcatgagccactgcatccagctaatcctgtcagttattgagagagagggtgttaagttctctagttattattttggatttgtttttccctttagttagttttggcttcatgtattttgaagctctgttgttaagtacatacacatttaggatcataatatcttttttttttttttttttttgagatggtagtctttctctcttacccaggctgcagtgtagtgctacgatcttggctaactgcaacctccacctcctgggttcaagtgattctcctgtctcagccttctgagtagctggaattacaggcatgcaccaccatgcccaggtaatttttgtatttttagtagagacggggttttgccatgttagccagcctggtcttgaactcctgacctcaggtgatccacccgcctcggcctcccaaagtgctgggattacaggtgtgagccactgctcccagcccataatgtcttgttgaaatgaatctttttcattatgacatgaccatctttatttctagtaagacttcttgtcccaatctcttgtctgatattaatatagctacaccacattctttttttgccttagggactttagcaactgccgaagagtctcgctctgtcgccgaggctggagagcagtagtatgatcataactcactgcagccttgaactcctgggctcaagtgatcttctgcctcagcctcccaggtagctgggagtacaggtgtgcgccaccatgcctggctaatttttttttttttagagatggggtctcactatgttgcccaggtcgtctcaaactcctggcctcagtgatcctcttcagcctcccgagaagctggggttacggccttgagccagccacacctggctaccccactttcttatgctgcatgtttgcatggtgtgtgtctttcaacaagtctggagttttaaactgcatgctttataaagagcattttgttacagcttgcttttttatctagtctgatagtttctgccttttaattgtgaagtttacataattgatgtcattatgtttaagtctatcattttgatatttgttttctctttccctttgtgctttcttcctttgtttctcctttttgattatttttaactctgttctattgctactggcttttttgctgtaactcctctatatattgctatatatatccatgtcttgtcacagattaccatccattaatatcatttctttcttgtacactgtaagaacctatcagcagtatcattccatttgtactccctcctgttttttgcaaactttttggcatatattttctttctatacgtgttataaatcttacattagattttttttttgctttaaacaatcgacttttcacctttttatattgaaatgatttaattatatatacgtagtagacttaaagcacacagagtatatacagagtacacagagccctcatacgccttccacccagatccctcaagtgttaacatttctgaaccattaagaataagctgtagacataatgccccatgaccctttaacacttcaactgtaccttccttggtacaaggacactctaaccacaccattctgacatcattaaaatcaggaaattgacatccatttgatcttgctacgtaattcatgaccccacccagacttgctgattgttatgatactttctttatatagctctaggatccatagattttatagattcaggatcatgtgttgcatttggtttgcatgtctctttaggctctttgaacttgaaatggttcctagtcttttcttgtctctgatgattgatatttttgaagattacagatcagttagtaggatgtctctcagttgggtctgttttttcctcatgagtttatgtgtttttgataggactgccacacagatgatgtattcttctcattgcatcatatcagggaaaataatgtcgatttgtcccatgttggtgatgttaactgtggttacttggttaagatagtcttgccaagtttcttcattttaaagttcttatttattcttattttacttacaagactgtagttctctagtatccttatttattttgaagctcaaattgtcccaaactcagccagtgggaagcactttaagctggctctggtctcttatttgtatttttatttattttaattattattactttttttgagatggtgtcttactctgttgcccaggccggagtgcagtggcacaatcttggctcattgcaacctctgcctcccaggttcaagcgattcttctgcctcagcctcccgagcagctgggatttcaggtgcctgccacccatacccggctaatttttgtatttttagtagagacagggtttcaccattttggccaggctggtctcgaactcctgacctcgtgatccgcccacctcggcctcccaaagtgctgggattacaggcatgaaccaccgcgcccggcctattttaatttttaattgcagtaaaaaagcaaacgcataacaaaatttactatcttaaccttttaattttggccatgttgcccacgctagtcttgaactcctgggctcaagctgtcctcccacctctgcctcccaaagtgctggaattacagggctgagctacaactcctggccagtcttaacctttttttttttttttttgagatggagtcttgctttatcacccaggctggagtgcaatggcgccatcttggctcactccaacctccacctcctgggtttaagcgattctcctgcttcagcctccccagtagctgggatcacaggcgtgcaccaccaagcctgtctaatttttgaatttttattagagacggggtttcgtcatgttggccaggctgactgtgaactcctgacatcggctgatcggcccacctcagcctcccaaagtgctggaatttcaggcgtgagccaccatgcccggccagtcttaaccatttttaagtgtacagttcaatagcaccaagaatattcatgttgtgcatctggcatctttttgacaagcccttgtctttctttaaacactttcttacatttgctaaaacaagatgtttcagctaatcttgttctttcctgtcccagccctggaaccagacagtcgtccaaggagtcctccttgcttttagtggaaatggtatttggaaaccaaatagctctttttctggatctatttatgtattaaacattagagttcacactgatacctctaattccagtccatgacacagaatttattccagtcatacccctttccacatttataccttgcttttccaacagtgagaaatctggttcctgttttcttcagtgtatttgcttttttgctcagtctccccataggttaacactcctagctgtgctaggcaaactcagctgaagacatgctgctgttccctccccacagtttgctgttggggatgctgtcctaaagctgaactaagaaatattcccttccccttccccttcctggattcactggccaaaagcttgggtttgatgaaagggagggggaggtgaggatgaaaaaagggtaaaggtcagttacacagctcagccctgaccaacatgttcctgtgccttgctgaacacattggcttaagctgggccctgggtatctcagttttccccatgtcttgcatgttgaggcagagttggtcccagacatgccttctctaatcctatggcatgtgtgccagtccagaggtggcccaggacgtcctggttccttaagcgtggccctgatgaaggggaagggatagtgagaagacacaggataaaaagccagttagagagctcatctctggacatgcttcccgtcttgtccttgacatgcatgctgacccactgctgggccttgggcattctgcccttttcagcttgacagactgatgctgcccccacctccccatccgaaagccatgatttgacatttttaaaagaccgaagaaaagaaagaaaatttatcttttctgtttatccctccttttatcatttttagcacttttatttcctctggaaaatttccatctggaataatttacctttggccttgtcaacttaaaaattcaagaaatgtacatatttggaaaggatactttatttcttacaaagagttgcaacctgtaggctggccatcccacaggctgggaagcgtagcctttggcagagcctgaaaggtaggcacttcagaggaggaggggttggaacaggaatttgtgctgaatgggtttgtgctgaccaagtatatacatattcaacaggttataggaggagttatgaatattcatggagggggtcctgatgcatgtgtactgaacagacatgcaatttattttattttatttattttttttgagacagtttcactcttgttgcccaggctggagtgcaatggcgcgatcttggctcactgcaacctctgcctcccgggttcaagcgattctcctgtctcagcctcctgagtagctgggattactggcgcatgccaccaggcctggctaatttttgtatttttagtagagacggggtttcattatattggtcaggctggtcttgaactcctgacctcaggtgatccacccgcctcagcctcccaaagtgctggattacaggcatgagccactgtgcctggcccaaacatgcatcttttttttttgagatggagtcttgctctgttgcccaggctggagtgcagtggcgcgatcctggctcactgcaacctccgcctcccaggttcaagcgattctcctgcctcagcctcccaagtagctgggattacaggcgcctaccaccacgcctggctaatttttgtatttttggtagagacagggtttcaccatgttgaccaggctgatctctaactcctggcctcaagtgatctgactgtctcggccttccaaagtgctaggattacaggcgtgagccacctcgcttggctaattttttttgtatttttaggagcgacagggtttcaccatgttagccaggatggtctcgatctcctgacctcgtgatccacctgcctcggcctcccaaagtgctgagattacaggcgtgagccactgcatctggcccaaacattcatttttaaaagaacttttaggttcaggggtacatgtgcaggtttgttatataggtaaacatctgtcatggggatttggtgtatagattatttcatcacccaggtactaagcgtagtatctgacagttattttttccagacaggcatgttctttgcattccatgttcactttgaggtggagacaacattatattcaggccccatacctcaaaaggtgaagcaaggagacagggcactcaagtgcacagcctctataaactggctagaaccagtctgtggctggtggtcttcttgtcaggagagagttactgaagtcagtctcttatacagtcacagctatagttttggcttgtggaacaggaggtcagttggcatctggtggtgagttgcagttgttttcctattgcttatccaggacagtgcttgtttggctgctagagaaaaagaagaaccctgtggcagttagaacagagttgatcttgaagagtcagactgtgtggctgaatccttacctggcacggtcgtaggtcttgtttataatttggtgtctttttttccccatgatcttcatgaacgcatgtaatttggtattttattgccacagagtccattctgtcagttttgtggtctctattttaacattaatgctggtcagttgtgcctgaactacaaaagggagggaatataatgaggtgcgtcccaaggcatcttgtcatggctggaaccaaaacaggctttgttcagtcagttggagtgcttaggattttatttttagttcttagcctgaagaccttgcttagaatttttcatggtgtaggtctgacacattgtttcaccttttattatctgaaaataccttcatttcatcttcatttttgaaggatagttttacagcagcagtccccaacctttttgacaccagggaccggtttcgtggcagacagtttttccatagaccaaagtggggaaaaggttttgggatgaaacttccatatcagatcatcaggcattagattctctaaggagtgcgtaacctagatccctccaacacacagttcagggtttgtactcttatgagaatctaatgcagccactgatctcacaggaggcggggctcaggtggtaatgcttgctggccctccactcacctcctgctgtgtgcggcctggctcctaacaggccacggacccagaccagtctgtggcctgggggctggggacctctgttttacaggatatagaattctaggttgactgttttctttcagcattttttattatttatttatttatttattttgagatagagtctcgctttgtcacccaggctggagtgcagtggcgtgatcttgctcactgcaacctccacctcctgggttcaagtgattcttttgccttagcctcctgggtagctgtgattataggcacataccaccacgcccagctaatttttttttgtatttttagcagagatggggtttcaccatgttgatggggctggtcttcaactcctgacctccagtgatctgcctgcctgagcctcccaaggcgtgagccaccatgcccagcttcttttggcattttaaagatgaagactcattatcttctggcatccattttttctcttgagaagttacctgtcatttttgttgtactgaatgtcttttatttgacagttttaagaatttcttttttttttttttgagatggagtcttactctgtcgccaggctggagtgcagtagcgcaatctcagcttactgcaacctctgcctcccagattcaagtgattctcctgcatcagcctcccaagtagctgggattacaggcatgcaccaccatgccaggctaatttttgtatttttaatagaaatgtggttttgccatgttgaccaggctggtctcgaactcctgacctcagatgatctgcctgcctcggcctcccaaagtgttgggattataggcgtgagccactgcgcctggccttttttttttttttttttttttgagacagggtctcactctgttggccaggctggagtgctgtggcgtgatctcggctcactgcaaccttgcaacctccgcctcccgggttcaagtgattctcctgcctcagcctcctgagtagccgggactacaggcatgcaccactgtgcccggctaatgaaaaaagttttttaaatatagatggaatctcagtatgttgctcaggctggtcttgaactcctggcctcaagccatcctcctgcttccgcctcctgggattacaggaatgagccaccgcacctggctgggttttatactttggtttggtagatcagttttgatctttgtccttactcttagggtaaatttcttagtcctggaatgtatgttttactcctaagatgtggcctttgtggggtttcaaatggatagtctcaagtgtttaaggtactgattaagcccctttaacttggcaggacttggactccaaactcttatctaccctgcagctagggagagctaaaatctcagctttttttttgagacggatcttgctctgttacccaggttagagtgcaatggtgtgatcatagtttactgtgaccttaaacttctgggctcaagcaattctcctaccttagcctcccaagtaggtaggactacaggcatgcactatctggctaatttttatttttgtagaaatggggtctcactatgttgcccaggctggtttcaaactcctgaactcaagtgatcttcctgccttggccgcccaaagtgctgggattataggcatgagctcccgcacccagccatcagcttgctccttcaaccttcaagctatcgtgtcctttctgggcttgtgggagtctcacctccgcttacgcagttcagggttcagccaaagatttgaggggaccttatactcagactttgggttccttttttagtgggttcctcctttcctatatttccctctcaatttccagcttctttagcagtctcaaatcctcctttaacctgtcaggccaataaaattgcagcttttttttctctgctccactcctctgagactggggcatactctcaggagtaaagcaatataaaagtggatcttgcccagtgatgttcccttctttcaagggtcatataaattccaagcttcttttttatttcttgtttgtctccagtgtctttagaagattgtttttcacattttatctagagttcataatctcggtctgtgagaaagttattttgatacagtctacttctctcttaagggaataagaacttctttgggtttattttttcttgacagtgtgttttggagctctttcattatagatatatagtttctttattcttctttagggtggaatggcatttttatctgtgggctactgtatttaaacagcagccctcctatggacttttaggttgtcattttgcttaaaaaataatgaagcaattaattttctaacctgtcatgtatgtaatgcatctgtaggattaattcccgaaaatgcacttgctgggaaacataagtgcatttgtaattttagtagatgttaacaaattgttttgtatggtagaaccaaggtttattctttttttctttacccacctctcaagagaacagtttttattaggtgaaagtggtatttgctaaaaattttgagtattttccaaaatgaacttgttaagttttcttactaaaaaatacatttgtatctcagaagaaagtagcaaaatatattatatgaaaaaaatcacacccactagaaacaactgttattagtctttcacgttgctttcctgtttgtgtatgcttttctgtgttagcagtaataatacagtcttattaccttggtatttatttcaaacacttgcttagtgcccactgtgtaaagagctttctggggagctgtcactgcctgcctgaatctccctcactgtctgagggtggtcttagtgctcatgaggtcgagaatatcgagtgctgtgtcagaagggcagaggtcaggtggatttaaagctgttgcaccaaagccaggtgtggcgacatgcctgtagtcccagcctactcatgaggctgaggtgggaggatggcttgagcctaggagttagagaatgcagtgagccatgattgtgccactgcactgcagcctgggtaatagagcaagaccctgtctctaaaaaataaaaaaaataataaataggctggcacggtggctcacgcctgtaatctcagcactttgggaggccgaggcgggcggatcacctgaggtcaggagttcaagaccagcctggccaacatggtaaaacccccgactctactaaaaatacaaaaattagccaggcatggtgacacatgcctgtaatcccagctactcgggaggctgagacagggagaattgcttgaacccggaaggtagagttgcagtgagctgagatcgcgccactgcactccaatctgggcgacagagcgaggctctttctcaaaaaaaaaaaataaaataaaataaataataaataaataaaactatgcatcaagcaccatctccctgtcccctgggtatgcctttggaagtgcagtttgcagagtgagtgagatgaggcaggggagtaggaggaggagctgaggaggagaatggggcaggggaagatgagacagggaggaggaggaggggaggagaggggaagggatgagagagggaaggaaggtggagtcattgttcctgctgttgccttgcgtggctgtgacagctgttgaagctgtcttctcacagttttgcacactgtgggttatgattcattagtggcatgtgaaatcaaccatgtaggtagcaacctttttttcatgtaagaatttaaaggatacaagtataaagttaaagaacttaaggaaaaattttgctagattcattttgaattagagctgtcacgtatttcttagctatctgcatggaaaacacctagaagcaatgacagtccaatagcagtggagcacacctaggactttattgtagtctgaattgtatgtcaagtagtgtggttacagtaagtgaggggatgtagctttttgccacaaaatctgtactttggaaggtgaatgtgaagcaatgagaacaaatggagattattaatctgtgctgtggttggcgttcagaattaggccacattttagtatgtttcatgtggggatcattatttttttttggaccagctttttttttttttttttttttttttttttgagatggagtcttgctctgttgcccaggctagagtggagtgcagtggtgcgatctcggttcactgcaaactccgcctcccgggttcacgccattctcctgtctcagcctcccgagtagctgggactacaggcgcccaccaccgtgcccggctaattttttgtatttttagtagagacggggtttcaccgtgttagccaggatggtctccatctcctgacctcgtcatccgcccgcctcggcctcccaaagtgctgggattacaggcatgagccaccgtgcctggccttttctttagagtttctgatgaattgcttttcttttttctttcaaaagaaacattaaattttaaaaaatttcagtagcttttggggtacaagtggtttttggttacatgggtgaattgtatagtgatgaagtctggcttttattttattttttgagacggagtctcattctgttggccaggctggagtgcagtggtgcgatctcggctcactgcaacctctgcctcccgacctcaagcgattctcctacctcagcctctcgagtagctgggattacaggtgcccaccaccacgcctggctaatttttatatttttagtagagacggggtttcaccatgttgaccaggttggtctcgaactcctgagctcaagtgatccaccagcctcggcctcccaaagtgctgggattacaggcatgagccacctcaccctgcaagtctgggcttttagtgtacccatcacccaaaaagcgtacattgtatccagtaggtaatttttcatctctcacctccctcccactttctccctttctaagtctccagtgtccattatatcactctgtgtgcctttgtgtagccatagtttagctcccacttataagtgagagaaccatgcccggcccagacttctttttttaaatgttctaataaaactttatttacggctgggtgcagtggctcacacctgtaatcccagcactttgggaggctgaggagggtggatcacctgaggtcaggagttcgagaccagcctggccaacatggcgaagccccatctctactaaaaatacaaaaattagccgggtgtggtgttgcgcgtctgtaatcccagttacttggaagcctgaggcgggagaatcgcttgaacttgggaggtggaggttgcagtgagctgagatcgtgccactggactccagcctggatgacagagtgagactccgtctcaaaaaacaaaactaacaaaaacaacaacaaaacacaagaaaaccccactttatttacaaaaacaggtggcttgcctgtgtggtagagtttactcagcctttttctagagaatgccttgttattgtgaatgagattcagttttattatggtaggcagtgagattactgggaaatctttttttttttttttttgtcgtgtgcatctttgtttagtcattattttgatagctctgtatcagttttttttttttttttttttttttttttttttttttttatgagacagagttttgctcttgttgcccaggctggagtgcaatggcacaatcttggctcactgcaacctctgcctcccaggttcaagtgatcctcctgcctcagtctccgtagtagctggggttacagacatgtgccaccacgccctgctaattttgtatttttagtagagttgggggtttctccatgctggtcaggctggtctcgaattcccgacatcaggtgatcctcctgccttggcctcccaaagtgctgggattacaggcatgagccaccgcacccggcctctgtatcagttttgaatttagttctgggtgttttccttacacctaaagtgtggactttttggatttctactgagtagccagttcagcaaagtctcttcagctgattataatgttcaggaaagactcttcagctgataataacttctggcatcaccattcagcagtcagtcaaacattaaatgattacctgtaggcattgtggagtttcatctctgcatgtccaggccagcccttagtcaaggcccaagaaacatgtttttatcgtcaagaacttctaggctcttagtttacataatggaatcttacagattttcctttgtttgcttgctgaacactgtcattgtcaccctgggatttcttttctctgcttcctgggttggttccactgtttcttggagtccacatctttttctctcttggatgatcctcgttttgctgggagtagatcctctagtatgtttttcaaaagggggtttttagagtgtaaagatcccaaggcactgcaggtgtgaaaataactattttgcaccttgattgacagtttggttttaaattaacttccagatttaaattaatttccacacagaattttaaagggattaccatattcccatttatcaggatacatctgatgctgatctgagtcttactgcttttacaggtacttttttttgcattttcttattggaaacctaagattctcttgaaattctgcagttttgtgaagatgagtctaaatgttgagggtttgtctcttacattcagcctacttgttactgtgctttttctgtccataaaattgagttcatcgttgttgtcttctgatatttgtgtccctctttgattctgcctgctcttattctcctcttaggaaactgttagactcgatggacccagcttctgtggcctttaatttttctcatgttaaactttttaccttttcactttatgttctaagacagggttggcaaacttcatgtaaaggaccagacagtaaatatttcaggctgtgtgggccagggggcaaaattgaggccattaagtaggtacttatataagagagaaagcaaattttcgtaaatttttttattgatgaaattcaaggtataataattgagtacaattttttgtaatatggttctactactgagaatggaattctttttgggggctaacattttgcttaatcagggttcaaagttggtgattccctttatcgaattggtggcaaatgttcatctgtaaaacatttgcagctgtggccatcagcagcaggcaggcattggccaaccccgcagttctccttcacatcattctttgggctctccgctatgtccttgttattattctacgaattttttattttggcagtcatatttgtaatttctaagatatatttcttgttctctgttctctctttttcttttttttttttttttgagatggagtttcactcttgttgcccaggctggagtgcaatggcgtgatctcacctcaccgcaacctccgcctcctgggttcaagtgattctcgtgcttcagcctcccgaatagctgggattaacaggcatgcgccatcacgcccagctaattttgtgtttttggtagagacggggtttctccatattggtcagtctggtctcaaacttctaacctcaggtgatctgcccacctcagccttccaaaacgctgggattacaggcgggagccactgcacccggccgttttctctttttcatagctatctagtcttattttatggatgcagttcttctcaagtgtctctaagtatactagctagaatgtaggttcctgtgcctgtctcttcccatttgttctttggcttttctctctcatgctgaccgtggggatcactgtgtttgtgagggaaggttggggttgactagtgttcagagcatgtgggttttctttttagtcatgtctatttccctggaatccttcccctccctgcagtagccaaaatagaggtgaggctgctcagctgagtggcacctctttctgtatctccctcctggtttgcctttttccctttgagcctacctgaaggtcagggtcagctggttctgccctgtataggcaacttttaggaaggagcaatctgaaattgtgactctactctggtttttaaagacagaaagtgacagtccagttaataccggatattgactcaaatctagttctgatgctgcttttccaactttatgacagtttctacatctgtggtatatggaataataattgaagcactaaattttattctgaagcaatcagtctttttggaatcaggaaatattaaactttatttgttacaggttaatgaaatagaattgtatgaaagtaccatttttatagccaaaacactgttgaaaatcagcactttgatttggttcaacctaatatttaaaaaattatattgtaattgttatgtttatttattgatctgtgaatatagtcactctaaccagatttttttttttttttttttttttgagatggagtctcactctgttacccaggctggagtgcaatggtgctatcttttcttactggaacctctgcctcccaggttcaagcgattctcctgcctcagcctcccaagtagctgggataacaggtgcccatcaccacgcccggctaatttttctactttcagtagagacggggtttcaccgtgttggccaggctggtgtcgaacttcttacctcaggtgatccacctgcctcagccttctaaagtgctgggattacagacatgagccaccgcacccagccaaccagaatatttaattaagtagccctccctatttgcaagccattctggaattatcagagttctaagagccttcaccagcaacagatccaacttctgcttttctagattaggaaatttgccttgaagaagtgagcttggccagaggcacgctgtttaatttcaaagtgctgctgactcaaactcatgagtcctggaggcaggtagaggcacttgtaggctgaggacccgtagagcccggtgtgccctgcccaagccccacctgggaatggagttatctctgtaaagatcttgctgcctttgagcaagcactgcaaatggggtaactggaacagccttgtcgcgtgtttccacccttcgtatgaggcaggtaccatgggtcttcaccaacagcacggcctgttgtctccaggaaatggtagcccctcacagtgctttctgtctgcttgtttagctttggcatttgaatgtgcagaatggtggactttgaaattaatgtccttctgttgactgcagaatttctgctggaaatgcagggaggctgcttgtggggttcgcgtgctgtgggaagtagggaaaatgagctggtttactttgtgtctttttgtgcatgcagactgtttggattttgccaacagtttctgggtgctgcctgctttttaaacttttaaaaaattgtaaacagcttcagtggctttgcagaaggaagctgtggtttctggtcttcctgttcagtcatgtttttttcagagggagggctaacatctggccatatttttcaacaaattcagaagtgagtagagaatgcatagtagctgtcggcagaggaggaaccagaatctctccaaagaaattcctcaaacagaatttcacacagggtattccatggagaatgaggtaggtgcaagtccagtgtggaaagcgccatttagaatgatgatggtgtgagtcccttgtgggtggctttcatggctgcttcccagggcttgcccattgtgagctagggtagcccagtctccatgacccctgctttgggaggatggggtgggtggagggttcatttgctggcttcctggtctgagaccctgtggcaaggggcgtgtatggagaagtgccgttccacccaggtggggagtataggttgttggattcatccatcttgactcaaggaagaagaagccacaggttttacatcttccacggagaagtaattttcctatggatttgtggtcgggacccaagagcctggttgaaaaatgatgtagggagatggccaagcaagagagcacccaaagctggaatttcatccacgaagcctgcaacactagtggggttctgcttgagactccaccagcatggatcctggccaccgccagtgtggcctcctgtgggcactaaggtgcctatgcctttctcactgaagcaaacaggcggtagtgggcagagctctggttccccttgaaattcgctctgtcagccgggtacagtggcttatgcctgtaatcctagcactttgggaggtggaggtgggtggatcaggaggtcaggagatcaagaccattctgactaacatggtgaaaccccgtctatactaaaaatacaaaaaaattgccgggtgtggcggcacgcacctgtaatcccagctatttgggaggctgaggcaggagaatcacttgaacccgggaggtggaggttgcagtcagccgagattgcgccactgcactccagcctgggtgacagagtgaaactccggctcaaaaaaaaagaaaagaaagaaattagccgtgtcctgagatgcgggtgcacaccggctgtgtcatacttatcatttagacctctccagcaccgaggaaaggtcctttttccattggtaggcaccaaagcacttaaaaaaaaaaaaagctaatctgtcaactgacactgcagggagtgctggaagtttgtggaaattcacataggcaggggtgcaatgtgggtgtccacagaggagttctttgtcatggagcttgtaggaggggatttgtcgtagtgcctcggatgtgcaccttaggcagtgtgatttatgaggatggcaggtgtctctctgggactatagcctatcactgtccagctggacagaatcatcgctccaggttccactgtcttctcagacccaggcactgagtttggtgcctcttccagtcattttccctcattcctgctgggccctcatgtggctgtgcagttgcggtttgtctgtctccctctttagactgggggttccctgggggcagggacggtggcttctacagccccagtgtctggcgcatagtgaatactcatgagatgtactgaatgttggccttaaggatacctaggcctttttataatactttaaacatctttgttcagaggcggttttgttttattagataaaacccaccttgtagtttattcataagggttaaataatttgcgcaaatgaaaatgcctgaaccctgtagcagagacatgctgggtactgctcagtgtgactaagtgttcttctctttcttccttcatagactttttagcactttctccagagtaatactgagctcaatgttttgcatggagaatgcagctagaaggtatagccatactatttactttggtccccaagtagaggccactgtttcatgagtctgcttttgctggttcttttagtggattcatttctccttgtaaattaataaacaggtgccctgacttataagttagtttctgagaatttgttgagcagatccagttactccagatcctgttcacccaagtgagctgataatgttgagcttcagatttaacaaaactcaagacccgcagttggcatctgagggccagccttgcccagagcctgagccttggctttgtgtgaggagggcattctcactaggtaagccctagtaggccagatttagttttagttttttaactcagaagtacattttaggtttccaactttaagagttgttttaagcttaagacgttaactttgtaagaatttgtaaggatctaggcatcttccagagtgagtttagaaagttctgtatagttatctgaggtggcatatattccatatggatgtctttgcacagcgctgcatggtgactcagagccctgtgttccctcctcctggctccgtactgtggactctggcaggtcccttcgaccctcacagcctcagtttcttcaggagagacttaggctgggatagactccacacctcactttggtgctgggactccactcatggaagagaaatagcacttagcctggtttccttctggggactgaattggtcctttggtctctgaggttcaaaggtgacaagatcatttagtggtgatgaacaggcatactcaatcaaatacatgttgaatgaagaatggttgcctgggctaatcccaccttttaaattctatgtgtccatctatagtacattctagtgagttaaagaacccatgatggtttactggaatcctgattctgtacattaaaaatatgctaaaccatttaattatttccctcgttccttccagacagggtctcactctgtttcctaggctgggtgcagtggtgtgatcacaactcactgcagcctcaacctcccaagctcaagtgatcctcccacctcagcctcctgagtgcctggaactacaggctaatttttaatattttttagagacaggtctcgctatgttgtccaggctggtcttgaactcctggcctcaagcgatcctcttgctttggcctcccaaagtgttggaattacaggtgtgagccactgtgcctgccctcaatttattttatttatttttttcttgagacggagtctcactctgtcacccaggctggagtgcagtggcgtgatcttggcttactgcaactgctacctcccaggttcaagcaattctcctgcctcagcctcccgagtagctgggactacaggtgtgcaccaccatgcccggctaatttttgtatttttagtagagacggggtttcaccatgttggccagggtggtcttgaacatctgacctcaggtgatccacctgccttagcctcccaaagtggtgtgattacaggcgtgagtcattgcacctggcctcgatttattttttaactagaactttcctttaaatttattttctttctttttttagatttaaagagaacagggccttgcccaggtgcagtggcttacacctgtaatcccagcactttgggaggccgaggtgggtagatcacttgaggtcaggagtttgagaccagcctggccaacatggtgaaaccccatctctataaaaatacaaaaattagccaggtgtggtggtgcacacctgtaatcccagatactcgggaggctgaggcaggagaatcgcttgagcccgggaggtggaggttgcagtgagccgagatcacaccactgtactccagcctgggctgtatagtgagactccaggtcaaaaaaaaaaaaaaaaaaaagagggccttgcttagtcacttaggctggagtgcagcgggcagtcatagcccactgcagctttgagctcctgggttcaagtgattctctccccccagtctttcaggtagctaggactacagacgtatgccaccacgctcagcttttttctttttaattaataattattatttgttttgagatggtcttgctctgtcacccaggctggagtgcagtggtgtgatcacagctcactgcagccttgacttcctaggctcaagtgatcctcccacttcagcctcccaagtagctgtgactacaggtgtgtgccaccatgtcctgctaatttttatgttctaatttttgtattttttttaaaagatgaggtctcaccctgttgcccaggctggtcttgaagtcctgactctagtgatcctcccatcttggcctcccaaagtgttgggattacaggtgtgagccactgcgcccagccatcagcttaaattttgtgttcaaaagcaacttcttttccaaaaatctgaggtggcttcttgttcagttttgtatctggaatagcagagagctcttccccagcaccggctgtccctcctaccaccccctgcagctgagagctgagcaaacattacctctgaaaagccccatcatcctcagcgagaacagcagctaccctgcattccgtgctgaatgggtaggagtggcagagggaggctgcagcagatgtgcaaagatgcatttctttacttaatagtgttaatattccactttctaggaaggcttacccatcaattaaaattatttgagacattaaaaaaagaaacttagggtagctgctattgaagactaaggactagggccagagagacgcctgcctccaagtagtccacagaatctgcttgttaaaatgttcgtgatttggaggcccaggtagaaggggcaggttcctctgaagcgccttggcatgccctatctttggcgttccggggtcgccctcctctgctagtctgtgagcagtcagaaggttgtatctcctgttcattcctctccttgtctcttgctgctcagaacagcagctttaagaacagggtggctgagccctaagtgtacctttggagcatcctgtgtgtcttcagcattgattgactgtttttactgtggatttaatttcagttactttactctggtcttactacttcggcttgactgtgacatcgttgagggcaggggctgtgtcacctctaaccaaagggcctccccagatgcctagcctggtccaagcgttccatcaagagtcagtaccagcgtttattgctgtccagtctgtgcaagctccatgctggctgctgggtaagagccaagggcagccaggcctaatggctcatgcctgtaattccagcactttgggaggctgaggctggtggatcacctgaggctgggagtttgagaccagcctggccaacatgttgaaaccccatctctactaaaaatactaaaattagccaggcatggtggtgggtgcctgtaatcccagctactccagaggctgaggcaggagaattgcttgaaccggggaggcagaagttaagtgaaccaagattatgccattgcactccatccagccttggtgacaagagcaaaactccgtctcaaaaaaaaaaaaaaaaaaaaaaaaaaagagcaaaggccagaggaggaaagagctgagctcgatgtagggaagaattgatgtgatgcttgggcaataagaggcatctacagatggccgtcctggtttccttgccctgcaagagttcctactatttctcactgcctaactgcagagggtctctctttaggggtgggattgtaggacgggggagcgccagagtccttcccagtgcagactgtaattctgtgtggagactataattttatgacctgtacatcaacattaaaataacagtgtaggttgcatgtggtttgtgggacctgttgatttggtgtgggcttcttggttagaggttgatcttggcaaatctcctgtctcagagttggtttcctgttgctcccataggtagattagtaactagtttggctaacaggcagctttcagaagagccaacaaatggagccaggctgcttgcccacactgtcagattcagagctcagtcactgtccatgacacagctagttatcatttaggaggaatgagctttgggggctagcaggcagaaatggtttagggacagccattttcctgtggctgatgtgagattatccatgtctgtggagatgcaagcttccgaaaagctgggctcatgggccaaatgcctctgtatttccataacctccaggccagggtcttgcacatcatagggcctgggagaataagtgagtggtcaagcatacacatttgaaaagtaattcatgtgccatctgtcacttgagagtgccagaagagaggaaatcacaggcaagcaaagcctggtgtgtttttagtgaggctagagaaacatgattttttgcatggctaaaattgcatcactaaattttgagggccgtttttaacttacagtttaccatgatttcttggctgacaaatcataggtgaccatttctcaccattctcccatgagaaccccgcactgcaaactacctgtcatgtccaaacttgtcctggggctcaaagcttgtcagggattaaggagaatgaagcccgaaagtgccttagggacatcctgtcttcactgctgtcatagagccagggcctgggcagcacaaggccacatgctttctgagcccaggccagtcccagcaagctcttatggaagcacttttttttttttttgttttgagacggagtctctctcttgttgcccaggctggagtgcaatggtgtgatctcagctcactgcaacctctgcctcccggattcaagcgattctcctttctcagcctcctgagtagctgggattacaggcatctgccactacacccagctaatttttggtattttaagtagtgacggggtttcaccatcttggccaggctggtctcaaactcttgacctcaagtgatttgccagtcttggcctcccaaagtgctgggattataagcatgtgccaccatgcctggcctttttttttttttttttttttttgagatggagtttcactcttgttggccaggctggggtgcaatagcacaatctcggctcactgcaacctccgcttccccggttcaagcaattctcctgcctcagcctcccaagtagctgggattacaggcgcccgccaccacacccagctaatttttgttatttttagtagagacggagtttcaccatcttggccaggctggtctcttaactcctgacctcaagtgatctgcctgcctcaccctcccaaagtgctgggattacaggtgtgagccactgcacccagcttctggaagcatttttaaaaagtttttatttttcttgagacaaggtctcactctgttgcccaggctggagtgcaatggcatgatcacagcttaccgcagccttgacctaccgggctcaagcaacctcctgcctcagcctcccaagtagctggtactacatgcgtgaaccaccacacctggctaatttttgtagtttttgtagagatggggtcccaccaggttgccgggctggtcttgaatccctgagctcaacaatctacccacctcggcctcccaaaagtgttgggattataggcgtgagccgctgcacccagcctgggagcactttctgtcccctctgtggttcgtcttagagcggatcatcttgtaaggatgttggtgatcttaattttttatgcttttatattttgcctcagtttaagtgtaatcagcaggaagcagaaaatatattcatcattttcaaaaaatatttaaaaattcaaatattaaaaaaatacagagaaaagttaacaaagctactgtatacatcatctggctccaactgttaccaactctgaggacctttagtcatccttactccatgctctcccctaccaccggatgtactgagcagcagagaatgggacctgggagggggcctattccaggtcaaaggggagagactactcctggtcaacggggaactactctgggtctatgagaggactagttcaggtagatgagggactactccaggtcaatggggaaccactctgggtcaagggaagactattccaggtcgggcaaggggagctattccaggtgaagaaggcggatgcaggggtgggtccagtcagcccaagtgagagaggaagcattttagcagattatagggctttaagcctgggtcacaggtgtgtcacctgttgggggcacgaatgaagagcttaggctgtgatgctggtccaactttattatagtctgtggtagtgatgagtaggagacagtctgattatatacatatatacatatatatatatatgtatagacagcagtggaagaagagataaattttaacttattgtcaaggtaaatacagtcataaaattaactggtatatattttgcttgttcacaacatatcagacgtgctcagaactttatgtagattattgtattgattgcctgtggcacttctctaaggattgttagcctgttgtgcagatggtgagagctcatccaaccagtttgcttagtaagtggtgcagcccaatgcatgccggagcagagatcatgcctaggacctgaggaacatctatctttactggtagaagaaagagagctggcaaagggtgcgtgagatgcaggaaacacaggggacagagtgacagaggcgtggtggcagcgttagtgcacttctctggaagcaagactttctgttgtgttttttgttttcgtttttattgaaagagcttcctgattccatgtctgttttagtgggtgaatggaataaaaacccagctatgaaagggtgaaataaataaaggtaagaaggaagctgaggagcagaaagctcagccttggctgtcaggaggcagcagggtcaggaaaaatgttgggttttgctctttgaggatttgttttatttggggtggcttttgtttgcttatttacttttcccgctaatgctggagagctgagcatgatggtggtggtggggaggggctcatacagggcagggtccaaccccagcctcattagggaggcagctgcagggcctgctgggagccactggacgaccaatttctgcttttttcaggagtggttactgaatagtgtagtccttggctgcaattgtctgtgaaattggtgggtttgaggaggtgtccttataggaccacaggttctgctacaccgttttatattggattttgcatatgggtgaatttcccatatgctggagagagacagaaatgagagcttttaatgaaagtttggtggtttattgtatatatgttttgttagtttctgtgtttggtgataaggggggtctgagcttggcctactgtgggggtttcggctgccatctgtgcactgggtcaccctatcctggcaggcacctgcaaaaggagtgttgtcatctcctcctgcgtttcctctgttgagagttatggaggagatggtggggaataagttctcactcttagtcacggctctggtttttgcaggcctgcgtgatgtttccttgctgcggctgcacatcagtgtcttgttttctcgggtttatgttcctttgggtgactgtagatagggattgtagcatgatctctcagcacaatttgggattgcttccccccagacccccaccccccgccgccattgtcaaaggtggtgatgaaaagctttcttacggagttattgtgaatgaagtgtcaggtcttttcctgggttctgcaggcgaggcttgctgtaatcctctcttgctctctcactgattctcactctttaaggtgactttgattgcaggattagccttcagaaccctcatgaaatgctggatagggtgtgaagtcatcagagttaggggctggccagctgctgatcagggcttctccccctacttttttttttttttttttttgagacagtatcttgctctgttgcccaggctggagtgcagtggcatctcggctcactgcaatctccgcctcctgggttcaagcaattctcctgccttagcctcccgagcagctgggattacagacatgtgccaccacacctggctaatttttgtatttttagtagagatggggtttcaccatgttggccaggctggtctcgaactcctgaccttaagtgatgtacccgcctcagcctcccaaagtgctgggattacaggtgtgagccaccgtgcctggcctggtttctcccttgttgatctgcattggagctcaacacactcagtgtccccacttggagtgttccccactggggaaagaattgcataaaaaacatatgctccacttgttgatgctagcactggccacaccttccacctgccttcctggagttctcagaaatgaagtgtcccagctgagctggaaagagttggagtgatgttatgttttatcttctgtggggaatctcccccttctatcattgtcttgccagataaggttacctggcttctatgtgttgtaggaacaggtgaagaacaaggtgcctccatgccagaggctgcatggcagcccagccccaccgtgccggcctgcgtgctggctgtggtccctcaggcttgtgtgctgttggtacctttctcaccagtctggcagtcagtgatccctgttgcatgggggccatggtagtagttttggctacttctgtttgttaaccataggtacaacacaaagcatttgtaaataatgaactccaatcattgccgtttctgcctgcagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaaggtaagtcgtcatgggccacaggacgtgcctgccaaacgacagtgacggtcatgcttgtatccaccagacactcttgagtttataagacacagccacacaaacaccttagtagttgattatcccacccattgtcttgtctatgctgataaatttaataattggataactgaaaacccagattctgtctgctgaccccagtttatttttttctgtagtagcaatgccaccttctttctctcgaagacttggctgtgtgagtagtatgtgctgctccaccagaagagggttaaagagctgggagaaaactcacatctcctgtagtttgcagttgaaaagagttacctggtcaaggccatgaccttgcaggtctaacagtcaccgcctagaattcagaccatgtgtttgaggctcatcattgggtctcaaaggcctgaggccaaaatactgtgcataaaccatgtgacgtgcataagttgatttttaatccctcccctaaaatgaaaatatatgaataaaaaggtataaagccatgaggtcagagagaataggaaaggagacaacagtggatgaggtggtccgtaaacatggaagaaggaaaccgctgagggtgagatgagttagagctaatgcagccagacccgagttcctgcagaggacccagagtccagggggctcaggaggggcatggggcagttcgaatgtccatgggagggatttccactctcacctggctcagccagatgattaactcatccccacccactggaagatggggctttggacgtgcagaaacctggtacaggggcaggtggggagagaccaagacagaagataaggaagtcaagtcaaagcctgtatgtggaatggagagaattcccaattcctttttctttcaagcttctagaatgcctgcaaccaggcctttcccacaaaggaattcttggaagggtgctcattggggaagttaagcagcccctactggcccttgggtttacccaaccaaccagcctgaataaactccaacagtcaggactcccgccaggcatccgacgtctgtcagctttttggagcctcatttcaaacacaggcagctgagtataagtacacatttgaggacaactttcaacctaaaggcagagctcaagacaaatacacaaacatgaataaacagcaacaatgcagaaaataggggaagaaatgtaaaagtatataatattttcagaaagataagaggaaatattgttgacagtgacaacaggattctacttttaaataaaaaggtgagaggaagagcttctggaattaaaactgttaattaggccaggtgcggtggctcacacctgtaatcccagcactttaggaggccaaggtgtgcggatcacttgaggtcaggagttcgagagcagcctggccaacatggagaaaccccgtctctactaaaaatacaaaaattagccgggcgtggtggcaggcgcctgtaatcccagctacttgggaggctgaggcaggagaattgcttgaacctgggaggtggaggttgcagtgagccaagatcacaccactgcactccagcttgggtgaaagagtgagactgtatgtcaaaagaaaacaaaacaaaacaactatgttatttatatatctttaaaaaattcaatagaggtgttgaaagataaaagtaaaaaaaaaggccaggtgctgtggctcatgcctgtaatcccagcactttgggaggccaatcacgaggtcaggagattgagaccatcctggctaacacagtgaaaccctgtctctactaaaaatacaaaaaattagccgggcgcggtggcgggcacctgtagtcccagctactcgggaggctgacataggagaatggcgtgaacccaggaggtggagcttgcagtgatcccagattgtgccacttcagcctgggcaatagagcgagactccgtctcaaaaaaaaaagtaaaaaaaagtcccagaaagaatattcaaaaaacaaagaaggttaataaacaaaagatgagaaagagaaatgaaattagatgaccaattcaggaagttcaacatctgactcccaagaaaaaagaatgaagggaagagtgagaagaagttattaagacagtaaaggaagaacattttgaataattgactgatggacatgactccccccattgaaaggatcctgtcatgatgactagacaggtctctaaaacctcaactcacagaagcctgttcttagaagttactggaggatgtgctgcatcaaaacataaggggaggccgggcatggtggctcacgcctgtaatcccagcactttgggaggccaaggggggcagatcagatgaggccaggagtttgagatcagcctggccaacatggcgaaaccctgtctctattaaaaatgccagaaaaattagccaggtgtagtggcacacgcctgtaattccagctacttgggaggctgaggcacgagaatagcttgaacccgggaggcggaggttgcagtgagccgagatcgcacccctgcactccagcctaggcgacagcgtgagacgcggtcttcaaaaacaaaacaaaacacaagggcaaaccaagaataggaagacacggattcatagcccaaggggtctgccagggaaaggaacaaagataattcccaggatgacaggaaagtgaagtcccaggaaattaatctaagaaacaggccacagaagctctgggataagtaagtatagactatatgtttgggtagaataatgtattgagaagttgctgaagaaatagaatagtacatagaaacaaagcaaatagaggtgtggaggaattgataataaatcattaaaaatgaaaacttaaatgttggaaactcctgtttctgggaagatgaagtagacattcttttccctgttcttctagttaagtgcatctaaaatctaaaatccttggacactatatgcaataacgtaagaacactctgaaaggtaaagagaacgcagaccacccaggacccagaaaatgacccagtagtgatttcttcaggttgtctttttgcctcatgtagcccagactatgagccgaagaaactggcagcccagaaacaccaacaggtacagacagaaccccctgccaaagccagctccttctgaccaaaggaccaggaaaggggcagcctagcacaaaacagagaatatttagacaactgctcagtgcaaaccaaacatgatagaaaggactgtggtcctacctctgtgcctgctaccagaggctaagtgagggccacttactcctccagagaaagttgaatagggaccatggacttttatccctgttgggcagtaacaaacccctaaggaaccttgtgtggttctggagtgttagtggagaccacattgggtggggcagtaatgaggccctcctattccttccaaccagggaagaatcagtggaagccacatggggaaccagaactcttatcatacccagcagtaacgaggaaggagccctccacgcaggaggccaagtagggaatctgacctttgacccctacttggtggtaaaggtggtgttgtcgagcgccgtggcccatgcctgtaatcccagtactttgggagactgaggcggacggatcacgaggtcaggagttcaagaccagcctgaccaacatggtgaaaccccatctctactagaaatacaaaaattagccagttgtggtggcacacgcctgtaatctcaggaggctgaggcaggagtattgcttgactccggaagatggagattgcagtgagctgagatctcaccactgcactccagcctgggtaacagagcgagattccatctcaaaaaaaaaaggtgccgttcccttcccttctgagggcctaggttaaattttctagcatttgtattgttgaagtcctgaaaagagaggagaaagagggaagggctgaaaaacttttcaaagatcttatgggttgaaacgtttggcaaaggacaaacttaaaagattcagaaagctgagcaaacgccaaacaagataaatccactactaaagcccatcatagtagaatttctgaaaagtaaagacaacaacaacaaaaaatcttgaaagtggcaagaaagaaacactttactcataggggaaaacagaaagcagatttcttgttacacataatgaggaccagtggcacaacattcttcaagttctgagagaccctgagaatcaaaaggataatgagagaacacaagcaactccacacacagtgggccaaaaaatagaccaattccttgaaaagcacaaactcctcccacagtcatccaatatgaaatagatcatttgaatacccctataattattaaagaaattcagtatctaatttgaaaactcccattaaaaaaagtctttaggcccaaatggtttcactggagaattctatcaaacatttaaagaattaatgtcaattctacatactcttccagaaaaacagaaagggagggaactcttctgttctctcttctcttctctgctttctcttctcttcttcttcttttttttttttttttttccttgagatagggtctgtctctgttgcccatgttagagtgcagtggcatgatcatggttcactgcagcctcgaccttccaagctcaagcagccctcccaccttagcctcctgagtagctgagactacaggtgcctgccaccatgcccagctaattttttattttgtagagatgaggtctcactgtgttgaccaggctgtcttgaactcctagactcaagcagtcctcccacctcagcctcccaaagtcctggaattataggcatgaaccactgcacttggaatattttctgactcattttgtaagggcagtattgccctgataccaaaccagacaaaaaacagtgcaaaattaaaagaaataacagacaccaatacaaacataaaattcctcaggaaactattaggtaacatattcagcaatatagaaaaaattatacctactgtggctgtgagaataaacaacaaaaaaattatacaccgtgaacaagtggagtttgttctgaggatgcaaggctggtttgatacttgaaaatgtaatccattggcaggagaatcacttgaacccaaggaggcggaggttgcagtgagctgggattgtgccactgcactccagcctgggtgatggggtgagactccatcccaaaaaaaaaaaaaattgtggagaaattttaattaacatttcttcaaatatttaactttatttttttctttccttctagggctcccattaatcacatattgatatttattttatttttcatgccctttcatttttctctcatttttcctattctttactcttcccaatgccttctgggaatgtttcaaaccactctccgtcttatgaattcattcctcaactgtattcattcaaccctgaattaaattgtttgtttctactatatctgattggtccttttttataactccttgtccctatttgtttccagtgccctcctacatgcccttgagaatatttattaggattattgtaaattcttgttttctctggcttatcagttcttctccctccagaattagttgtttagtttgtgatcttgcctttccagtgcttgaggtctgtgttccacagatctgtctttattttttccattccctccagaatatcagctatagtttttttgttttgttttgtttcgttttgggatggagtctcgctctgtcgcccaggctggagtgcagtggtgcaggctccgctcactgcaagctccgcctcccgggttcacgctgttctcctgcttcagcctcccgagtggctgggactgcagaagcctgccaccacgcccagctaatctttttttgtatttttagtagagatggggtttcaccgtgttggtcaggatggtctcgatctcctgaccttgtgatcctcccgcctcggcctccaaaggtgctgggattacaggtgtaagccaccacgtctggcccagctgtagtttttatattacgttctgagttccatctatagcccacttgcttctgaggcatctccaggatgagattcaaaggagggaaaccccaattgctgtaagttccccatcttgactcttgacttccttacagcataaactacacttctggtcctcaagatttagcccaatttgactgggctgtctttttatgttcagtagaattagactatatcacagaaccaccaaacattttttactagtttatggagagaattaccattttctagaggtagggaagagacattagtgacctcatatggcaaattactatggagaatataattatttccaaattttcctagaaccataatactttgtgattgttacagtgattcttattttccttccttccttccttagacctcttaagtataccctataatatgatttttaattcaaaagttattaaaattttgttttgaagatttcataactaaactctaaccgatccccaagatgactagaaaagcctcttggttttacaaaactagtttggatagtgctgttctgaaggtataatagaaattggtgaaattatttgtggcctgtctttgtgttcttgctgtatcaatatttgtatcttatcagatacctttacatatgtctagccttttctttctatctgacattaacttattcaacaaatatatgttgaacacttgctccactatcgttatagctgctaggtgcagctagaagtgacagctgatagagcaatttctttagagtagtttgtgcagtttcagttgaaaaatcagcgcctggtttccattcaggccctgctattgtgcatgggaacttgaatcaccttggaacttttgtattgatttccataaatgggaagttagatgaattgcttaataataccatatgtttgcagaaataaaagaaaaatcaccgcttaaaaaaatgtaatccatcatattaacaagctaaagaagaaaaatcacataattatatcaatcagtggcagaaagtttatttgacaaaattcagcacccattcttgattaaaaactcagacaaatggggctgggtgcggtggctcacgcctgtaatcccagcactttgggaggccgaggcaggtggatcacaaggtcaggagatcaagaccatcctggctaacatggtgaaacactgtctctactaaaaatacaaaaaattagccggacgtggtggcgggtgcctgtagtcccagctactcgggaggctgaggcaggagaacagcatgaacccgggaggcggagcttgcagtgagcccagatcatgccgctgcactccagcctgggtgacagagtgagactttgcctcaaaaaaacaaaacaaaacaaaacaaactcagacaaacaagatatgtttttgaacaatgaatatgtggatatcaaaattaaatcaataccattcacaatcacttaaaaaatgaaacacgggtataaatcttacaaaacatgaataagatttgtatgctgaaaactatagaacactgatgaaagaaatcaaagatctgaataagtggagagacacactgaattcatggattggaagactcaacctaattagtatgttacttgtccctaagttgatataaatggaccaactccttgaaaagcacaaactactactacaagtcatccaatatgaaataatttgaatagcttgtaactattaaaagtgaattctacaattcctatcaaaatttcagcaagaattttttgtagatataaacaagactattcttaaagtgcagtggcacgatcttaaatttcaagctattcttgaaatttaaatggagaggcaaaataagtagaatagctaataataattttgaaaaagaagaaaatgagaagagtcagcctgtctgatttcaagatagatcatactgctatcacaatcaagactgtggtatctgcagagggactgacacagagatcaggggagcaaaatgaactagaaacagatccacacatatatgcccagctgattcttgacaaaggttcataagcaattcagtggagaagggataggatagccttttaacaaatggtgctggagcagttggacatttgtaggcaaaaattgaaccttgccctgaatttcacaacttaaacacaaaaattaactcaaaatggatcataggcttaaatataaaatacaacttctaggataaaacatagaaaatcttcaggatgcagggctacgcagagttctgagacttgatacctaaagcataattcataaaagaaaaaactgataaactggacttcatcaaaatttaaaactcttgctctataaaagacaatgaaaacatatgctacagactgagaggagatatttttaaaccacatatctgacagagggttggtatctacagtatataaagaactctcaaaactcaacagtaaaacaaacaatccgattaagacataagcaaaagacaggaggagatacttcaatgaagaggatatacagatggcagtaagcacatgaaaatatgctcagcatcattagccatcagggaaatgcacattaaaaccataatgagctgccaatacacacctaacagaatgtttaaaaaaagtagaacacaagatgctggagaagatgtggaggaactggacccctcattcattgctggtagggatgtaaaatggtaccgccactctagaaagcagtctggcagtttcttcaaatctccacgtgcaactacgaacaacttggcaattgcactcctaggcatttatcccagggaaatgaaaatttatgttcacatgaaaacctgcctactaatattcaaaacagttgtattcatagtagcccaaaactggaaacaactccatgtcctttggtggataaatggttaaacaaaatgaggtccatccatgccacagaagactattcaataatacaaagggctgggcatggtggcacctgcctgtagtcccacctactggggaggctgaggctggaggattgcttgagcccaggaagtccaggctgcagtgagccatgatcatgccactgtgctccatcctggatgacagtgagaccctgtcttaaagcaacaacaaaggaacaaactacacagcaacctggatgggcctccagagaattatgttgagtgaaaaaagccgttcctaaaggtttcacactgtatgttcctttctgtaacatctttgaaatgacacagttgctgaggtggagaacagattagggtttgctaggggtggagagaagtaggtgtgcctataaagggcaacaggaggggtcctcacagtgatgggtgctctggctgtgtttacatccatgtcctggtgtgatgtgctgtagttctgcaagatgtcactgctgggggcaatagggtaaagggagcgatggatctccctgtatcatttcttataataagagaatttacaattaccttaaaataaaagtttaattataaagaaattgcaatttgactactacttggcatgtcagtgagagaatgtagataataaaatgatgtaaaaactaagtaatgattaagaaaaattatctaagttgtaagaaaagagagggaaagtgggaatggtgatacaattggaagtcaatatcttaaattgataagcaataggaatataagcccattatttagaaaaatggctctagatcctagaagaatcagaagacttcagtgtggctgcctcttggaagtggtttgtggatggggttgtcccagttagtaaaggagattgttgttgttttgttttacaattttttgaactttatttgcctttttaaactgtatacatttcataaaataaaaacaatcacaataataaaatccaccagtgataggagacatttaatcccacatactccagtgtggtgtttatgggaagtattttgtttttagaatgaacattaatgaacaagttgagagggatttaatagtagcttctgttttggaatgcttactgtgtgcagcaacactatttaacattttaaatatatttttctcatttaatcttcacaaaaccttcataaagtagaaacattcctctgggaggccgaggcaggcggatcacgaggtcaagagatctagactatcctggccaacatggtgaaaccccatctctactaaaaatacaaagattagctggatgtggtggtgtgcacctgtagtcccaggtgcttgggaggctgaggcaggagattcgcttgaacccaggaggtgaaggttgcagtgagccgagattgtgccactgcactccaggctggtgacagagcaagactgtctaaaaaaaaaaaaaaattctttctgtagtttccatcacaagctgacattttccccagtaggatttggtgcagtgcaaggctcacgtgggctcacctagtgactatgaatggactcatagcaggcttgctgtgtggttttaataatgggacagggtaattaatcacatttgtgataacaaacccaagaagctcttctcagatttgttattattttttgagacagggtctcactctgtcacccaggctggaatgtagtgacacagtcatgactcactgcagcttcaacttccctgggctcaggtgatcctctcacctcagcttcctgagtagctgggaccacatgttgcaccatcacacctggctaatttttgtatttttttgtggtgatggggtcttgccatgttgcccaggctggtctcgaactcctgtgctcaagcgatcctcctgcctcggcttctcaaagtgatagattacaagtgtgagccaccatgtccggcctattatttatttttatctaattgaatatgtaatttatgtacatggttcaaaattcaaatgataacagagattcttggtgaaaagaaatcatgtgcaccctccgtgggaggaattgctgacaccagcttcttgtgtctttacagtctgtccatatatgagcttacacatgcatttgtttcccaaatgattacacggtatacactgtttgcaccttgctttttacactgaacagtgtatcttgatttatcgccgagtgttcacattagcacacataaaactgcctcgtccattttaatggttgcatgatattccattagatagctgtgtcatattctatttaaccagtgatttattaatacatatttaatttattttcaactgttatgtatgttttactgtacctataggataaattacaaaagtggagtttctagatctaaggctaggttactttttaatttgacagacatttccaaattgctcttcataaagggttgaagtcagtgcatacgtgaggactctgtgagtgtgcaggcggccctgtacctctgcaggttcttcacctgagtcaagcaactgtgggttgaaagtattcaaaaaaagaacaataaaaaaaccactacaacaataaaaaataatacaaatttaaaaaatacagtgtaacaactatttacataacatttacattgtattaggtataagtaatctagagataatttgaagtacagtcttggccatataacaacatattggtcaacgacagaccacacatatgacaatggtcccatgagattataagggagctaaaaaatttccattgcctagtgacatagctgtcttaacattgtagcacaacgcatcaccttttctgtgtttgaatgtatttagagtcacaaatacttactattgtgttacagttgcctgcctgcagtattcatacattaacatgctgtacaggttgtagcctgggagcaataccatatagcctaggtgtgtagtgggctataatgtaccatctgagtttgtgtaattacactctgtgatgttcactcaatgatgaaattgcctaatgacatatttctcagaatgtatctctgttgtcgagtgatgcatgactgttacacaggaggagtgtaggttatgtgcaactaatactgccatattgtatgaggaacttgaacatctgcagattttggtatcccaagaggctcctggaaccaagccccagcagatactgagggacaactgtacctgtttctccaccctctgaggaacgcagtgtttattcaaactttttggtctttgccagtctgatattcttaaaatgttttctcattatagtttgtacttataagtgaggttgagtgtctttcaaatggtcaaaagtcaggtctctttcagactacctttctagatccattgcccattttttctgttgggttattgcttcttttcttatatctttgcagtagctctcagtgtgtcgggtaagttagtcctctgctgtaaagttagttttaaatgttttcccctagtttgtcatttgtctttgttcatcattgtcttcaattggttctcttgcagcagagcctgaaactggggatcatgttccactgatctgtaaagggcatgctcaagagaaagagtgaagggggtagggtagggcagaggggaaagatgcctgaaaatcatagactcgggttaatttcaacctgatcatgctctaaagcctagaatgccacagctcggtgaagacagaagtagctcagggtgttacccatccaccctcagagcagtggggggatcctgggtgagacaccactgcctgtactacactccaccctgcacttcctcatccacatatttctcacgttaagttcattctatccagactcagcttctccagaggcatttggtcatgatttctggaaacctttccagatgaactacagccctgactacttcagtgggtcccaaggcctcattccacccactggggacatagcaccatgtagcaactattggtttagatgtatactgcatcctaaagaagagggggcatcctttcagggtgtcatctcccagctggccacagctctatcaagatgacagctccaggatgcttgggtatttatttatttatttatttatttatttattgagacatagtctcgttctgtcgcccagcctggagtgcagtggcgtggtcttggctcactgcaagctctgcctcccgggttcatgccattctcctgcctcagcctccctagtagccgggactacaggcgcccgtcaccacgcctggctaatttatttatttattgtgagacggagtcttgctctgtctcccaggctgtagtggtggcatgatctcagctcactgcaagctctgcctcccgggttcatgccattctcctgcctcagcctcccaagtagctgggaccacaggcacgtgccaccacacatggctagtatttttgtatttttagtagagacggggtttcactgtgttagccaggatggtctcgatctcctgacctcgtgatccgcccacctcggccccccaaaatgctgggattataggcatgagccactgcgcccggccacgcctggctaattttttgtatttttagtagagacggggtttcactgtgttagccaggatggtcttgatctcctgacctcgtgatccacccgcctcggcctcccaaagtgctggggttacaggcgtgagggtattttataggacattgaattccgtgatcatgtgcctactgctgtacctcctttagcactaagtgagtcccttgatccaaggtgatgatggtacttgctgtcccacatcggaaaccacatgctccacaagcccttggagagtaggttggcagctgctgcaggcaggagaggcaaacccttatgtggaggacatgctaatttttgccagaacaagtgtttcttattgcaggatcaaaggagttctgaagtattcagctggccagcagacaggacaactggttggtctcttggaggggatgatgccttatcagggctgcagaattggtatcctgctggcaggtctgccacggtgaagggctgtagtgtatttgcttgtgcctaagtatgtgaaccaggcttggggttttctttctgtcagctgtgtattgggaaccctttctgaggctgtgggtgtaatttaagggagaggcttcagaacaggtccgctgggaagtgtttaggtttgggccacctgttcctgcagctggcactgttagcacagtcctgcagtaagaacgtgaacatgtactgttgtccatcccacatgaacatcagtagttcctgattggtttgaggaagaagtgtttaccgcatcagtagctacaaaccatgtacccaagattgtttatccacttgaataaagattccatttagctcagtttgtggcagtctacagtcatctaccacaatttatccaccataatttctataggagccagactgggcatgagatgggggcccctaccctgtgtcatttatgttttcaagagcagcattaatctctgcttttcccactgggaaatgatactgtttttgatttactatggccaggggtcaggggccggataaatttcaggggcttccaaatggccttttctacttatagctcttattctttagacaaaggaccaatggaaggattctgcaaagtgctaagtatgtccgttcctcttgtattacgtctcttatattcagggaagtgggcagatggccaccagtggagtctttacccagtggatgtactttcaggtggacctggctgggcttcatgtattatctgactcccatatgttcctactctgcagaggacctttttgatagtttgggtccctaagtatgtgcattgtctcagaccctctatttcaaaaacctctgaagacttgcagttcctatggtacttttacccaggtgaatgaagtccctttgggaagagctggggaaatcactgtggtgtgtacttgccttggtgttgcaggtcgactcccacgcaggcttggtctctccttcagtcagtgtttctgagtctgagagctgctccagatctagaaacggagtcagggattgatactttgcattgtagaagctcaccttagccttctgcttattccgttttgattttcttgtttatatatagtaagcagcacccttcttggcttcgtatctgtcctgcccatggaaactccagcattctgtgagccgtctccatagatccctgcatggatcccaggctcccctggctactattttgactttgctgcctattaccagctgacacctacacctgctctgtgcgagtcagtgctgctccctggcttctgctagggaaggtcttattacccccttgctcctggggagcccagttctgtacacgcacacctgatggttagcttccccttcggaggctggccagtacagagcttcccagtgatgcctgtagaccttctgcacactcattagtgccatggttgatggaatgccatcatgttctcctgagggacatgggccacgggtgggctttcctgtcattttgtatgtcgattatagtatgtctacttccctgagcctttcgatacctggatccactttgccacagcagtcccacaatctctgctttaatatgagccatcactttggctgaactttgaagagcctgccagcagtatctgagaatggcctctggaccccttctcagggtgttaaatgctgtgttatagtacatgccgtagtagagaagatctctcattcagcttaatattctgtccccctggatccagcaccttgaggtcctctcccaggtgcattccccagctctgtcagaactcgttagacacatcccgtagccggtgtcagccatggaggaggacagggcagattctggggagagcaagcagtatctcatgagattcccatttcatttgaggcctatgtgttatattcaagcaaggagtgtgtggggggcttctgtcgtacaacaaaaggggataggtcacttctgtaggcacagtgttaagaagaatttgaggactaaggttctcaaaggcatttacccagctatccccatcccaaatctcagaatcctgttccttccctgttagggcccagaccctgccacgggaactttatcaatcaaggccaataaagagaagttatggggagactgatttaggatcaatattaaaaaaaaaaacacttatatcttgtcagaagttgtttttagaagaattttctgtttagagccaactcccctaccccaccccctagacaaggtgcttgaggaggtggtgagcctgccagcgtggagctgtgtggttggcagtcaggcaagggtgtgtgagaggccacctggccataccgtcttctttcactaatcccagaactgatggagctgatggctggctggtcagatgtccccttgctctctcactgcttcaccgtggtcctctctcttgtagctgtgctcttggcttgctgggacagtgggtgtgggctgggcatggcattgccataggggcactgggtgttggccaggggacacccaggagacagggttccccagggcagatggggagcccattttgagaactgtccaggaggcatacataccgtatcctattcagatattagaacaaggattagagctgtactttttctttattgacaaaagttgttttcctactataaatatttcacagtgaaaaaaatctcaaatgagtaaagattcatccctataggaagaaagtagaatcgtgaatcctctttagagatctgtgagcctgagtttttgaagcatcatggccagattttggataacaccaaagaaaagcaagataatgatggtgatgtcgtgtcaccccagccacagggaggccagggagaattcctgtacaattctgtaaacataattccggggtacttttgtttcagcaaagcacttgacatatgaccccatcttagtcagtattttttattacccttttgagaacagagaataatatttgtggatgatacaaaactaggagggatagcaaatgaaattgaataaagctaattagatgaaattttttattgtagtaaaatatacataagatttattatcggccgggcccggtggctcatgcctgtaatcccagcactttgggaggctaaggcgggtggatcacgaggtcaggagttcaagaccagcctggccaagatggtgaaaccccgtctctactaaaaatacaaaaaaattagctgggtgtggtgacgggtgcccgtaatccgagctatttgggaggctgaggcagataactgcttgaacccaggaggcagaggttgcagtgagctgagatcgcaccactgcactccagcctaggtgacagagcgagactccatctcaaaaaaaagatttactgtcttaatcattttgaagtgtagagttcaatggcataaaatcaattcacattgttgtgcaaccatcagcactatccatctccagagcttcccaccagcccttactgaaaccatgttcctgttggacaatgcctctccatctccctcccacagcccctggcaaccaccgctttactttttgtctctatgatttgactactctaggtatcttatgtaagtggaatcatacaatatttgtccttttgtgactggcttatttcgcttagcacagtgccctcaaggttcttccatgtcgtagcatgtgtcagcatttccattgcttttaaggctgaataatatttcattgtatgtgtagatcacatttggtttattcatttatctgtcaatgaacatttgagttgtttcttgctttagttgattgtgaatcatgctgctatgaacatgggtgtacaaatgtcttttcaagcccctgcttttatttcttttgtatatatacccagaagtggaattactgaatcatatgctaattccatgtttaattttttgaggaaccaccatattgcttttcacaggagtatcattttacattcccatcagtaatgcacagggtttcaatatctccatatctttgccaacaattgtaattttcccttttttaaatagccatctaggctgggtgtggtggctcacgcctgtaatcctagcactttgggaggctgaggcaggaggatcaattgagctcaggagttcaagaccagcctaggcaacatagtgagaccccacccccgtcactattaaaagaaaaaagtagccatcctagtgggtgtgaagtggtatttcattacggttttgatttgcatttccctaataactattgatgttgaaaatcttttctcatgcttggcttattggccatctgtgtatctttagagaaatgtcaagtcatttgcccagtttttaattgggttgtttggtttttggttgttgagttctaggacttctttatatattttagatattaatcccttatcagatatgattggaaacattttctcccatactgtgggttttttcaccgtgttgattgtattctttggcgcacaaaagtgtttaattttggtgaagtccagatttgtttttcttttgttgcctgtgcttttggtgtgatagccaagaaatcattgataaatccaatatcatgaagcttttcctgtgttttcttctaagaattttatagttttaggtctcacatttatatatttgacccattttgagttaatctttgtaaatattgttaggtaaatggtctaaacttcattcttttgcctgtggatatccagttttcccagcaccatttgttgaaaagactgtcttttccccattgaatgctcatcatggcacccttgttgaaaataatctgaccatatacacaagggtctttcttgggctctctttttttctttctttcttttttttttgagatggagtctcactctgttacccaggctggagtgcagtggtatgatctcgactcactgcagcctctgcctcttgggttcaagcagctcccctgcctcagcctcccaagtagctgggactacaggtgtgcgccgccacacccggctaagttttgtattgttagtagagacggggtttcaccatgttggccaggatggtcttgatatactgacctcgtgatccacccgcctcggcctcccaaagtgctaggattacaggtgtgagccaccgcgcctggccttgggctctcttttccaatccattggtcagtgtctgtctttatatcacgctctttccatgactgtggtggtgtagtaagttttgaaatcaggaagtatgaaaatagttgaaatttattactgataaatgtaagcagtatctacatttggtttatatgagcagataggaagaggatggaaaggcctcagctaagggcaggtctgtggaaacattccaaaatgttcactgatgacaggctaaggatgagccagtacttggatgtgctgcttatttgttctgaaactgctctaattatcagaagggtcttaccagcactatagagattggggaagccaatacatacttttgcattcttccctccccacttccatcctcaccttatgaaatataaaacttcttggaataactatacatttccttatggagctgcccagcacacgcaattctgaagtttaggttgcccatctgactaagcccaagatgaacttgtatttgccaccgtgccctgagtgtgcttcagccagttactcttctgcctgtttcctgctccatccagtgagaaggctacattgcatagcaagcagcaggtagactgactcatgtcaccgtgtttacgttgcttggattcggaaatctccagagtgacctccttgcttggttcccagtcagagaggtcatctgtcagcaaagacagtttcccaacctttatactttttgtttccttctcttgcataattgcattagctgagacttctatatgatgttaaatcatagtgataagaggggacatctttgccttgttcctgatcttagggggaaggtatctaactttttgccattaagtatgatgttcgctttagggtgtttttttttaatactttaagttttagggtacatgtgcacaacgtgcaggtttgttacatatgtatacatgtgccatgttggtgtgctgcacccattaactcatcatttagcattaggtatatcttctaatgctatccctcccccctccccccaccccacaacagtccccggtgtgtgatgttccctttcctgtgtccatgtgttgtcattgttcaattcccacctatgagtgagaacatgcggtgtttgtttttttgtccttgcgatagtttgttgagaatgatggtttccagtttcataaatagatgtttttaattagttcaggaagtctctattcctggtttgctgagagcttttgtcatgaatgggtgttagatttgtcaaatgctttttctacatctattgctacaatcatatgatttttctttagccagttgatgtgatggattacaacgatatatttttttttgagacagagtttttgttctgtcacctaggctggaaagcagtggcacgatcttgcctcagcctcctgagtagctgggattacaggcacctgccaccacgcccagctaattttttttttttttttgtatttttagtgtaaacggggttttgccatgttggccaggctggtctcaaactcctgacctcaggtgatccacctaccttggcctctcaaagtgctgggattacaggtgtgagctaccatgaccagcctaattttcttatttttagtagagatggggtttcaccatgttggccacactagtcttgaactcctgacctcaggtgatccacccatcttggcttctctaaatgctgggattataggcatgagtcactgcccccgctacgattgatatttgaacattgaattagccttgcacacctgggataaatcctgcctggtcgtggtgtataattattaatacattattggattcaatttgctgattttttgtttaaaagttttggccaggcatggtggctcatgcctgtaatcccagcactttgggaggccaaggcaggaggatcacttgagcctaggagtttgagactagcctaggcaatgtggcgaaaccctgtctgttaaaaaaaaaaaaaagaaagaaagaaagaaaaaacaaaaaatacaggctgggtgcggtggctcatgcctgtattcccagcacttttgaaggccgaggcgggcggattgattgagctcaggagttcgagaccagcctgggcaacatggcaaaaccccgtctgtctctacaaaaaatacaaaaattagctgggcctggtggcatgtgcgtgtagtctcatctactagtgggaggatcgcttcagcctgggaggttgaggctgcagtgagctgtgattgtgccactgcactccagcctgggcaacagagcaagaccctgtctcaaaaatgtgtatgtgtgtatatatatatatttattttagtggttgccttagggtttgcaatatacattcacaactaatcaaaatccactttcaaataatgctgtgctgcttcacaggtagtgcaaataccttgtaaccaagtattcccagttcactcctcccactgcttataacattgctgtcatttatttcatttatccttaggctacagtcacccaatacacaaattttattttgaacaaattgttaatgtgttagagcaattaaaataagaaaaataaaagattaattttacctacatttatttcttctctgatgcttttccccttctttacatagatcagagtttctgaccaaatcattttcattctctctgaagaagttcttttaacttttcttgaaatgttaaatccctgagtttttgtttttctgataaaaatctttatttctctttcacttttgaaggataatttcactggatacagaatcaaatagttccctcctctctcttcttgcttggatggttcctgaagagaaatccagtgtcattcttgttcttgccattttataggtaggatgtttttttcctgtggaaaaaattcccagatttctgcaaagagagaatcttcctttctaattttctttttgtctttgatttctgcagtttgatgtgatttgcctcagtgtaaattacctgctttttaccgtttcatgttctctgaccttattggatctgtggatgggtgtctgacattagtttggggaacttctcagctctcattactccaaatagttattgtgttcttttctttctcttgatatcctcattgcacatatgttacactttttgtaactgtcccacagttcttgcatattctgttttctttctttcgttcttttttccctttgcttttcatgtttggaagtttctgttgacgtattcttaagctcagagagtctctccttggctgtgtccagcctcttgagcttgttgaaggcagtccccattgctgttacaggacttttgctttctggcatttcctactgattgttgcttagggtttccatctctgcttatgctgcctatctgttcttacatgatgtctactttttccgttagagccattaccatattaatcgtagttgttttaaattcccaatctggtagttccaaaatctccactatgtctgagtctggttctgatatgaggaacttaggcgtcaggttaataggccttagtgtgaggtacgtttggctggctgggagttgggctgtgtttactgtttgctgcccttgtgatgctgggggataaaaatctcctgtgtatccttgtttttgtcttccattgtttttgggttttcttcaagattccttcttaaatagagtctgaggcctgcagttcttataggtgtgcatccctgttattacacaggggtcctgttgatgtggctttcaggggagaggaagtgttctgtagtcctgggattaggtctcagtgttttagtgaacctgtgtccctgggccgtggccttcacatgtgcttctcagttttgtttttttcctcccccttaggagagacataaacgatagaggaggcaggaattgggtgtttccttacccctaggtggttaggctctggtaaaatagttttccttgaggaaagccctttgttaaggataacagaatgctctggtcatgcctttttctttctttctttctttttttttttttttttttgagatgacctctgagccctttatatgttggttgggaaactggagtgcagtggcaccatcatgactcactgcagcctcaacctcctgggctcaaatgatcctcccatctcagcctcctgagtagctggcaccacaggcacactgccgtgcccaactattttgttgttgttgttgctgttgttgttcttgttgtagagatagggtctcaccatgtttcccaggctggtctcaaactcctggcctcaagcaaacctgccgccttggccatccaaagtcctgggattatgggcatgagccaccacacctggcctggttatacttttaaatgatgtattcttccctcctcctaccagagtatgaggagatgtttctccagtctcaccctgagagcctggtggggctcatggaggtaaaactcagactggtatggggacctccccagtgactattcccctggagtttttgtctcctactggtccatgctcagtctctgccatttgtcagttcccctttcctctctgctggtgctggctctagggtttctgccccgcaatgagctgtgattcttagcattgcatatctgtctctccatctttggggttattgttttttcatgtgacctcaattatctgatggatctgagaacagtcattgattttaagtttgccagctttcttgttgtgaggatgggagtgatgacttctgagcctttacaagctggacaggaaattggaaagtcccatttcattcttttttaatagagaacttaactgtgtgaggtaatgaacaactgagaaatgttgagtgcaagaagcctgttcttgggaagaatcagcaacccattttaaaaaacagaaacattgaaaatgttatggtggttggtaagatgcaggcaggagcacagcaggtacagtgctgctgcccacagccttctacacctgaggccctgcattatggaggtttgctaagccaagtgcctcatggccatgtgtgaccaaaaaaacctttttactaaatgttttgtgctgctataacagataccacagactgggaaatttataatgaatagatatttctaggctgtgcatggtgcctcacacctgtaatcccagcactttgggaagctgcggtgagcagattgcttaagtccaagagttcgagaccagcctgggctacatggcaaaaccctgtctctacaaaaattagccaggcgtggtgacacacacctgtagtaccagctactcaggaggctaaggtgggacaattgctttgagcctgggaggcagaggttgcagtgagccaagatcacgcctctgcaccccagcctgtgtgatagagtgagaccctgtctcaaaaaaaaaaaaaaaatcgtatcgttctggaggctaggaggtttaaggttgaagggcacagctggtgaggggctgcatctgcatcttatgttatcccagggcgaaaggtggaagggcaggagagggaagggggtcaaattcatcctttcatcaggaacctgctcctgagataacaaaccctctcccaggataacagcattaatgtgctcacaagggcagagctctcgtggcctaatcagctcttttctttcttttttttttttgagatggagttttgctcttgttgcccaggctggagtataatggcgcagtcttggctcaccacaacctccgcctcccgggttcaagcaattatcctgcctcagcctcctgagtagctgagattacaggcatgcaccaccacgtccagctaattttgtatttttagtagagacggggtttctccatgttggtcaggctggtttcgaactcccaacctcaggtgatctgcccaccttagcctcccaaagtgctgggattacaggcgtgagccaccgcacctggcctaatcacctcttaaaggccccacccttaacactgttgcatgtggggactaagtttccagcacatgctttttgggggacacattgaaaccatagcacttcatttctctatttatgctcatttctcagctatgttgacctttgcaattgaggaagtttattttttagtgaagttgtgcatgatgccattgttttcagtttccccagcagtgacgagaaaaccctgaccatccctgttttagaatacagattctaccaaaactagtagttttggtactagtagtttgggatactcattgcaggacttttgatgatgaccttcactgtagaatagtaggagatggggcagcactgtcctcagccagtagagatttctgtaagaacccaggactctcttcctagagttgggcctccacgcgagccggaatggagacccatgggcctggtggcctgagtatgaagcacttggtttgtgctctcggtggtagtgatggtggtgttggctcagctcccatttctcatggcatttttttcttcactttctttcagtatttaggtcagttaacgtccataccaggatacctgaatccctccagtaggactgaaatcctgcatttcatagacaatgcaaaggtaaccctatcctcttaaccctgtgcactagccctcagcccccaccagcccttggtccctgtactcttggcctcgtggctgtgaggaatgagccagtcccatcacattatgggtacacttggctcttggccataaagactattccttagtatggacattaagttgattctcgacacttgctccatgtgattttgggctgtttccaaaatttacactttcaagatatttcaaaccatgtgccgtaagtctgaatctgaaggcagttccagaagaatctcccaaatggtttgaacacattggtgtccctggaataagcactgttctgaggggaataacactgaccttattcactcagcatttgtcacatgtgtgacatcggccagcacaatattctcaggagaagcgccccatgccggttgacagctgagtctgtatttctgatgccctgtggttccttccagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacaggtacaggaggtcaggggtcaggagggtccttgtcctaaggagtacatgtgtgaattttatgaagttctggagacagtttttgcagcttcgtgttgggtgctgctgtttgtcacgaccaataattgtctttcctgtctctgagatcagccagaagagggcttgagatcagttaccagacactgggggtgactgtcacactaagagcctttggggactcaataatactgggatacagtatttaggactggtatcctgttcctctgcccggtggggctcctattgactccctctgggtacagtggagttgcccctctgcccaggtgtggtggagcctagagagagtgcagtggatagggacctcacctcagcttgactgatattttgagctctgcacagtgtcctcaaacctgggacagaaaagatgagacccagacctcccaggagctcttggtcatagaggttactctctgtgtgtccttgccgtctgctgctttcacaatgggatagaattgggcagaattgggcagaattgggcagaatgttatttttggctgtggtgagtacagtgctgcctcactggacccaagcccaagctgcccgttaatttccagcagcttccagcccaggcattcaggccactgaggatgaggggagagaccatggttcgccctacctgtattttgcccctcccagtcctgagtttcgaggctggtgttgcagtggggacagtatcctgggctccttggatctctgctggtgactgggttgatcccaaagcctttcatttccagagggccagtggcagggtgtgaaggggtcacagtgggtctgcctagaccacacactgtgttttaggtagcagagaggggaatttgttgttccacttaaggtcagtagttcattgagaatctggcgagtgtgttcattattgaccccttgagccatgaagctgccagcttgagtgcgctcttgagagcagtccactgaaagcctgtgagtctagatgcttggggttgctgtggtcataaactacacagggaacactggcggggtttatgaaggtggctgttgctctgttttgttctctgtgtagcagtagcttagacttgcgtacaccctccccaacgcaggcacacaccacacctacacacatgtacattactcaccctatctggcttagaaggctgggttggtggctccttccagccatactatccgacaccatggtgaccctcctgtttttctacctttggaccctgcgggaggccttaggcctgggacatccttagggacaaggagtgaggagactggtttctgactcgcttcttgcaggtgtttcaagctggtagggaggggagataggctcctccctttatttcttctgctgcatgacagtttctcagctttaattattagaacacattgctaaaggaaatggatgacagattttttttaatggagagagaatgagcgccataggagaaactttccaaaattagatgaaaaacaggacttctggtctttgagagaacttttgatttaaaggaagagagtgaatccctgtgtcctgggggccatcttccttgtttttgtggatgcaccggagcagttgtgtgtcccctgtgttacataaggtgtgctgtgtttattttttaatttttaaaatattttaaaaatttttgtaaggatgaagtctctctatgttgcccacgctggtcttgaactcctggcctcaagcgatcctcctgccttagcctcccaaagtgttgggactatgggcatgagccactgcactgggccgccatgctgtatttaggattaggcatccagagttctcagcataagagactagcaggtgaatagctaacgtttacttggtgcctgctatgtgcaagcaagtctctgtgcctctttggaccaaaagtacgctggtatttgggatagcacaggagtggggaagttgggggccaggtctagctgcaatagggtccatgtggcaggagctgcttggagggtgatgacttgagttggtgccagatggggcagggtcacccgtgcacccgtggtagcacttcctggatgatataggagaggcacacaactcgctgcccgcatccttaggctgcccaccctgcttccttgagaactaccacaggcacacaccagggagccaacatttaaaaatgtttaaaaggtagagatttcttaccaaactcataccaaaaaaagaaaaaaagtaaagggaaaccagtaaatttttttttttttttttgagacggagtctcgctgtgttgcccaggctggagtgtagtgccgtgatctcagctcactgcaagctctgcctcccaggttcacgccattctcctgcctcagcctcctgagtagctgggactacaggctcctgccaccacgcctggctaattttttgtatttttagtagagatagtatttcaccgtgttagccaggatgatcttgatctcctgaccttgtgatccgccaccttggcctcccaaagtgctgggattacaggcatgagccactgtgcccgcctttttttttttttgagacaagtttggtgcttgttgcccaggctagagtgcaatggtgtggtcttggttcactgcaatctccgccccccgagtagctgggattacaggcatgagccaccacgcccagctaatttttttgtatttttagtagagatggggtttcaccatgttggccaggctggtcttgaactcctgacctcaggtgatccacccgccttggcctcccaatgtgctgggattacagccatgagccactgcgcctggccaattattttcaataatatattttatttacccctccgtacccaaaacattattacatcagtatataatcaatataaaaatcgttgagctacatagcattctttctttgcctacctctgaaaccctgtgtatagtttgcactcacacatttcaatgtgggctcatcacattttgcatactcagtagtcctgtggccagtggctgccatagggacagagcagccccaggagtctcactgtggggtttgaggtacagtttcttatggagcccttgtctctgtgcatgcgctaactttgcatgtggcctgggacggccttcttctccctcctgaggctggcctgccctctgacaccctggcactagtggcacttctaggttttgttttcagtcttgaagtcctcccagggtggtccgaactgatggtgagagccctgcttcctggggattggcctcacttctgccatcaggaaaaccactgagttactccatgtatttcaggagaacctcatttgtctagggaggcaatgggtaggatgttagaaacaagggcactggggtctgaccgtctagattgccatgtggacagtgcaactcacacgccctcaggccaggcctttcactttcccatgcctcagtttacccatctgtaagaagggaactccccagaacacatggaaacctcctggaggtgactgttctcagggttgtatatgtggtctgttgtatatgaacttgaagcgtgtgaaactgcaggatgacatgcagctctggtgcccttggagctcaggggtcgcgtgttcccacccttatttagagaagcgaagtgtgtctggtgcaggcccttcacctgagtcgttctgtgggtgcctgagccaggtaaaggtcctctcagcctgtttccatggcggcctcagctgtttcctcaagtgcccccatgcctgcccttccactgtgctaaactgagatggtgttgacttctcagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtgagactttctcgccccacttactcagaactggctcctcccagaccctgctcatggccagccccaccctggccacacccagcacagtgctgggcactgctgggtgccccagctacttcctctgccattgcctgtccctgcctcaccctagtctccacccagccccacctctctctgctcaaccctgccccaggcattgcccccatcctggccctgcccacagctcctctgcgcatgactgcatcccaggtcctgccccaggcccaggctccccaccggttcccacccctgtgccttctgaccctcctacctccaacccccagcaacttctctgagaccacctggccactgagctttttgcttatcattcttcaaggtgcccccacgctgatgggcgggcagcggcggtcacctgtgcatcctagacctgcctggtgttaaggactgtgcttgcagattcctcacaacctggaagagccaagggctgggcccttgtaggctaggatttggggccccctcagccacccaatagctgtggggccttggcagtcacttaacacctttgtttaatttccatatctgtaaaatggatgctagtgaccacccaccttaaatatcctctaatgagcatttctcagtgttggtgctactgtcatttttagccggataattttccattgtgggaggctgccctgtgcactgtagggtgttgagcagcatcccagcttctccccttgtgacagctgaaaatgtctccagatattgctacatgtcccctgggaggggtacaaaaattgccccagttgagagcctctgctttagacagcacactgttataaaactgttttatagctgttagaaatgcctccaggtgggctgtgatactgatggtatctcctctcacctctttcctgggctgggatagggttgtgagggtgttgataggtcaggttaatggaaagaagacgttggactggcagctaacacttgtgccctgcacagtcccctcacacttgcaataccacccctgggccacatggcagtcctagatagagtcctggggcagttggctgggtctctcttttgacacccctttgggtcagtgaaaggcagagggacacattctggtatccactcttcattcatgtttattgagcatctgggctgccccaggtatcctggaagccgcctgggaaggcgcagtctccagccagactgaccgagcagctgctgtcccccactgcaggtcgctgcggaggagctttgctgtctgctaggccaggtcttccaggttgtttacacggagtccaccatcgactttctggacagagcgatatttgatggggcctctaccccgacccaccacctgtccctgcacagcggtatgttgagtgagagtgggcagcgggtgggagcagggacaggaggggctactgcagtggcccccagctccccatgagttactcctggaatagcgcagttactgccgtgacatggtggccttttgtttccagactttgctgttcacattagcccatagggtttcatgaaggcagaagtgtcacctgtccttgagagagttgcaccaggtcagcgctatggcttcctggaataaatttggggtctgtgaacacttttttggaaccacttgtggctaaagtcacttcacttaactcggaacaaagagcttggagaaggctcctagcactggggcctgtgatggaattggggaggctgagagtgggtctggggagcctccttttcagtatgcccagactatggctgctcttaatgtgaaactccttccaggaccatggccagacccatgggaagctgctcaggctgccctgggaggccagctggcagtggtggagcagtggcagatggggaagaatggaaggtaccccagagctgtctcttcctgcatggcccacacagcattttcaggagtctgttagtccattgaaaacacttcatcagcaagctcacttgagttaagtcttcaaaaacatcatctgtttttcagatgtattacttattgaggattaatgggttatataaattgaggtgcataaaaagctgttggaggctgggtgtggtggctcatgcctgtaatcccagcactttgggaggctgaggcgggcggatcacctgaggtcgggagttcaagaccagcctgaccaacatggagaaaccctgtctctactaaaaaataccaagaaaaaaaaaaaggctgttggaaacagtgcggcttgttgagtacaatttcttctttttacggagataagtcccagccctctgccctttccccagtaactcgcacatctcagtgaagagagtaaatggtggagaagcctgtgctggtgtgagggctgctcctcagtgcctccttcttccctttcttgctgctggtgccagagccctttgtgggcactacacgccttgtgttggcccagcagctgcagagagacagctgctgagctctcaggcatcctctctatctcatttagtcctcggtggcccagcgagataggtgcaatcttcatccccattttagagatggggaagtggaggcttagaagtcaacagcttatccagaggaatgtaccatatgagtagcagatgatttatcgagctgtaattaaacattcagttttagtgcgactggtttggcccttgtgctttaaaattcccaaagggcctttttttctttaataattttttttttactgagaagtacacaagtcatacatgtacagttgaatgaattttcataaagtaaacacatcatgtaacaccactactgggggttgctgaagtgggcttcttcccctgccagcctttcccaagacctccccgtgggatccacacacagatgtgcacacgttacgcacatgcatgcattctctgcttatttctgccttggagttttgcttgctgtgttctctctactacagctatgccaaaacatagcagcataaacagcagaaatatattctcttataattctatacgttaagagtccattgtgggtcccactgggctaaagttgaggtgtccacagggctggttccttctggaggctccagagaagaagccatttccttgtctttccagctcctaaaggcggctgcatgccttggctcatggcccttcctctgtcttcacagccagccacgtgacctcttccacagtcacatcttcctttgactgtcagcttcctctgcatttcaggactcttgcaatcacattgagcccacccaaattctccagggtcatctccctatttcaaggtcagctgataagcatcctttactcccctttgaaattggtaacatattcaccaattccagggattaggatgtggacgtctttggggggtcattattctgccctccatacttaccttgttcctagtgccagaaatgtcccttttatctctcagcctctccctctgcttcatttaaaatcttaccctctctgcaacactcacctgcctcgctcacaaagctttcactcactgtctgtgctggtgtgaaatgtgccttcctcaggtttgaaatagcaaattacagtctgtgtcacacggacctaatgtcatttgttgaatgtagctgctcagtgccagaccctttgctggtctgagggtcttgggaatcctgtggcttcactgggttcagatggggagtcagactgcccggctctgactgtggtttctgctgtgtgacctgggccaagttgtgtaactctctgacttacttcctaatctacaagtgaagacaggggtgatatatgcctgggttaaaggagacaaagccccagtaaccctgcctggcacatgagtgatacctcaaagacagcttttgctggctctggccatgggtgaatgtgtacttcagcccagcgtgcagcaggatttgcatttgccaggatccccaggaggggtgtatgtgggctcaagtctgggaagccctgccctgaggcacacagcacattccagagtgcgggcagcttgatgaaggacagcagggtccctgaagaccagggctgccgctgtctcctgtaaatacagcagtgggctggactcaaaatgcctccccactatgtccctgaaagtcatcttagttttctgcatcttccttacagatgactcttctacaaaagtggacattaaggagacctacgaggtggaagccagcactttgtgagtgcacatgccaccaagccctgcggtgggacacgcaccaaatgcgttgtctggtgttgtccaggctgcagccagtcagctcccccatctcagctcaccctcgctaagccatccccagacccactgtacccagcttagtgaatggctgaggcctggctcgccgccctctcctcgtagacttctagagcccttgctgtccctcttgtctctccctgcctaccttcccatggcctcccaagagtgagcttgtaataggcatgttggatggagctgttcccctgcccgagcctgccgaggcgctggccttccagcccatctctgccaccacctggggctctgtagtagttcacccactcgcgctctccattcctgccacctccccaaccctggctccttcccctgcccaacaatgctgcccactgccttgacctgtgtactccctctcttcactcagagcccaactcagagccatgcccccggggagccccaggaccaggccaagctgaccaccctgcatgcccagtcagctctcctctcatcatcatcatcatcacttacattcctctgttcaaggacagggacccacacacacggcatggactaggtttcctgaaacgtgtgtgggatggagggtcggggaagccacccgctcacataccacattctttcgcagctgcttccctgaatctgtggatgtgggtggtgcatcaccccacagcaagaccatcagtgagagcgagctgagcgccagcgccactgagctgctgcaggactacatgctgacggtaggcctccgctgcagggacgctgggctgcatgagggagggggtgccccagggaggatggggggaaggggaggaggaggaggagcagtgcagggcaggctgcagtgagtgaggtcacctagagcactcttggtcaattttgctgacatcactgccttttcctggggatagtctaggagagcatcagtcagtggggctgagttgggagtgctgtggccgtcagggctggactgtgggcctgtgcttgggtcctgggggaggggagggaacggtggcccctgcaaggccacatggccagacatttttatcctccccatcttatatagttctgtcattgcaaactcaagtcttcctgatttgcctgtgtgcctgtgtgtagcctaagggcacaggcattggccccgggccaggttgccaacttccaccctgccctgctggctcctgtccctcccatgcactctgtgttccagctcaggagagtggagctgcccgggtgccttggtctcctctgggtggccccgtgccaggtctggtaggatggggacacattgtggtcattctgatgccccagcctgtgcagaggtgaagccagagacagctggtgctctggctggggttagtggctgtggcaaggtgggcccgactgccgactcttgcctactgtgcccagccccctatctggctctgctctcttgcagctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtgagtgggccctggaaagagggtggcttgtccaaacctggcttggagaggctgatccctcctgggaatgtgcacacggacccctcagtgggtgcagcaggggctccatcagggatgggagatttgaaccagagatggcatgagagcagagtccagagatcggggaatctgctgtgattagtcagaagggcttttcccaggtactgttgggggcccaccgacaggccttcattctcctgggaactcaagctgagctgggtgggccctgccaggaagtagcagagatcccccaggagcagggctgggagtgaacacaaccctgagatttaggaaaacagtgctggaggagccagagaggcatgggttttggtgaatgtgtaggacttcaaggcggaaggaccagcgtttgccaagacccctaaaatgctcggcacattaggtcagtgcggctagagggctgtgtggtctgagcagcagagttggatgttggccccacacctctcaggggcggtgacttagctgtggtttccctctgccgacacttagaacacagcaagtttgcggtaatgtgttgctagtagccagttgaaggcttctgggtcctggcctgttttccctgcaaaccaaggaaggtgggtttgttaaccatcgtaccgacctggcagtggcaaacgtggattgcctgcccagggctccccgctcttaggagcgtgaagggctggaggctggggcagcctgtctgtacaataggttctgtctaagcagtgcctgccccttctgtgctgggccctgcgttgcctcctggcatgggactctgtctgcccctccacatcggggagtagagattctgagagacacactaggcttcccaaataagagggcagccctctgagttgggacagtcacctaggtcatggcagggaaactggactttggcatgaggcctgcctctgaggactgcacccttgttgccgggtgccagcaggtggctttgagcactgctctgggcctcagctttccccactgtaaaatgggtcctttgtgaggactaatagagaatgagaggaggccacaggttcttggcctgtgctggtgccttgaggccagggagtgtgcatgtggcagaggcagtaagctgtcagggccagcagcagtgtctgtcaagagttgaggttttagccaaactgtctggccccaggaagcatgatttcaaccaggatgctagatgcagtgagcatggcatcagggtccccaaggccatgcaccaggggcagctgtggccctgtcagggggctttgagccctgagagaagagctgagtgggctgagccgaactggaggtgccatgctgggtgttgtgtgtctgcaggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagca

SEQ ID NO: 1194 - DNA, 76284 bp, Homo sapiens; identical to SEQ ID NO: 1193

SEQ ID NO: 1195 - DNA, 76284 bp, Homo sapiens; identical to SEQ ID NO: 1193

SEQ ID NO: 1196 - DNA, 48838 bp, Homo sapiens
cagtcatgtttttttcagagggagggctaacatctggccatatttttcaacaaattcagaagtgagtagagaatgcatagtagctgtcggcagaggaggaaccagaatctctccaaagaaattcctcaaacagaatttcacacagggtattccatggagaatgaggtaggtgcaagtccagtgtggaaagcgccatttagaatgatgatggtgtgagtcccttgtgggtggctttcatggctgcttcccagggcttgcccattgtgagctagggtagcccagtctccatgacccctgctttgggaggatggggtgggtggagggttcatttgctggcttcctggtctgagaccctgtggcaaggggcgtgtatggagaagtgccgttccacccaggtggggagtataggttgttggattcatccatcttgactcaaggaagaagaagccacaggttttacatcttccacggagaagtaattttcctatggatttgtggtcgggacccaagagcctggttgaaaaatgatgtagggagatggccaagcaagagagcacccaaagctggaatttcatccacgaagcctgcaacactagtggggttctgcttgagactccaccagcatggatcctggccaccgccagtgtggcctcctgtgggcactaaggtgcctatgcctttctcactgaagcaaacaggcggtagtgggcagagctctggttccccttgaaattcgctctgtcagccgggtacagtggcttatgcctgtaatcctagcactttgggaggtggaggtgggtggatcaggaggtcaggagatcaagaccattctgactaacatggtgaaaccccgtctatactaaaaatacaaaaaaattgccgggtgtggcggcacgcacctgtaatcccagctatttgggaggctgaggcaggagaatcacttgaacccgggaggtggaggttgcagtcagccgagattgcgccactgcactccagcctgggtgacagagtgaaactccggctcaaaaaaaaagaaaagaaagaaattagccgtgtcctgagatgcgggtgcacaccggctgtgtcatacttatcatttagacctctccagcaccgaggaaaggtcctttttccattggtaggcaccaaagcacttaaaaaaaaaaaaagctaatctgtcaactgacactgcagggagtgctggaagtttgtggaaattcacataggcaggggtgcaatgtgggtgtccacagaggagttctttgtcatggagcttgtaggaggggatttgtcgtagtgcctcggatgtgcaccttaggcagtgtgatttatgaggatggcaggtgtctctctgggactatagcctatcactgtccagctggacagaatcatcgctccaggttccactgtcttctcagacccaggcactgagtttggtgcctcttccagtcattttccctcattcctgctgggccctcatgtggctgtgcagttgcggtttgtctgtctccctctttagactgggggttccctgggggcagggacggtggcttctacagccccagtgtctggcgcatagtgaatactcatgagatgtactgaatgttggccttaaggatacctaggcctttttataatactttaaacatctttgttcagaggcggttttgttttattagataaaacccaccttgtagtttattcataagggttaaataatttgcgcaaatgaaaatgcctgaaccctgtagcagagacatgctgggtactgctcagtgtgactaagtgttcttctctttcttccttcatagactttttagcactttctccagagtaatactgagctcaatgttttgcatggagaatgcagctagaaggtatagccatactatttactttggtccccaagtagaggccactgtttcatgagtctgcttttgctggttcttttagtggattcatttctccttgtaaattaataaacaggtgccctgacttataagttagtttctgagaatttgttgagcagatccagttactccagatcctgttcacccaagtgagctgataatgttgagcttcagatttaacaaaactcaagacccgcagttggcatctgagggccagccttgcccagagcctgagccttggctttgtgtgaggagggcattctcactaggtaagccctagtaggccagatttagttttagttttttaactcagaagtacattttaggtttccaactttaagagttgttttaagcttaagacgttaactttgtaagaatttgtaaggatctaggcatcttccagagtgagtttagaaagttctgtatagttatctgaggtggcatatattccatatggatgtctttgcacagcgctgcatggtgactcagagccctgtgttccctcctcctggctccgtactgtggactctggcaggtcccttcgaccctcacagcctcagtttcttcaggagagacttaggctgggatagactccacacctcactttggtgctgggactccactcatggaagagaaatagcacttagcctggtttccttctggggactgaattggtcctttggtctctgaggttcaaaggtgacaagatcatttagtggtgatgaacaggcatactcaatcaaatacatgttgaatgaagaatggttgcctgggctaatcccaccttttaaattctatgtgtccatctatagtacattctagtgagttaaagaacccatgatggtttactggaatcctgattctgtacattaaaaatatgctaaaccatttaattatttccctcgttccttccagacagggtctcactctgtttcctaggctgggtgcagtggtgtgatcacaactcactgcagcctcaacctcccaagctcaagtgatcctcccacctcagcctcctgagtgcctggaactacaggctaatttttaatattttttagagacaggtctcgctatgttgtccaggctggtcttgaactcctggcctcaagcgatcctcttgctttggcctcccaaagtgttggaattacaggtgtgagccactgtgcctgccctcaatttattttatttatttttttcttgagacggagtctcactctgtcacccaggctggagtgcagtggcgtgatcttggcttactgcaactgctacctcccaggttcaagcaattctcctgcctcagcctcccgagtagctgggactacaggtgtgcaccaccatgcccggctaatttttgtatttttagtagagacggggtttcaccatgttggccagggtggtcttgaacatctgacctcaggtgatccacctgccttagcctcccaaagtggtgtgattacaggcgtgagtcattgcacctggcctcgatttattttttaactagaactttcctttaaatttattttctttctttttttagatttaaagagaacagggccttgcccaggtgcagtggcttacacctgtaatcccagcactttgggaggccgaggtgggtagatcacttgaggtcaggagtttgagaccagcctggccaacatggtgaaaccccatctctataaaaatacaaaaattagccaggtgtggtggtgcacacctgtaatcccagatactcgggaggctgaggcaggagaatcgcttgagcccgggaggtggaggttgcagtgagccgagatcacaccactgtactccagcctgggctgtatagtgagactccaggtcaaaaaaaaaaaaaaaaaaaagagggccttgcttagtcacttaggctggagtgcagcgggcagtcatagcccactgcagctttgagctcctgggttcaagtgattctctccccccagtctttcaggtagctaggactacagacgtatgccaccacgctcagcttttttctttttaattaataattattatttgttttgagatggtcttgctctgtcacccaggctggagtgcagtggtgtgatcacagctcactgcagccttgacttcctaggctcaagtgatcctcccacttcagcctcccaagtagctgtgactacaggtgtgtgccaccatgtcctgctaatttttatgttctaatttttgtattttttttaaaagatgaggtctcaccctgttgcccaggctggtcttgaagtcctgactctagtgatcctcccatcttggcctcccaaagtgttgggattacaggtgtgagccactgcgcccagccatcagcttaaattttgtgttcaaaagcaacttcttttccaaaaatctgaggtggcttcttgttcagttttgtatctggaatagcagagagctcttccccagcaccggctgtccctcctaccaccccctgcagctgagagctgagcaaacattacctctgaaaagccccatcatcctcagcgagaacagcagctaccctgcattccgtgctgaatgggtaggagtggcagagggaggctgcagcagatgtgcaaagatgcatttctttacttaatagtgttaatattccactttctaggaaggcttacccatcaattaaaattatttgagacattaaaaaaagaaacttagggtagctgctattgaagactaaggactagggccagagagacgcctgcctccaagtagtccacagaatctgcttgttaaaatgttcgtgatttggaggcccaggtagaaggggcaggttcctctgaagcgccttggcatgccctatctttggcgttccggggtcgccctcctctgctagtctgtgagcagtcagaaggttgtatctcctgttcattcctctccttgtctcttgctgctcagaacagcagctttaagaacagggtggctgagccctaagtgtacctttggagcatcctgtgtgtcttcagcattgattgactgtttttactgtggatttaatttcagttactttactctggtcttactacttcggcttgactgtgacatcgttgagggcaggggctgtgtcacctctaaccaaagggcctccccagatgcctagcctggtccaagcgttccatcaagagtcagtaccagcgtttattgctgtccagtctgtgcaagctccatgctggctgctgggtaagagccaagggcagccaggcctaatggctcatgcctgtaattccagcactttgggaggctgaggctggtggatcacctgaggctgggagtttgagaccagcctggccaacatgttgaaaccccatctctactaaaaatactaaaattagccaggcatggtggtgggtgcctgtaatcccagctactccagaggctgaggcaggagaattgcttgaaccggggaggcagaagttaagtgaaccaagattatgccattgcactccatccagccttggtgacaagagcaaaactccgtctcaaaaaaaaaaaaaaaaaaaaaaaaaaagagcaaaggccagaggaggaaagagctgagctcgatgtagggaagaattgatgtgatgcttgggcaataagaggcatctacagatggccgtcctggtttccttgccctgcaagagttcctactatttctcactgcctaactgcagagggtctctctttaggggtgggattgtaggacgggggagcgccagagtccttcccagtgcagactgtaattctgtgtggagactataattttatgacctgtacatcaacattaaaataacagtgtaggttgcatgtggtttgtgggacctgttgatttggtgtgggcttcttggttagaggttgatcttggcaaatctcctgtctcagagttggtttcctgttgctcccataggtagattagtaactagtttggctaacaggcagctttcagaagagccaacaaatggagccaggctgcttgcccacactgtcagattcagagctcagtcactgtccatgacacagctagttatcatttaggaggaatgagctttgggggctagcaggcagaaatggtttagggacagccattttcctgtggctgatgtgagattatccatgtctgtggagatgcaagcttccgaaaagctgggctcatgggccaaatgcctctgtatttccataacctccaggccagggtcttgcacatcatagggcctgggagaataagtgagtggtcaagcatacacatttgaaaagtaattcatgtgccatctgtcacttgagagtgccagaagagaggaaatcacaggcaagcaaagcctggtgtgtttttagtgaggctagagaaacatgattttttgcatggctaaaattgcatcactaaattttgagggccgtttttaacttacagtttaccatgatttcttggctgacaaatcataggtgaccatttctcaccattctcccatgagaaccccgcactgcaaactacctgtcatgtccaaacttgtcctggggctcaaagcttgtcagggattaaggagaatgaagcccgaaagtgccttagggacatcctgtcttcactgctgtcatagagccagggcctgggcagcacaaggccacatgctttctgagcccaggccagtcccagcaagctcttatggaagcacttttttttttttttgttttgagacggagtctctctcttgttgcccaggctggagtgcaatggtgtgatctcagctcactgcaacctctgcctcccggattcaagcgattctcctttctcagcctcctgagtagctgggattacaggcatctgccactacacccagctaatttttggtattttaagtagtgacggggtttcaccatcttggccaggctggtctcaaactcttgacctcaagtgatttgccagtcttggcctcccaaagtgctgggattataagcatgtgccaccatgcctggcctttttttttttttttttttttttgagatggagtttcactcttgttggccaggctggggtgcaatagcacaatctcggctcactgcaacctccgcttccccggttcaagcaattctcctgcctcagcctcccaagtagctgggattacaggcgcccgccaccacacccagctaatttttgttatttttagtagagacggagtttcaccatcttggccaggctggtctcttaactcctgacctcaagtgatctgcctgcctcaccctcccaaagtgctgggattacaggtgtgagccactgcacccagcttctggaagcatttttaaaaagtttttatttttcttgagacaaggtctcactctgttgcccaggctggagtgcaatggcatgatcacagcttaccgcagccttgacctaccgggctcaagcaacctcctgcctcagcctcccaagtagctggtactacatgcgtgaaccaccacacctggctaatttttgtagtttttgtagagatggggtcccaccaggttgccgggctggtcttgaatccctgagctcaacaatctacccacctcggcctcccaaaagtgttgggattataggcgtgagccgctgcacccagcctgggagcactttctgtcccctctgtggttcgtcttagagcggatcatcttgtaaggatgttggtgatcttaattttttatgcttttatattttgcctcagtttaagtgtaatcagcaggaagcagaaaatatattcatcattttcaaaaaatatttaaaaattcaaatattaaaaaaatacagagaaaagttaacaaagctactgtatacatcatctggctccaactgttaccaactctgaggacctttagtcatccttactccatgctctcccctaccaccggatgtactgagcagcagagaatgggacctgggagggggcctattccaggtcaaaggggagagactactcctggtcaacggggaactactctgggtctatgagaggactagttcaggtagatgagggactactccaggtcaatggggaaccactctgggtcaagggaagactattccaggtcgggcaaggggagctattccaggtgaagaaggcggatgcaggggtgggtccagtcagcccaagtgagagaggaagcattttagcagattatagggctttaagcctgggtcacaggtgtgtcacctgttgggggcacgaatgaagagcttaggctgtgatgctggtccaactttattatagtctgtggtagtgatgagtaggagacagtctgattatatacatatatacatatatatatatatgtatagacagcagtggaagaagagataaattttaacttattgtcaaggtaaatacagtcataaaattaactggtatatattttgcttgttcacaacatatcagacgtgctcagaactttatgtagattattgtattgattgcctgtggcacttctctaaggattgttagcctgttgtgcagatggtgagagctcatccaaccagtttgcttagtaagtggtgcagcccaatgcatgccggagcagagatcatgcctaggacctgaggaacatctatctttactggtagaagaaagagagctggcaaagggtgcgtgagatgcaggaaacacaggggacagagtgacagaggcgtggtggcagcgttagtgcacttctctggaagcaagactttctgttgtgttttttgttttcgtttttattgaaagagcttcctgattccatgtctgttttagtgggtgaatggaataaaaacccagctatgaaagggtgaaataaataaaggtaagaaggaagctgaggagcagaaagctcagccttggctgtcaggaggcagcagggtcaggaaaaatgttgggttttgctctttgaggatttgttttatttggggtggcttttgtttgcttatttacttttcccgctaatgctggagagctgagcatgatggtggtggtggggaggggctcatacagggcagggtccaaccccagcctcattagggaggcagctgcagggcctgctgggagccactggacgaccaatttctgcttttttcaggagtggttactgaatagtgtagtccttggctgcaattgtctgtgaaattggtgggtttgaggaggtgtccttataggaccacaggttctgctacaccgttttatattggattttgcatatgggtgaatttcccatatgctggagagagacagaaatgagagcttttaatgaaagtttggtggtttattgtatatatgttttgttagtttctgtgtttggtgataaggggggtctgagcttggcctactgtgggggtttcggctgccatctgtgcactgggtcaccctatcctggcaggcacctgcaaaaggagtgttgtcatctcctcctgcgtttcctctgttgagagttatggaggagatggtggggaataagttctcactcttagtcacggctctggtttttgcaggcctgcgtgatgtttccttgctgcggctgcacatcagtgtcttgttttctcgggtttatgttcctttgggtgactgtagatagggattgtagcatgatctctcagcacaatttgggattgcttccccccagacccccaccccccgccgccattgtcaaaggtggtgatgaaaagctttcttacggagttattgtgaatgaagtgtcaggtcttttcctgggttctgcaggcgaggcttgctgtaatcctctcttgctctctcactgattctcactctttaaggtgactttgattgcaggattagccttcagaaccctcatgaaatgctggatagggtgtgaagtcatcagagttaggggctggccagctgctgatcagggcttctccccctacttttttttttttttttttttgagacagtatcttgctctgttgcccaggctggagtgcagtggcatctcggctcactgcaatctccgcctcctgggttcaagcaattctcctgccttagcctcccgagcagctgggattacagacatgtgccaccacacctggctaatttttgtatttttagtagagatggggtttcaccatgttggccaggctggtctcgaactcctgaccttaagtgatgtacccgcctcagcctcccaaagtgctgggattacaggtgtgagccaccgtgcctggcctggtttctcccttgttgatctgcattggagctcaacacactcagtgtccccacttggagtgttccccactggggaaagaattgcataaaaaacatatgctccacttgttgatgctagcactggccacaccttccacctgccttcctggagttctcagaaatgaagtgtcccagctgagctggaaagagttggagtgatgttatgttttatcttctgtggggaatctcccccttctatcattgtcttgccagataaggttacctggcttctatgtgttgtaggaacaggtgaagaacaaggtgcctccatgccagaggctgcatggcagcccagccccaccgtgccggcctgcgtgctggctgtggtccctcaggcttgtgtgctgttggtacctttctcaccagtctggcagtcagtgatccctgttgcatgggggccatggtagtagttttggctacttctgtttgttaaccataggtacaacacaaagcatttgtaaataatgaactccaatcattgccgtttctgcctgcagcctggaattgtctcgccatttaaacgagtattcctaaaaggtgaaaagagtagagataagaaagcccatgagaaggtgacagagaggcgccctctgcacactgtggtgttgtcattgcctgagcgcgtcgagccagacagactgctgagcgactatattgagaaggaggtaaaggtaagtcgtcatgggccacaggacgtgcctgccaaacgacagtgacggtcatgcttgtatccaccagacactcttgagtttataagacacagccacacaaacaccttagtagttgattatcccacccattgtcttgtctatgctgataaatttaataattggataactgaaaacccagattctgtctgctgaccccagtttatttttttctgtagtagcaatgccaccttctttctctcgaagacttggctgtgtgagtagtatgtgctgctccaccagaagagggttaaagagctgggagaaaactcacatctcctgtagtttgcagttgaaaagagttacctggtcaaggccatgaccttgcaggtctaacagtcaccgcctagaattcagaccatgtgtttgaggctcatcattgggtctcaaaggcctgaggccaaaatactgtgcataaaccatgtgacgtgcataagttgatttttaatccctcccctaaaatgaaaatatatgaataaaaaggtataaagccatgaggtcagagagaataggaaaggagacaacagtggatgaggtggtccgtaaacatggaagaaggaaaccgctgagggtgagatgagttagagctaatgcagccagacccgagttcctgcagaggacccagagtccagggggctcaggaggggcatggggcagttcgaatgtccatgggagggatttccactctcacctggctcagccagatgattaactcatccccacccactggaagatggggctttggacgtgcagaaacctggtacaggggcaggtggggagagaccaagacagaagataaggaagtcaagtcaaagcctgtatgtggaatggagagaattcccaattcctttttctttcaagcttctagaatgcctgcaaccaggcctttcccacaaaggaattcttggaagggtgctcattggggaagttaagcagcccctactggcccttgggtttacccaaccaaccagcctgaataaactccaacagtcaggactcccgccaggcatccgacgtctgtcagctttttggagcctcatttcaaacacaggcagctgagtataagtacacatttgaggacaactttcaacctaaaggcagagctcaagacaaatacacaaacatgaataaacagcaacaatgcagaaaataggggaagaaatgtaaaagtatataatattttcagaaagataagaggaaatattgttgacagtgacaacaggattctacttttaaataaaaaggtgagaggaagagcttctggaattaaaactgttaattaggccaggtgcggtggctcacacctgtaatcccagcactttaggaggccaaggtgtgcggatcacttgaggtcaggagttcgagagcagcctggccaacatggagaaaccccgtctctactaaaaatacaaaaattagccgggcgtggtggcaggcgcctgtaatcccagctacttgggaggctgaggcaggagaattgcttgaacctgggaggtggaggttgcagtgagccaagatcacaccactgcactccagcttgggtgaaagagtgagactgtatgtcaaaagaaaacaaaacaaaacaactatgttatttatatatctttaaaaaattcaatagaggtgttgaaagataaaagtaaaaaaaaaggccaggtgctgtggctcatgcctgtaatcccagcactttgggaggccaatcacgaggtcaggagattgagaccatcctggctaacacagtgaaaccctgtctctactaaaaatacaaaaaattagccgggcgcggtggcgggcacctgtagtcccagctactcgggaggctgacataggagaatggcgtgaacccaggaggtggagcttgcagtgatcccagattgtgccacttcagcctgggcaatagagcgagactccgtctcaaaaaaaaaagtaaaaaaaagtcccagaaagaatattcaaaaaacaaagaaggttaataaacaaaagatgagaaagagaaatgaaattagatgaccaattcaggaagttcaacatctgactcccaagaaaaaagaatgaagggaagagtgagaagaagttattaagacagtaaaggaagaacattttgaataattgactgatggacatgactccccccattgaaaggatcctgtcatgatgactagacaggtctctaaaacctcaactcacagaagcctgttcttagaagttactggaggatgtgctgcatcaaaacataaggggaggccgggcatggtggctcacgcctgtaatcccagcactttgggaggccaaggggggcagatcagatgaggccaggagtttgagatcagcctggccaacatggcgaaaccctgtctctattaaaaatgccagaaaaattagccaggtgtagtggcacacgcctgtaattccagctacttgggaggctgaggcacgagaatagcttgaacccgggaggcggaggttgcagtgagccgagatcgcacccctgcactccagcctaggcgacagcgtgagacgcggtcttcaaaaacaaaacaaaacacaagggcaaaccaagaataggaagacacggattcatagcccaaggggtctgccagggaaaggaacaaagataattcccaggatgacaggaaagtgaagtcccaggaaattaatctaagaaacaggccacagaagctctgggataagtaagtatagactatatgtttgggtagaataatgtattgagaagttgctgaagaaatagaatagtacatagaaacaaagcaaatagaggtgtggaggaattgataataaatcattaaaaatgaaaacttaaatgttggaaactcctgtttctgggaagatgaagtagacattcttttccctgttcttctagttaagtgcatctaaaatctaaaatccttggacactatatgcaataacgtaagaacactctgaaaggtaaagagaacgcagaccacccaggacccagaaaatgacccagtagtgatttcttcaggttgtctttttgcctcatgtagcccagactatgagccgaagaaactggcagcccagaaacaccaacaggtacagacagaaccccctgccaaagccagctccttctgaccaaaggaccaggaaaggggcagcctagcacaaaacagagaatatttagacaactgctcagtgcaaaccaaacatgatagaaaggactgtggtcctacctctgtgcctgctaccagaggctaagtgagggccacttactcctccagagaaagttgaatagggaccatggacttttatccctgttgggcagtaacaaacccctaaggaaccttgtgtggttctggagtgttagtggagaccacattgggtggggcagtaatgaggccctcctattccttccaaccagggaagaatcagtggaagccacatggggaaccagaactcttatcatacccagcagtaacgaggaaggagccctccacgcaggaggccaagtagggaatctgacctttgacccctacttggtggtaaaggtggtgttgtcgagcgccgtggcccatgcctgtaatcccagtactttgggagactgaggcggacggatcacgaggtcaggagttcaagaccagcctgaccaacatggtgaaaccccatctctactagaaatacaaaaattagccagttgtggtggcacacgcctgtaatctcaggaggctgaggcaggagtattgcttgactccggaagatggagattgcagtgagctgagatctcaccactgcactccagcctgggtaacagagcgagattccatctcaaaaaaaaaaggtgccgttcccttcccttctgagggcctaggttaaattttctagcatttgtattgttgaagtcctgaaaagagaggagaaagagggaagggctgaaaaacttttcaaagatcttatgggttgaaacgtttggcaaaggacaaacttaaaagattcagaaagctgagcaaacgccaaacaagataaatccactactaaagcccatcatagtagaatttctgaaaagtaaagacaacaacaacaaaaaatcttgaaagtggcaagaaagaaacactttactcataggggaaaacagaaagcagatttcttgttacacataatgaggaccagtggcacaacattcttcaagttctgagagaccctgagaatcaaaaggataatgagagaacacaagcaactccacacacagtgggccaaaaaatagaccaattccttgaaaagcacaaactcctcccacagtcatccaatatgaaatagatcatttgaatacccctataattattaaagaaattcagtatctaatttgaaaactcccattaaaaaaagtctttaggcccaaatggtttcactggagaattctatcaaacatttaaagaattaatgtcaattctacatactcttccagaaaaacagaaagggagggaactcttctgttctctcttctcttctctgctttctcttctcttcttcttcttttttttttttttttttccttgagatagggtctgtctctgttgcccatgttagagtgcagtggcatgatcatggttcactgcagcctcgaccttccaagctcaagcagccctcccaccttagcctcctgagtagctgagactacaggtgcctgccaccatgcccagctaattttttattttgtagagatgaggtctcactgtgttgaccaggctgtcttgaactcctagactcaagcagtcctcccacctcagcctcccaaagtcctggaattataggcatgaaccactgcacttggaatattttctgactcattttgtaagggcagtattgccctgataccaaaccagacaaaaaacagtgcaaaattaaaagaaataacagacaccaatacaaacataaaattcctcaggaaactattaggtaacatattcagcaatatagaaaaaattatacctactgtggctgtgagaataaacaacaaaaaaattatacaccgtgaacaagtggagtttgttctgaggatgcaaggctggtttgatacttgaaaatgtaatccattggcaggagaatcacttgaacccaaggaggcggaggttgcagtgagctgggattgtgccactgcactccagcctgggtgatggggtgagactccatcccaaaaaaaaaaaaaattgtggagaaattttaattaacatttcttcaaatatttaactttatttttttctttccttctagggctcccattaatcacatattgatatttattttatttttcatgccctttcatttttctctcatttttcctattctttactcttcccaatgccttctgggaatgtttcaaaccactctccgtcttatgaattcattcctcaactgtattcattcaaccctgaattaaattgtttgtttctactatatctgattggtccttttttataactccttgtccctatttgtttccagtgccctcctacatgcccttgagaatatttattaggattattgtaaattcttgttttctctggcttatcagttcttctccctccagaattagttgtttagtttgtgatcttgcctttccagtgcttgaggtctgtgttccacagatctgtctttattttttccattccctccagaatatcagctatagtttttttgttttgttttgtttcgttttgggatggagtctcgctctgtcgcccaggctggagtgcagtggtgcaggctccgctcactgcaagctccgcctcccgggttcacgctgttctcctgcttcagcctcccgagtggctgggactgcagaagcctgccaccacgcccagctaatctttttttgtatttttagtagagatggggtttcaccgtgttggtcaggatggtctcgatctcctgaccttgtgatcctcccgcctcggcctccaaaggtgctgggattacaggtgtaagccaccacgtctggcccagctgtagtttttatattacgttctgagttccatctatagcccacttgcttctgaggcatctccaggatgagattcaaaggagggaaaccccaattgctgtaagttccccatcttgactcttgacttccttacagcataaactacacttctggtcctcaagatttagcccaatttgactgggctgtctttttatgttcagtagaattagactatatcacagaaccaccaaacattttttactagtttatggagagaattaccattttctagaggtagggaagagacattagtgacctcatatggcaaattactatggagaatataattatttccaaattttcctagaaccataatactttgtgattgttacagtgattcttattttccttccttccttccttagacctcttaagtataccctataatatgatttttaattcaaaagttattaaaattttgttttgaagatttcataactaaactctaaccgatccccaagatgactagaaaagcctcttggttttacaaaactagtttggatagtgctgttctgaaggtataatagaaattggtgaaattatttgtggcctgtctttgtgttcttgctgtatcaatatttgtatcttatcagatacctttacatatgtctagccttttctttctatctgacattaacttattcaacaaatatatgttgaacacttgctccactatcgttatagctgctaggtgcagctagaagtgacagctgatagagcaatttctttagagtagtttgtgcagtttcagttgaaaaatcagcgcctggtttccattcaggccctgctattgtgcatgggaacttgaatcaccttggaacttttgtattgatttccataaatgggaagttagatgaattgcttaataataccatatgtttgcagaaataaaagaaaaatcaccgcttaaaaaaatgtaatccatcatattaacaagctaaagaagaaaaatcacataattatatcaatcagtggcagaaagtttatttgacaaaattcagcacccattcttgattaaaaactcagacaaatggggctgggtgcggtggctcacgcctgtaatcccagcactttgggaggccgaggcaggtggatcacaaggtcaggagatcaagaccatcctggctaacatggtgaaacactgtctctactaaaaatacaaaaaattagccggacgtggtggcgggtgcctgtagtcccagctactcgggaggctgaggcaggagaacagcatgaacccgggaggcggagcttgcagtgagcccagatcatgccgctgcactccagcctgggtgacagagtgagactttgcctcaaaaaaacaaaacaaaacaaaacaaactcagacaaacaagatatgtttttgaacaatgaatatgtggatatcaaaattaaatcaataccattcacaatcacttaaaaaatgaaacacgggtataaatcttacaaaacatgaataagatttgtatgctgaaaactatagaacactgatgaaagaaatcaaagatctgaataagtggagagacacactgaattcatggattggaagactcaacctaattagtatgttacttgtccctaagttgatataaatggaccaactccttgaaaagcacaaactactactacaagtcatccaatatgaaataatttgaatagcttgtaactattaaaagtgaattctacaattcctatcaaaatttcagcaagaattttttgtagatataaacaagactattcttaaagtgcagtggcacgatcttaaatttcaagctattcttgaaatttaaatggagaggcaaaataagtagaatagctaataataattttgaaaaagaagaaaatgagaagagtcagcctgtctgatttcaagatagatcatactgctatcacaatcaagactgtggtatctgcagagggactgacacagagatcaggggagcaaaatgaactagaaacagatccacacatatatgcccagctgattcttgacaaaggttcataagcaattcagtggagaagggataggatagccttttaacaaatggtgctggagcagttggacatttgtaggcaaaaattgaaccttgccctgaatttcacaacttaaacacaaaaattaactcaaaatggatcataggcttaaatataaaatacaacttctaggataaaacatagaaaatcttcaggatgcagggctacgcagagttctgagacttgatacctaaagcataattcataaaagaaaaaactgataaactggacttcatcaaaatttaaaactcttgctctataaaagacaatgaaaacatatgctacagactgagaggagatatttttaaaccacatatctgacagagggttggtatctacagtatataaagaactctcaaaactcaacagtaaaacaaacaatccgattaagacataagcaaaagacaggaggagatacttcaatgaagaggatatacagatggcagtaagcacatgaaaatatgctcagcatcattagccatcagggaaatgcacattaaaaccataatgagctgccaatacacacctaacagaatgtttaaaaaaagtagaacacaagatgctggagaagatgtggaggaactggacccctcattcattgctggtagggatgtaaaatggtaccgccactctagaaagcagtctggcagtttcttcaaatctccacgtgcaactacgaacaacttggcaattgcactcctaggcatttatcccagggaaatgaaaatttatgttcacatgaaaacctgcctactaatattcaaaacagttgtattcatagtagcccaaaactggaaacaactccatgtcctttggtggataaatggttaaacaaaatgaggtccatccatgccacagaagactattcaataatacaaagggctgggcatggtggcacctgcctgtagtcccacctactggggaggctgaggctggaggattgcttgagcccaggaagtccaggctgcagtgagccatgatcatgccactgtgctccatcctggatgacagtgagaccctgtcttaaagcaacaacaaaggaacaaactacacagcaacctggatgggcctccagagaattatgttgagtgaaaaaagccgttcctaaaggtttcacactgtatgttcctttctgtaacatctttgaaatgacacagttgctgaggtggagaacagattagggtttgctaggggtggagagaagtaggtgtgcctataaagggcaacaggaggggtcctcacagtgatgggtgctctggctgtgtttacatccatgtcctggtgtgatgtgctgtagttctgcaagatgtcactgctgggggcaatagggtaaagggagcgatggatctccctgtatcatttcttataataagagaatttacaattaccttaaaataaaagtttaattataaagaaattgcaatttgactactacttggcatgtcagtgagagaatgtagataataaaatgatgtaaaaactaagtaatgattaagaaaaattatctaagttgtaagaaaagagagggaaagtgggaatggtgatacaattggaagtcaatatcttaaattgataagcaataggaatataagcccattatttagaaaaatggctctagatcctagaagaatcagaagacttcagtgtggctgcctcttggaagtggtttgtggatggggttgtcccagttagtaaaggagattgttgttgttttgttttacaattttttgaactttatttgcctttttaaactgtatacatttcataaaataaaaacaatcacaataataaaatccaccagtgataggagacatttaatcccacatactccagtgtggtgtttatgggaagtattttgtttttagaatgaacattaatgaacaagttgagagggatttaatagtagcttctgttttggaatgcttactgtgtgcagcaacactatttaacattttaaatatatttttctcatttaatcttcacaaaaccttcataaagtagaaacattcctctgggaggccgaggcaggcggatcacgaggtcaagagatctagactatcctggccaacatggtgaaaccccatctctactaaaaatacaaagattagctggatgtggtggtgtgcacctgtagtcccaggtgcttgggaggctgaggcaggagattcgcttgaacccaggaggtgaaggttgcagtgagccgagattgtgccactgcactccaggctggtgacagagcaagactgtctaaaaaaaaaaaaaaattctttctgtagtttccatcacaagctgacattttccccagtaggatttggtgcagtgcaaggctcacgtgggctcacctagtgactatgaatggactcatagcaggcttgctgtgtggttttaataatgggacagggtaattaatcacatttgtgataacaaacccaagaagctcttctcagatttgttattattttttgagacagggtctcactctgtcacccaggctggaatgtagtgacacagtcatgactcactgcagcttcaacttccctgggctcaggtgatcctctcacctcagcttcctgagtagctgggaccacatgttgcaccatcacacctggctaatttttgtatttttttgtggtgatggggtcttgccatgttgcccaggctggtctcgaactcctgtgctcaagcgatcctcctgcctcggcttctcaaagtgatagattacaagtgtgagccaccatgtccggcctattatttatttttatctaattgaatatgtaatttatgtacatggttcaaaattcaaatgataacagagattcttggtgaaaagaaatcatgtgcaccctccgtgggaggaattgctgacaccagcttcttgtgtctttacagtctgtccatatatgagcttacacatgcatttgtttcccaaatgattacacggtatacactgtttgcaccttgctttttacactgaacagtgtatcttgatttatcgccgagtgttcacattagcacacataaaactgcctcgtccattttaatggttgcatgatattccattagatagctgtgtcatattctatttaaccagtgatttattaatacatatttaatttattttcaactgttatgtatgttttactgtacctataggataaattacaaaagtggagtttctagatctaaggctaggttactttttaatttgacagacatttccaaattgctcttcataaagggttgaagtcagtgcatacgtgaggactctgtgagtgtgcaggcggccctgtacctctgcaggttcttcacctgagtcaagcaactgtgggttgaaagtattcaaaaaaagaacaataaaaaaaccactacaacaataaaaaataatacaaatttaaaaaatacagtgtaacaactatttacataacatttacattgtattaggtataagtaatctagagataatttgaagtacagtcttggccatataacaacatattggtcaacgacagaccacacatatgacaatggtcccatgagattataagggagctaaaaaatttccattgcctagtgacatagctgtcttaacattgtagcacaacgcatcaccttttctgtgtttgaatgtatttagagtcacaaatacttactattgtgttacagttgcctgcctgcagtattcatacattaacatgctgtacaggttgtagcctgggagcaataccatatagcctaggtgtgtagtgggctataatgtaccatctgagtttgtgtaattacactctgtgatgttcactcaatgatgaaattgcctaatgacatatttctcagaatgtatctctgttgtcgagtgatgcatgactgttacacaggaggagtgtaggttatgtgcaactaatactgccatattgtatgaggaacttgaacatctgcagattttggtatcccaagaggctcctggaaccaagccccagcagatactgagggacaactgtacctgtttctccaccctctgaggaacgcagtgtttattcaaactttttggtctttgccagtctgatattcttaaaatgttttctcattatagtttgtacttataagtgaggttgagtgtctttcaaatggtcaaaagtcaggtctctttcagactacctttctagatccattgcccattttttctgttgggttattgcttcttttcttatatctttgcagtagctctcagtgtgtcgggtaagttagtcctctgctgtaaagttagttttaaatgttttcccctagtttgtcatttgtctttgttcatcattgtcttcaattggttctcttgcagcagagcctgaaactggggatcatgttccactgatctgtaaagggcatgctcaagagaaagagtgaagggggtagggtagggcagaggggaaagatgcctgaaaatcatagactcgggttaatttcaacctgatcatgctctaaagcctagaatgccacagctcggtgaagacagaagtagctcagggtgttacccatccaccctcagagcagtggggggatcctgggtgagacaccactgcctgtactacactccaccctgcacttcctcatccacatatttctcacgttaagttcattctatccagactcagcttctccagaggcatttggtcatgatttctggaaacctttccagatgaactacagccctgactacttcagtgggtcccaaggcctcattccacccactggggacatagcaccatgtagcaactattggtttagatgtatactgcatcctaaagaagagggggcatcctttcagggtgtcatctcccagctggccacagctctatcaagatgacagctccaggatgcttgggtatttatttatttatttatttatttatttattgagacatagtctcgttctgtcgcccagcctggagtgcagtggcgtggtcttggctcactgcaagctctgcctcccgggttcatgccattctcctgcctcagcctccctagtagccgggactacaggcgcccgtcaccacgcctggctaatttatttatttattgtgagacggagtcttgctctgtctcccaggctgtagtggtggcatgatctcagctcactgcaagctctgcctcccgggttcatgccattctcctgcctcagcctcccaagtagctgggaccacaggcacgtgccaccacacatggctagtatttttgtatttttagtagagacggggtttcactgtgttagccaggatggtctcgatctcctgacctcgtgatccgcccacctcggccccccaaaatgctgggattataggcatgagccactgcgcccggccacgcctggctaattttttgtatttttagtagagacggggtttcactgtgttagccaggatggtcttgatctcctgacctcgtgatccacccgcctcggcctcccaaagtgctggggttacaggcgtgagggtattttataggacattgaattccgtgatcatgtgcctactgctgtacctcctttagcactaagtgagtcccttgatccaaggtgatgatggtacttgctgtcccacatcggaaaccacatgctccacaagcccttggagagtaggttggcagctgctgcaggcaggagaggcaaacccttatgtggaggacatgctaatttttgccagaacaagtgtttcttattgcaggatcaaaggagttctgaagtattcagctggccagcagacaggacaactggttggtctcttggaggggatgatgccttatcagggctgcagaattggtatcctgctggcaggtctgccacggtgaagggctgtagtgtatttgcttgtgcctaagtatgtgaaccaggcttggggttttctttctgtcagctgtgtattgggaaccctttctgaggctgtgggtgtaatttaagggagaggcttcagaacaggtccgctgggaagtgtttaggtttgggccacctgttcctgcagctggcactgttagcacagtcctgcagtaagaacgtgaacatgtactgttgtccatcccacatgaacatcagtagttcctgattggtttgaggaagaagtgtttaccgcatcagtagctacaaaccatgtacccaagattgtttatccacttgaataaagattccatttagctcagtttgtggcagtctacagtcatctaccacaatttatccaccataatttctataggagccagactgggcatgagatgggggcccctaccctgtgtcatttatgttttcaagagcagcattaatctctgcttttcccactgggaaatgatactgtttttgatttactatggccaggggtcaggggccggataaatttcaggggcttccaaatggccttttctacttatagctcttattctttagacaaaggaccaatggaaggattctgcaaagtgctaagtatgtccgttcctcttgtattacgtctcttatattcagggaagtgggcagatggccaccagtggagtctttacccagtggatgtactttcaggtggacctggctgggcttcatgtattatctgactcccatatgttcctactctgcagaggacctttttgatagtttgggtccctaagtatgtgcattgtctcagaccctctatttcaaaaacctctgaagacttgcagttcctatggtacttttacccaggtgaatgaagtccctttgggaagagctggggaaatcactgtggtgtgtacttgccttggtgttgcaggtcgactcccacgcaggcttggtctctccttcagtcagtgtttctgagtctgagagctgctccagatctagaaacggagtcagggattgatactttgcattgtagaagctcaccttagccttctgcttattccgttttgattttcttgtttatatatagtaagcagcacccttcttggcttcgtatctgtcctgcccatggaaactccagcattctgtgagccgtctccatagatccctgcatggatcccaggctcccctggctactattttgactttgctgcctattaccagctgacacctacacctgctctgtgcgagtcagtgctgctccctggcttctgctagggaaggtcttattacccccttgctcctggggagcccagttctgtacacgcacacctgatggttagcttccccttcggaggctggccagtacagagcttcccagtgatgcctgtagaccttctgcacactcattagtgccatggttgatggaatgccatcatgttctcctgagggacatgggccacgggtgggctttcctgtcattttgtatgtcgattatagtatgtctacttccctgagcctttcgatacctggatccactttgccacagcagtcccacaatctctgctttaatatgagccatcactttggctgaactttgaagagcctgccagcagtatctgagaatggcctctggaccccttctcagggtgttaaatgctgtgttatagtacatgccgtagtagagaagatctctcattcagcttaatattctgtccccctggatccagcaccttgaggtcctctcccaggtgcattccccagctctgtcagaactcgttagacacatcccgtagccggtgtcagccatggaggaggacagggcagattctggggagagcaagcagtatctcatgagattcccatttcatttgaggcctatgtgttatattcaagcaaggagtgtgtggggggcttctgtcgtacaacaaaaggggataggtcacttctgtaggcacagtgttaagaagaatttgaggactaaggttctcaaaggcatttacccagctatccccatcccaaatctcagaatcctgttccttccctgttagggcccagaccctgccacgggaactttatcaatcaaggccaataaagagaagttatggggagactgatttaggatcaatattaaaaaaaaaaacacttatatcttgtcagaagttgtttttagaagaattttctgtttagagccaactcccctaccccaccccctagacaaggtgcttgaggaggtggtgagcctgccagcgtggagctgtgtggttggcagtcaggcaagggtgtgtgagaggccacctggccataccgtcttctttcactaatcccagaactgatggagctgatggctggctggtcagatgtccccttgctctctcactgcttcaccgtggtcctctctcttgtagctgtgctcttggcttgctgggacagtgggtgtgggctgggcatggcattgccataggggcactgggtgttggccaggggacacccaggagacagggttccccagggcagatggggagcccattttgagaactgtccaggaggcatacataccgtatcctattcagatattagaacaaggattagagctgtactttttctttattgacaaaagttgttttcctactataaatatttcacagtgaaaaaaatctcaaatgagtaaagattcatccctataggaagaaagtagaatcgtgaatcctctttagagatctgtgagcctgagtttttgaagcatcatggccagattttggataacaccaaagaaaagcaagataatgatggtgatgtcgtgtcaccccagccacagggaggccagggagaattcctgtacaattctgtaaacataattccggggtacttttgtttcagcaaagcacttgacatatgaccccatcttagtcagtattttttattacccttttgagaacagagaataatatttgtggatgatacaaaactaggagggatagcaaatgaaattgaataaagctaattagatgaaattttttattgtagtaaaatatacataagatttattatcggccgggcccggtggctcatgcctgtaatcccagcactttgggaggctaaggcgggtggatcacgaggtcaggagttcaagaccagcctggccaagatggtgaaaccccgtctctactaaaaatacaaaaaaattagctgggtgtggtgacgggtgcccgtaatccgagctatttgggaggctgaggcagataactgcttgaacccaggaggcagaggttgcagtgagctgagatcgcaccactgcactccagcctaggtgacagagcgagactccatctcaaaaaaaagatttactgtcttaatcattttgaagtgtagagttcaatggcataaaatcaattcacattgttgtgcaaccatcagcactatccatctccagagcttcccaccagcccttactgaaaccatgttcctgttggacaatgcctctccatctccctcccacagcccctggcaaccaccgctttactttttgtctctatgatttgactactctaggtatcttatgtaagtggaatcatacaatatttgtccttttgtgactggcttatttcgcttagcacagtgccctcaaggttcttccatgtcgtagcatgtgtcagcatttccattgcttttaaggctgaataatatttcattgtatgtgtagatcacatttggtttattcatttatctgtcaatgaacatttgagttgtttcttgctttagttgattgtgaatcatgctgctatgaacatgggtgtacaaatgtcttttcaagcccctgcttttatttcttttgtatatatacccagaagtggaattactgaatcatatgctaattccatgtttaattttttgaggaaccaccatattgcttttcacaggagtatcattttacattcccatcagtaatgcacagggtttcaatatctccatatctttgccaacaattgtaattttcccttttttaaatagccatctaggctgggtgtggtggctcacgcctgtaatcctagcactttgggaggctgaggcaggaggatcaattgagctcaggagttcaagaccagcctaggcaacatagtgagaccccacccccgtcactattaaaagaaaaaagtagccatcctagtgggtgtgaagtggtatttcattacggttttgatttgcatttccctaataactattgatgttgaaaatcttttctcatgcttggcttattggccatctgtgtatctttagagaaatgtcaagtcatttgcccagtttttaattgggttgtttggtttttggttgttgagttctaggacttctttatatattttagatattaatcccttatcagatatgattggaaacattttctcccatactgtgggttttttcaccgtgttgattgtattctttggcgcacaaaagtgtttaattttggtgaagtccagatttgtttttcttttgttgcctgtgcttttggtgtgatagccaagaaatcattgataaatccaatatcatgaagcttttcctgtgttttcttctaagaattttatagttttaggtctcacatttatatatttgacccattttgagttaatctttgtaaatattgttaggtaaatggtctaaacttcattcttttgcctgtggatatccagttttcccagcaccatttgttgaaaagactgtcttttccccattgaatgctcatcatggcacccttgttgaaaataatctgaccatatacacaagggtctttcttgggctctctttttttctttctttcttttttttttgagatggagtctcactctgttacccaggctggagtgcagtggtatgatctcgactcactgcagcctctgcctcttgggttcaagcagctcccctgcctcagcctcccaagtagctgggactacaggtgtgcgccgccacacccggctaagttttgtattgttagtagagacggggtttcaccatgttggccaggatggtcttgatatactgacctcgtgatccacccgcctcggcctcccaaagtgctaggattacaggtgtgagccaccgcgcctggccttgggctctcttttccaatccattggtcagtgtctgtctttatatcacgctctttccatgactgtggtggtgtagtaagttttgaaatcaggaagtatgaaaatagttgaaatttattactgataaatgtaagcagtatctacatttggtttatatgagcagataggaagaggatggaaaggcctcagctaagggcaggtctgtggaaacattccaaaatgttcactgatgacaggctaaggatgagccagtacttggatgtgctgcttatttgttctgaaactgctctaattatcagaagggtcttaccagcactatagagattggggaagccaatacatacttttgcattcttccctccccacttccatcctcaccttatgaaatataaaacttcttggaataactatacatttccttatggagctgcccagcacacgcaattctgaagtttaggttgcccatctgactaagcccaagatgaacttgtatttgccaccgtgccctgagtgtgcttcagccagttactcttctgcctgtttcctgctccatccagtgagaaggctacattgcatagcaagcagcaggtagactgactcatgtcaccgtgtttacgttgcttggattcggaaatctccagagtgacctccttgcttggttcccagtcagagaggtcatctgtcagcaaagacagtttcccaacctttatactttttgtttccttctcttgcataattgcattagctgagacttctatatgatgttaaatcatagtgataagaggggacatctttgccttgttcctgatcttagggggaaggtatctaactttttgccattaagtatgatgttcgctttagggtgtttttttttaatactttaagttttagggtacatgtgcacaacgtgcaggtttgttacatatgtatacatgtgccatgttggtgtgctgcacccattaactcatcatttagcattaggtatatcttctaatgctatccctcccccctccccccaccccacaacagtccccggtgtgtgatgttccctttcctgtgtccatgtgttgtcattgttcaattcccacctatgagtgagaacatgcggtgtttgtttttttgtccttgcgatagtttgttgagaatgatggtttccagtttcataaatagatgtttttaattagttcaggaagtctctattcctggtttgctgagagcttttgtcatgaatgggtgttagatttgtcaaatgctttttctacatctattgctacaatcatatgatttttctttagccagttgatgtgatggattacaacgatatatttttttttgagacagagtttttgttctgtcacctaggctggaaagcagtggcacgatcttgcctcagcctcctgagtagctgggattacaggcacctgccaccacgcccagctaattttttttttttttttgtatttttagtgtaaacggggttttgccatgttggccaggctggtctcaaactcctgacctcaggtgatccacctaccttggcctctcaaagtgctgggattacaggtgtgagctaccatgaccagcctaattttcttatttttagtagagatggggtttcaccatgttggccacactagtcttgaactcctgacctcaggtgatccacccatcttggcttctctaaatgctgggattataggcatgagtcactgcccccgctacgattgatatttgaacattgaattagccttgcacacctgggataaatcctgcctggtcgtggtgtataattattaatacattattggattcaatttgctgattttttgtttaaaagttttggccaggcatggtggctcatgcctgtaatcccagcactttgggaggccaaggcaggaggatcacttgagcctaggagtttgagactagcctaggcaatgtggcgaaaccctgtctgttaaaaaaaaaaaaaagaaagaaagaaagaaaaaacaaaaaatacaggctgggtgcggtggctcatgcctgtattcccagcacttttgaaggccgaggcgggcggattgattgagctcaggagttcgagaccagcctgggcaacatggcaaaaccccgtctgtctctacaaaaaatacaaaaattagctgggcctggtggcatgtgcgtgtagtctcatctactagtgggaggatcgcttcagcctgggaggttgaggctgcagtgagctgtgattgtgccactgcactccagcctgggcaacagagcaagaccctgtctcaaaaatgtgtatgtgtgtatatatatatatttattttagtggttgccttagggtttgcaatatacattcacaactaatcaaaatccactttcaaataatgctgtgctgcttcacaggtagtgcaaataccttgtaaccaagtattcccagttcactcctcccactgcttataacattgctgtcatttatttcatttatccttaggctacagtcacccaatacacaaattttattttgaacaaattgttaatgtgttagagcaattaaaataagaaaaataaaagattaattttacctacatttatttcttctctgatgcttttccccttctttacatagatcagagtttctgaccaaatcattttcattctctctgaagaagttcttttaacttttcttgaaatgttaaatccctgagtttttgtttttctgataaaaatctttatttctctttcacttttgaaggataatttcactggatacagaatcaaatagttccctcctctctcttcttgcttggatggttcctgaagagaaatccagtgtcattcttgttcttgccattttataggtaggatgtttttttcctgtggaaaaaattcccagatttctgcaaagagagaatcttcctttctaattttctttttgtctttgatttctgcagtttgatgtgatttgcctcagtgtaaattacctgctttttaccgtttcatgttctctgaccttattggatctgtggatgggtgtctgacattagtttggggaacttctcagctctcattactccaaatagttattgtgttcttttctttctcttgatatcctcattgcacatatgttacactttttgtaactgtcccacagttcttgcatattctgttttctttctttcgttcttttttccctttgcttttcatgtttggaagtttctgttgacgtattcttaagctcagagagtctctccttggctgtgtccagcctcttgagcttgttgaaggcagtccccattgctgttacaggacttttgctttctggcatttcctactgattgttgcttagggtttccatctctgcttatgctgcctatctgttcttacatgatgtctactttttccgttagagccattaccatattaatcgtagttgttttaaattcccaatctggtagttccaaaatctccactatgtctgagtctggttctgatatgaggaacttaggcgtcaggttaataggccttagtgtgaggtacgtttggctggctgggagttgggctgtgtttactgtttgctgcccttgtgatgctgggggataaaaatctcctgtgtatccttgtttttgtcttccattgtttttgggttttcttcaagattccttcttaaatagagtctgaggcctgcagttcttataggtgtgcatccctgttattacacaggggtcctgttgatgtggctttcaggggagaggaagtgttctgtagtcctgggattaggtctcagtgttttagtgaacctgtgtccctgggccgtggccttcacatgtgcttctcagttttgtttttttcctcccccttaggagagacataaacgatagaggaggcaggaattgggtgtttccttacccctaggtggttaggctctggtaaaatagttttccttgaggaaagccctttgttaaggataacagaatgctctggtcatgcctttttctttctttctttctttttttttttttttttttgagatgacctctgagccctttatatgttggttgggaaactggagtgcagtggcaccatcatgactcactgcagcctcaacctcctgggctcaaatgatcctcccatctcagcctcctgagtagctggcaccacaggcacactgccgtgcccaactattttgttgttgttgttgctgttgttgttcttgttgtagagatagggtctcaccatgtttcccaggctggtctcaaactcctggcctcaagcaaacctgccgccttggccatccaaagtcctgggattatgggcatgagccaccacacctggcctggttatacttttaaatgatgtattcttccctcctcctaccagagtatgaggagatgtttctccagtctcaccctgagagcctggtggggctcatggaggtaaaactcagactggtatggggacctccccagtgactattcccctggagtttttgtctcctactggtccatgctcagtctctgccatttgtcagttcccctttcctctctgctggtgctggctctagggtttctgccccgcaatgagctgtgattcttagcattgcatatctgtctctccatctttggggttattgttttttcatgtgacctcaattatctgatggatctgagaacagtcattgattttaagtttgccagctttcttgttgtgaggatgggagtgatgacttctgagcctttacaagctggacaggaaattggaaagtcccatttcattcttttttaatagagaacttaactgtgtgaggtaatgaacaactgagaaatgttgagtgcaagaagcctgttcttgggaagaatcagcaacccattttaaaaaacagaaacattgaaaatgttatggtggttggtaagatgcaggcaggagcacagcaggtacagtgctgctgcccacagccttctacacctgaggccctgcattatggaggtttgctaagccaagtgcctcatggccatgtgtgaccaaaaaaacctttttactaaatgttttgtgctgctataacagataccacagactgggaaatttataatgaatagatatttctaggctgtgcatggtgcctcacacctgtaatcccagcactttgggaagctgcggtgagcagattgcttaagtccaagagttcgagaccagcctgggctacatggcaaaaccctgtctctacaaaaattagccaggcgtggtgacacacacctgtagtaccagctactcaggaggctaaggtgggacaattgctttgagcctgggaggcagaggttgcagtgagccaagatcacgcctctgcaccccagcctgtgtgatagagtgagaccctgtctcaaaaaaaaaaaaaaaatcgtatcgttctggaggctaggaggtttaaggttgaagggcacagctggtgaggggctgcatctgcatcttatgttatcccagggcgaaaggtggaagggcaggagagggaagggggtcaaattcatcctttcatcaggaacctgctcctgagataacaaaccctctcccaggataacagcattaatgtgctcacaagggcagagctctcgtggcctaatcagctcttttctttcttttttttttttgagatggagttttgctcttgttgcccaggctggagtataatggcgcagtcttggctcaccacaacctccgcctcccgggttcaagcaattatcctgcctcagcctcctgagtagctgagattacaggcatgcaccaccacgtccagctaattttgtatttttagtagagacggggtttctccatgttggtcaggctggtttcgaactcccaacctcaggtgatctgcccaccttagcctcccaaagtgctgggattacaggcgtgagccaccgcacctggcctaatcacctcttaaaggccccacccttaacactgttgcatgtggggactaagtttccagcacatgctttttgggggacacattgaaaccatagcacttcatttctctatttatgctcatttctcagctatgttgacctttgcaattgaggaagtttattttttagtgaagttgtgcatgatgccattgttttcagtttccccagcagtgacgagaaaaccctgaccatccctgttttagaatacagattctaccaaaactagtagttttggtactagtagtttgggatactcattgcaggacttttgatgatgaccttcactgtagaatagtaggagatggggcagcactgtcctcagccagtagagatttctgtaagaacccaggactctcttcctagagttgggcctccacgcgagccggaatggagacccatgggcctggtggcctgagtatgaagcacttggtttgtgctctcggtggtagtgatggtggtgttggctcagctcccatttctcatggcatttttttcttcactttctttcagtatttaggtcagttaacgtccataccaggatacctgaatccctccagtaggactgaaatcctgcatttcatagacaatgcaaaggtaaccctatcctcttaaccctgtgcactagccctcagcccccaccagcccttggtccctgtactcttggcctcgtggctgtgaggaatgagccagtcccatcacattatgggtacacttggctcttggccataaagactattccttagtatggacattaagttgattctcgacacttgctccatgtgattttgggctgtttccaaaatttacactttcaagatatttcaaaccatgtgccgtaagtctgaatctgaaggcagttccagaagaatctcccaaatggtttgaacacattggtgtccctggaataagcactgttctgaggggaataacactgaccttattcactcagcatttgtcacatgtgtgacatcggccagcacaatattctcaggagaagcgccccatgccggttgacagctgagtctgtatttctgatgccctgtggttccttccagagagcccaccagcttccgggacacttgactcaggagcacgatgctgtgctcagcctgtctgcgtacaacgtcaagctggcctggagggacggggaggatatcatcctcagggtgcccatccatgacatcgccgccgtctcctatgttcgggatgacgctgcacacctggtggtcctgaagacaggtacaggaggtcaggggtcaggagggtccttgtcctaaggagtacatgtgtgaattttatgaagttctggagacagtttttgcagcttcgtgttgggtgctgctgtttgtcacgaccaataattgtctttcctgtctctgagatcagccagaagagggcttgagatcagttaccagacactgggggtgactgtcacactaagagcctttggggactcaataatactgggatacagtatttaggactggtatcctgttcctctgcccggtggggctcctattgactccctctgggtacagtggagttgcccctctgcccaggtgtggtggagcctagagagagtgcagtggatagggacctcacctcagcttgactgatattttgagctctgcacagtgtcctcaaacctgggacagaaaagatgagacccagacctcccaggagctcttggtcatagaggttactctctgtgtgtccttgccgtctgctgctttcacaatgggatagaattgggcagaattgggcagaattgggcagaatgttatttttggctgtggtgagtacagtgctgcctcactggacccaagcccaagctgcccgttaatttccagcagcttccagcccaggcattcaggccactgaggatgaggggagagaccatggttcgccctacctgtattttgcccctcccagtcctgagtttcgaggctggtgttgcagtggggacagtatcctgggctccttggatctctgctggtgactgggttgatcccaaagcctttcatttccagagggccagtggcagggtgtgaaggggtcacagtgggtctgcctagaccacacactgtgttttaggtagcagagaggggaatttgttgttccacttaaggtcagtagttcattgagaatctggcgagtgtgttcattattgaccccttgagccatgaagctgccagcttgagtgcgctcttgagagcagtccactgaaagcctgtgagtctagatgcttggggttgctgtggtcataaactacacagggaacactggcggggtttatgaaggtggctgttgctctgttttgttctctgtgtagcagtagcttagacttgcgtacaccctccccaacgcaggcacacaccacacctacacacatgtacattactcaccctatctggcttagaaggctgggttggtggctccttccagccatactatccgacaccatggtgaccctcctgtttttctacctttggaccctgcgggaggccttaggcctgggacatccttagggacaaggagtgaggagactggtttctgactcgcttcttgcaggtgtttcaagctggtagggaggggagataggctcctccctttatttcttctgctgcatgacagtttctcagctttaattattagaacacattgctaaaggaaatggatgacagattttttttaatggagagagaatgagcgccataggagaaactttccaaaattagatgaaaaacaggacttctggtctttgagagaacttttgatttaaaggaagagagtgaatccctgtgtcctgggggccatcttccttgtttttgtggatgcaccggagcagttgtgtgtcccctgtgttacataaggtgtgctgtgtttattttttaatttttaaaatattttaaaaatttttgtaaggatgaagtctctctatgttgcccacgctggtcttgaactcctggcctcaagcgatcctcctgccttagcctcccaaagtgttgggactatgggcatgagccactgcactgggccgccatgctgtatttaggattaggcatccagagttctcagcataagagactagcaggtgaatagctaacgtttacttggtgcctgctatgtgcaagcaagtctctgtgcctctttggaccaaaagtacgctggtatttgggatagcacaggagtggggaagttgggggccaggtctagctgcaatagggtccatgtggcaggagctgcttggagggtgatgacttgagttggtgccagatggggcagggtcacccgtgcacccgtggtagcacttcctggatgatataggagaggcacacaactcgctgcccgcatccttaggctgcccaccctgcttccttgagaactaccacaggcacacaccagggagccaacatttaaaaatgtttaaaaggtagagatttcttaccaaactcataccaaaaaaagaaaaaaagtaaagggaaaccagtaaatttttttttttttttttgagacggagtctcgctgtgttgcccaggctggagtgtagtgccgtgatctcagctcactgcaagctctgcctcccaggttcacgccattctcctgcctcagcctcctgagtagctgggactacaggctcctgccaccacgcctggctaattttttgtatttttagtagagatagtatttcaccgtgttagccaggatgatcttgatctcctgaccttgtgatccgccaccttggcctcccaaagtgctgggattacaggcatgagccactgtgcccgcctttttttttttttgagacaagtttggtgcttgttgcccaggctagagtgcaatggtgtggtcttggttcactgcaatctccgccccccgagtagctgggattacaggcatgagccaccacgcccagctaatttttttgtatttttagtagagatggggtttcaccatgttggccaggctggtcttgaactcctgacctcaggtgatccacccgccttggcctcccaatgtgctgggattacagccatgagccactgcgcctggccaattattttcaataatatattttatttacccctccgtacccaaaacattattacatcagtatataatcaatataaaaatcgttgagctacatagcattctttctttgcctacctctgaaaccctgtgtatagtttgcactcacacatttcaatgtgggctcatcacattttgcatactcagtagtcctgtggccagtggctgccatagggacagagcagccccaggagtctcactgtggggtttgaggtacagtttcttatggagcccttgtctctgtgcatgcgctaactttgcatgtggcctgggacggccttcttctccctcctgaggctggcctgccctctgacaccctggcactagtggcacttctaggttttgttttcagtcttgaagtcctcccagggtggtccgaactgatggtgagagccctgcttcctggggattggcctcacttctgccatcaggaaaaccactgagttactccatgtatttcaggagaacctcatttgtctagggaggcaatgggtaggatgttagaaacaagggcactggggtctgaccgtctagattgccatgtggacagtgcaactcacacgccctcaggccaggcctttcactttcccatgcctcagtttacccatctgtaagaagggaactccccagaacacatggaaacctcctggaggtgactgttctcagggttgtatatgtggtctgttgtatatgaacttgaagcgtgtgaaactgcaggatgacatgcagctctggtgcccttggagctcaggggtcgcgtgttcccacccttatttagagaagcgaagtgtgtctggtgcaggcccttcacctgagtcgttctgtgggtgcctgagccaggtaaaggtcctctcagcctgtttccatggcggcctcagctgtttcctcaagtgcccccatgcctgcccttccactgtgctaaactgagatggtgttgacttctcagcccaggacccagggatctcccccagccagagtctgtgtgcggaaagttccagaggcctcagtgcaggctccctgtcggagagtgcagttgggcccgtggaggcatgctgcctggtcatcctggctgcagagagcaaggtgagactttctcgccccacttactcagaactggctcctcccagaccctgctcatggccagccccaccctggccacacccagcacagtgctgggcactgctgggtgccccagctacttcctctgccattgcctgtccctgcctcaccctagtctccacccagccccacctctctctgctcaaccctgccccaggcattgcccccatcctggccctgcccacagctcctctgcgcatgactgcatcccaggtcctgccccaggcccaggctccccaccggttcccacccctgtgccttctgaccctcctacctccaacccccagcaacttctctgagaccacctggccactgagctttttgcttatcattcttcaaggtgcccccacgctgatgggcgggcagcggcggtcacctgtgcatcctagacctgcctggtgttaaggactgtgcttgcagattcctcacaacctggaagagccaagggctgggcccttgtaggctaggatttggggccccctcagccacccaatagctgtggggccttggcagtcacttaacacctttgtttaatttccatatctgtaaaatggatgctagtgaccacccaccttaaatatcctctaatgagcatttctcagtgttggtgctactgtcatttttagccggataattttccattgtgggaggctgccctgtgcactgtagggtgttgagcagcatcccagcttctccccttgtgacagctgaaaatgtctccagatattgctacatgtcccctgggaggggtacaaaaattgccccagttgagagcctctgctttagacagcacactgttataaaactgttttatagctgttagaaatgcctccaggtgggctgtgatactgatggtatctcctctcacctctttcctgggctgggatagggttgtgagggtgttgataggtcaggttaatggaaagaagacgttggactggcagctaacacttgtgccctgcacagtcccctcacacttgcaataccacccctgggccacatggcagtcctagatagagtcctggggcagttggctgggtctctcttttgacacccctttgggtcagtgaaaggcagagggacacattctggtatccactcttcattcatgtttattgagcatctgggctgccccaggtatcctggaagccgcctgggaaggcgcagtctccagccagactgaccgagcagctgctgtcccccactgcaggtcgctgcggaggagctttgctgtctgctaggccaggtcttccaggttgtttacacggagtccaccatcgactttctggacagagcgatatttgatggggcctctaccccgacccaccacctgtccctgcacagcggtatgttgagtgagagtgggcagcgggtgggagcagggacaggaggggctactgcagtggcccccagctccccatgagttactcctggaatagcgcagttactgccgtgacatggtggccttttgtttccagactttgctgttcacattagcccatagggtttcatgaaggcagaagtgtcacctgtccttgagagagttgcaccaggtcagcgctatggcttcctggaataaatttggggtctgtgaacacttttttggaaccacttgtggctaaagtcacttcacttaactcggaacaaagagcttggagaaggctcctagcactggggcctgtgatggaattggggaggctgagagtgggtctggggagcctccttttcagtatgcccagactatggctgctcttaatgtgaaactccttccaggaccatggccagacccatgggaagctgctcaggctgccctgggaggccagctggcagtggtggagcagtggcagatggggaagaatggaaggtaccccagagctgtctcttcctgcatggcccacacagcattttcaggagtctgttagtccattgaaaacacttcatcagcaagctcacttgagttaagtcttcaaaaacatcatctgtttttcagatgtattacttattgaggattaatgggttatataaattgaggtgcataaaaagctgttggaggctgggtgtggtggctcatgcctgtaatcccagcactttgggaggctgaggcgggcggatcacctgaggtcgggagttcaagaccagcctgaccaacatggagaaaccctgtctctactaaaaaataccaagaaaaaaaaaaaggctgttggaaacagtgcggcttgttgagtacaatttcttctttttacggagataagtcccagccctctgccctttccccagtaactcgcacatctcagtgaagagagtaaatggtggagaagcctgtgctggtgtgagggctgctcctcagtgcctccttcttccctttcttgctgctggtgccagagccctttgtgggcactacacgccttgtgttggcccagcagctgcagagagacagctgctgagctctcaggcatcctctctatctcatttagtcctcggtggcccagcgagataggtgcaatcttcatccccattttagagatggggaagtggaggcttagaagtcaacagcttatccagaggaatgtaccatatgagtagcagatgatttatcgagctgtaattaaacattcagttttagtgcgactggtttggcccttgtgctttaaaattcccaaagggcctttttttctttaataattttttttttactgagaagtacacaagtcatacatgtacagttgaatgaattttcataaagtaaacacatcatgtaacaccactactgggggttgctgaagtgggcttcttcccctgccagcctttcccaagacctccccgtgggatccacacacagatgtgcacacgttacgcacatgcatgcattctctgcttatttctgccttggagttttgcttgctgtgttctctctactacagctatgccaaaacatagcagcataaacagcagaaatatattctcttataattctatacgttaagagtccattgtgggtcccactgggctaaagttgaggtgtccacagggctggttccttctggaggctccagagaagaagccatttccttgtctttccagctcctaaaggcggctgcatgccttggctcatggcccttcctctgtcttcacagccagccacgtgacctcttccacagtcacatcttcctttgactgtcagcttcctctgcatttcaggactcttgcaatcacattgagcccacccaaattctccagggtcatctccctatttcaaggtcagctgataagcatcctttactcccctttgaaattggtaacatattcaccaattccagggattaggatgtggacgtctttggggggtcattattctgccctccatacttaccttgttcctagtgccagaaatgtcccttttatctctcagcctctccctctgcttcatttaaaatcttaccctctctgcaacactcacctgcctcgctcacaaagctttcactcactgtctgtgctggtgtgaaatgtgccttcctcaggtttgaaatagcaaattacagtctgtgtcacacggacctaatgtcatttgttgaatgtagctgctcagtgccagaccctttgctggtctgagggtcttgggaatcctgtggcttcactgggttcagatggggagtcagactgcccggctctgactgtggtttctgctgtgtgacctgggccaagttgtgtaactctctgacttacttcctaatctacaagtgaagacaggggtgatatatgcctgggttaaaggagacaaagccccagtaaccctgcctggcacatgagtgatacctcaaagacagcttttgctggctctggccatgggtgaatgtgtacttcagcccagcgtgcagcaggatttgcatttgccaggatccccaggaggggtgtatgtgggctcaagtctgggaagccctgccctgaggcacacagcacattccagagtgcgggcagcttgatgaaggacagcagggtccctgaagaccagggctgccgctgtctcctgtaaatacagcagtgggctggactcaaaatgcctccccactatgtccctgaaagtcatcttagttttctgcatcttccttacagatgactcttctacaaaagtggacattaaggagacctacgaggtggaagccagcactttgtgagtgcacatgccaccaagccctgcggtgggacacgcaccaaatgcgttgtctggtgttgtccaggctgcagccagtcagctcccccatctcagctcaccctcgctaagccatccccagacccactgtacccagcttagtgaatggctgaggcctggctcgccgccctctcctcgtagacttctagagcccttgctgtccctcttgtctctccctgcctaccttcccatggcctcccaagagtgagcttgtaataggcatgttggatggagctgttcccctgcccgagcctgccgaggcgctggccttccagcccatctctgccaccacctggggctctgtagtagttcacccactcgcgctctccattcctgccacctccccaaccctggctccttcccctgcccaacaatgctgcccactgccttgacctgtgtactccctctcttcactcagagcccaactcagagccatgcccccggggagccccaggaccaggccaagctgaccaccctgcatgcccagtcagctctcctctcatcatcatcatcatcacttacattcctctgttcaaggacagggacccacacacacggcatggactaggtttcctgaaacgtgtgtgggatggagggtcggggaagccacccgctcacataccacattctttcgcagctgcttccctgaatctgtggatgtgggtggtgcatcaccccacagcaagaccatcagtgagagcgagctgagcgccagcgccactgagctgctgcaggactacatgctgacggtaggcctccgctgcagggacgctgggctgcatgagggagggggtgccccagggaggatggggggaaggggaggaggaggaggagcagtgcagggcaggctgcagtgagtgaggtcacctagagcactcttggtcaattttgctgacatcactgccttttcctggggatagtctaggagagcatcagtcagtggggctgagttgggagtgctgtggccgtcagggctggactgtgggcctgtgcttgggtcctgggggaggggagggaacggtggcccctgcaaggccacatggccagacatttttatcctccccatcttatatagttctgtcattgcaaactcaagtcttcctgatttgcctgtgtgcctgtgtgtagcctaagggcacaggcattggccccgggccaggttgccaacttccaccctgccctgctggctcctgtccctcccatgcactctgtgttccagctcaggagagtggagctgcccgggtgccttggtctcctctgggtggccccgtgccaggtctggtaggatggggacacattgtggtcattctgatgccccagcctgtgcagaggtgaagccagagacagctggtgctctggctggggttagtggctgtggcaaggtgggcccgactgccgactcttgcctactgtgcccagccccctatctggctctgctctcttgcagctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtgagtgggccctggaaagagggtggcttgtccaaacctggcttggagaggctgatccctcctgggaatgtgcacacggacccctcagtgggtgcagcaggggctccatcagggatgggagatttgaaccagagatggcatgagagcagagtccagagatcggggaatctgctgtgattagtcagaagggcttttcccaggtactgttgggggcccaccgacaggccttcattctcctgggaactcaagctgagctgggtgggccctgccaggaagtagcagagatcccccaggagcagggctgggagtgaacacaaccctgagatttaggaaaacagtgctggaggagccagagaggcatgggttttggtgaatgtgtaggacttcaaggcggaaggaccagcgtttgccaagacccctaaaatgctcggcacattaggtcagtgcggctagagggctgtgtggtctgagcagcagagttggatgttggccccacacctctcaggggcggtgacttagctgtggtttccctctgccgacacttagaacacagcaagtttgcggtaatgtgttgctagtagccagttgaaggcttctgggtcctggcctgttttccctgcaaaccaaggaaggtgggtttgttaaccatcgtaccgacctggcagtggcaaacgtggattgcctgcccagggctccccgctcttaggagcgtgaagggctggaggctggggcagcctgtctgtacaataggttctgtctaagcagtgcctgccccttctgtgctgggccctgcgttgcctcctggcatgggactctgtctgcccctccacatcggggagtagagattctgagagacacactaggcttcccaaataagagggcagccctctgagttgggacagtcacctaggtcatggcagggaaactggactttggcatgaggcctgcctctgaggactgcacccttgttgccgggtgccagcaggtggctttgagcactgctctgggcctcagctttccccactgtaaaatgggtcctttgtgaggactaatagagaatgagaggaggccacaggttcttggcctgtgctggtgccttgaggccagggagtgtgcatgtggcagaggcagtaagctgtcagggccagcagcagtgtctgtcaagagttgaggttttagccaaactgtctggccccaggaagcatgatttcaaccaggatgctagatgcagtgagcatggcatcagggtccccaaggccatgcaccaggggcagctgtggccctgtcagggggctttgagccctgagagaagagctgagtgggctgagccgaactggaggtgccatgctgggtgttgtgtgtctgcaggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagca

SEQ ID NO: 1197 - DNA, 26348 bp, Homo sapiens
ctgacggacatcctgatgttggttttactgttttcgttttgaatacacaggctgggtcaggagcagtgagatttgccagcactcagggttctaagggtcttgggccagctctggatggaggaagagccccacatgcccagagcaaggccccccattaagggactgcagccacctccaagggctcctccctccacccaccggctcccaaatgccagagggagcctcttcgccctccctccctgcccaccatccctcaaccatcagcctggcgttcaaagcctttccaagtcccacctcacttttccctctcccaaaggtgcccaggctctgggcaggccctgctcatatccctgatcatggcacattctctggaggaccctcctgttctcgggtaggggccgtgccccacctaggtagccgtcccatgtgggatcctgtaggatctctaaaacctagctctggccccaactttctgtctgccctggaggtttctcagcctcctgagagctctgctgggccccggtctgggcagaacctgggcctaaacaaacaagagccagggcagccagggtctctgcgtggctgggcccagggcttgccctcagagctcacctgtccaacagaagaggagtgtgcctccaccttccctactgcccgcccctttttcagggtcttagggcctctagccctgtggtggggtgctgggtgccccaggtggagctgaagtcatggggctgttgaggagttggtgtccacctggagtctgtccagtgagtttaggtcaacaggtgtgcagtctgtccttcgaggctgagccacctcccaacagcctgaacaactccaggggccttttgagggaggggcaggcaggcccagtgggtggtcagcccaaggtgaacccacccaccatggccagggttccttaggttgagcctccagtgggtgaaacctgggagtcctcaaccttcctggcagatggggccattgacaagaggaggtgggcggggcctccacagactccgccctgtggtgtcacacagctggcagccaatggaaagcaaccagccaggaagccccggagctacccttgctgggtacccttgctgggggacctgggccatcccagtttgtgcagagcggccggaggcagttaggagcccacgttcagtccaaggccgtccactgagccccgtgtgactctgacagagctgggggtgtccatgtcctctctggacctcagttcctgtaaaaaggcccgttggccagatcggccgccgggctgctcacaggtgcacgggctgcacgtaactccgtgggaagaagccaacgcgcccgcaggaccggccccgccaccagtgggggtctgggcgctccaggacctcaatgatgtcgccacggcggaagctgagctgcgaggggtcctgggctgagaagtcaaactgggcctgggcaaagcaggccccaggtgactgcaagaagaggaggtggttagtagggtgccttcagaagccctgcaacccaccctccctcagaggcacccaagagaagtgatttgccacaggtgaggaggggtctcgggcagcaccggagttgaactttaagtccagatcaatggtagtgccaccactgggcctcctgctgcccacacccctgcctgtctgctgtgcagatgctgcatctacatagaacacggctttcccagccgcccagctgggacaatagggctggtgggtcaggggacctgagtcctggtccttagggtgggattttggttaggtccctgcttctcttgggatcttatttacccgactctgcagcagccatggtagcttttgactccaggccacaaagccatgagaatgggccttataaactgtaaagtgacgtgcagctaagagtcgtgtttattgctcttgcccttggtcagccgttgagggagagaattgtcactttgagctctcaggcctgggctccactcctatctatgccccatgtgtgatgttgggtaggtccctgccctttgtggaactcagtttccccacctgtgaatggcagcaggacaggagctctctgcagcacatctgcctggcaccgtgactattgcacccagcaccctggccctgcctgcccaccaagatctcagctctgaatctgcagaatctcatccaggatgggtgataggatcagcagagaagctgtaattagcagctctctgcccaggaaggaggaggcgtcataggtcccaggggactgaggcagctctggagtcgagccacagggtgggtgaccccacggcccgggccagagcgaggtgttgggtgtaggggagctctcagttgcccctgccctagctccatcctggcttcctcacactcttccaaggcagagctggcccaggtggtgaacagggaggaggatggagatctggcagacaggagcccagctggagagaaaagtgccctgaggctgggagctcacagtgacctgggcactcagggtcaggcagggaaggccaacagaggagaaactagtgggggtctctcaaggcactgtttgactcccctggcatatcagaccccagggctcatcctactgaacagagggaacactgaggggatgaactggcctctgatcacatggaaaggtggtggggaggtgctaggaacaagatttggctggagcttctcttcagcggttatcagcctctccccaggccttggccacactccccatctcctctgcagagcccaagctcaagtgtcccagggtcttgacctccagccccaggccttgccagcatccccgctcctgaagaaaacagcctgttggggctaataaccccagtggctattgttggcatcccaatcagcttcagagctggcccttggggctccttgatgaaagggctggctggcaaattgctgttattgcaaggtcaaggggtggatgaccccgaccccccaccccccaccccccaccccgcggcttgccaggatctcgcccaccagcactcatgctgccccacacccaaggtcaactcttccgcgagcagaaaccaggactgagcctaccaggtaagtgtccttggatgagtcactgcactctctgagcctcggtttcctcatctgtataatgggcatgatgaggctcccagagtacagagaccagttcagtgcatggtacccagtatgctcagtgggggtctgtaccttccttcactcaatgaacatttattgagcacctactgtgtgccacatgctattctaggagctgagaacaagctagacagtttgtccccatgggattttccttctgtcctttgcttttctttccctcttctcctttcccacccttgcaagtctcaccatagccgccaccaggatataacttcgaagcctgggctggacgcctcttgcaataccaggctgctggggaagtgagaccaggcccgtgcttggcctcagtgtcagcatctcccctgctgcagatggcaggaggtgcagagaggctcccacaggccagcccccacccgcccctaccttgagcaagggctcctcgtcgcgcaggaagatctgccgcttcttggcgatggtggtggtgcggtagaagtcgaccagctcgttgagggagttgaacttctcctcccacaggaagtacttccccgaggcctcacgcagcaccttgaagtgctgcacctggtctccatagctaggggaaaggacccggggccacctcaggtggtggccgtcccagcctggcatggtcccaggggctcccgtctcactaccacctggaaccagcctgtctcacggtgggacctggagtcagataaggtgcaagtgggagaggccccactgacccagctccacatggggtctggggagtcccatctggcagtggaatatggggttaatttaagggtgtgggctctgaaccaggccactttctcactgtgtgacctcatgcaagtctctcaacttctctgaacctcagttttctcataatgataacatctccgttatggataagtgcacagtgactggcatattggcaacgtgaaatgggtacctctgagtgtgtcgtgatcagagagcatctccttcacatctctttgttgttcccctcagcttggacctactccctgctcccctgctcctcccatgccccagagtcccttggggagcaagtcctagactcatcctgactcagaccaaagcctactgctatgagaggagctcagacctgttgaatgtctcacgtcctccccctcccatgaaccttccgtggcttctcccttggcctcagggtaaactcttaacacttcagactcaagatctggctccacttacatgtccagcttcatttactttatatcctctccgatgaagcaagcaggcccctttctctcatttcccgtctgtgccctgccttccagccagcccactaccgccaaatcgccccgagtaccttctagcccagcggaggagagagcctgctctttcttttttcttttcttttctttttttttttttttgaggcggagtctcgctctgtcacccaggctagagtgcaatggcgctatctcggctcactgcaagctccgcctcccaggttcatgccattctcctgcctcagcctcctgagtagctgggattacaggtgcccgccaccacgcccggctaattttttggtatttttagtagagacggggtttcaccatcttggccaggatggtctcaaactcctgaccttgtgatccaccctcctcggcctcccaaagtgctgggattataggcgtgagccactgcgcccagccacggatttttctctctcatttcccgtctgtgcccagccttccagccagcccactatcgccaaatcgccccaagtaccttctagcccagcggaggagagagcctgctctttcttttttcttttcttttttttttttttttgaggcgtagtctcgctctgtcacccaggctagagtgcaatggcgctatctcggctcactgcaagctccgcctcccaggttcacgccattctcctgcctcagcctcccgagtagctgggactacaggcgcccaccaccgcgcccggctaattttttttgtatttttagtagagacggggtttcaccgtgttagccaggatggtctcgaactcctgacctcgtgatccacccgcctcagcctcccaaagtgctgggattacaggcgtgagccaccgcacccagccgagcctgctctttcaaactggccagaggcagagcctgtcctggctgggactgggcagaggaactaactggaacctctcacactcggcgtgtccacccaggacaggccttgtggggctgggactggaggcggtgcagctgtgggtcaagatcatggcagacatgactgcagcgctgccccgctgtgcttcgggggtggctggcctgcctcacggcccaggaggagcaaattgggccctatgtttcagtttctccaccagtcatccctggggcagcttgctgctttattgatgttttaagatgaaagatttcagataaagatgtgttcaaggccgggcgcggtggctcatgcctgtaattccagcactttgggaggccgaggcgggcggatcaagaggtcaggagatcgagaccatcctggctaaaccccatctctactaaaaaacaaaaaaaaattagccagacgtggtggcgggtgcctgtagtcccagctactccagaggctgaggcgggagaatggcatgaacccaggaggtggaggttgcagtgagccaaaatcgcgccactgcactccagcctgggcgacagagcaagactctgtctctaaaaaaaaaaaaaagatgtgttcaaggttcccaccctctgatctgtatgaggcatagggcaaaacaggattccccctactccattccagtcaaggggtccaaaccacttctaaacacacctccaggcatttgcacacagagtgtcctccagctagagggaatttttcttgaaatcctcatgccccagtggggaaactgaggccccgagtgcagccgcgacctgcccagagccacaacagcaagaaaggtcagagctggggccacatttgagctcatacatgtaaaacgttgcctaatgccctcctgattggttattatcacataacaatagcaataataattattccaattatgctattactattgttccagagctcatcattccaagtccatttctactttgccatgttgctacctgggctgtgccccccaggaggccctccctccctgcctcatcctctctgcctggccaaaccttagctacccttcccagctctatagccagcctgcctggacttagaccccagcccacctctctgggcctctgcgtcctggcctgccaaatgtgggcgatagtgcactccttgcaagggagctgagaggcctgggaccctgggggctgtgtgggtgctgccaacagagccaccctaggcccacctggctgggctaggggctgtggggagaacacagaacagtcccagctcccaaccagaaagaagacagtttaggaccccgagggagggcacctgttcaggtggctggcggagctaatagctgggaaagcctggggccctgtgagccgggtgaggcagggtaggggcacaggatggccactgggaggtagatagcccctcagcctcctgagccacaggctagggatctttttgttcacatttgggctaaatgagatccaaccaccagtccaaagcacttgatgccttgatgggacacatgcgcgcgcgcgcgcgcacacacacacacacacacacacacacacacacacacacacccctacctctcctgggttgtaaattgaaatctggttaaacaatttggtcgcaatacatttgcaagcttgggttcacccacagcctgagttccttcaggtctatggttctcctgaacaagagggtggtgtctgtcaccccagctgcccagatctgctgctccatctgtcctatccctgcctgtggttgagtttctccaccagtcatccctggggtggcttccttccttattgatgttttaagatgaaagatttaagataaagatgtgttcaagtttcccaccctctggtctgtatgaggcgtagggcaaaatgggattccccctactccattacagtcaaggggtccaaaccacttctcccttttttttttttttgagacggagtctcgccctgtcacccaggctggagtgcaatggtgcgatctcggttcactgcagcctccgcctcctgggttcaagcgattatctcatctaagccttccgagtagctgggattacaggcacctgccacaacgcctagctaatttttgtatttttagtagctgggattacaggcacctgccacaacgcctagctaatttttgtatttttagtagagacagggtttcaccatgttggcctggctggtctcaaactcctgaccttgggtgatctgcccacctcggcctcccaaagtgctgggattacaggtgtgagcaacggcgcccagccccaaaccacttctaaatacacctccaggcatttgcacacagtatttcctccaactggaaggaatttttcttgaactcctactcatgcctcaaggcccaggtaaaatggcgcatcctgtgagagctgcatcagaccccatcacgcagtcagggccttcttggatccctcagcccctctcatagccttcttgtaacttgctactcaaaatgacttgcatatgagacactaaaaaggcagggaggcaggagtgggccctgaaggtccagtctagctgggactcagcaaacagagcatcactttccaggtcttaggtcctcattgcgatgctttgttcttgaaacccacttctgttggttctgaactgggattgcagcccaccaggtgttctgaccctgaacccaggctccggtggccaacccattgctctaagatgcatccagccctcagggtcacacagccagaaagagagctagttcatgtgctcgtgacgcggaggtgggtgtgcaggcagatgtgtgtctcctgccctgtctggccttccgaagcctcccagaggcttccgagaggcagcctctgagccccatgactccctagtgccacgtgctaaccagcccagggtttactgaactttggccgtggtgcctggggaggagcactgcttcaagcagtggagtgacggtgacccacagctgggcaggcgagaagcctggagacagggatcccagtggctccacctctggggcaccgggtacccaggcagaaggccctgactccctgttggccccgaggaggggcctgcatacaggtggccccactcctctgggtgaggggacagaaagggtgtggtgggtttgaaaatgatttcaaacccaaacgaccacaactttgaattttatggtatttgaagttcatctttagatacttggaaagttatctagagcagatagaacgttatctggagcagttctttgatcatatagtagagtcagggagtggagaacaggagataagggaaagggagccagggacccagggattctagggctttccaacctgggaactggagaattctcaaatctgggaaacgtgcatgtgccagcccctacctagtctgtgtgtggcacatactaggtgctcagtaaatggcaaatcttgccccttctcccacctggtccaaatgtcctgctttacagcagaggacagtgaggcttgggtgcagcccctcctgctgagccagcccctgcctgaggccaagcggtgctgtctctgtcatctcacagcccagcatcccagctgtcactccctctcccagcctggcccttttccctagcctggctgggctcttgctcatggccctcaccagaaataatgccttttcccttttctctgtctagtcttgaccttagccatccttcaaggcccaggtggagcctcaaagcatttgagaatcccccagactggggctaccctctggggcctctccagacctcatctccactccccttcccaaggcctgtgggaacttcagggcttgcaggaggaactgaatctgagtccagatggccccggaaccgggagggctggatccagtgcagccggctctgctgcatgagcctcccagagccagaggagggagggggcactgggattgtgggcctgagttggtgagaggagaggctgctggagccattcacttcagtgggcagtgccgggggtgtgagagcgtctccattgtgtctgagtgtgcattcctgggatgcttgtgtgtgtgtgtctgtgtgtgtctcccactgtgtggagtgactgttatgtgtgagtctctcactgagcaatcatgagtatctttgtctctctgtgtgacccctacatccacctacccaggggaacaaggggctaggctgacccctgggctgtcagaaaagccccaaggaccaagtcaggcctaatgctggcagcagccagtcctgcccagcgagtttttctggcctggtggcggcagcagcagcagcagcagcagcagcagcagcagcaaaggtaacagtgtcagcccagagaggaaaaacaaggctggggtgggggcaggagccctaggacaccccctccaccaccccaaccagggcttgtggacgtgtggacccacctgggtgctaactgcccgctgggcgatctccatcaggcatggcccctctctggcctcagtttgcccatctgtgaaaaggaggggtggaacaacctgttcggcagcagacaggaaccagagtcaagctgagcttgggaggggcaggacactggtgcagacagactcctgctgggtctttggagctcagggagggtgggtggaggacagaccaggtctgtcagggcacagaggtcggtgggcaccagctctaagttcctcgctgtgtgaccttggggaagttgctgcacctctccaggcttcagtttccttacctgcaagctgggcttctggggatcaggcaggtctcctcacttcctccctgtccttgcctgcagccagtcccttcctcctaaaattgcaccccccctccaccacttccctgcttcattttctccaaagccttggtcattgtgtaagattttatacaatttcctaatcacttattgtctgtcacccagtagcacatgggcacttgagggacagagagctttgccctattttgttgctggctgaatccccaggccctgggacagggctggcacacagcaggggttcagtgaccagatgggcagggcaaacacatgtgcattgactccagggtacctctggctagaaaggaggcaaatatgtcacttggagacaaactgtcatttatggcagaagagtccacagtagcttggataggagtgtggggcaaaagttaggcagcccagacattgcacgccagccttggcccctggcccgctgcccgccagctcagacatgctccctggaggaggagggggacagccctttgtaaactcataaagggcagctagctatggccacagttgctctaggaggcagcatgaggcccataaaccccacctctgacagctttacagggcttggtgtgagtatgccagagatgccatgcatagtgccatcagagttcccaagtaccaaccagcaagggtggaagagctcttacacacaaatctgccaggctgtcattttccgaggtggccatcaggtcacccggcttcccagcatctgggttccctgactccctgtgctgctgcctcttctctaagagtgttggattcatgggccgggggtggggggcagccttccaggccaggaggggctccctaattcctccccagcttggtgtgcagtccttggagccttaatataattatgataactggcacttatcatgtgccagtcatcataaaaaacacgttacatagctgtccattttataaatgaggaaactgaggctcagaggggtaacttgcccaggattatacagcgagcagctagcaggtgtcagagctgactgttgctcaaaataccatgctcttagccacatgccccatttgagtctcagcttccaactctgacccctgcttggtggttgtccaaggaccactgagaggccccatgacagatgatggacagaatgggagcaggacccaggagcctgggcccaggcaggaagaagccaagggtcaagggctccacctgctggtgctgtgtacaacccacagccagccaagcccaggaagctcctgacagttttgacctgggcacacttggccagtatgccttggacaaaaggttcgggggcacaggccaggatttctctgagggtcgcttccagatcccttcccaggaaacaccggtgctggctcgcctgctcaagaactgctccctaagactgtccatcttccctcctggtcagaaaacacgttgttatccaaacacacccctcgcttccccacctctagatctctactcatgctgtttcctgtgcctggcatatcatctactctccttgtgcgccaaaatcctactcatgctttagagcccaactcagatgtcacttcctccctggtgccttcactatgtggaatgtatccactgtcattgaatttcatttattcatttgctcatcatagagacccctgggccaggctgtgaccatttccccttcacatgcctctggtttgtctcctgtttcagtcctgccttgtggttttcacacagctgatgctcaataaatgcgtgctgagcaaactcacaaggctggggtgttcaggtctgatcatgtgcgtgtgcgcaggtggctgcacttacagagagacgcctgaagagggcagcacactggggcgctaacttggagagtgaggccgcgtgatttgttagaggaggaagccggagggcggagggagggccagcccctccccctcaactcgggctccagacgtagtttgagtcccctgtgcccccactttgctgggtgaccttgggctttggggttggttccaggagccactcagccaggccagcccgcctggcggacgccattcccaggagatgaccaggccctggacagccgacacttggaagactgccacgtcctgcctccgcaggagccgcagctccccggggctgcagggaagtggtggctgggctgggggggtggggggtgagcccgcggggactccaggctccaggtgcccacaccatcccgggggtgggcagtcagggccaagaacgcacagtaaacccccagtacacacaagcgcacacacgcacatgctgacagcactcgcatttttaagatggggaaatagaggctcagagggggcatgcgcgttcctgcccctcaggatcaccagcctgcccccaggagaaaagggaagggaacaaggctgatggctggttccaccaactgggcgcccgggctcagggtgaatgtggggggctgtgacccctgagacgttggatctgcctccctggtatggtttggatgtttgtcctctccgaatctctcactgaaacgtgactcccagtgttagaagtggggcctggtggggggtgtttgggtcatgggacagaccctcatcagtggctctttgcagtaatgactgaggtctggttgttgaaaagagcctggcacctccctccccgacttgcccccgtctcgccatgtgatgcgccggatccccttccccgtttaccatgcgtaaaagcttcctgaggcctcaccagaggcacatgccggtgccatgcttcctacacagcctgtagaacaccaagtcaaataaacgccttttctttataaattacccagcctcacgtgttcctttatcacaacactaaatggacgaacacacccctagagccgccttcctgaccataggctcctattccttgcgggtgcctccaggctcaggggagctcgccaccctgcagggctagcagcagacgtgctgatcccacacagtgaacagcttgagcttgtttcaaaacaggccggctgaacacatgggagtcacagggacccggcagagcctggaaggcatcaggtgggtgggaatgcttttcccccagcaggagccctcatgggctcctggcccagcctgtctgagtctgcctttgtctgcttctttgggaccccctgactccaagccccatcaagcttgcatctccacacccagccccagtgttagctatcgacccaggcctgtatttctttgtcctttatttttatttttatttttattttttgagacagagtcttactccatcacccaggctggagtgcagtggcacaatctcggctcactgcagcctctgcctcccgggttcaaatgattctcatgtctcaacctcccgagtagctgagattacaggcgtgcgccaccatgcctggctgatttttgtatttttagtagagacggggtttcagcatgttggccaggctggtctcaaactcctgacctcaagtgatccacccgccttggcctcccgaactgctgggattacaggcgtgagccaccacacctggccttcatcctttaggagatcatgagaggccactctgccctcctctggggccaccccttccttcatcccttcctcccggctggactctttaccaccccagtgctagctccgctggtggcagtaagagctggcatggtaagcgcctcctccattccgggctctgtgcccacagcagccctgagagctggtactgctggtggtccccccgcacacctccatgcctgggcccaaccatttctctgtgtcccctcatcagcccctacccgtacagtcccagaggccatcatctccctcctgactccccacgggcctccctgccaccacgctctcccccaacagttctttctcctcacagcactcagagtcatctgctaaaaatggagtccaattacatctctcccctgctcaagaccctccatggctccctattgctctgagagaaaacccgacctcctttcaggccctctgtgatcactggatgtgggtggaactccagcccctgcccttcgctcactctgctccagccacgtcacctcctccgggctcctacatgccccaatcacattcccacctcagggtctttgcaaatgctattccctctgcctagaagcctctcttcccaggtcctcctcattcctgggcacctgggaagcctccacctcctagttcagatctttgctgcaaggccacctcctcagagagccctttcctgaccaccttggttcattctgtattaacatgttttcttgttcactcacaaagactgaaacccacgacagcagcaactttgttttttttcccatttggtttccccagcccctagagcatcctggcacatggcacctaatcaataaatattccttgaattaatgcatctagattctaccaaggcctaagagtaggaaggacagagactaactaggagcctgaccctgtctacccccacccccattcctgctgctactttccagcctggattcctcaatcactccagggtggccctttaggattggattctgtgctgcccagaggctgccacaccacagctgagggccgccctaatacaatgccagatgttccccagcacggccaccctgcctccatgccagggactattctaattgctttaaatataccaacttgtttcttccgtgcaatagcctattttacatgtgaagaaacaggcacagagaaggtaagtgacttgcccaagctcacacagccaggaagtggcagaactagcatttgagcccaggcagcctggcctcagggtgcatcttcccaactatatcacatagagtgggaccctgtgcggagcacatcctggacacccgccctgggcgtttcagcactctcctgccctcaatctcttgccacatcaccaccctggacatcgccctctcctgatgaagaacctatgatggctcctatactcgtagaagcctggaccttcagcctggcattgaggccttgcacagctggcctgatcctgctttcccaacacaccccactgctctgggctgcaccctggggtgcccagaccaccgcctgtgtccggaaggcctctgcccggactgctccctctgcagggatgccattcctccaccctcactccgtgagcccgtcccgggccccaaggctcagctcaaatgctgcccaaccccgcccaccctcctctgcacacacccccaagggccagagctcacttcacagacacagagaactcccctggggagctctcactctcccggatcaggaaggctcccagatggttccgcttcatcagaatctcttcggccagctgccgggaaatcctgcccgagtaccacctgcggagagagggagccggtgaaggcagtgtgagaccaggctctcagccagcctcccaccccgtgccaggtgttcaaggtctgagacaagggagatgtgattgcacccattttacagatgggaaaactgaggcacagagaggtgaagcaatacacccacaatcacacagcagaggcaggcaggagctggaacacaatcccagcattttagctcctgaggccagcctctcctaccatgccagcaaacacatacccttatggaaacagaaaagtcacactccagtgagccacaccccagccaacctcagtctaactttccctttgagatggtagattctttaaagtcaaaaaataaatcaggctcggtggtgcgtgaccgtagttcagctactcgggaggctgagatgggaggatcacttgaggccaagactttgagaccagcctggggaatagagaacctcccacccccattccttaaaaaaatacttctggccgggtgcggtggctcccgcctgtaatcccagcactttaggaggccgaggcgggaggatcacgaggtcagaagatcaagaccatcctggctaacacggtgaaaccccatctctactaaaaatacaaaaaaattagccgagcgtggcggcatgcacctgtagtcccagctgctggggaggctgaggcaggagaatggcatgaacccaggaggcggtgcttgcagtgagccgagatcgcaccactgtcctccagcctgggtgacagagcaagactccgtctcaaaaacaaacaaacaaacactttttttaaaaaatagagtcttgttctgccgtccaggttggagtgcggtggcatgatctcagctcactgcaacctccgcctcctgggttcaagtgattctcctgtctcagcctcccgagtagctgggactacaggtgtgtgccaccgccccggctaatatacatatatacatatttttttgtatttttagtagagacagggtttcaccatgttagccaggatggttttgatctcctgacctcgtgatccgcccaccgcagcctcccaaagtactgggattacaggcgtgagccaccgcacccggcaaaaaaaaaaaaacttcttaagtcgaaaatataaaaacatgacaaaaataatagtagctttgatatggtgaggaaatatccattccacagtctcaggccacctgaatttttttcacaggcacaagttccttttgctgctgaccaaacagaactgggtatgcagaagttgcctggtaaatgcttagactcttgcaagatccccagggtctgggagtgaaactccttttccagtcctgcttatcttgctgtgtggctcctggtagctcctggtagcccccggcctcttcaggaatttgccactgctataggctgactttctgtcccccaaaattcaaatattgaaacctaatcccccatgtgacagcagtaaaaggtggggtcattgggaggtgattagcagtccccctgaatgggattggtgcccttatgaaagagaccccagagagctcacttgtctctctgccatgtgaggacacagctaaaagacacagccgtctgtgaaccaggaagtagcctcatcagacgtgaatttgccggcaccttgatcttgaacttcagactccagaacagtgagcaacaaatgtctgttgttcataagctacccagtggatggcattccgtgacagcagcctgcaggactagaacacccaccatcggaggggctgtgtggtctctgactggctttcctaactccagtgttttagcccagctttggctctgacccctttattgttcggatggggaaactgaggcccagagcagccacaggtctcgtggtggcaccatgacagaatgttccccttcactccttccataaatgctcctctccctgagtcagactgagctcggcacaggtggtggaagccaggcggggcttttcctgttgtttcggatgttgatgagccctcggggctgagtgcagaaggcgtgcggtgctgcacatgccgctagtgtcctggccatgtcccggcgccggccttggcaggatgaaggctgctcagtacagacctcggggccttttttctggtgattgacatatttggcctgggttcagggcaggctgaggctcccaggaacagtctgactcccagtggtgactgatggagcagaggggtagacgccccagcgcctggccttccggaggcatgactcctaggtgcgcattctgtactgtctccagctggccctggtccccagccagatggagctccggttacccccagcagcgatgacgccaacagtttgccccactggctcccccacttccctgtcctcttctccactgttatataaattccttgttatcaggctcgtgtctcagggacggcttccggagaaacccgaactcctagacatgagattctagaccactgctgcccccaaacgaatgggggcccctcggcccctgtcccagcgagtttccttctgggaggggacgtggggaaggtagccgctgggtatagggctcagggcaaccatccggagagctcagcctgggtcttctggggtttggagacctgaaggcaggtgcccagccagcctgggtgtctcaaggccagaggtgaatgccacaggctgcagcaggaggggagcgtagggggcccagggttggggttaccaggcaggggagctgcagagagcttctccaccaggaagcccccagctccgtcccgcaacagtgcccagcgtggcccagggcgggagtttcctgagggggcaggtttcttcgaagaacccacaaaactcctcaggcggcatcagtgtgtgggtggctgttgccctcagagagcatcgcaatcacaccctcccaggagttcccacgtcccctgccagccctgcccccaccatggcttgacggatggaggcaagaagaaagcacttcctgaaactccagggcccggctccttcccccacaccagtgtcactccatttgtggccatctcgcatcattcctgttttactgatgtggaaaccgaggcccagataggggcagagacgcccccacaccccaccagattgcatagcaagtgcatggcctgggactctcccagtcccacagctgttcttatgagcttccccgctgtcctccagggtgtcccagcccagggccatgccacacggctgcagtcccgctccacctcgtgccagctgtgagatcctgggggggcactcaacctctctgtgcctctgtctgctaatctcaaagatggcgatggtggtgctcagctctcagggccttgggaggatgcatgagctgctcgtacgcgggtgtttgctgctccccccacacatccccctgccaggcttgtctctgccttccctggcagacatctacttgaacttccaggcccagcgggccacacccttcctctaggaagccatccctgactcccatgggccgtgaggctgggtcacttgccgctgtggcccctgctgatggggctggctctggagcacttggcgtacattgtgcctcccccgggggctcctggggttggcaggggtgagagggggtgcccagggaaggagtgggcctggcataggcacgaggcctacctctgaatttctgaggccccagccctccctctgaccccacacctgaggcctttatgggctaagtcaggtatggagctggagtttccccatagttattttggggagcaaggcaggtgctgaggttagtcgaggacacacctgggcatcacttcaggcaggttactcgggggcttgaccccatccctgctgtgtcccagacacaaatggccagagatgaccccagaggcatgggaggctgaaaccctccatggctcccaactgccctgctagagtcttgcctcgaccactggcatcccctcgacaggcctggcccggcactgcggtcttttgtcatcttttctcccctgcctgagcaaatgcgaccctctcagcagctgtaggccagccagccttccagccattgccaggccatttcctccacctgaaggcccctccctgacagcttggcccagggggattgctcccgttcatgccctctggcatgtctggatggtcccattggcttacaggggcctggggcactggctccagcttgtggccctgggtcggattctctcgtctctctccctcttcgcacacccccctccctctcccccttaattgacagaaagatcacagaaacctgcccaatgtcacacaaccacgcgggacatagtggggcctggaacccaggctgccgccccagatgccgactggaagctgcagcctctgtgggggaggctgggagtgcctgcagcccgggcaggtggctgaggacctgggtcggagggggcctcgcccagcacaggaagctggaggtggtggcagctttggaactaacttaaagagagataaagaggaaatacctctcatgccccaccctggccctgcacctccttcccttcccaccgcacagccacacacacatctcagctcccaaactgtcccgccagcctgcttggccctgtcacctgtctccatatctgactgagtcctaccataacacctccatggctccccacatggcttggcatttgggggcctcctgccagtcccacatgccacaagttctctctcattgctctccctttgctcatcctgaccctctcccagggatgcctttctctttttctacttaaccaactcctacacatccttcaaaatctcactcattgccacctcttctgagaagccttccctgagaaatcaccttaatgctcactgtcttcccatgtagtatgtccttcatgtcctctttctcccccagaacacagctgctctgaccccttgtgtctccagcatcacccgggctggaccccctggaattgtggccagtgtttagtgaatgactaagtggctgtatcttggggctgcctcagctgccatttaaagcatatccagttggtttgcatagatttcttgggccccatgcctgttctgaggctgggccctgccccagtcattctcagggcagcagtgttggctgccacctgcccagagcccaacctgggacatccctaggctggtaggtcccaggccccaggatagctgggccccaggcccagttcttgctccaccctggtaccagactctgctctgccaatgtccaactcccccccagactccaaaggcagggcctacagggtctgcttcccgcccagccctctcccagccaccacccagggccgggccagctctcagcaagagctctagaaccctccaccctgaacagattggagcatctgccctccttgagttatagataggaaaactgaggaacagagggcagggacctgcctgaggccacacagcagccagtggcgcagccagctgaaagcccagggccttgtcctctctcggggacctcctggacattctccagtggctcacgtcctcagtgtggaagcctgggcttgccctgactctgtccccactctggggaagtcctcagaactcagtctcctatgcctgcccaggctggtggcctctgtggagcctgggggccccagacagatggacagaggcccaggagtgagggggtcccatggccaggagagatagagccacggggatgggatggggctgtccactcacggatggggcttgacgcggatgtagttcttgggaataaatccctcgacaccccggagctcggccttgtaccagttctggtcatcctccatgttcaggatctgtgggcaggagacacaaagccactcagtcaccgagaaggaacaactgtcacccccggaggccccactgcacgccaggccccaggtgggcctcgcctgcaccagcttctgtgcctactcacagagcagggctgggggcctgggacaggacttgcccacggtcccaagggctgaattagaagccctcgttcctcagtgctgcccatcccctggccccaggacagcccatcctcaggtgattcacagactccaagggaggcacagtcggggactcgtaggaggcttggggtggctggagctggattctcaggctccgacaccaggagccctgcggaccatggggtttgcaggagcagaactggggacctgagttccttcctgggttgtgcccccgagtttggggggcccacagcacttacatgccacgcactgagccttggggtgaaggtcgggggacccggcctgagcacagccaccagtggtcacctagggtccctcgcatttagacagctcaggggtgacaattcagtggggggacgtcaggctctggggagcagataagggggcctttggtctgagacagactggttctcagccctggcatggcctgctcggtcacacgggctcctcttccgagcctgtgaggcccccatcacaccacaggtgggcccggaggaactgaaatagccagagccggggtgggagtccctgagggggagcaaccaagcgaccaaggcggggggcggggccgggcctgggaggggcacagcatgaggccgggggtcctgcctccattccctgggcacgccttccgtctgtccccctgattctcatatagcccccaaggtcaacatcaccaaatgctattttacaaataacaaaactgaggcccacaggggaagtgacttggccaaggccacgcagcaggggagaggcagagcctgtttggtcagtcaggactctgaggcctggagtttttggctcactggtcaagggggtcctggcccaccaatttttgcctccagtcctctttgtcactggactccagcttgaggggacatctctcctgtgaggggacatctctcctgtcagtcctggagcaggttccaatgtcagctcaatccttcaggggtacttgagagaaaaaattgggcacggggtaccaaaggcccagggcgggccaatacaggggcatcaactccagcagtgatattttgccaagagtagctgggattggcctcctagggcccaggcctgaggccccaccctcacaggtggcctctgcacccccatctccacccccgctttgtccaccaggccaggctggctgagcctcttccttcctgcccctgcagcctgggccaggtcagcagacccaggggtgaacggaagcaggtggctgactcaggaaaactttcgctcaacacaaaacaaaacaggccgggcgcagtggttcacgcctgtaatcccagcactttgggaggctgaagagggtggaccacctgaggtcaggagttcaagactagcctggccaacatggcgaaaccccgtctctactaaaaatacaaaaaaattagccaagtatggtggcacactctcataatccccaactttctcaggaggctgaggcaggagaatcacttgaacccgggagctggaggctgcagtgagccgagatcgcgccattgcactccagcctgggcaacagagtgagactccgtctcaaaaaaacaaaacaactcccccaacctaaggagaaaatgagggcctgtaggccacataccacagccatggattccaggaggatgccctgaagcctggggctccagaacattctgtctgcttctgactctctctgtggccttggcctcagtgtcctccctcgtctgtccaatgggtgcatttatggcctgccctgcatgcagcagtgcggacactgggtggaatacgtctcatgcagtccctgcttcgttttgtctccttgtcatctgcactcagaggactcaggaatgtcccattggttacattagctaatttctttttcttttttctttttttttttctttttgagatggagtctcactctgtcaccaggctggagtgcagtggcgcaatctcagctcactgcaacctctgcctcctgggttcaagcgattctcctgcctcagcctcccgagtagctgggactacaggtgtgtgccaccacgcccagctaaatttttgtatttttagtagagatggggtttcaccatgttggccaggctggtctcgatctcttgacctcacgttaactgatttcttactgtgaacattgtttgaaagccccagaccctctgagacccgggaattctcacaagggagagaggccaactcctccctggaggagtatcactgctcaaggtgagaggcagaacttggcctgcccctgagcctttgcccacatggtgccctccacccaggctgccgccccactttaccatcccagcccgatgcagttgctgcttgatagttgtttactgagcacctactgtgtgccaggcaccccacgacagagcagggaacaagaagctcacattctagtaggcagagacagaccataaacaagggaagaaacaaataagcaaggtagtttaatggagcagtaagcgctgtgaaaaatggacatcaggtgacagatggagaatgtctggttgggtgggagcagggagattgtcaacacgggacaggtggggtggtccagaaaggcctctctgaagaagtgacatggaagctgagacccgaattacaagaaggaaccagcggtaagaaaatgtggggaacagtgtccaagacggacggaacagccagtgccaaggctctgaggtggggccaagctctgtccctgaaacagaaaggaggccagggtgtctggagctgagggagggaggagcagatgtcataagatgtacgggggaggaccaggctctgagtcatggccactgcatggagactgggctggggagcagggattgttgcggggaggccttgggagccaccacgcaagcccaggtaagtgacaatggaggcctgggctggaggaggggcttcgggtaggttttgccagagttgccgacaagacaatgacaggcagcagaaagtaggttcagggagcccagggctggctgtgttgggtctggaccgtcgccctttcccatggagatgtcaaggtgacatgggcttcctgagtctgggtctcatcatccaggctgctcgtgcagagatgggagtgaagccactaaccacatgcccctccagctggcaacagcatgggggtgcgtgcacccagaaacgcctggcctatcagggagggaggctttgtcccagggaggtgatgtttggggccatttgtccagggtgagtccatgagccagagttttcatccaagaccaaagttcagatttcaagaacgggcttcatcgcccactctcccaggctggactcaatctgtaggcaggcagtgccatggcaggggctggcccacagggagcactggaaaatacttgctagacgagaggacaggatggtcgcggagctcagcttccaccccagccacttgatccctccaagcctggctcaacgcctcccgcgcaccccattcctatttcatcactgccccactccctcccaacaccacacttgggtctagagacctcgaagtgctctcagatgagaaaccaagacttggatccccgcagagggtcatgccttgggctcacagccccagtgctcagcctggccctgtccccatctggccacatgtccacgaggccgacagccagcactgcagtgaccccaggtgccagcaccagcaccccagcatagagaagaaggaattgctcctcctcctctggaccccaacccccagcccagcctgttcagaccaagcgcaagttccacagccaaagggacacgggttcaaaactgactccataccgagcaggtcatgttgcctccctgtgcctcagtttagtcacctgtgaaatgggggtgccagtccccattgcttaaatggtacatgaggtgtgctgctgagttcggggcctggctatagcagggtgatggcacagggagctctcccgtcttgtgcttgaagcttgtggccaagggcagcgcccagggctcagcgcagaggagcatccagtctaacacccattgctccagtggggaaactgaggcccagggaagggcagtcacttccctagtgtggtttactggcagttccagtgcacacgtcttggcatggccactcccagaatcctgggcatggctttcatatgcaaacttttaagcaaggacatttccagagacacattccacaggcccaactgtctagaccgtcttggaaggctgcaacatctgtcaaaagcggcccagacaaggagaaatgaacggtggtatgactctattttcccttttctccacactactgggaagctcatccttgacactttcatcttagctattttagccctactaggttagcatgtgtacttatttctttcctaagaccttctctctctccctctttctcgctctgttctccattcccatactctgtctctctctctagctctcattctctccctctctcaacaattttcttttcaaactttttcctggaaaactgggggttgaactaactcctgccagacactgtggtaatatctcatcgaatcctcacaacagccccaaaggagggtcattagttatctccccatttcctagatggagaatctgaggctccgagggaaaaggtggcttgtccagagtcacacagccaataactggagaggctgggcctgtcttccaggggccacagtctgcttgggacagtcccaggtccctggttcctaaatccacccccaccccgtgtggggccaactcagcaggctccagcccccctaccttgagtgtgtctcccttgttgaaggccagctcgtcgctctctgtagcctgaaagctgtacagggccacggactccatgccgctgctcggggctccagcagctgggctcagagctgggccgacagcttcctgcttcctctgcagtcgaggacggtcttcctttgttttgagtgcg

SEQ ID NO: 1198 - DNA, 68528 bp, Homo sapiens
cagtccctcgggctcatacctagtgcctgcggcaggacagccatggccgccaactccaccagcgacctccacactcccgggacgcagctgagcgtggctgacatcatcgtcatcactgtgtattttgctctgaatgtggccgtgggcatatgggtaaggggacctgtggtggtgttggccaagtgggctctcagggttggtgcttggggtgggaaccggggtccagcatgtccctgtggtgtcagcattggtcccagctggtggcctagtgatccttgtggtcctcctcccagcctggggtagacttgcttggagaccttgaccaagcccgtttctctctttgggtaatggcgtctccatctgcaaagtgaggaggaggaaattctctctaacaggtaactgggcttttgtgctgctgcccagctggagtccttgggtgtggcccatcagcctcctggtcccagtctccatggtgtcagtgactcctgtctgcttgaacaacaggctccccgggattccctggctgcaccccagagctgctggatcagaatccggaggcagggagggccctgggaactgggggtctttattttgaacaagctccctggggatttatgtcctgtggcctagccctagatcataagccggttctttctcccttcataacagtgagaaatgagcagagatctgaccccacacacagattccaggggcagcggggcccctggggacaggctgtttcatgtgcagatggagaaaccgaggctctggccctgcagcaagggaagggctcctctggtctatcgtggaggccttcctgagggaaggtggacacagcctggttcaggtcacctgctccacgcttagcgcctggggatgttgggctccacttcttaagccccagaggtccccagcctggcatccctgagccctgacagtctcctggggagaatgagtaccccttctttttttttttttttttttttaactgagacggagtctagcactgtcacctgggctggagtgcagtggcactatctcggctcactgcaacctccacctcctgggttcaaacaattctgcctcagcctcctgagtagctgggattacaggcgtccactaccacacccaggtaatgttttgtatttttagtagagacagagttttaccgtgttggccaggctagtctcgaactcctgacctcatgatttgcccgcctcggcctcccaaagtgctagaattacaggcgtgagccaccgcgcccggccgagtacccgttcttatcttccataacccctggcctaagcacgaaggcctggcaaacaggagactggtcacgtcccctcagcttcctgggcctcagtgttctgatctgttatatggagacaccacctacctggggtgaggtctgctatcaaggggcccacacaggaccagaccttgctgctgccattggttctacagtggtagcagtggtggtggtggtggcagttgtagcagtggtgattataagagtagcagccgcagtcattaaaattaattatcacaggttggatttcaaaaatctgaaacccaaaatctggaacattttgaacaccaacatgatgctcaaagcaaatgctcattggagcatctcagattttagagttttgggttggggatgttcaactggcaggtattctgtaagtatctccaaatctgaaagagtccgaaatccaaaacttttctggtttcaaatatttcggataacggctcctcaacctgtatgtgattaaatattaactcacaagtagcccagtgctggccatcggcaaagccgagttcaagtctcggctctgctctgtgtacttaagtcacttaatctctgtgggcttcagtttcctcaaacacgcaatgcgggtttctgtgcagcccacatctcagggctgttccaaggagcaagggtccaatggaagtgaaaatctgttgcaaactgtaacgtgctatattcctgtgacagttggtggctagaattcagaggaggaggtgcccacgtggggcagaacagacagtggagggtttctggatgaggggaggtaagggccaggcaagatctgaagagggaaagaggaggggagacaaggctgtcctggctagcacgtctaagaaagatgttctgggcacctgaggccagaccctttgtagcccagtgacttgggccaccagcccttgttgcccatgacccacctctcctagtgagtcagcttgctgtttgcaggctggtgcccctggaagtagggctgtaggagttctgccctgtccctcctagcaggctaggctggcccagctgggagcggctggcaagagagcagtgagcacatccagaaaagatcagaaccagacagggaggatgctggagatgcatcccacagggagaagcagacagagcaagccaggcaggtgcagccctgcaaagatgtttagatggtgggcctgggagagtctggcgggggccggggggaggcctttaaggaagagatgttcctggaggaggggactttgagctgagcctttgcattcattaaagtatctgttaacaagtgactgaaaactgctttcaaatgagctctaagaatataggaaatgtaggccgggcgcagtggctcatgcctgtaatcccagcactttgggaggcctaggcgggtggatcacgaggtcaggagtttgagaccagcctggccagcatggtgaaagcccgtctctacttttgtattattttgtgataatacaaaaattagccaggcgtggtgccaggcgcctgtaatcccagctactcaggaggctgaggcaggagaattgcttgaaaccggaaggcggaggtcgcaatgagctgagatcacgccactgcactccagcatgggcaaaagagtgaaacactgtatcaaaaaaaaaaaaaaaaaaaaaaaaagaattcaggaaatgtaattgtgtccagcaatagaaagggcttcaggtgcagtatgatccagggattcacagcattattaaggatacagctacacctcactttggttctctcagcctccatccatgtgtagctctgtcctaagcccagctcccctcgtgtcctgatgtgaaatgaccagccctgcgattgagcctgagttgaaatccaggctgcaccacttgctagatgggtgtgttttcatctctgagaccatcagtttcctcattggtaacatggcacctgcttcatagagctgttgcgaggactaagaactccacacagatcaagaagttgaagccaactctggcatgggggccttcggggaaccttaaatgggtacatgtggcccccagcaactgccagcagcccccagagccccagatataagaaggcaactggcaatgcccactataggcttgaaagatgagaagggttaggaaaaagcatgggctgtaaacatagatgctttggagttgtgcagtgcacagcgtacacatctggatatggccatcctggccaagactgtgagccttcagactatgctgcctttagtacagcaagatcacggcacacaaagagaaagtggtgggagttggagctggagagaggcaggagccacatcaaaagttctgaactgggtgtggtggtgtccacgtggttcctgctactcaggaagctgagatggggagatcacgtgagcccaggagttcaagacctgcctgggcaacataatgagaccctgtcttaaaaataaaaataaataggccgggcgcggtggctcatgcctgtaatcccagcactttgggaggccgaggtgggcagatcacctgaggtcgggagtccaagaccagcctgaccaacatggaggaaccccatctctactaaaaatacaaaattagccgggcatggtggcacatgcctgtaatcccagctactagggaggctgaggcaggagaatcgcttgaacccgggaggcagaggttgcggtgagccaagatcgtgccattgcactccatcctgggcaacaagagcgaaactctgtctcaaaaataaataaataaataaataaataaataaataaataaataaataacaaatagataaagctttgaatggtgagtacatacaatgaagcctaatcatcctgagtatagggcagggcaattaaagtcaggaagaaagagacctgcatattgatggatatattttgtgatccagccttatgtatgttctgaaaagaaatacaaaatttgtatctaaatacctgtcctgtgtccctcttttcaaattcttctgttttttcttttttctttctgttttttttttttttttttttttctgttttgagacagagtcttgctctgcagcccaggctggagggcagtggcgccatcttggctcactgcagccttgacttcctggtctcaagtgatcctcccacctcagactctagagtagctgggattacaagcatgcaccaccacgcccagctaattttaaaactttttatagagacagagttccactatgttgcccaggctggtcttgaatccctggcttgagtaaccctccttccttggcctcccaaagtgttgggattacaggcatgagccaccacgcctggatgatttaacttaaatttctcccatccaaatagcactaaagacaggcttgaaaaatccatgtactcactgacccttatctcagcatgctacgtgtactaacccactaaagctcataaaaaccctgtgagggttaggaagccaaggcaggcagatcacatgaggtcaggaatttgagaccagcctggccaacatagtgaaaccccctcctactaaaaacacaaaaaattagccaggtgtggtggtgcgcacctgtaatcccagctactcgggaggctgaggcaggagaaccgctcgaacccgggaggtgaaggttgccgtgagccaagatctgtcactgcattccagccagggtgacggagtgagattctgtctcaaaaaacaaaacaaaacaaaattcatgaaggaagaacttcttaggaccacattacagaggaagaaaccaaggcatacgcgttcagtaacttgccccaggtaacacggccaggaagcagggaagacaggattttactctcagacgttccgactccagaatttttattccacttacatggaggacaaaattctatactccccgtaaaccaaaggcatgtgggaatacgtaggtaaggagctgactgcttctgttctttttataaaagttgagataaaatttacataatatacaattcatcattttaaccattttattttattttattttatttatttattttgagacggagccttgctctgtcaccaggctggagtgcagtggcacgatctcggctcactgcaacctccacctcccgggttcaagcaattctgcctcagcctcccgagtagctgggactacaggcgcctgccaccacgcccagctaatttttgtatttttagtagagacagggtttcaccatgttggccaggatggactcgttctcttgacctcgtgatccacccacctcggcctcccaaagtgctgggattacaggcgtgagccaccgcgccagcccattttaaccattttaaagtgtgcaattcatggcatttagtacatttgcaatgctgcgcaaccattacctgtagctagctccaaaacattttcatcctgtccccatcaaagtcaagcaccgttcttcctgcctcccagcccctggcaacaactcatctgctttctgtctctataaatttgcctgttctggacttttcatataaatggaatcatacaattcgtggccttttgtgtctgtctgtgttcatgaagcatcatgttgtcaaggtccatccaagttgggcatgcatcagagcttcattcccaagatatttgttgtttttttccagacaggatttcactctgttgcccaggctgcagtgcagtggcacaatcaccgctcactgcagcatccacctcctgggctcaagagatgctcccacctcagtgtcctaagtagcgggggccacaggtgtgtgccaccaaaccctgcattttttgtagacctggggtctcactatgttgccagtctggtctcaaactgctaggctcaagtgatccgcttacctccgcctcccaatgtgctgggattacaggcatgagctactgcacccaatagaacttcattccttttgaagactgaataatatttctttatataggatataccacattttgtttatttactcatcagtcgacagaaatgtgggttgttttcacttttggctattatgaataatgctgctatgaacattcgtgtacaagtttctgagtggatgtgtgttttcaattcttttggacatatacctaggagtggaacttctgggtcatatggtgattctatgcgtaaccttttgaggagctgccaagccgtttcccattcgacttcccagcagcagtgtgcgggcttccaactcctgtcccttttctcctcttgcagtcctcttgtcgggccagtaggaacacggtgaatggctacttcctggcaggccgggacatgacgtggtggccggtgagtgcaccctgacttctcacacacccccactttgtccgtggggctgtgtctgatctctaggtcacctggcatctgtatctttgagccagtccaattcagtggagcaggccggaggctggcaggaggtccccaagtgaggggcatagggctgagctgctagaaattgtgtaaggggcaggggctatggagtctgaaacttacatccgctccttagctgtgcagctagtcatgggtagaacacacaccctgggctcctcatccgtgaggtggggctaggaccccgcttaggtttgtgaggatgagggagaagctattaggcccaggatggggccggcgcagggagcctgctgctgatgcgtttccctttctctcctccagattggagcctccctcttcgccagcagcgagggctctggcctcttcattggactggcgggctcaggcgcggcaggaggtctggccgtggcaggcttcgagtggaatgtgagtcctggaggactggcggcctgtgggagggccagggcacaggatgtggtcgcagcactggagggggacagctcccagtggctggtgtcagccgatgtccaggtgggctctgtgcagtgctgttcctgggccaaatcgtgtcttcagaataccaaggtgctggatggcacgactggcagggagctgtgggccttgcccagacctagagaggggaaggagccacccaggatctcatggcaagtcaggaggggctgggggaagccaggcctccggatggctcatcccagccatgtctgctttgtctctggagcagagctgtgggagctgcacctgcagtcctcacctgtctctgtccccataggccacgtacgtgctgctggcactggcatgggtgttcgtgcccatctacatctcctcagaggtgagtctactcatggggcctccagctggggggctgggccttggtccaagttggtggtagtaatgggcaggaccaccgtggcctcacatcaggagttggtaaactcttagggctgggtttgctattagcccgactaatatttctatcaacctgctaaggtggatcccgactaatatttctatcaacctgctaaggtggatcccctcagacctcagcctgggtgccgtgttggctggtttccactgccctgagtgctgcatctcaggaataatgtcccatccagctgggcacataggctgtacaactgggccatgcacctggtttgcacacctggcccacacacctgggtagcatacctgggctgtacccctgggctgcgtacctgaatggcacacctgggccgcacaattggctgcaccatcgtcgactctgcccactccttcagccccagccatgcagccactaagtccagtcaactccacttcctggatgtctctcagcctgtccccagctctgcccctcacagccacctccctcatccagcctcatcatagtgcacctggatttgtcataacagcctctaaacttgtccctctgtcccagccacggcccctccaatccattcctcgtctcagccctaaagagccagtctagggatctcagcctgccactcccctgcctgacaccctcggggcgcagccggagcagcccgggattccaggccgggtgctggggctgtaaggggtcagtgcctgggccttgcccttgagaggctcgcagctgctttgtggcggggggagaggcagagtgattgagacaggccctgcctggagccctgggcatcatctggaggatgcttagcccctacccatgtgccttcccagatcgtcaccttacctgagtacattcagaagcgctacgggggccagcggatccgcatgtacctgtctgtcctgtccctgctactgtctgtcttcaccaagatatcggtgagctgcccccggctccctgctggcatagcctggaaacatcgccaatctgtgggcccctcaagaggacctgacatcttctcattcatctctgccttgtttaacagctgggcaaattgaggcccagagaggggcaatgacttgcccagggtcacgcagcgagtctggacaggtagtccagggcccccggggtgtaggctcagcagccagccctagtcagggacagaacacaacctggtgacctctgctttgcctcaggttctagacacagggtgttaggacggttctcggtctgaggtcagttctggggccggcaccggggtgagccacgatctcccactagggggcgccaaaagcccacgtggtcttagccacatctggtctgcactgagctgacctgcctctcaccccaaggctggtgggctccatcactgacacccatccttgggggcctggccctgcccccacgggcatattaagagcaggagcacacctcgaatgtcagggtcaggagaagcatagagctcatcttgtccaagcccctgactttacagagagggaaactaaggcccagagaagggaaagagcttgtcctaaccctcccggtgacctcatggcaacactaggccttctgctctcactccaagtccctgggggcagctagcttcatccagccccaggcttctgaaggggcttgagtcctggggctgcctgattctggctgagagagctgacactagcccctgcgacctccgagcctccctgtgcctggggctcctcccttgtaaggaggggcggcagaccttgtctcctagggctcctgtgagttggtggtagcaatgggcaggaccaccgtgtgagggctgctgtgtctgcgggaagtgctctgtgaggcccagctttccctcagaggcaaatggcctcctgggccctcttcattcagtcctgggactaggaaagcccagaagaggcgtcgatttagtgaagggaatggaggtgcagaggccggagaggtagaggcctcgctggtcagccaggagctgtgggcagggctacctgggaagagggccctaaagggtccatccagagcccccacggggccccggtgggggtctcatgcagcatctgacccgccctctcctctcctggggcatcccctcggcagcctcagcctggcctctatctgcactggtgttgctaggtgactctgaggggattcccagagtgtctcatccttcgtgtgggcaggtctcaggagtggccagcagcaaaccccgtaccgcagtcttcgccagatgcccttggcgtactgtaggaggtttgctttctctgggagccctttagagtccggagggacttggccttggcctgcccttaaggctgagtttagagctttccactcatactcttccttcctctcccacatttcttgatctccaccccacccccatgccagccacccccatgccagccacctccctggaaaccagggatacagaaataaacaagacctggccctggtctgccaggggctcgcactgtggtgagaaatagatggatgcatgggacaggcatgaaactcagaagaggacacagcggggcttgctgggggtggcatttgagttgggctctgatggagacagggatactgatgggggatgggagcaaatgacaaagagagaggtgggaagaggcaggatgtgtctgggggtggtcggggctggaggcttagactctaggagtcactaagtcagacacttctggggccagataaagaacagcgtggagagaagctgggagtgagtaataggcagtggtggggacaaaggcaaaccagagaacgtgccccaggattgacacacaacaggcccgtgtgccacatttgcctctcggctgccagttttcagggtctggcctgcagtgagagatgaggcaagggaggtctgattgtaagaggttgaagtgcccaaggtgcccaggtggagcgggggtggtgtttaggagccggggtggtgtttaagtgggagagtgacatggtcgtgtttgtactttgtgctctctggaatcttccagagggtggactggaggtgagagagacaagaggaggccaggcttgtgaggaggccccaggtaggtctggtgagggagggagactgagccatgggcacagggttctctgccccctgtttcaccctgctggcttctctgcagtagagcttatacctcacactcggagagtcctgaaagtggatggcttgggcggaacttctagaaaggcagagggggccggcgtggtggctcacgcctataatcctagcaatttgggaggctgaggcaggcggattgcctgagctcaggagttcaaaaccagcctaggcaacacggtgaaactccatctctactaaaatacaaaaaaattagccaaatgtggtggcatgcgcctgtagctactcaggaggctgaggcaggagaattacttgaactggggagatggaggttacagtgagctgactctccaaaaataaaaagaacaaaaggcagagggaagagttcagtgaagtgggaggaccttagaaacaatcttgtccagctctccgagtttacagatgacacactgaggtccaggtcacagcgagtcaggcagggactactgttagaacccaggtctgtgcctcccaccacaagaggcccaacctcagccctgctgccctgaagcagccaggacgtggcctttcaaactccactttgtgatgggggtgattcagtttacccaactataaaacagggagcacccactcacatcaaggctgggcttcagaaccaacgctggggctgcctggatgaagcagagggcgaagcttgaggaatgctaattgctgggcttggctgcgagaggactggggctaccctggctgtttgaagtgcacgcgcccaggcggtccccagaggccctgacctcactgggctgtgccccgggaatgcctcacatgtctgcgcatccagcacccgtcccagccactgcccgtgtggacagagatcttagggtgcctgctgccatccctcaggcaggggcactggcccacaggaggaccggcgatggcagggcctggagaatcaccaccctgaccctcagacgaatgggcccaagcccagctccatcattgtggggctctagccagtcatttaacctctggaactgggcacgatgccccatgccacttgcagtaaaggtcctccacgggggtcgctttgcgccctcactgacctcacccctccctcgccctgttgcccccacccgctccagccacactggcctctgcgcttccatgaacacaccaggcatggtcctgcctcagggcctttgcatttgctgtggcctctgcctggaaccttctgcctggatatccacgtggctccctcatgtccctcaagcctttccactctctccatcttcacccccatccccgcaggccagcccccttcctctctctacccccatggactcggaacgcctgctggctgtgtgctccgttggttcccttgctcactggccgcatccccagggctgcccacatgcctcgtgggtctaggtgagagaatctatgccaggggtcagctcgttttttctgcgaaaggcctgagagtaaatattttcagcttcacaggccacccagtctctgtcctcactcctcaactctgcccctggggcccgaaagtgcctgcagacaataccataaggcatgactgggcctggcctgtgggttctgggctgccactccctgccctatggaaatcacctacttactgtgcacctactgtgtgccaggccctgggtgagccccccacacccatagatgctttctagacagggggtaaggaaacagaccaaggaaatcataagaaatggtaaaagtgtgacaaaagaagcaaacacggtgaaggggggacagaaatggggagacaggagcagggagtgggctcactggagacagggcagtctggggtggaaatgccagccttgcagccacagggcaagagcttggcaagtccaggagtgggaagctcatggggctgggggtgtctagggatatggaggggcagcaatgaccaagagcggagaggcagtggggaccacgcagagcctctgggcagggcctctgccgggcgggggtgcaccttattcctggaatggtagaaatgcagaacctgaccgggtgcagtggctcacacctgtaatcccagcaatttgggaggccgaggcgggtggatcacctgaggtcaggagttcgagaccagcctggccaacatggttaaaccctgtttctactaaaaatacaaaaaattagccaggcgtggtgacacacacctgtaatcccagctactcggaaggctgaggcaggaaaatcgcttgaacccaggaggcagaggtttttttaaaaaaaaaaaaaaagaggaaatgcagagccccagatcttccttgcacaagccaaatgcaggagggaccagtgaggggcttgcaaggggatcgggcccagggtgggggcagcagaggttttggggagtgggtgtgtgttttggagacggaatccatagcagtggccggtgggtcagaggcggggagtgtggcaaaggggagccccggaggacggtgatggcctccatggaaatgggcaaggctcaggggcagaggacaccaaaaagatttgggagaaatcacagtcaactcctagtgtcagtgcagagcccacccagcttctctgctgtcccacgaaggatgggagatataagttccatgtgggaaggtggctgagagcgggcagggcaagggcccaggccgggcagccagagtaccagggccggttcccagcctccttcagcctcagacacgccctggagtgaatggtttccatcggctgggagatggagtgaggctccttcatatacgtggggagcttgggggtctaagctgtgcagagcccgccagatcagtcccacgctgcaccacagggcccacacgtcctctctcagccttgctccctccctgtgtactgggctcccgcccttgcaagcccccagtggtggctacatggtgccaggagaggagtggcttgctgccaacagtgtgtgctctctgggaggtcccctgccatgagtttcctccccaggacctcacaggccccagggtcagccagcaggaagggcacgtccttggggcccacctcttaggacggtgggactttgacaaagtcatttcacttctccatgcccaggtgccccccactgtggagtggagtggattaccacacccacctggtaggatgctatgagcagcactgggggagacctgaaagacatcagggcgccgtgtggcacacacgcacatttgtcacctgtcaaaagtggcaagtcagcagggagtcctggaggacaaccagggccgtgaagcactggcagggtttctgggtacaagatgaagggaggaatcgtgggggtcctgcatggggaggaaggagcagggtagtggaaaggacagtttgtgcagggtgaatgtggggccacatcacaggagcaggcaggcacctctggacagcagcctggatcaggctgctgagctgggggtggaccagttgctccggccccatgggtggcagcctggagtgaggtcctggttcagcctgtgccctgggagtggcccttcctcggggatgctgttccctggtgcagtcttgttgattttgttcccagagttttgcctccatgggcaagttcctctgcaatttgggccttgacctccccatctgtgccttctaggagttggaatagactctgggccgggtgcggtggctcacgcctgtaatcccaacactttgggaggccgaggtgggtggatcacctgaggtcaggagtttgagaccagcctggccaacatggtgaaaccatgtacaaaattagccgggcttgatggcacacacctgtaatcccagctactcaggaggctgaggcaggagaatcacttgaacccgggaggtggaagttgcagtgagccgagatcgcaccactgcactccagcctgggtgacagagcaagactccgtctcaaaaaaaaaaaaaaaaacaacactctgcggttgctcctgggtcactggggagggaggcacagaggagagctggctatctcagacagtcccacggagcatcccgtgccagggtgagggggtagaggggctgcagggtgccggcagggtggaggggctgggtggctggctttgtgtgctccacacccacttccccatggcacagatcaggggcactgaggttcaggggatgaagtggcctgctcaaagccatgtggctgggacatggcagaccaggggcacagagccagggctgtgtggctcttggcatctgtcaggctgaagctgccccggcccacagaggagtgctcgggctgcaggaagggtcggatagggctaagtgatgtctgaattcctcacccgggggctgctcgggagttgcaggcaaccgcacacctactgggcctctagcaacagcagcaaacgttcactggatgccatgtagtgtccagtctataggggagacagcagtgaaaggcccaccccacacccttgctcctgccgttcctgcacctgcgggacttctattcagtctttggggcctgccaccgtggaaggaagggcaggaaggagggaggcaggagggagggcgaatgaacaatgtactcgaggagcagaggggctggcacggctgtgttttgaaacatgagaagcagaggctgggatgttccagggcagagggaatctggtgagccggtgagcaaagactcagaggcagctaagtgctgggcatgggatgaagggccatgtgtctggcgtggccagagccaaagaccgggcacacagacccaggttctgtccagagacagccagggtccagcaggagtctggagcagtgactgtaggacagaagcttgcaggctgcctgtggtgggccttctagaagcctcctgctccctctcggccttccctctcctggtaactccaatctctgatacctaccaggggctgactttggggaagtcctttcccttcctggggcctcagtttatcctctagtctgatggggcaggacttgaagagtccatcctgctctgatattcagcacctctgcgcttctctacttgggctggaggcagatcccgcccccaccccccaccacaccttcccctgaactacctgcccttcctatacacacacacacacagccaaagataaggaccagagccggggttctcctgaaagcccctggctagtttccaaactggctggtctctctaagacaggttgagagaggcgcctggagggagaggtacaggaagcacaggctttggagccagatcccatcctgcctgggccctgtgtcagaccccaggaggcagggatccctgcctgggggagctcaaaggggcctggggcctgcacttcctgggcctcgtgcagatgtgtccccacactaggaagcacagggccccagccttctcaggaagctcctggcccctgaggctgtgtgttgggtcatctcgcatctcctgagtcaaagcagaatggtaggtttaggaactcaggggtggggcaaggtgaagcctgttactagcccatgtcccagagaacagggtcctgcccttcctctcactgggcccctactgccaggtggagggtgggattctggtctttgaggcccatgccaggcagaggttggcctccaggctagcgctcctgcctttaggaggagcagccacaggttctgggagggcaggggctgtgtccagtcagtgtggagaccagcttcagcctgagacccagcctctgagccactattggcttcagttccaaacccactggggggtgggggcaggaagcaaggctgcccctctgtttcctggtccgcccagcacacacttttcctgaggcctactggtccgcccagcacacacttttcctgaggcctactggtcttcacagactcctcacaaactcatcaaggtgcccctgggaaccgaggggacagggctctgccttttatcccctcgggaaggggccagattcaataacaacactgcttttgggaaaggcattggccactttggactttattagcaacagtaatgtcccctgacatccgcacaagcttgtagctccacggccaggtcttcccccaacctcacaatggccccgtgatgcaggcaggcaggcgagtgggggtctcccctccttatccacaggccaccgaggcccagagagggccttgcccgaggtcacccagggagtggcttgctggagccctgggaataacagtcccacacaaggctctctccctccgcagctggacctgtacgcgggggctctgtttgtgcacatctgcctgggctggaacttctacctctccaccatcctcacgctcggcatcacagccctgtacaccatcgcaggtatggtgcctgcagcagggaggtccacccaggggacgtgtaaaggggtcagaaggccacctccccctacaggcccgagggagcagcccaggaagtggccccagcaggagccccagaagttcctccccgtgtccctcctccctggggccagggccccctccagcaaccttgcttccactggcagggggcctggctgctgtaatctacacggacgccctgcagacgctcatcatggtggtgggggctgtcatcctgacaatcaaaggtgaggacagagtctgtggccatggcggggctgtccccacagcgagccctttggagtctggcactgcccggcactgtgcaggattcatgccgttggggttctgggtagcatcgctgggagtgggtgggttcaggaggttgagccactaggcagtcagcccccctgctggcccctcagggactgccctggctggtagaggctacccaccctgctgccccgctgttaccagctctggccctggcaaggagctgactcaggaactcagggccagccacacccgcattggctcagcgcttgatggtgaggtggggctgtaggcgggtgtgaaggcacacaaccaggaggccataaaactgcctgggcagctcctccaattgtttaaaagcatgtacaaaatgccaagaggtgatgctacctcctgcaggacaaaggccagggaggaaagaagagagctgggagagattggcgatactagtctggaacagataggaaactcacagggctgcccggagagagcgtgagctcaccgtccctggaagtatgtaagcagagccaggaggatccctcagagagtgaacaaatctctaaagactcttccagactcagacactgggaccctgtggctgagcagtttctaacccttgaatggcacttgttcatttgctctgagcctcacacaaaccctcggtctgaatacagagcctgacctgagctccatgggaacagtgatgctggggagaccagcatccaggcagcaggctgcctcttccatgtcccacttggaaaaggctagggagtagggcctggggtggaaacgggttttcctacatccaggcttctccctctcagaccaggggctctagtgtccctgggacccaccgcatgagagggatcccagcagccaggcccagtctggaagggaggggagtgacacagacacagatgggccagggcttggccatgccgggccctgaccccgaggtagacaggaacagtgaggtgttttggactggagaggaaaaagccccggcttgagcccgccagatggtctatatggtcttggtggaggccccatccctctctggacctgtctccctcttctctgtgcctcagggggtggggccacatcaccaccagccactctcagctctgctaaaatcacacccttcaggtgatcaggatgaacactttagaagcctcaggaaggtcctcaaatgtcaagaaaaattacttttgcttccttgaatcgacaatcggaaacctggctgagaaccacttgcccaaggccgatgagtgtccagaggccaacagtgactcctgctgggccagcgggacactggggtgcccatgtgcaaaatgcttacttaatagtattattttaaatacgaataaaatagtcattcaaatacaccttaaaaaaaaaaacaaccctctaccctcacacctttccaaacactgggaaagatgaggtggaaaaaactcaagtttgatgcatcaggaagtttcttgtgagatgaaggcaggggggagcccagggagtcagggccccgcaaccaccaaactgtccctgttccaccctgacccctccagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtgagtgccaacgtctcccgcccatcccaccttcctgccgtcccagtgggctctggtaggcccaggcggcctgtctgccctccgcgtcatgagtctgggctggggcctcagaaggtgtggctccaggctgggacatgctgctaggggtctttgcggtcccggggggcttgagccctccgtttagaatccgatgaggcccactggctaccgcccgtcctggcctttaggtgcttcgactgagacagtttggagtatgggattccgaagggactcggatgctcctcggtggccctgccatcggtcatggggcgggcattttgggccagtcttgggctgccgggatccggaagcaggcggggtacctgacctcccttggcctgccagtggtgggggccagccatggctgggccagcgtttctggtagagctctggacgctgtcagcagcagagcggtacctagggggtcctgggaagccgtctttatccctagtccctgaggcagggaccctgtgatgatgaaactgctggccctgggagagagagagcagagagtgaggctgagcaagaagggccaaccccgccccagcacaggaccctgctcaggcacacaggagccggcaggcccgggttcgcctcctggctctgccattcaccagggagtgggcctagaccagttggtttagtcactcgatgcctcagttcccctgtctgtaatatgggaataatcctgccctttgtgggtgtagcaaggcagcttcctcccagctcacccccgcagcctcctctattccgacacaggcctgggacgtggttggaaatgggctgaatggggttgttggaggcaatgcaggagtttctgttgagtgcagggggtgactctggccctgccctcaagaccctgtcaccagccctccaggtgacctcagatgagctgcttcctgtctctgggcagaagcagatggtgcccttgctttgcttgtcccaaaggccgtgggcagctccagggagcatgggggtgggaaaaggcctgtgaagcagtgggcacaggccccacaattgtccatgcctctggacccagccccaggggtccaccataggacaaggcagccacagccagcctctgtggaatgaacgatcacagcgctcacacaagcctttcccacgtggcctaccctgggagtaggcccgaccagctccattcataggccagagcactgaggccagagacagagctggatccgaacccagagtggagtgacttttccgtggttcccgactctgctcttcctctcccaagcagcacgggctccatcagtatctgcccagagaccctccctgggttccaacagtaagaacggacctggccgggggcggtggctcaagcctgtaatcccagcactttgggaggctgacatgggcggatcacgaggtcaggagatcgagaccatcctggctaacacagtgaaaccccgtctctactaaaaatacaaaaaattagctgggcacggtggcaggcgcctgtagtcccagctactcgggaggctgaggcaggagaatggcgtgagcccaggaggtggagttgacagtgagcagtgagccgagattgtgccactgcactccagcctgggggacagagcgagactccgtctaaaaaaaaaaaaaaaaagaacagaccccaactaggagctatcagaagctctggaaggctgggcctcagtttccccatctgtaacacgtggtcctcaagcagggcccctcatgctccggcatgctgtgctcacaagctgcccacatccgccatgcctcatgggagggctttccagggaacatgtgggctcacagcaggcgtctgcccagttctcctgggagggctgagggccagccccagtgggcaaggggctggtgaaaggttggccgtggagggcacagtaggcaagtggtaccctgccaggctgagcccctttacacccgccacctcccacctcctcccaatgcagcatgggcttggcatggcacggtcttctctgggtggaacatcagtcaggagattttcccatcaaggccaaacgaatctgcacatgtcctggccttggggtcagggttgggcaggccccactgcacagataaggagcccgaggcccagagaggatcacacagggaggtggaggaggaacactgctgaccccaggtggttcaggacaccaaccagcattggagctgtagcctggcctctgccctacctccccatcctctaccccttgggctgggtctgcctggtggatgcggggcctcggtccagaaacccaggcactagtcctacttgaggttcctggtctctgtgtggctctcactgacactggggacttttaggggcacctagaggtctgactccactttgctctgtggccagggtagccctcaaagatagccacagtctagtcagaagggaggtagcagttctgtgtgttgagaccataggggtgttttgcttttttttaagatggagtcttgctctgttgctcaggctggagtgcagtggcaccatctcggctcactgcaacctccgcctcctgggttcaagtgattctcctgtctcagccacccaggtagctgggactacaggcatgtgccaccacactcggctaatttttgtatttttttttaagttttttttttttttttttttttcccagagacatagtcttgttctgtcacccaggctggagtgcagtggtgtgatctcagctcactgcaacctccgcctcctgggtttgagcaattctcctgcctcagcctcctaagtagttgggattacaagcgtgtaccatcatgcccggctaatttttgtatttttaatagagacggggtttcaccatgttggcaaggctggtctcgaactcctgacctcgtgatccgcccacctaggcctcccaaagtgctgggattacaggcatgagccaccatgcccagccaatttttgtatttttagtagaaatggggtttcaccatgttggccaggctggtcttgaactcctgacctcaagtaatccacccatcttggcctcccaaagtgctgggatacaggcatggaccgttcactatcttctggctcatccatgacaagtaggtggcatttttctaaccagaaacaaaaccagtaacaaagaggcaaagggtccagtggacagagccctggtctgggctcccgtctgggctatgcccctgcccctccctgggccttggtgtccctgtctgtgaaacagggcagtgcacagaccagaaggcctcccagggtcctgccagctctgtcacctgctgatgccgcagctccaggccgggtgccctcccttagtcagtagcagccacctcagtcataacagcaaccacagctttcgtgggcagcgtgctgactccaatggccacaccccaaaactcactcatcatcttccctgagaaagagaactcacattcaccggaggcccttgaggagccagggacaggcttggccggctacactagcagcctcacttaagtcgttgcaacaactctcctcattttgcagatgaggagcccaaggtgaaatggccactcagggagtgagtgccggcttcctcagggaagagcgcctggctgggactagacaccagtgctgggaggtgggggtgagcagtggcctgctgacatctgagttgggggcccagccttgctatctgacagtcaggggtggggaaagcccctgccctattcagggggactggcaggcctcacagctcatggaaactctgagcctcagcttctctacttggggtgacagcacctgtcccagggccagctgacatgagcacagattggaatatagaggcaaatatcccaccaatggcaaaaagacattcagggtcttagggaaatgcttctctcccaagcacctagacagaaccaccgtctaactctctcattgtccagatggggcaactgaggcccaaactgaggcaagggcttctcccaagtcacagcaagctggcagagaagcaggaaggacagcagcttgccctgcgttcggaggctgcagcccgcaggcattcctagcctctgtaattaatgtttccgtgacatccacagcttaggggtaaatgctgggagccgtccgttaaactagcaagcttggaaagtaagttaaaatcacggaggcagccggatgcggtggctcacacctgtaatcccagcactttgggaggccgaggcgggcagatcacctgaagtcgggagttcaagaccagcctgaccaacatggtaaaaccccatctctactaaaaatacaaaaaaaaattagccgggcgtggtggctcatgcctgtaatcccagctacttgggaggctgaggcaggagaatcccttgaaccctggaaggcagaggttgcggtgacccgagattgcgccattgcactccagcctgggcaacaagagtgaaactccatctcaaagaaaaaaaaaatcatagaggcttcctgctcctgagttgcagctggtgacttaaactgtggaaccgcaaaggaaaactagttacgtttcagagtcataggtcgtacaactttgtgaacgtactaaaaaccatgggaacagtgtacactttgggtgaattatatggtctgtgaatatctcaataaagctgtttaaaaagtaactcttttgggctgggcacggtggctcacgcttgtaatcccagcactttgggaggtcgaggcgggcgatcacgaggtcaggagatcaagaccatcctggctaacaaggtgaaacctcgtctctattttaaaaatacaaaaaattagccgggcgtggtggcaggcgcctgttgtcccagctacttgggaggctgaggcaggagaatggcgtgaacccggaggcggagcttgcagtgagccgagatcgcaccactgcactccagcctgggcgacagagcaagactccgactcaaaaaaaaagtaactcttttgaagtagaatcgtaatatcagtgctgggagagatctcagacattatgggtccaaattaccgctccctcctcccattctgcaaatctggaaaggcctggttaggatttgctgaaggctcccagaagggccggtgtcctcagatagcttctagcctccctctgctactgaactgcaagctttcaaaaccccaggtcttaaagcacctgaactctgccagccatgcaaacacagttggcgccagtgtctgctcctggcactataaatgtgccagctgctgtcatgagggtccaggagatgagggtaggggtgtatgtccccataccaccccacccagggtctcctccagccctgacaattgccaggggtggtgggctgggcaggatccacacctcccctattgacaggtcaggggactgagtccctgggaatgagtgtacctcggctctcgctgcttggcctgctgaagtgagctctcctggtgggaccctgacagtattggggctttgagtgtggctgttttgggcaggtcagaggctaatgggacatcatcgtgcctcatgcccattccctgaggcccaccaaggaccaatcctgacacaagtgtccctcaggcttggactcaccccgtctcgcactccacccccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtaggacgggctccgggcactgaacccaggctgcagggcacccagggttctgggaccttgtcctgcaaacgtcaccagaagaagaggcaaaggatagatgtgaactgttccccaacctggggagtggggagagtggtcctcagggccacaatcaaagggattaacatggatgtggcttggcacaaggtctggacaggtatcacttactgctgtgtgacctcaaggctgtaaatgaacgtccctgtgccccgccttttcctcatctgcaaactagggactgtgccacccatctggcaggtgccatcaagatcctctaaccacaggctttggagacctctaggtggggaaacgtgcattttcttaggttgccttttcaggatgctgggaccaagagtccccagcattaatgatggccttccatatggccctggccggttcccacccctgcctgttcatcaagtttccccatctgtaacaagggaattgaagtcatcagagtcagggacatggtagcccagaagacaacagctcgagctcttgggtggctggcagggagggactcgtgacccctggtgtgcagggaccctgacccacctgtgcctccttgtctgtggagcgctgggcctgcatcctcttcaacgcatctgcttcttctcttccccgactctgggcccatggggagccaccctggggtccaacaaaggtccctcgggttatatggggggcactcagctgccggcgcggtggtggggttggcccgttggccacttgctctgagtggcgcctccggagagggactgagtgctctctcacctcgaagtactcctctgacacagaggaagccactgagggccgtcgggggccagggccacggccggagctgcctgagtggctgtcctggtcactgagggttacgtagtcgtcatcatcttcttcttccaccccatccagcccattggggagccccaccccgaggctctcggggtcatcctgggtcacagatagctgccgctggagtggggcgtggcctgggcctgccatcctgggtagcctatggtctgtcccattctggggagcttcctctttggggagctccaggacccagccaatatcactgctgtcccgggctagtacatctgccacagggactgtccggggcttgggcacggggggcaatggctcagggtccccctgggggaggccgttctcagctgggacaccgtcctggggggcactgggctctgggggagggcaaggctctggacggggcctgctgtcctggctctgcttccacagctggtgctgggcgctggcctgggaggtgtcacggatcttgatgcggttcatctggctgggctgggggttccagatgttggggtcgatgatattgatgtagcccaggatgtcgctgccaggctccgggtctggctccacccacgtgggcaggtactcaaacatgttggccctctccaggtgaagcagtcctgggtggatgggtggcagcagctcggggagttcccctggatgctcagccagcgctgggcctttcagccccaggggcttcttggcctcctgcttctcagaggagatcttggcaatctcgtcgacgctcttggccttgacaagtgcgtacttggggttgacgagcttcttggccacagtgcccgcgggcaccagggggaccacagagggcagcacaataggctccggctccggttccttctccatagggatgcccttgaggctcacactgtgtgacatgaggtacagctcctggaactgccggtcaaacatctccaccacctggccagacagcacagagatcacattccggtccgtccgcgcggccgaccacgtgaagctgcaacagagggagggggcgctggtcaggcacatgaccctgcttcctccgcccagcccccgtgcacccatagccgctgggcctcagactgtggccacagggccctgggatcaagaagtgaatgggggcagagagcaggtgcatactgtggggtcagactgagtcggatgtcaagcaagttggttgcaccaagcccattcccacctctgcaaatgacagggcactgtgctcctctcaggctggtacaggattcactaagcagctcaggaaggccctggacactgtggggggttctgcatgtggtggccgctgctgccatgcgtctatgctgccaccaacccccatgtaaccatgggcagcgcccaccccatgccccatgtggtggtgcccacagagctggccccatccctaaggacggctctcagagtgacccccataggcttgcgaaggcacggcctggccacaccccacctccaggccggtgacatctccaagctggaacaacagcgtcctcagacaaagcccttctctgcctgcctccagagacagacaggcgggcagatgtgctccagccctgcgcacacctcagcagccttgggaccaatgaaccggaataaccagggttaggattaagggcagaagccagttgggagccagaggtacctctcgcacaacttccctgaaagctggagagtcacctgtaggagccgcacacagcccggtctccatccacaaacatgaacttctgggccagggcacccttgaacttggttgccgaccgcgtgaagaactcagttcccccgctgctccgcactctgagattctgttttgggaaccaagagacagaattacacgactgcaaccctgaccacacagggcgaggggaggacggcagctgcccagggctcagaggggactctggagtagtcaggaggggaagaaagaggctgtaaggcctggagaaaggggctggtgtgtctgggactgcagggctcagggtaaggagggagctgctgagccgtgaagctacagagcgggcaggcactggtacaaaggggttggcataagatggtctgggctttggccctaaaggtgtctgaagagcagcatcaggcaggaaaaggcttacacagccagccagcttgggaaatgctgccgtgggtggtggatgctatggtggggtcctgagcgggagggtgatgtgcacacgttttagaagtgtctcgtggatggctagggggtgatgcagccagaggagggcaggaagggggcctgccctgcagaatctgtgccttatactccgataagtctgtggccctccagggtgcgtggccctacccggcctctcccctgtgcttctcaacacccctgtctctgctgggctctgctccgaggacaggactcacagcaaacctttctccttccccatggccaggacaccacccagcacccaggccaggtcctgtaaatggtcagagattcaattctgtgccggcttacactgtttggcccaggagcaggccaggaaggccctcagagactgtggccaagggagctgagacccaaggagaagagggctccttgggcatgaggagcacagcgggcccctcaactgcctcagctccaaggccaggtcgtcaccggccttttcctggaccctgaacacataagggccctctgtcccagtgtggagtctctggagctgccaagggcctgtgtgttatgagctccaggtgctgacttccctcccccaggtagcaggacctgctgtgagggaggagcagatggtaaaggctggtgctgggcacggcagaccccaggaaggacagggcgagcctggctggaacccaagtgtcgaggatggccaagggcatcccgaagtagaatcacaggtgtaaaggggacctggggctcatctggcccctgtctagggcagtgtgtaagaaatgctcctgggtgccctgagggtctgactcaggaggcctgaggtcaggcagggaatctcagttttaacacccactccagggattcctgactggtctgcctgcatgcctcctgtgatgggagtctcactccctcccgaggggctctgtgccggcttctggctctcggctatgacgtgttcttagtcaggctgagctgtgacgtactggtctgtcccctcacccactcactggccccagcttattcaccccactcattcacatagtcatcaacccctgccgaggcctccagctgcagagatgcctgtgatgaggatcccacctgggaggtgaaggggaggctgagggggtaaacgaaaacaagctgaatgcccaggatcgcagaggagtagcctgaagtgtgaagggctggccgggaggctcccgggagaggatgacataggtcacagggggaggtggggaagcattccagggaagggactcaaagaccaggcatgagaggcctttgtacaagagcacctcaggggaggaggggtgggtgatggagcctgcagagcgagcaggggcgggctcctggtaaaagaccctgcaccggcttaagagcctgagcttggccctggggccagtagggagccatgggaggatttacagcaagagcgatggggttgggtgtgtatctcaggagcagtgctggcatcaggcagtgggtgtgtgaggtgaatgctatgggagaggaggggagcctgagagagcagagctgcccgccatgccatccagcctcctgccctgccagtcctttccgtgtcccagacccctgtggctggggtggccccaggcaagcaaccacagaggcaggcaggtgtgggccgtgggtgagtccccatctgatgcccacctgtgggataaaccatagccttttcatagggcccagtgcagaaggcagataagcctctgctcccagggccgccctcgccggccccccaccccgcaggctgcaggtttgcacacagccagctcagcaggaagctggccacggcccaggacaattagcgctcgtgactttgtacccaacatggagcacgctcggggttgagaagtcggacaaagatcctggaggtggtacgaggccttccctgtcactgagcccaaccgagcccagctccaccgcctcctgcaggctcctggcccggccacagacccctccttagcctggaaaatcggccgccagcatcaggacccttctggacagtgtctgtccccacccatcccaaaccttgtcctgatgagggctcggaaagtcaccacttccatctcagagtgactcagcctccgtgtgagccgcaggcctcggctgggccgctgactcgctgtgactcgaagcaagtcccgggcccttgctgggccttagtctcccttagcacacagcagggcgggcctccaactcttaggcctgttctacctggggctcagcagcaggtgggggcctgcagcagggccccccacctcttgcctcatggcctgctccccagcttgtgcctggatgggccccaccccacggggcctggcctggatgaggtaacgtctcaagactctgggctcgtgtgcgcagaggtggaggatcccacaaagctgcattgtctctgagctcctgggacacccccggcacaggacagcagatgggtggagggatgccggggctggcccaagaggggtgccctggaaaagtctttggaccctctgggacctcagtttcctcataagtaagagaggacgtcaagggcgagtcagggcaggggaggacggccgggtggtgcttcatctgctctcagcgggtggcaaggcaaggtgggggctccagggctggggcaaactacagcaacctgcccccaatccccccaggcctccaggccacatgtgcttaaaggacatgtgatccaactgtgccaagcccgctggtgcgaggcagagggggctgagcccaggagcccctggagtgggtctagggtctaggcattcctgagctccagtcaaacaggctccaatcctagcaccaaatggacgccaaccaaggcctttctttccacgcctcagttttctcatctatgaaagggtctactcatccttgtgctgcaaggctgctgtgaggactgaatagagccacagtacaggtggggccctcccagggaaggtgtccagctcccagtgggtgccccatgaactggaagtggcgcagtgggctgtgggggaccaacacagaggaccacaaaacatccaggagggatggactgcccagggaggccaggactgtcagccgtactgggtgggtggttggtgggctcaggtagggaaagtgacctgcccactgtctcccagtagccctgggctgggccgggactgaggacagggctctttcatcacccacctcctcagggccctgctggccaaacaccgtctcctttaatttcaccctcacacaaccccgtgaggcatcactatggccatggggcgctcgaggcccagagaggtggaaccacacgcccaggtcccacagcaggtcaacagccagtgagccatgtaggcagcaccaggacagcctgtgctggcaggttagctttggttttggttttataatggaagccagtgattacttcccctgcccatagtgggatggccattcctaggtttattgatagttgagtagttagtgtgaatgagtagaggcccggtagagcagtggggaggtccagagatgcatccttgaccaggtctgagctgggaacagtgaggccaggcctagtgtgaggaatgcaaggaacagagcccaacatagcagcaggagcctggctgcctgaggtgcaggcctccagcagcctctactctcctctacagggcctgtctcgctctctgtggagggtggagaggggtggtcaacactcaccctggacttctccaggctgttgtgaagttggggtggtgggccctttgtgaaccacatttggcccaaagtatgtgacggcatgtaggggcagggccagcctagctccaaggccctggtctgaggggctcctctctcccctaggccaaggctgctcagcctctgcacaactgatacatgtccccttttgtgtgggacctgtccccggcagtgtaggatgtttaacaacatccttggccactcaatgctggtagtacccccaaggtggacagttaacaatgccaaatgtccctcagcagagtgaatcccccccgtttgagaacccctgccttggccgggcgcggtggctcacgcctgtaatccccgcactttgggaggccgaggcgggcggatcacgaggtcagcagatcgagaccatcctggctaacacggtgaaaccccatctctactaaaaatacaaaaaattagccgggcgtggtggcgggcccctgtagtcccagctactggggaggctgaagcaggataatggcacgaacccgggaggcagagcttgcagttcacgccactgcagtccagcctgggcgacagagcaagactccctctcaaaaaaaaaaaaaaaaaaaaaagagaaccctgccttataccctgaatccaccacagacccaggcccaggtagagacagcaagcaacacccaggcatccccggggaacgggggaacctgggcagcggaagggctgggtcgtgcctgtccagcgtgaggcctgagcggcagcgatcctcacttcctcaccgtgtgccttcccatggccatcccagctgatgcttctttgttcatcagaaacgggaaacgggtctggcctttgcccaggggctgctggtatttccagtttggctgcacgaagtcaactggcttttcagatggcccaggcatctcatggctcttgtctgtcctaagctggaagcctcaggcccagcctgtctctggttggcctgggagcatccctccacacccagtatcacccccaaaagcagccaagtcatgcggcctggccctgtgaccctagagggtgtcagtgaaagttctggccctcttcccaaggcctgctccctatttgtcatttggggtggtcattcccatactcccacatggagggccactggggccggccagggcaaccggctgaggtgcttaggaatggctgggagccccacatttggggagacactggtgcacgctgctcccacctcacctggggaccaggagtgggcttggcccaagcaacagggcagcgtttcgagagtgtgttggtgtgggctccaagctcaggaggaaggagccgagtgagggtgaaccacagccagaccctggcgcagagggaaagaaagccgctcagcactcagaccagagctgcgtctcatggcggggctgtgcctgtccctagccaaagccaggatgggaagggagctcgtgaccgaaggcccaccgcacaaacggcctccttcactcttcacagcacccctgacagataaatgaccatgtccccattttgtagacaagacaatggaggcctagaaggattcagtgactctgcccaaggttaccatgcaggtggcacagctggggctcaggactggctcctggtatcacccccaaactggcacctgacaccccaaggtcaaaaggatgaccctaccagaaaacctgtaccctgcctgggcccaaaggagctggggcaggttggtgcagagctgggcaggggtggcagtggctgagggcaggcccagggattatcggcaaaggaagtgctcccgggacaggtctgggcccagctagctcaaggtgagggaggtaggcagggaaggcaggccctcgacagggggtgacacttggctggggctgggctctcagggcctctggccacccgcccagggctgtagaagggcaagctcagaggcgagaatgaggaagccaggtcacactttcccatggaggcgtctagctcctggatatgtcaccctacagactctgccaccttccctggggaagcgaggcggctgagcagggcaggcggggccagggacctgcagtgccagctgccttccagctggtcacagccagtggaagggctgggggtggaacagggcaggcctcatacccaagcccctaccccagcccagggcctgggatttagaatgtgtggttcttgccagtagctgtataactttcctcagcacacacagcactttacaaccaccgtctcctttaatttcaccttcacacaaccccgtgaggcatcactatggccatggggcactcgaggcccagagaggtggaaccacacacccaggacccacagcaggtcagcggccagtgagccgtgtgggcagcaccagggcagcctgtgctggcaggttggctttggttttggttttataatggaagccagtgactacttcccctgcccatagtgggatggccattcctaggtttattgatagttgagtagttggtgtgaatgagtagggtgggagtgctagaagattggttgagccaataaaaaggataagagaaattaatataagggatcaagttcatcctttgatgctctgtgttattatttgtagttgtttattatttgctgcttgagtaccagggatctgcagcctccttgtcagagctgatttgtcactattggcttttaggcgccacccctaaattggtcggaattgctttgggcaaggcatggcctccctcggatctcagtttctccatctgtcttgtgggagcctcatctgaatgacctcaaggccccttcaggcccaggcactccaggccccccacctgccccattgcctccggcttcctggaaactcagaactctgcaagcagcggagcagccagggcttctctgctgagaaggggcctgggtggaaggcgaggcctctggagtggctggccccaggttagggtccctgctccaaaccgacaggcttgctccctgcttgcgtctgcacgctgggggaagtgcaaagcactcgctgggcctggggcaggggtacggtgctggtggggccccactggggtctcttcctgggcatcgggcagggccaggccttctgcagtcaggtttccaaagtggcctttccacactggctctctcaggcatgagctatctgccactggaatcgattcccagcactaattacgcggcggggagtgaggtgggtgtggggcttggggccaacccaccagggagaccacattaaaaatgtcccaagagctagagactcaccacggagtgctcacaaccacttgaaaggactcaaccggaggcgttggggttggagggggtgggcgcgcctgacaaatgctgacaaattacaggcgtggagcccggccccttgttaaccagactggcggtgccccttctcctaggaccacaagcctgaaacctgcagaattttgacctgtcagacactggtgctgagcccaagggtctggagcaggcctctaccccactatctttaacttgctagcagtgacatggggtatgtggctccattccctcatctgcaaaatgggaacaactccctatcccactaggctgttgtgaggattaaattaaccaatgcaaagtgcctgtgacagggcctggcgcacggccaatgcaagagaagtattcgccgtcatcacgcacgctcatctgctctcagggaaatgctctgcacgcagcaggtgccaagcgatggctggcagaaggagggctccagacaccaaatgccagggtgtctgggcagaagagcgttggaccaatgagatcctgtagcccagagaagggaggtgacatgcccaaggacacacagcaaaacagtgctgagaaccacagcccaccctgaccccatcggcagccttctctgatccacttctgttccatggtttcccccaccccaaaggttctttctcctctgctcttgtgccttaaattcacttcaactgtgcagccatcgcagaagccttccctggccccagcctgagggagcttcctctgtctgagccagaatctaaaaccagtaaatggaattctaaggagacagatttgggcttaacccaagaaaggacttcctgggagttgaagctctccagaaaggccacgagctacctgaggaggcagtgagcacactatcaccagaggtatgcaagcaaacagataaccgatgtggcatgggctgctctgaaataacatgatgcagcacttggcatgagctccagcacctggtcagcaagcacctaatcagtgtttattttatctctgccacgttggaggtagtgagtatcctgcccctcagggaattcaagcagtggctatgtgactgcttggcaggaggctctaggattactggactctgagtgcctggcacaggactccgtccagagcaggcaggtactcgaagtgtttgttgacagactgaatgacccctgccctccagccacccaggcaagtgaggagcctgctcaccttgaggtgccccaggtgcatgcaggcccgctcacacatgtgcaggaagtacttgacgttactctcatccacgatgatgtacacggccactttcctcttgaagccggcgtccagcaggtccttgaagatgtccacgtcggtgaacatgtccatgaccacagctatcacctgggagcaagaagagagactagggcctgtcagacagtgcagcagtggggacagggtgccctggcagagcgcacagccctcccatgccaccagcctctcacaggtgcccactctggccctactcctggagcctcaggcccgggaccaggaagtgaggggccaggggcctctcttgccctgaagttctagttgcagtcccagctctgggctcagcccaggggccctgtgttggtgcattcccaggccagggccggctacgctctgccctccttgtaacacctgggaatgctgagatgaacctgatgtgtcaatgaccggaagggcagcagctggcgtggcggctcgctggggcatcccctacattcctgggctggtgtggactttggccagtgtctaaacccagatctcttcctgtcagctgacaacatctgtccccatagcaggtgacctcctgctggacctggctcagggtggggccccagtggtcagggccttcccccagcccagccaagcaccaccaacagggcagggggcctggctgagtgaaggtgcaaggtggaacatgcagaaggacaggatgaggtggtatgggcccggccccagtggggctcagtgactgtcaggcttctctcacacctagtcccctccctgtcccttggcagcaaggggagggagtcaggacagggcctgtgcctgggcacagccgcctacactgctgatgcagacacatgtcccacttttgggcagccccacccctcccaccctccgagcctggcaccaccatccctgtcccaggtctgaggaccacctggagaagaggccagggacctgccctaggccacacagcaagctggggacagagtcaggctacagactaccctgacttgtcagagagcaccccagccttgctgggatgcggagattcagggtggtggaggcggcctggagcctgctggggatgtgtctgcacgccccaaagtgagctcaccaggctggcccctgcaggcccatctgggctcctcctgggcctcaggcccccatcgttcacctggcaccaaagcccaaactccagcagaggggagggctccatacctgccctgcctcaaactcactgtgtgaccctgagcaaaacacctggcttctctggacccagttttctcatcagtatagcatgctccatctctcaggagaatggagcacacctgaataccgcagcacctgcaaagagcccgacggggggctggggcgggggctcggtgatgcccgtttgctgcctttctcccacagtcaccccgcacgttcccatttacagggggtcttgtcagcctgactcctgcagcctctcacaggcaccatggtggtgacagcccagcatgcagccaggtaaactgaggctcaatgaggttgtaaggcttgttggatgtcgcaaagcaagttgggccagggcctggacctacctccgagtcaggtcagggttggtctccagtaccttctcttggacgtttagtctcggagagcctgggagagagtggtccccccagagcggacagcggaggtgtgggaccagctgggactcccagaactccaaggcctagggttctctctgttctctggggagatgactgctccctatctctctgtttctgaagggctgttttggggcagagggagtagctggttgatgcagggtctacgactcgcaggggaggcagatgttggcaccagatggggaagcacttgctgcccccagggctgcccaaggttaaacagggatcttaagagggagctcactccctgacctaggagatgttcaaggaaggccagagactgcttggagcgggggtagatgatagggcagagaagacacgatgcaggcaggtcaccatgaccctggaggcagtggtgttgagacactgggcaggggtgtgtggtggtagcagggtcctccctgcctgggatctcccagacccaaagcctctccagccccagaatctccttagttaagccacttctgagcaggcaaacagcctcacgtgccaccctggaaaggagcctaatgagggcgcagtaggcatgcttctccctggagggcaccaggccctgcctaccgtggcagatggggacttgccctgggcttgggctgggggacgtgccccagcaggacccgcaccatgtgcgccactccccacattgccctcagccaggcagggtgcctgatccagggaccatctgctgtcaggttggatatgttggagcctgcactccaaaatggatccccccacagtcctggctctccccaggcattgggttcagtgcctagggtggtcagagatgggtttgtaacaggcacgagcttatgctggggatggggagggggagcctggtgctcccccaggcaacccccaacagcctggcctgtccatggagccacaaaggtttcttgggggcccttgagtcctgtcatgccctttcccattttatagacaggaaagctgggatcacagtccatgactgaggctagaacccagggccctgtcccacccagagcaccttctgcacaagagactgggcatcagtcctgggcccttgagctgcttgatggtttataaggagcctttacagctgttaccttgttcaggcctcacaagcacaccgggaggcagtggttctttttcccattttgcagataaagaaactgaagcacagaggcattcgccaccttgcctaattctgttgggaggcccagctcacttgtgacaccatgagctcagcaagagcagagcccttgtctgagcccaggacggggcctggtttaaggaaggtcctggggagcttttatcaactgagaacaagaccaactggcttggtctgggaatgactgcaggaatcagggcatctgggaccacagcccctcctgggcccttggcttccccatctgtcaaatgggggtgtgggcctggcttgcccctgtggttctatccagttcacacattgtcagagctggcccaagtcaagaaaagtaccagatgcttcacgtagccccaagcccacacgtcctctcagaggtcctgggcagggcaagggctgtggaaatgagaggggaggctgactccaaagaccagctctacctgctgttatgtcaggggccacactgggcaggaggcgggtggcctgggtcccatcactgagcttgttccgctcctgaggcaggaaccagccatgtccatgtgagcagctggcacaggggcaggcatggcaggcgggcacgtgtgtgtcctgcaccccaggtaccgttgtcaaagccgacgggcagctcccagcccagcagcctggaatctgcgcaggccacacagcccagctcccaagtgaaggagggagcccagtggtccctgtgcatcttactgatggacaggcctctgctgggcggccttgaggcctcgaagatgcagctgcagaacccaggaggcccaatgcccaagacaaccatctgactcctgccagggtgtgggaggatggcccaagatggcagggtgtgggaggatggccatgcctggggggcagaggcaggcaggctgcactggagggaaacaccagcagggatgtgggcactcctccagtgagccaacagcgagcctgcgcctgccccagcccaggcctctccctgggggctcctggtgcccaaacacctccggcatgtctgtccaggggtgtccatatgcacaagccctccagcgccccgcccgatgagcacctcctcccatgctgtaccctccctgcccagtggatccgccggccttctccaccctgccttctgcctgtgtctcgaatcccccacctccctctgtgtccttgggacagggggacatccgcctccatgtgagagatgcagaaactgcagctgggagaggggagggcactggtccaaggtggtgctgcatggggatccccagtgccctgccaggagcacctccaacacctgggcagtgaccggagcagcttgagctgggatgcaggggtgacagcatctcacacaaaggagaaccccacctgtggccactgccccccagcagacacggcctgaagccacgtaacactggctgctggcgttgggggtgggacagggctttaggtcacagaggcagggagcacaggcgtgggcctcctcaatctccctcagccccagccagagccccctgagcaagggtggagcgggcggagtcggtccagcaccggcgcccaagctctaggctgggctttgggtgagccacacctgcgttccaggtctcagtttcttcacctgtcaaaggagaaggtggacaagatgtccaaggcccttcgtctctgatgtccctgccgagggaccccaactcctgttccctgcctggtgccgggcagggcctgtctgggcggctaacacatctcattgcgcccacaggtctgggagaggaagtgctggtggccgccctctccctgcctccccacacagctcctgcctcacaggtgccaacaacagcctgtggctcctgacacccacaacagctgtttcctagccttcctgtgaccacagaaccactcttgaagcagaagtgccctcgcaggacgagtaggtagaacaggtctccacagaggtgcctggggaggaggggtggggcgagacgggctggcctggttccgagcatggtgggaaaccacgggtgcacaggcccagcctctgcagcagcacctcttcaggggggccctaaaccaacgcatcctgacccctctccccgacgcttcctgatccctctccccgacgcgtcctgcctcaagccactgtgtctcctacatgttgttctccttgccacctgcccattttgcatctgctcggacaactaccttttttcaaatcccaactccagtgcagccccagcctcccctgtcgtcactctggcctgtctgggttgagcgtgtatcacttgcgtatttcttctcaggcacagcaatggagtctcccaaggactgagtcgcaagactcgggtaagaggggacagtttccaacctgcacgtgacaagccttacactcacctcaccctcctaggcctcagagatccctagaggcggctcagagagaggagagaggcggccatattctctctcctcactatgctccaggcaggtggaggacagataccctcaagcctgccccagaacctggagccctgaagcagccacagacactgcacacactgcagacaagtccctaggcctctctgggcctcactttcccacctgagaagtgccgggggtggacagagtctctcatcttggggttcgttattctccaggtctgatggcagatgcccagacagtggcagtgtgggctctgcacccgctggctccgatctcagctcctcctgggaagctgcatgaccttgggcaagtaccttcatttcctcatggggataataacaatccccacccacaaggttgttggaaattaaaatgaattcatgcaggtgaagccctagcaggggatccacaaacggcagctgcacggaccctcctcgtcctcccaccaacccaagtcccatcccaccagacccacagctccctctggggtgaacaggccagcagcgtctcactaccctccgggccagctggaaggctgtaagtgacgcatcagggctgctcacaggaatgctgcagactgtcttaaaggttgaggcagtggccatcatgaccttggattcaacttccacttacagccatgatggaataacagagacggaattcaccccctgccttagcaataaaaaacccggataaaatctatgaagccatggacaacaggcttcaatcagcacagcgattcctgagagaagaggaacaaaccagctgagccctaggatcaccccactatttccaggctgcagcacagggaggggcgcccccgtggagtcttgtggtctccctgagttgaggagacagggttcactctgagtgtagcagctaggatttgcaggacggagtgccgcaggggagagagctgcacagagtgaactccagagacctgcagagggtcccctggagtcttcagctgatagccgagcagcacacgaacgtgaggaaactactgaggctgagcagggaaccactggaaaggggaggctgagcagagaaccaccggaaaggggtggctggaacaattgctggtgctcacgcaggaccgggaatagtgtatgtgcccccagccagaacagaaacccctcctaacacacaggtcctgcagggggtgtcctcagaaggatactgcctcagcagttgacaaataagtcctagaccaggcataagcaaacttcctgaagaaccagagtgtagacatgtgaggctttaagggccatatgttctctgtcacaactactcaaatctgctggtgtaacacaaaagcagccaaacaaagtatataaataaatatctatgttctattgtttataaaagctggcaagaggcttcctttggcctggggtccataatttgcaactcctaccctggagtgaagtctgctctggtcctgcctaataaagcttgacaggaagccacaaaagcattaaatcgtttccaagtaacctaactgcatcccagaacaaggctccaaaatatttaaaggagaaaacaaaacaaacaaaaactacaaactaaaatccaacatgcccggtatccaattaaaaattaccagacacacaaagaaacaagaaaacatgatgcacatgagaaaaaaaaatccatcaaaatcaaccaaaaaccgacacagatgttagaactggcagataaagacataaaaacagttataactgtgttccatgtgttcaaaaagttaggtagagatgtggaagcttttttttagccaacaaatcgaaattcaagaggtgaaaatgcaacatttaagacgaaaaatatactaggtggaattaacagattaaacactatagaagagaaaattagtgaacttgaagacatgtaagtagaaactgtccaaaatgacacacagaaagactgaaagaacatgaacacagcatcagcaaactgtgggtcaacttcaagccatccaatatatgtgtaattgcagtctcagaaggtggaagggttgggagtgagcgagagactaaaaaaataaataaataagaaaaaaatggccaaaacacttctaccatttgattaaagactaaatccaaggcaaggtgcagtggctcatgcctataatcccagcactttgggaggcagaggcgggtggatcacttgaggtcagaagttggagaccagcctggccaacatggcaaaaccctgtctctactaaaaatacaaaaattagcagggcatagtggcatgtgcctataatcccagctacttgggaggctgaggcaggagaattgcttgaacccaggaggtggagtttgcagtgagccaagattgcgccactgcactccagcctgggcaacagagtaagactctgtctcaattaaaaaaaaaaaaaaaagactaaatccacaggtctcagaagagacatgaaaaaactataccaacgcacatcataaacaaatcacttaaagtcagtaacaaagagagcgttaaaaacaaccagaagagaaaagacaactgcatgtcaaggaacaaagtaagtggacttctcatcagaatcactgcaagccacaagacaacaggcaatatctttaaagtactaaatggaaaaaaaaaaaaatcaacttagaattttatacccagtaaaaatacatttcaaaacaaaaggcaaactaaagactttttcaaatataaaaaagctgagagaattcattaccagcagacccgcactccctcctccagctgcaaccccctcctccagcagcacggttgggacagacgtggctgcagcacctcagtttttctatcatgacatggtcccactccccctcccctcctcctcccctccagggggctggcagaattagtgacatgccatctgaagaggcccaagaaggttctctgggttaggaagttctcctaggatccctgggtggtgctccctgccacctcctggcaatctccaaaccagtttgcccatataatgtctctgaaagtctgtcaccgagaggactagtttagctaacagtctcatcttgcctcccagggtaaagggagtctgtgtacttggtaacaaatgctgaccccagccagagcaaggataattaggccaaccagctggcacgcatacaggtgtcccttttctggagacagggaggggtggtgatggccactcccattttccagagggggtgtcactgtcccagggccaccctgtcaactagtggcagaggtctcctgttcctaggcttttctcctaatgggggaccctgtgtccattccaacctctgaacccacccacagcctcccagaggccacctcagctcttgaaagaaatacctgaccatcagcactgtctggaaggttaatgcctgggcctccctggctctgccatgccttccctgggtggcccatggcgggtcacttcccactctaagcctcagcttctcttcttggtaacatggggagtgaaactggatgaactctgaggtcccgttccccttgacattcatcagctctgtgaacaccttccccaccctctgactattaaggctgaagcctcattaaggccaattaaaggaagatcaggccttctgagcaccaaatggctgcagtgggttggggtcaagaagcccaggctaatcatgcccagagcgctctgaccaggaggctcagcctagcccagtggcatgaaggcactaccctgagtctcctacctcccccagacggacatcagcttcctggtcatggctcaggaatactgcaaagacaaggggctggcagagcttggggaaaggccatgaggtgaccaaggctgttccctgtggatgaggcaagagggcaagatcctttcccgctggccgcaaggagcttcagaatcctcagagcttccaggcttgcaggcgcaggatccagccaaccagaccatcccatgtgggcagcaaacggcaccagctgagaattttcaaacaggaaaatctcaaaactatagattcaaaagcctttaaaacctcagcttctccagggtccaagagcgacagacattggggccatcaagcatcctaatgccccagaaagcctggcttggaaaggacttgcccaaggtcacaaagcacaccagggcagggctgaggcttctaggccacctggtgcccacatgctctctgctgcgttccagtgagcccctgcttgaacttctcccaggacagggagctcaccacttccaccccagactactcacagagagaagctctcaggacaggagtgaggagtgaaggtggaggaggcgaggggagagatctggcatctaccgatgccagctccatgccagacacagagtgttttacacaccacactttttcccatttaaatctcactgactttatgaggcaggtgttagctgttagcactaccatgacactgaggaggaaggaacagaaggtcagagaggccaagcaactatctccaagcagccactaaagataacaccagagctggggctcatgcctgggtcccagtgatacggaagcctgtcttcccaccaccccacatggcatttaacctggcaaggtactcgagcccaggggtcattcagacccttaaaggggactaggacagcccaaccaggccagggcctgccaggctggggccaacgtgggccagggcacagggtgggaccccatcttcctccccagctgctctcaaggcagagggtagctcagtgcttttggatgctcctgtctatcactgcgtcaagacaaggcctgatccccattttacaagtgaagaaactgaggccgagggtcctgcagcatgcaagtggctaagtgggaccagcactctctgctggcccaggggccaggaccctcagctgcagggagaccctctccagccagggagacccaatccaggtccagccacacctaagacccttggtgtaaccttatgaaggccccagccgactctgagcctcagtttccccagctgtgatatgaacatgacggcaggccctggctcttggggttgtgggaaggaggccagcccagtggctgagcagctgcctgtcccactggagtgcccagacgggcaggcactctctccttagagctccttcctcgaagggctgctcccggctctcctcgaaactcttaattaagggaagggagcctttggagcgcacaggagttaacacctgggattactttatcagatggttccccacccactctctgacctgtggtgggagcctgggccagctgtgcgccccacaaggtgtcaactgggccacctgtggcctctggcagtgtggggagctgtcctggcactgcccagctaaaggatgcaatgagtggccttcctcctggtccccaggccacagagctcaccctgttcttgtgagtccccgtcccagccctcctccagagagcccagtatttagctgccaaggagcctcatgaaaacgcttttactgccaggcacggtggctcatgcctgtaatcccagcactttgggaggcagaggcgggtggatcacaaggtcaggagttcgagacccacctgaccaatacggtgaaaccccgtttctattaaaaatacaaaaattagctgggcgtggtggcgcacacctgtaattccagctactcaggaggctgaggcaggagaatcgcttgaaccctggaggcggaggttgcggtgagcagagatcgtgccactgcactccagcctgggcgacagagcaagactttgtctcaagaagaaaaaaaaaaaaagaaaatgcttttactgtcctgagtcaacaggatccagcagtgaggctctggtgctcccatgcaggggtagggctcagaaggaacagtgccactgcttctccagggaatgggagggtgctcagggcctgcagactgggggtctcggcccagtccctccagatatcagttctgtgacctcaggccagttatttgccatctccgagccccaccaagcctcagtttcctcatctgcacaatggagacaacacctactttccagagttgtggggaggattacacagcatggtaaagtgcccgctcagcacctggcgcggggctggcatttagtaagcacctcattaagctgcttctattctctcagagccaagctgtgggccaggacttcagtgtgtgaaggcgggggcctgacagaaaaaatgtggggtgaatcaggcttcgtgaaacctgggttcgactttatttctctgggtctgttcccaagccctggcctggcatgcagagatcagtgttctggccctggccaccggcgcctcacctgccctcagtttcctcaactgtgaaataaggaaggtgtgatctgtccctgccctggggcctcaccctggggctggtgagggatcctgctaaggcccccctgctgtgtcctgttgaggggggctcagcatctgctggaggagcaaccagctagaacatctacatccagctctggctgaggaagccccaacccagcccagcctcacgccttctcaggctgcagccaagtgaggccggggctcgcccctcccaggcgtgatcttacaagcccgtcctctggtatgtagttggaaccccacagcaggttttttcccagataaatcatggctcctggggctaggggaggggcaggcagttgaccttccatcttggagtaggagcccactagggctggagggaggctggagggcacaagctgctgagagtgagacctgggacccacccgcctcttgtcccaggggagtctaggatcacagggcagcaaggtgtcagggctgaaggggcccctaacagtcttcaatacctgttcccattttacagatgggatgaccggggcttggagaggagctggggcttgttccaggtcccacagtcaggcagaggcagagcacggactcttggctcctggtcctgctgtccactagttccattctagtcatttgggaacaggggggactgacagcagtcctgacaggaacacagccgctcccctaagtgctgcgtcacttccctgccccagggtctgcctgttgtgctgacgacaggtaaggtgagtgaggaggcggaaggctgggctgtcctgactcagccccagcagccccagcctaaagcccccggtgggaaggggccagtgtgcggcaaggcggcccaggcagagggatccccatcctaggcagggggcaggcagagttctccctacacaataccagagtgagaaggggaggtggaagcatgggcacgagaggtgattcatggggagagataaggcagggagcgctcccaggaagcaggcagacaaagcgccccgtcagcatccgtcagtgtccgggccctgcccctgtgagcctgggaagcagctggggcaggacagctggaggactgcagtggcctggatgagctgcccctcccagcccctgcctgtcactctgtcctgccagggccagggcacaagggatagcctagagtttgagggaaacacaggcctggtccccacccctctacccgagaactagctaggtgaccttgggcagcgactaaccagtttctacatctgaaaaatgagacagataacactagctgagattataaagcgcctcgcactcagtcaacacttgctattgttattatccctgcccacacatgccacacaagcctgggccacaggtcccaggacagatgtggcagggaaggaagtgcccagggcagaaagcaggggcttggctcaccacaatgctgtggagtcatgaacaaatccctgtccttctctgtgcctcagtatccttgtctgtcagatgaggagcttagtctctactgcctctgaggcccccactgtgggacccttgaggactccctgaggtctgagagtagggagcagtttcagcagtgagtgccccatcctgagggctggaaaagcagaaagcagggcccacctgtccgaggctggaggacatcactcactatggggccatgtagacagactggcacccaaactggagaccagcttcttcctggctatgtcaccttagacaggtgacagcaatcaccttgtgggaagcaaaggaaggcaatgtcaccttaggtgacactaataaccttgtgggacttttgtgggaagcaaaggaagctccaggtggctcatgggactgtacggagtggctgggtcacagctgtagccagagactcagggaggaacctggggtcagcaggtgaagtcctggccctgggagcccctatctggcccatcgctgggcgggggatctgtctgtctgcagaccctctggctgttcccatctgcctccttcctgtcgctgacaaggaggggaggcacagaggagtgggaaccttggcacagcaggtccccctacccatggcctcagtttccctattttcaagatggaagtggaggctgggtaatgggatcccagcaggctctctgtggggactgggttctctagcctccagccagtcatccccatcaggcacagacatcagcagcacttcctccacaccacagcaggtgtggggcgggtctctcagtctgcaaactatgaaggtcccttcctcctccccctcctcctcctcttcctctaactccttccttacttttgtcacccgatattccatcttcacaatagccaaagatgcagcttttatccacaccacctccatcttatagatcagaaacccgaagcctcaaagctgcccagggtcagtcagtgaattgagagcagccaggccaggggccaggcgcccccacccagctagctgacccaactggtccccttgttgggcagggactccaccttcctggaaactggggccagggccaggggccacctcaccagttcttgacccacgtctggtttctctgcccacgaacttccccaaggccctgtcagttagccaggatggtccccgaagccagcattctggtcttctgcaattggctgccctgctctgggactggaagtataaagggattagacccagctaggaacacctcatcccacaacctgaggcccagacctggcttcagaatccttctcaacacagctcactaggtaagctttatctatcaaattaagatgtgcttggaaacgatgagaaggtacttacgtgcagcaggcattagcacctgctcatggtcacaactgtccagcagtggcctagctgtctctgcaaatggcaagcaccccttctcagaatgtgtgacggtgtgtcagccaagaatggccccccacagctagggcactgcatagcccaacaggggtggagaaggggagggccagagaaggcttgaggtcccttccggtggcaaaattcaggtggacaatgctcaggtggactcactccacttccacagatgaggaccacacctccctcacccaagcatcctggcctggaaagtttccaccattgcaaagctcacaaagaggctcagagagggtgtgcaatctgctcccagttgctcagcacagctaggaaacaggcagtgttgaacaaggacctccaggccagtctcagatggacttggaccatgcctattccctcaccccacaacaaaagctctccccaccagagagctcatggtgtgtgcgcgcctttacagtgaatcagagccactctaagggagagtgagaggaagccctggggttcctcccctccccactccaccctatctcggtgccttcttctggggaaccagaaacaccctccaacaataaagaggccctttgagacggggcagcccactgtcacctgctaggacctgggaaccctaccctgcaaagaaactgcggatccccacgaaggtggggaggaaacctccacccaagaggcagccagggaaaacagcagagatccctagaagcccatgttgggctcccgttttgggctctgagtgagcctgtattgagaggggtccggtggctggttgggccatggctccaggagtccccgcgctgcctcaccttctgtgcctggctgatcatcttccgcaccacctctttgatgtgggcctgcccgtctatggggggctgcatgtagacgctagcccgggtcacgccgcggtaggcgatggtgtcgggccagcccaggtccagctgcgggatggagcggtccgacttctggggccagtactccagggagggcagcggctcggcctcgatggggaccccatccgccccgctggcttcctcgccgtcgccgaccccattgtcctcgggcccctgagaggggcccgtgccccgagggtcctcagagcccgggtcgtacacctcgatggtctccaggatgcgcttgagctccagctccgagaggaagtctcggatgttctcccgcttgagcacctcgtagaaggcgtcccggccgcgggccaccagggcctccagcgccagccgctgctcctcgctgtagaagaactcaggcttggactcgctggagcgccagttcacatggttgtcgtccagacactgcacctgagagaaggccatggcgccgcctgcccgggcactgctgccgggggtgggtgggcaaggtccagctcctagctccggcccagctggggcaccgcgcgctcgggggcctctccgcggcctctgcttctctgcccatgagcaatctgcgggaaagacctgatgagcccggctcggcggggagggcgggccgcgcggggaggggcggcgggggcggggccgggaactcaggtgggcgtgggaaggacggggctggggctggggctgggaagatgaggtgggggcactggactgggatgggaagaaagtaagggatcggaacagcggtgagggagcggtgggccacgtcccagggctcagcgtgcctctacgtgcagggaacccatatcccagatttccggagctgcctgaagtcctcgcaacttctgagggaaactagggcagccggggaacttcccagtagcttcttagagtgggaggcggccccggcacagaggcgccccgcaaaccgagggcttccgggtaagggaggggtcttaaaatttccgggtgccggcaacccaggaggcctgcccggaggaggctggggctctgggaggggtccaggagacccagaaacgcggttgcggggcggcgacgccccgcgagacccgggatccggggggcgcggccgggacttgcttaccgagcgggcgctggcggagcggggcgcacacgcggcggctgcggcggcggcgcgaggctgggcgggggcgcgccggtgactcagggccgccccgcttaccccgccgccgccacctgcggtcacgtgccgcccggggcggggccggaagctgattcacccctcgacagacagacagacctggggcggacgcactgcccacggtcccctggtgcccgaattccgaaaatatcagaggcctaagcccaagagctcctggaacacccatcccagagagggacagtgttctccctgaggtcacacagcgggtcaacagccttggcacccccctgtgcccccagggtctgttggtgatcctggatcaaccctggctgtgcccagtttcgccggcgtggcgggaagtccgtgcggctgtatagatacccagctgtccagttgtggaaacaggtctagggtactgggctgggagcccccaggcagggatagggcactgactgacccaaactcagggctttcctgagcagatacccagttctcagtcctaagccctgatcccctctgggaggggtccccggactgcttctgcgtggcgggcagcacccgacctgaaccctagggcagggaggggccaagagggccgctgtgggctggggtcaggcccagctctctgctgagcgtcccctggggttgggaccctggttatggggagcgtggagaccacatctgaaggcaggctttgagggtgggacagcaaagcccattaaatctggcccaacaaacagcccccaccccatcgcgtgccgcagccagtctgcccggcaccaggcccagcccttcctcccatcccccatacttgctctggatctggatggggctggtttgggtcccgtaaggatgctgcttccgtaggctggtgacatctctaggccttgtgccctcaaaccccccccctccaaggccttctccaccattcatggcccatcaggactccttgcctctgagtccactgccctgggcaatgactagcctcctaggcccagcatccttgtggtccccatcactgacccctcaagcatgaagtcctacactctgccatatagccccccaagggctttatgctactgaacatagtggcccctggggaacaggcacacatatttgcatcctcctcctgccccagggccagagaggggaggtgatcccagcgggggagccctgccttgagggtcctgaagacccatttatagcccctctgctactgtggatcccctgtaagaccttctctgagccgcctcagcttctccctgtgttcttaccaatgcacagaggctggagagttcaggaagggagtccaaggcctcactcccacctccaccaccccaacacttctgcagttgatgagcaggaaggttgtatgcacccagttttccccagtagcgacgttttgcataactataatacaataatatcacagccagaaaattgacactggtgcaatccacaaagcttatttagatttcaccagttttttgtttgttttgggacagggtcttgctctgtcacctaggctggagtgcagtggtatgtacaatcattgctcaatgcagccttgaactcctgggctcaagcctcagcctcctgagtagctgggaccagagacaccatgcccagctaattttttttcttttttcttttttcttttttttttttttttgtagagacaaggcctcactatgttgctcagactggtctcaaactcctggcctcaagtgattctcccaccttggcctcccgaagttctgggattataggcgtgagccactgcactggccagatttcaccagttttacatgcactcatttatgtgtgttatacaaccttattatgtgtatagatttgtgtaaccaccattacagtcaagatacagaactgttctgtcactacaaagatctccttctctgtagccatccccacacctcccccgaccaccattcctaacttctggcaaccactaatctattctacaattcaacaattttgctgtttcaagaatgctatataaatggaagatatagtatataaacttttgggattggccttttttcccacttagcataattctccagcaagtcatccaggttgtttcatggatcaatggtttgtgcttttcattgctgactagtattccatggtatggatataccacagtttgcttaaccatttcagtgattgaaggatatgtggggtttccagcttttgattattacaaataaccttgttatgagcattcatacacatatgtatataaacatcaggtttcatttctctggcataagtgcccaagagtgttattcctgggtcctggtagttgcatgttcaaacactgccaaactttttccagagtggctgtaccatttcacattctcaccaacaatgtatgagtgatccagtttctccacatccttgccaacatgtggtgttaccgctatttttttttttttttttggccattctgataggtagatcatatcttattgtggcttaaatttgtgctttcctgatggctaatgtcattgaatctcttttcatgggcttatatgccatctgtttgtcttttcctttgaaacatttgttcatgtcttttgcccattttctaaatggattgtctattttttaactcttgagttttaacttttttacttttttgttttattagagataggctcttgctctgttatccaggctgaagtgcagtggcttaatgatagctcactgcaacctcaaattcctggactcaagccgtcctcccacttcagcctcctgagtagctgggactacagatgtgcaccaccatgcctggctaattgttttttatttttagtagaatcatggtcttgctatgttgcccaggcttatactgttgaatttcaaaagttctttatatattctagctacaggacctttgttgggtgtgtgctctgcaaatattttctcccagtcagtagcttgctttttcatcctcttcgaggtgtcttacacagagctaaagttttaaatgttgatgaggtccagtttatcaatttttccttttatgcatcatgcttttggcatcaagtctaagaactattcactttgttgaagtcaaaatgaaaatgtagagatgaatctctatatttaacgttttatttgggaagaaaaattgcaattcagggcatgcacaaagactgggtggtctttgatgtgtctggagaacacaaagaaggttagaggttttcttgaaagcagaaatgttacttagtgctctttgagaaagttccttggcactggtaagggtttggggagctgaagagttctgactggtaagtgatggtggtaagcaaaattagtcctagatctgtagcaagttatctcagcagctatagataaaactggttgcaggttgtaaaagggagtttctttcaccagccaggctcatagggaattgcatttttggaataatgttatgtaccctgggtgctttcccccactgtcctcttaactctattttagttttgtagacaagaatgatccaatgtgtatgatcaacttttacagcctagccttaggtcctaaagattttctcctattattttccccaaaagtttgatagttttttttaacattttacatttaaatctgtgatctattttgagttaatttttgtataaggtgtgaagtttagattgagggtaggtttttggcctatagatgttctcagaattctgagtttttacagaggaggagacagcctcacagattttttttttttttttgatacggggtcttgcactgttgcccaggctggcgtgcagtgtcacgatctcagctcactgcaagctccgcctcctgggttcacaccattctcctgcctcagcctccggagtagctgggactacaggcgcctgccaccacgccctgctaattttttgtagttttaatagagacggggtttcaccgtgttagccaggatggtatcgatctcctgacctcgtgatctgcccgcctcagcctcccaaagtgctgggattacaggcgtgagccaccgtgcctggcattattattattattatttttttttttttttttgagatagcgtcttgctgtgtctcccaggctggagtgcaatggcctgatctcggctcactgcaacctccatctcccaggttcagcgattctcgtgccgtagcctcccaagtagctgggactacaggtgcgtgccactgcaccttgctaatatttgtattttttggtagagacagggcttcaccatcttgcccaggctggtctcaaactcctggcctcaagtgattcatccacctcagcctcccaaagtgctaggattacaggcatgagccaccgttcctggccagtctcagagatcttaataatcactcaagatcttacagcaagggattgggagagctgagtttgttttgttgttgttgttgtttgtttgtttgtttgagacagggtcttgctctgtcacctcaaggctggagtgcagcggtgcaatcacggttcactgcagcctgcacctcccatactcaaacaatcctcccacctcagcctcccgaatagctgagactacaggcacgaaccaccacgctaattttaatgtttttggtagagacatgctttcgccaggctttgttgtttaattgagatggggtctccctatattggtcaggttggtcttgaactcctggcctcaaacaatcctcctgcctcggcctcccaaagtgttgggattacagatgtaagccactctgcctgactgagaactggatttgtactcaggtctgggagcctttctcctgctccctcctgcaatggcagtgtctggactggctcccgagaatgtgccgggcctggttagggagtagagagcaccttgattactcctcaagggactgtgtccagtgacctccttgggagggaatcattcactcagtcaacagacactggcagaagctaccatatggttgcttgtgctaagcactgttgagacccagacttttccctgaggccccatagtcatagtctgggtgggagacaggacagtcagaggtcatagagttattggtgctgtggaggatatagccccaaagcctgaagggctcagatgtccataatgaattgagaggaatgagtataagttccctgggataaatccagggaagggcagaaggtgggaagggtgttccagggagaaggaacagcaaacacagagacctagaggtgtccaggagagcctggggtgccagaagtctgggtgaaattagtcaaggagagggtggccgagcgaggtggccatagcaaggggtgtgggagggccttaattggagcctgtgataccccggcagcggctggagaggcacggagcgggtttgagcagggaagagcgtgggcggattggtgggtttcgaagttccctttgcttgcttgcagggggagtggattaggaggcacagcaaggaggtagtgcagttcgcctaataatcaaacaggactgggcattggccatggggagggaagacaaggggacgaggaggggcaacccctggcttctggtgtgggccttggctggacggggagctgatgcaaaagtggggcccagtggggagctcctaggcctgcagaagccagtaccctggcaaacccatagacccctgccagctccccagttctcactgcccccagctctgcctccccggggctgcttactctggagtcctgggggactgtgtttcaatggtgacaccactgccacggttctcataaagaagttctttcttgctgctcagcacaaacacttggtcaaaccagtgggactcggggcggtttcccatgccgagagcctggaatgggctgaagaaactcacaaagaatctcctgactcgggctttctgaaacatatatggctgcaacgcctcacctgtccctcccaggagggctgggtcctccgagtgccagtcagcctgcctaggttcagagcccatcagcagtggctcatcacctgtcctctgaatcctggaccccagtgtcctcagagttctgccatggggcccccggctctgtcttggatccgactgtgtcccccaggcaagttatgtcctttctggtcctgaaaaactaatgggggtagaggtggtagggtagggcagctggatcaaacagtgcctgaactcctcatggctctttctgggatcccttctcccactcctcctctcctcctgtgcctttcctccctcctccccaccatgcagtcacttattcattcattcaatcagtgttcccagaaagtctcttctgggcccggccctggaccaggcgatacctgggacttggagatgattcaaacccagtgtctgcccttggggagcctccgtcctggtggggaaggtagactatgtaaacaaacaactgtgattcaatctttggccttaggagcccttgggaggaagctgctactgccttgggggttgggagagtcagggaaggcctcagagcacaagccctttgcaatgggccttgaagcaggaggtaaacaagggtgtgggtgggtgttagacggacagtggtgccctgggaggagggactacgtctgcaaaggcatggaggcgtccaagtgctgggtgtgtgtgagaaaatacaagcaggtcagggtggctcgtgcacggtgctgggatgggaggttctgggaccaactgtcaagggcctcgaatgccatagaaaggatacttttttcccccaggatgccatgggctgagaggtgggggtagggaggagggtcctgagaaataagtaataggctgagagctgtgactccaaagtgtggagaggatggacaggaggctggggaggagcatgggattgggcagggtgggccccagacgggagggggaagaagctatgagcctggggggctaatgggaggagccagggaggtgcctgggggatgacaggaacctggcgtccgggaagcctggagctcaaacaggctgggctggagactgggacatgttcaagggtgccagggtaggggacactgccagggtaggggggactgccagggtaggggacactgccccaggccagctggcctgggggaaggggtgtgagacccgcccttccccatgggctgggcatctaagaagggacgtatcagaagggggctttggagggggcagtctacagagggagcaccaagtcacagaagtgtcaatgccagccgcccctgctgctgctgtgttgcaactctgcctgcccctaaccagccactgcagtgctgtcagtcagcttgtttctgaactcccccgtaatcatcatcttctggttagctctgcactctgggccctcctgaaaaccccagaagcaggggccaaagctttctagaaagtcttttatgggaggaaaaagagaatgtgggtcaactctcttcatccctacgtatcactaggccaaagtcagccccacgactgctaacaccagcaaatctcactgagcagagcagtgaggagagccccacacctcagggctatggaggtaggccggggttctgcccccacacagggcaggaggccgagggatgcctggatttagggttcagtcgggatctggcctgagcctgggaaattcgtgagtcctttcattcaacagatgagccgtgtgtaccaccccagccatgggggagatagcacgaggcaaaccccgtcctctcaggactcacctgccacagggaagtggcaagaaccaaataaacatgtccaagtcctcccagggatgacaagggatgagggaaagcgatgtggggcaaggggacagacggagaatggggtgggaaggacagaccggaattcgggaaggaggcagtcctcaggcgaggcctggggcaggcctcaggtgggagcgaggagggacttgtggggaggggccaagggtctggatcacccagggtcttgtagactgttgagaggctgagtggctggagagtcctgggcatcagctcagctctctgcagcaggaaatagcctggcgtaaagcttggaccccagggttggagacaggggtgtggatgggctctgaccccacgtcctaagccaggaagttggagcaggcaggcctcgccagcccctgagctttcaccacagccctgctgcatgagctgcagctgtgtgacagcacactcaagccggctgcccatggacagacgcgacttgttgacttgtcgctgagtgaacacaaagcccagggaacaggttgagggcctggggcagggcccatcctgcaggcctctctcttctctagcctccatttccccctttggggagaatggctggggacgaggggggcaagggaggctcaggccccaggtagactctaatggcggacctcacacagcagagccaacggcaggtgagccccctggccaagaagtaggatcaggaagaagagttatgatggagaacagcagggaaaaggattttcagaggccatgccctccctgtggctcagattgtgaaactgaggcccaaggccaaatggtaacaggtcagaggcattgatggagcaggtctgggccaggctcctgcccccagccctatcttgcccaccccaggtgctcatgtctatgaggagagacaccaagtgtccgtctctcgaacagatgatgtgggctgcgtggtgccgtccgagtgcctgcgggcctgcggggccgaggtcggctgctccaacatcgcctaccccaagctggtcatggaactgatgcccatcggtgaggctgtgtgggtgggggtctgggtggagggcgtggggttggacttggggcccaatgagtatggggactgtggaggctgccactcactggccaagaaatttggggcatgtcacttccctgcttggagcctgggtgtcctcatttgtaaattggagataatggcatctacccacccctcagcgttgttgctgggattaaacataatgacacagggaaaatgctgggtgcaggcttggccatgctgtagttcccaccttgggccttcgcttttctcttctgttctgggcaaggggactcgctaagccctccagggctgacaccgagccattgttgggccacagtccctctctaggtcttgagttccctctctaagaaatggatggaataagctccaagttcatccatctccatgagcaagacaagggagtgggtggagaaatgttttggggaaaactgtgatttgactcactttcctttgggctccatcccaaccagcttctgacaagtgaacagagagcccagagacacctggaagtcacacagccaatcagacacagaaccgaggccagacaacccagccaggcaataaatggctgtgccttccgggcaggggggcctatgtcaggcttatcctaggacagacgggcaagagtttgtagaggtaaaggaggtgcttaaaattgcaggagttcttgtagacagacttgaactcatccccagagaggggaggcgaccagcctgaagccacacagcacagagtgggcagttgagcatccttccaccttccttagggctcctcaccctcaggccctcttgagcccacaactcccagaaggcctttcacagcaatgctacccgcacctcctaggggagccctcactcccactctggaaaaccacagagccaaggagagaggggatccactatgcctgctgggtcctgccatgcacaggaagtggcggaaaattccagagactggggcactgcatgctggggtgaggtgtgcatcttgcccagggtgtggccttcaagcagaggccccgcccaagccttcctcaccaaccccaccgcaccccaaagtcctgccgctggcctgctgtgaatccctgggcaatctcttcacttctctgagcttccatttcctcatctgtcaagcgggttaatcatgctttcctcggacgaaggcatgggtgtgaaagtgctttgtcaacgccaggctctgcagaaaggacaggcctgatcgcagcctcagcattatgagtaattatggtcgggcctagggttgccagcaagcctagggctcaagcagccagctccgaagtccccacggtttgtccttggcctccccagtctcctcattctgggtcttgctcacctcaaacctcctcagcttctctccctccccgccctctgccttggaggagcatgcaaatggcgggcgggcctcaggcattagagcccaggcgggaggggttcccggggctgtctcaaggccggacagggtcacacatcccccgtcccaccccaggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggtacgggggtgggggccagtacgggggtgggggaacactacaagggtgggcgcccgcactgactttgagggatgagccggagtttgccacttagagaaaggtggatgccaggaaggagggaagagaagggccagtgtaccccatccataccacctctcacattgctctcctgtccacctctgtgtgatcacagccctcatctgggatgcatctccacccttgagctggattccttctgcaggggccagccctccctccccaaccatgccacagatctctctatctccccgaaaacctgggcccccattcctcctgatggttcccagctgcgccacagagggcccccgggccagcactcaggactggccacacttgggctgccacgtccctcagcctccatggccctggccctactgagctccagcttgtttcctcccagcccagcttgtcccctcctttttcacctcgatgactcatgctgatctttctggactctgcctgtgtcccctcctccgtgcagtcctccctgagaccctcaaccaaggaatgagcctctctccccttcataccccagggacgcttgccagattcttcccacagcacatgtggccattacaggccaagagacctccccgacacccttctccaaatatctgggcgcttcatgaggaccggggctgtgtctggagaacaggtggtgtttggttacatgaataagttctttagtggcgatttctcagattttggtgtatccatcacccgagtggtatacactgtacccaatgtgtagtcttttatccctcacaccctcccagcgtttcccctgagtcctcaaagtccattgtatcattcttttttttttttttgagacagtctcgttttgtcacccaggctggagtgcagtggtatgatcttggctccctgcgacctccacctcccgggttcaagagattctcgtgtctcagcctcttgagtagctgggattgcaggagcgcaccaccacgcctggctactttttgtatttttagtagagacagggtctcaccatgttggccaggctggtctcgaactcctgacctcaggttattcatccacctcagcgggctgggattacaggtatgagccagtgtgcccagcccatcctatcactcttatgcctttacatcctcagaggttagctcccatgtgcacgtgtctatttgcgccctccctggccctccagtcccaccctcttgttgtcctctgagcagtgtggctcacactctgctgctcgggggtccagccttctggcacaacagagcaccccctggccaggagcccagggcacccatcctgggggtggggtctcctccagagctccaggcagctgtcccagggatgcaaaatagtcaggcttctgttggaagggccctgttgggacacgccagaggcgggtgcgagtgagctcatccacgggctcacaggattctccaaaacaaggagcctcccacctctcactgggcaggacacttccatgtccctgtgtcctgggcacttggccccttgaccacttctccccctctggctcccctgcctctcctcagaagctgtgtggcctggggaagaccctgcccctctctgaccatgtgtctcctctgaggccagaccttgctctaagcccctccatgctccagcatcctgggccctgggaactggatgccctcctgccacccagtgtgtgacactggtagcccctgtacctgcccagtggccctcatgtcccctgcccactacttcctggcctcctcacccagactcccacctgcaaccaaaagtcttgacctggcctcctgctgcgccagctcacccagctgcccgtgcccttgaccctccttcccacctcttctgccaagtcaacccccgcccctagccctgcaagcctggcagtcggcctccctgaggagcaaggcacaaggctgcgtggtgcagggcaggttgctcaccctctctgggccccagttctctcagctgccagctggatagagcagaaagggccccgtgccaggtgtcaggctggccagctcaacttcccgtccctcttacagcactgggataccctcaacacccccagcccctcaaagccgtctcagcttcctcctgcccgaaacaccaccattggagcggtatctcctaggcctcgtggtcatggatctctggtagggtgaatggcctgacaacagtctctgtcagggagaggcgaggcttacagagagaagaccaacagcccagaggcctggagaggaggccatcgcagggccgggtgcagtaccatgccggtgaccctgatggctctgtccagctgagcagaggctggaggagccgtcacaggctgggggagagcgatgacccgcccccactcccgtatgcctgccccaagcccccacacctcagtccactgttccgccactgcccccctgccccactctcccctgtctgtgttcccggctgttcagtccgtaaatggggcccacagcctcctggaaaccctgtgcaggactcggagagatctcagacacccctccttgagatgttccacagtaactgtggctgcagcccagggagatgctggagggcactatccaccctgatggtggcatgggagggagtggcattccaggcagaaggagcagcctctgggtttgggggtcctctggcagccaggtaagaaggctgggtaagaaagcgagggcctggctggagtggccccagccctggcacagagatgcagagtctggtgttgggcgggagagctgtgtgcagagggcggggtgggcaggcgttaatggaggcccgcctgggcctttgatgagggcagcgcccgcctgcctgcctggctaggggttaattagccttaatcaaggtggcacctccttcctccaccctctccctcaggcctagaagggaagaaagggagggaggaaggcggacaggcgctgagaggacccaccctagctgaacacatagcctctgtcacccctgccaccacagccagggttccagcgggtcacccaccacccaccttgggggtgaggaatgccaactgacccaggacacaggggtgaggtgctcagccagggaggagcggatggatgccatgccccagcttcatccccttagctgggtcccatgcccctcaaggctcggggagggggtgcctcctcctgaaagccctcctagattgatgtttcctctgagctgctccagcccagtccgagtgtaggtaagaggctcatctgttttctttgctggactctgagtgctgggcaggcaccaggtcccactcatcgccgagttggggatcctagggtagtgtcctacgcaggtgagcacctcaccagtggtttgttggatgaacaagtgtagcatgtgcctgttgtagaggggctcttggcctaagggagaggcaggcaggagctgacacgcaggggacaggaggggacgggctcatgctggcccagcagggctccggcttcacagctggggagtatgggctctaaccccaacccacacctctggctccaaactttgcatccttagtaagcaggttgccctgtgaaggatgtgcagcacagggctgtcggggtggggatgtgccagccagaggtcccagctcccacaaatgccggccagtgtgaaaaatcctagtgtcttcaaataaccaccaggaagtcagtctggcccagatcggggggcagtggtcattcatgcactcaccaaatgcttagtaagcacctactatatgctgggagacacagcaatgaactaaagagatgaggctcctgctctcctggtgcttccattgggaggggaagacaggcagtaaacaagtagacacccaggtaaatgtgcatgtagtgactgggacaggtgctttgaaggagagacaagagggagctccatggcggagctccaagggctggctccgcagagaccccagggcagggaaggagcagacagcacttagagtcaggagctgcacctgcaggatccagggagccaccaaagggtttggagcagggcaggactggccaggtcactggtggtgtggaccagagtccagggaggaggctggagctggggtagcaggggaaagattagagagcaagtcttagtgaccaggggaggtgggagagagctgaagagcctcccacgacgaccgctgcctgccttccactcgcctgcaggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcaggtgggcgtcggcggtctgctctccctggggacgtgccacaatttgctcttccctgctgcctgtggggggagccttggtcctcctcccgtagccccacatgccctgcctccctcctccccagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccaggtgagccagccctgacccctgaccctgacccctaacaatttcttactctggtcccattctcatccccgacccactctgactcagaattttctagccctggactacctagccccgtccctttttgaactcagctgccatcttgccatccccaacctttgatcctgtctgggtcacccccaccctgccatcccccacccccaaccctatcctcactcatttcttacagattgagaaccttacctggtggaccctggctcaggatgtgcccttgggaactaaagcaggtaagtggatgaccctaggcactcctccaccttgaccctggcctggaggcaagggcaccaggtgtaaccttgtgtccttcatctgtccctctccttctgcaaccccctccaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctga

SEQ ID NO: 1199 - DNA, 33681 bp, Homo sapiens
ttccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtgagtgccaacgtctcccgcccatcccaccttcctgccgtcccagtgggctctggtaggcccaggcggcctgtctgccctccgcgtcatgagtctgggctggggcctcagaaggtgtggctccaggctgggacatgctgctaggggtctttgcggtcccggggggcttgagccctccgtttagaatccgatgaggcccactggctaccgcccgtcctggcctttaggtgcttcgactgagacagtttggagtatgggattccgaagggactcggatgctcctcggtggccctgccatcggtcatggggcgggcattttgggccagtcttgggctgccgggatccggaagcaggcggggtacctgacctcccttggcctgccagtggtgggggccagccatggctgggccagcgtttctggtagagctctggacgctgtcagcagcagagcggtacctagggggtcctgggaagccgtctttatccctagtccctgaggcagggaccctgtgatgatgaaactgctggccctgggagagagagagcagagagtgaggctgagcaagaagggccaaccccgccccagcacaggaccctgctcaggcacacaggagccggcaggcccgggttcgcctcctggctctgccattcaccagggagtgggcctagaccagttggtttagtcactcgatgcctcagttcccctgtctgtaatatgggaataatcctgccctttgtgggtgtagcaaggcagcttcctcccagctcacccccgcagcctcctctattccgacacaggcctgggacgtggttggaaatgggctgaatggggttgttggaggcaatgcaggagtttctgttgagtgcagggggtgactctggccctgccctcaagaccctgtcaccagccctccaggtgacctcagatgagctgcttcctgtctctgggcagaagcagatggtgcccttgctttgcttgtcccaaaggccgtgggcagctccagggagcatgggggtgggaaaaggcctgtgaagcagtgggcacaggccccacaattgtccatgcctctggacccagccccaggggtccaccataggacaaggcagccacagccagcctctgtggaatgaacgatcacagcgctcacacaagcctttcccacgtggcctaccctgggagtaggcccgaccagctccattcataggccagagcactgaggccagagacagagctggatccgaacccagagtggagtgacttttccgtggttcccgactctgctcttcctctcccaagcagcacgggctccatcagtatctgcccagagaccctccctgggttccaacagtaagaacggacctggccgggggcggtggctcaagcctgtaatcccagcactttgggaggctgacatgggcggatcacgaggtcaggagatcgagaccatcctggctaacacagtgaaaccccgtctctactaaaaatacaaaaaattagctgggcacggtggcaggcgcctgtagtcccagctactcgggaggctgaggcaggagaatggcgtgagcccaggaggtggagttgacagtgagcagtgagccgagattgtgccactgcactccagcctgggggacagagcgagactccgtctaaaaaaaaaaaaaaaaagaacagaccccaactaggagctatcagaagctctggaaggctgggcctcagtttccccatctgtaacacgtggtcctcaagcagggcccctcatgctccggcatgctgtgctcacaagctgcccacatccgccatgcctcatgggagggctttccagggaacatgtgggctcacagcaggcgtctgcccagttctcctgggagggctgagggccagccccagtgggcaaggggctggtgaaaggttggccgtggagggcacagtaggcaagtggtaccctgccaggctgagcccctttacacccgccacctcccacctcctcccaatgcagcatgggcttggcatggcacggtcttctctgggtggaacatcagtcaggagattttcccatcaaggccaaacgaatctgcacatgtcctggccttggggtcagggttgggcaggccccactgcacagataaggagcccgaggcccagagaggatcacacagggaggtggaggaggaacactgctgaccccaggtggttcaggacaccaaccagcattggagctgtagcctggcctctgccctacctccccatcctctaccccttgggctgggtctgcctggtggatgcggggcctcggtccagaaacccaggcactagtcctacttgaggttcctggtctctgtgtggctctcactgacactggggacttttaggggcacctagaggtctgactccactttgctctgtggccagggtagccctcaaagatagccacagtctagtcagaagggaggtagcagttctgtgtgttgagaccataggggtgttttgcttttttttaagatggagtcttgctctgttgctcaggctggagtgcagtggcaccatctcggctcactgcaacctccgcctcctgggttcaagtgattctcctgtctcagccacccaggtagctgggactacaggcatgtgccaccacactcggctaatttttgtatttttttttaagttttttttttttttttttttttcccagagacatagtcttgttctgtcacccaggctggagtgcagtggtgtgatctcagctcactgcaacctccgcctcctgggtttgagcaattctcctgcctcagcctcctaagtagttgggattacaagcgtgtaccatcatgcccggctaatttttgtatttttaatagagacggggtttcaccatgttggcaaggctggtctcgaactcctgacctcgtgatccgcccacctaggcctcccaaagtgctgggattacaggcatgagccaccatgcccagccaatttttgtatttttagtagaaatggggtttcaccatgttggccaggctggtcttgaactcctgacctcaagtaatccacccatcttggcctcccaaagtgctgggatacaggcatggaccgttcactatcttctggctcatccatgacaagtaggtggcatttttctaaccagaaacaaaaccagtaacaaagaggcaaagggtccagtggacagagccctggtctgggctcccgtctgggctatgcccctgcccctccctgggccttggtgtccctgtctgtgaaacagggcagtgcacagaccagaaggcctcccagggtcctgccagctctgtcacctgctgatgccgcagctccaggccgggtgccctcccttagtcagtagcagccacctcagtcataacagcaaccacagctttcgtgggcagcgtgctgactccaatggccacaccccaaaactcactcatcatcttccctgagaaagagaactcacattcaccggaggcccttgaggagccagggacaggcttggccggctacactagcagcctcacttaagtcgttgcaacaactctcctcattttgcagatgaggagcccaaggtgaaatggccactcagggagtgagtgccggcttcctcagggaagagcgcctggctgggactagacaccagtgctgggaggtgggggtgagcagtggcctgctgacatctgagttgggggcccagccttgctatctgacagtcaggggtggggaaagcccctgccctattcagggggactggcaggcctcacagctcatggaaactctgagcctcagcttctctacttggggtgacagcacctgtcccagggccagctgacatgagcacagattggaatatagaggcaaatatcccaccaatggcaaaaagacattcagggtcttagggaaatgcttctctcccaagcacctagacagaaccaccgtctaactctctcattgtccagatggggcaactgaggcccaaactgaggcaagggcttctcccaagtcacagcaagctggcagagaagcaggaaggacagcagcttgccctgcgttcggaggctgcagcccgcaggcattcctagcctctgtaattaatgtttccgtgacatccacagcttaggggtaaatgctgggagccgtccgttaaactagcaagcttggaaagtaagttaaaatcacggaggcagccggatgcggtggctcacacctgtaatcccagcactttgggaggccgaggcgggcagatcacctgaagtcgggagttcaagaccagcctgaccaacatggtaaaaccccatctctactaaaaatacaaaaaaaaattagccgggcgtggtggctcatgcctgtaatcccagctacttgggaggctgaggcaggagaatcccttgaaccctggaaggcagaggttgcggtgacccgagattgcgccattgcactccagcctgggcaacaagagtgaaactccatctcaaagaaaaaaaaaatcatagaggcttcctgctcctgagttgcagctggtgacttaaactgtggaaccgcaaaggaaaactagttacgtttcagagtcataggtcgtacaactttgtgaacgtactaaaaaccatgggaacagtgtacactttgggtgaattatatggtctgtgaatatctcaataaagctgtttaaaaagtaactcttttgggctgggcacggtggctcacgcttgtaatcccagcactttgggaggtcgaggcgggcgatcacgaggtcaggagatcaagaccatcctggctaacaaggtgaaacctcgtctctattttaaaaatacaaaaaattagccgggcgtggtggcaggcgcctgttgtcccagctacttgggaggctgaggcaggagaatggcgtgaacccggaggcggagcttgcagtgagccgagatcgcaccactgcactccagcctgggcgacagagcaagactccgactcaaaaaaaaagtaactcttttgaagtagaatcgtaatatcagtgctgggagagatctcagacattatgggtccaaattaccgctccctcctcccattctgcaaatctggaaaggcctggttaggatttgctgaaggctcccagaagggccggtgtcctcagatagcttctagcctccctctgctactgaactgcaagctttcaaaaccccaggtcttaaagcacctgaactctgccagccatgcaaacacagttggcgccagtgtctgctcctggcactataaatgtgccagctgctgtcatgagggtccaggagatgagggtaggggtgtatgtccccataccaccccacccagggtctcctccagccctgacaattgccaggggtggtgggctgggcaggatccacacctcccctattgacaggtcaggggactgagtccctgggaatgagtgtacctcggctctcgctgcttggcctgctgaagtgagctctcctggtgggaccctgacagtattggggctttgagtgtggctgttttgggcaggtcagaggctaatgggacatcatcgtgcctcatgcccattccctgaggcccaccaaggaccaatcctgacacaagtgtccctcaggcttggactcaccccgtctcgcactccacccccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtaggacgggctccgggcactgaacccaggctgcagggcacccagggttctgggaccttgtcctgcaaacgtcaccagaagaagaggcaaaggatagatgtgaactgttccccaacctggggagtggggagagtggtcctcagggccacaatcaaagggattaacatggatgtggcttggcacaaggtctggacaggtatcacttactgctgtgtgacctcaaggctgtaaatgaacgtccctgtgccccgccttttcctcatctgcaaactagggactgtgccacccatctggcaggtgccatcaagatcctctaaccacaggctttggagacctctaggtggggaaacgtgcattttcttaggttgccttttcaggatgctgggaccaagagtccccagcattaatgatggccttccatatggccctggccggttcccacccctgcctgttcatcaagtttccccatctgtaacaagggaattgaagtcatcagagtcagggacatggtagcccagaagacaacagctcgagctcttgggtggctggcagggagggactcgtgacccctggtgtgcagggaccctgacccacctgtgcctccttgtctgtggagcgctgggcctgcatcctcttcaacgcatctgcttcttctcttccccgactctgggcccatggggagccaccctggggtccaacaaaggtccctcgggttatatggggggcactcagctgccggcgcggtggtggggttggcccgttggccacttgctctgagtggcgcctccggagagggactgagtgctctctcacctcgaagtactcctctgacacagaggaagccactgagggccgtcgggggccagggccacggccggagctgcctgagtggctgtcctggtcactgagggttacgtagtcgtcatcatcttcttcttccaccccatccagcccattggggagccccaccccgaggctctcggggtcatcctgggtcacagatagctgccgctggagtggggcgtggcctgggcctgccatcctgggtagcctatggtctgtcccattctggggagcttcctctttggggagctccaggacccagccaatatcactgctgtcccgggctagtacatctgccacagggactgtccggggcttgggcacggggggcaatggctcagggtccccctgggggaggccgttctcagctgggacaccgtcctggggggcactgggctctgggggagggcaaggctctggacggggcctgctgtcctggctctgcttccacagctggtgctgggcgctggcctgggaggtgtcacggatcttgatgcggttcatctggctgggctgggggttccagatgttggggtcgatgatattgatgtagcccaggatgtcgctgccaggctccgggtctggctccacccacgtgggcaggtactcaaacatgttggccctctccaggtgaagcagtcctgggtggatgggtggcagcagctcggggagttcccctggatgctcagccagcgctgggcctttcagccccaggggcttcttggcctcctgcttctcagaggagatcttggcaatctcgtcgacgctcttggccttgacaagtgcgtacttggggttgacgagcttcttggccacagtgcccgcgggcaccagggggaccacagagggcagcacaataggctccggctccggttccttctccatagggatgcccttgaggctcacactgtgtgacatgaggtacagctcctggaactgccggtcaaacatctccaccacctggccagacagcacagagatcacattccggtccgtccgcgcggccgaccacgtgaagctgcaacagagggagggggcgctggtcaggcacatgaccctgcttcctccgcccagcccccgtgcacccatagccgctgggcctcagactgtggccacagggccctgggatcaagaagtgaatgggggcagagagcaggtgcatactgtggggtcagactgagtcggatgtcaagcaagttggttgcaccaagcccattcccacctctgcaaatgacagggcactgtgctcctctcaggctggtacaggattcactaagcagctcaggaaggccctggacactgtggggggttctgcatgtggtggccgctgctgccatgcgtctatgctgccaccaacccccatgtaaccatgggcagcgcccaccccatgccccatgtggtggtgcccacagagctggccccatccctaaggacggctctcagagtgacccccataggcttgcgaaggcacggcctggccacaccccacctccaggccggtgacatctccaagctggaacaacagcgtcctcagacaaagcccttctctgcctgcctccagagacagacaggcgggcagatgtgctccagccctgcgcacacctcagcagccttgggaccaatgaaccggaataaccagggttaggattaagggcagaagccagttgggagccagaggtacctctcgcacaacttccctgaaagctggagagtcacctgtaggagccgcacacagcccggtctccatccacaaacatgaacttctgggccagggcacccttgaacttggttgccgaccgcgtgaagaactcagttcccccgctgctccgcactctgagattctgttttgggaaccaagagacagaattacacgactgcaaccctgaccacacagggcgaggggaggacggcagctgcccagggctcagaggggactctggagtagtcaggaggggaagaaagaggctgtaaggcctggagaaaggggctggtgtgtctgggactgcagggctcagggtaaggagggagctgctgagccgtgaagctacagagcgggcaggcactggtacaaaggggttggcataagatggtctgggctttggccctaaaggtgtctgaagagcagcatcaggcaggaaaaggcttacacagccagccagcttgggaaatgctgccgtgggtggtggatgctatggtggggtcctgagcgggagggtgatgtgcacacgttttagaagtgtctcgtggatggctagggggtgatgcagccagaggagggcaggaagggggcctgccctgcagaatctgtgccttatactccgataagtctgtggccctccagggtgcgtggccctacccggcctctcccctgtgcttctcaacacccctgtctctgctgggctctgctccgaggacaggactcacagcaaacctttctccttccccatggccaggacaccacccagcacccaggccaggtcctgtaaatggtcagagattcaattctgtgccggcttacactgtttggcccaggagcaggccaggaaggccctcagagactgtggccaagggagctgagacccaaggagaagagggctccttgggcatgaggagcacagcgggcccctcaactgcctcagctccaaggccaggtcgtcaccggccttttcctggaccctgaacacataagggccctctgtcccagtgtggagtctctggagctgccaagggcctgtgtgttatgagctccaggtgctgacttccctcccccaggtagcaggacctgctgtgagggaggagcagatggtaaaggctggtgctgggcacggcagaccccaggaaggacagggcgagcctggctggaacccaagtgtcgaggatggccaagggcatcccgaagtagaatcacaggtgtaaaggggacctggggctcatctggcccctgtctagggcagtgtgtaagaaatgctcctgggtgccctgagggtctgactcaggaggcctgaggtcaggcagggaatctcagttttaacacccactccagggattcctgactggtctgcctgcatgcctcctgtgatgggagtctcactccctcccgaggggctctgtgccggcttctggctctcggctatgacgtgttcttagtcaggctgagctgtgacgtactggtctgtcccctcacccactcactggccccagcttattcaccccactcattcacatagtcatcaacccctgccgaggcctccagctgcagagatgcctgtgatgaggatcccacctgggaggtgaaggggaggctgagggggtaaacgaaaacaagctgaatgcccaggatcgcagaggagtagcctgaagtgtgaagggctggccgggaggctcccgggagaggatgacataggtcacagggggaggtggggaagcattccagggaagggactcaaagaccaggcatgagaggcctttgtacaagagcacctcaggggaggaggggtgggtgatggagcctgcagagcgagcaggggcgggctcctggtaaaagaccctgcaccggcttaagagcctgagcttggccctggggccagtagggagccatgggaggatttacagcaagagcgatggggttgggtgtgtatctcaggagcagtgctggcatcaggcagtgggtgtgtgaggtgaatgctatgggagaggaggggagcctgagagagcagagctgcccgccatgccatccagcctcctgccctgccagtcctttccgtgtcccagacccctgtggctggggtggccccaggcaagcaaccacagaggcaggcaggtgtgggccgtgggtgagtccccatctgatgcccacctgtgggataaaccatagccttttcatagggcccagtgcagaaggcagataagcctctgctcccagggccgccctcgccggccccccaccccgcaggctgcaggtttgcacacagccagctcagcaggaagctggccacggcccaggacaattagcgctcgtgactttgtacccaacatggagcacgctcggggttgagaagtcggacaaagatcctggaggtggtacgaggccttccctgtcactgagcccaaccgagcccagctccaccgcctcctgcaggctcctggcccggccacagacccctccttagcctggaaaatcggccgccagcatcaggacccttctggacagtgtctgtccccacccatcccaaaccttgtcctgatgagggctcggaaagtcaccacttccatctcagagtgactcagcctccgtgtgagccgcaggcctcggctgggccgctgactcgctgtgactcgaagcaagtcccgggcccttgctgggccttagtctcccttagcacacagcagggcgggcctccaactcttaggcctgttctacctggggctcagcagcaggtgggggcctgcagcagggccccccacctcttgcctcatggcctgctccccagcttgtgcctggatgggccccaccccacggggcctggcctggatgaggtaacgtctcaagactctgggctcgtgtgcgcagaggtggaggatcccacaaagctgcattgtctctgagctcctgggacacccccggcacaggacagcagatgggtggagggatgccggggctggcccaagaggggtgccctggaaaagtctttggaccctctgggacctcagtttcctcataagtaagagaggacgtcaagggcgagtcagggcaggggaggacggccgggtggtgcttcatctgctctcagcgggtggcaaggcaaggtgggggctccagggctggggcaaactacagcaacctgcccccaatccccccaggcctccaggccacatgtgcttaaaggacatgtgatccaactgtgccaagcccgctggtgcgaggcagagggggctgagcccaggagcccctggagtgggtctagggtctaggcattcctgagctccagtcaaacaggctccaatcctagcaccaaatggacgccaaccaaggcctttctttccacgcctcagttttctcatctatgaaagggtctactcatccttgtgctgcaaggctgctgtgaggactgaatagagccacagtacaggtggggccctcccagggaaggtgtccagctcccagtgggtgccccatgaactggaagtggcgcagtgggctgtgggggaccaacacagaggaccacaaaacatccaggagggatggactgcccagggaggccaggactgtcagccgtactgggtgggtggttggtgggctcaggtagggaaagtgacctgcccactgtctcccagtagccctgggctgggccgggactgaggacagggctctttcatcacccacctcctcagggccctgctggccaaacaccgtctcctttaatttcaccctcacacaaccccgtgaggcatcactatggccatggggcgctcgaggcccagagaggtggaaccacacgcccaggtcccacagcaggtcaacagccagtgagccatgtaggcagcaccaggacagcctgtgctggcaggttagctttggttttggttttataatggaagccagtgattacttcccctgcccatagtgggatggccattcctaggtttattgatagttgagtagttagtgtgaatgagtagaggcccggtagagcagtggggaggtccagagatgcatccttgaccaggtctgagctgggaacagtgaggccaggcctagtgtgaggaatgcaaggaacagagcccaacatagcagcaggagcctggctgcctgaggtgcaggcctccagcagcctctactctcctctacagggcctgtctcgctctctgtggagggtggagaggggtggtcaacactcaccctggacttctccaggctgttgtgaagttggggtggtgggccctttgtgaaccacatttggcccaaagtatgtgacggcatgtaggggcagggccagcctagctccaaggccctggtctgaggggctcctctctcccctaggccaaggctgctcagcctctgcacaactgatacatgtccccttttgtgtgggacctgtccccggcagtgtaggatgtttaacaacatccttggccactcaatgctggtagtacccccaaggtggacagttaacaatgccaaatgtccctcagcagagtgaatcccccccgtttgagaacccctgccttggccgggcgcggtggctcacgcctgtaatccccgcactttgggaggccgaggcgggcggatcacgaggtcagcagatcgagaccatcctggctaacacggtgaaaccccatctctactaaaaatacaaaaaattagccgggcgtggtggcgggcccctgtagtcccagctactggggaggctgaagcaggataatggcacgaacccgggaggcagagcttgcagttcacgccactgcagtccagcctgggcgacagagcaagactccctctcaaaaaaaaaaaaaaaaaaaaaagagaaccctgccttataccctgaatccaccacagacccaggcccaggtagagacagcaagcaacacccaggcatccccggggaacgggggaacctgggcagcggaagggctgggtcgtgcctgtccagcgtgaggcctgagcggcagcgatcctcacttcctcaccgtgtgccttcccatggccatcccagctgatgcttctttgttcatcagaaacgggaaacgggtctggcctttgcccaggggctgctggtatttccagtttggctgcacgaagtcaactggcttttcagatggcccaggcatctcatggctcttgtctgtcctaagctggaagcctcaggcccagcctgtctctggttggcctgggagcatccctccacacccagtatcacccccaaaagcagccaagtcatgcggcctggccctgtgaccctagagggtgtcagtgaaagttctggccctcttcccaaggcctgctccctatttgtcatttggggtggtcattcccatactcccacatggagggccactggggccggccagggcaaccggctgaggtgcttaggaatggctgggagccccacatttggggagacactggtgcacgctgctcccacctcacctggggaccaggagtgggcttggcccaagcaacagggcagcgtttcgagagtgtgttggtgtgggctccaagctcaggaggaaggagccgagtgagggtgaaccacagccagaccctggcgcagagggaaagaaagccgctcagcactcagaccagagctgcgtctcatggcggggctgtgcctgtccctagccaaagccaggatgggaagggagctcgtgaccgaaggcccaccgcacaaacggcctccttcactcttcacagcacccctgacagataaatgaccatgtccccattttgtagacaagacaatggaggcctagaaggattcagtgactctgcccaaggttaccatgcaggtggcacagctggggctcaggactggctcctggtatcacccccaaactggcacctgacaccccaaggtcaaaaggatgaccctaccagaaaacctgtaccctgcctgggcccaaaggagctggggcaggttggtgcagagctgggcaggggtggcagtggctgagggcaggcccagggattatcggcaaaggaagtgctcccgggacaggtctgggcccagctagctcaaggtgagggaggtaggcagggaaggcaggccctcgacagggggtgacacttggctggggctgggctctcagggcctctggccacccgcccagggctgtagaagggcaagctcagaggcgagaatgaggaagccaggtcacactttcccatggaggcgtctagctcctggatatgtcaccctacagactctgccaccttccctggggaagcgaggcggctgagcagggcaggcggggccagggacctgcagtgccagctgccttccagctggtcacagccagtggaagggctgggggtggaacagggcaggcctcatacccaagcccctaccccagcccagggcctgggatttagaatgtgtggttcttgccagtagctgtataactttcctcagcacacacagcactttacaaccaccgtctcctttaatttcaccttcacacaaccccgtgaggcatcactatggccatggggcactcgaggcccagagaggtggaaccacacacccaggacccacagcaggtcagcggccagtgagccgtgtgggcagcaccagggcagcctgtgctggcaggttggctttggttttggttttataatggaagccagtgactacttcccctgcccatagtgggatggccattcctaggtttattgatagttgagtagttggtgtgaatgagtagggtgggagtgctagaagattggttgagccaataaaaaggataagagaaattaatataagggatcaagttcatcctttgatgctctgtgttattatttgtagttgtttattatttgctgcttgagtaccagggatctgcagcctccttgtcagagctgatttgtcactattggcttttaggcgccacccctaaattggtcggaattgctttgggcaaggcatggcctccctcggatctcagtttctccatctgtcttgtgggagcctcatctgaatgacctcaaggccccttcaggcccaggcactccaggccccccacctgccccattgcctccggcttcctggaaactcagaactctgcaagcagcggagcagccagggcttctctgctgagaaggggcctgggtggaaggcgaggcctctggagtggctggccccaggttagggtccctgctccaaaccgacaggcttgctccctgcttgcgtctgcacgctgggggaagtgcaaagcactcgctgggcctggggcaggggtacggtgctggtggggccccactggggtctcttcctgggcatcgggcagggccaggccttctgcagtcaggtttccaaagtggcctttccacactggctctctcaggcatgagctatctgccactggaatcgattcccagcactaattacgcggcggggagtgaggtgggtgtggggcttggggccaacccaccagggagaccacattaaaaatgtcccaagagctagagactcaccacggagtgctcacaaccacttgaaaggactcaaccggaggcgttggggttggagggggtgggcgcgcctgacaaatgctgacaaattacaggcgtggagcccggccccttgttaaccagactggcggtgccccttctcctaggaccacaagcctgaaacctgcagaattttgacctgtcagacactggtgctgagcccaagggtctggagcaggcctctaccccactatctttaacttgctagcagtgacatggggtatgtggctccattccctcatctgcaaaatgggaacaactccctatcccactaggctgttgtgaggattaaattaaccaatgcaaagtgcctgtgacagggcctggcgcacggccaatgcaagagaagtattcgccgtcatcacgcacgctcatctgctctcagggaaatgctctgcacgcagcaggtgccaagcgatggctggcagaaggagggctccagacaccaaatgccagggtgtctgggcagaagagcgttggaccaatgagatcctgtagcccagagaagggaggtgacatgcccaaggacacacagcaaaacagtgctgagaaccacagcccaccctgaccccatcggcagccttctctgatccacttctgttccatggtttcccccaccccaaaggttctttctcctctgctcttgtgccttaaattcacttcaactgtgcagccatcgcagaagccttccctggccccagcctgagggagcttcctctgtctgagccagaatctaaaaccagtaaatggaattctaaggagacagatttgggcttaacccaagaaaggacttcctgggagttgaagctctccagaaaggccacgagctacctgaggaggcagtgagcacactatcaccagaggtatgcaagcaaacagataaccgatgtggcatgggctgctctgaaataacatgatgcagcacttggcatgagctccagcacctggtcagcaagcacctaatcagtgtttattttatctctgccacgttggaggtagtgagtatcctgcccctcagggaattcaagcagtggctatgtgactgcttggcaggaggctctaggattactggactctgagtgcctggcacaggactccgtccagagcaggcaggtactcgaagtgtttgttgacagactgaatgacccctgccctccagccacccaggcaagtgaggagcctgctcaccttgaggtgccccaggtgcatgcaggcccgctcacacatgtgcaggaagtacttgacgttactctcatccacgatgatgtacacggccactttcctcttgaagccggcgtccagcaggtccttgaagatgtccacgtcggtgaacatgtccatgaccacagctatcacctgggagcaagaagagagactagggcctgtcagacagtgcagcagtggggacagggtgccctggcagagcgcacagccctcccatgccaccagcctctcacaggtgcccactctggccctactcctggagcctcaggcccgggaccaggaagtgaggggccaggggcctctcttgccctgaagttctagttgcagtcccagctctgggctcagcccaggggccctgtgttggtgcattcccaggccagggccggctacgctctgccctccttgtaacacctgggaatgctgagatgaacctgatgtgtcaatgaccggaagggcagcagctggcgtggcggctcgctggggcatcccctacattcctgggctggtgtggactttggccagtgtctaaacccagatctcttcctgtcagctgacaacatctgtccccatagcaggtgacctcctgctggacctggctcagggtggggccccagtggtcagggccttcccccagcccagccaagcaccaccaacagggcagggggcctggctgagtgaaggtgcaaggtggaacatgcagaaggacaggatgaggtggtatgggcccggccccagtggggctcagtgactgtcaggcttctctcacacctagtcccctccctgtcccttggcagcaaggggagggagtcaggacagggcctgtgcctgggcacagccgcctacactgctgatgcagacacatgtcccacttttgggcagccccacccctcccaccctccgagcctggcaccaccatccctgtcccaggtctgaggaccacctggagaagaggccagggacctgccctaggccacacagcaagctggggacagagtcaggctacagactaccctgacttgtcagagagcaccccagccttgctgggatgcggagattcagggtggtggaggcggcctggagcctgctggggatgtgtctgcacgccccaaagtgagctcaccaggctggcccctgcaggcccatctgggctcctcctgggcctcaggcccccatcgttcacctggcaccaaagcccaaactccagcagaggggagggctccatacctgccctgcctcaaactcactgtgtgaccctgagcaaaacacctggcttctctggacccagttttctcatcagtatagcatgctccatctctcaggagaatggagcacacctgaataccgcagcacctgcaaagagcccgacggggggctggggcgggggctcggtgatgcccgtttgctgcctttctcccacagtcaccccgcacgttcccatttacagggggtcttgtcagcctgactcctgcagcctctcacaggcaccatggtggtgacagcccagcatgcagccaggtaaactgaggctcaatgaggttgtaaggcttgttggatgtcgcaaagcaagttgggccagggcctggacctacctccgagtcaggtcagggttggtctccagtaccttctcttggacgtttagtctcggagagcctgggagagagtggtccccccagagcggacagcggaggtgtgggaccagctgggactcccagaactccaaggcctagggttctctctgttctctggggagatgactgctccctatctctctgtttctgaagggctgttttggggcagagggagtagctggttgatgcagggtctacgactcgcaggggaggcagatgttggcaccagatggggaagcacttgctgcccccagggctgcccaaggttaaacagggatcttaagagggagctcactccctgacctaggagatgttcaaggaaggccagagactgcttggagcgggggtagatgatagggcagagaagacacgatgcaggcaggtcaccatgaccctggaggcagtggtgttgagacactgggcaggggtgtgtggtggtagcagggtcctccctgcctgggatctcccagacccaaagcctctccagccccagaatctccttagttaagccacttctgagcaggcaaacagcctcacgtgccaccctggaaaggagcctaatgagggcgcagtaggcatgcttctccctggagggcaccaggccctgcctaccgtggcagatggggacttgccctgggcttgggctgggggacgtgccccagcaggacccgcaccatgtgcgccactccccacattgccctcagccaggcagggtgcctgatccagggaccatctgctgtcaggttggatatgttggagcctgcactccaaaatggatccccccacagtcctggctctccccaggcattgggttcagtgcctagggtggtcagagatgggtttgtaacaggcacgagcttatgctggggatggggagggggagcctggtgctcccccaggcaacccccaacagcctggcctgtccatggagccacaaaggtttcttgggggcccttgagtcctgtcatgccctttcccattttatagacaggaaagctgggatcacagtccatgactgaggctagaacccagggccctgtcccacccagagcaccttctgcacaagagactgggcatcagtcctgggcccttgagctgcttgatggtttataaggagcctttacagctgttaccttgttcaggcctcacaagcacaccgggaggcagtggttctttttcccattttgcagataaagaaactgaagcacagaggcattcgccaccttgcctaattctgttgggaggcccagctcacttgtgacaccatgagctcagcaagagcagagcccttgtctgagcccaggacggggcctggtttaaggaaggtcctggggagcttttatcaactgagaacaagaccaactggcttggtctgggaatgactgcaggaatcagggcatctgggaccacagcccctcctgggcccttggcttccccatctgtcaaatgggggtgtgggcctggcttgcccctgtggttctatccagttcacacattgtcagagctggcccaagtcaagaaaagtaccagatgcttcacgtagccccaagcccacacgtcctctcagaggtcctgggcagggcaagggctgtggaaatgagaggggaggctgactccaaagaccagctctacctgctgttatgtcaggggccacactgggcaggaggcgggtggcctgggtcccatcactgagcttgttccgctcctgaggcaggaaccagccatgtccatgtgagcagctggcacaggggcaggcatggcaggcgggcacgtgtgtgtcctgcaccccaggtaccgttgtcaaagccgacgggcagctcccagcccagcagcctggaatctgcgcaggccacacagcccagctcccaagtgaaggagggagcccagtggtccctgtgcatcttactgatggacaggcctctgctgggcggccttgaggcctcgaagatgcagctgcagaacccaggaggcccaatgcccaagacaaccatctgactcctgccagggtgtgggaggatggcccaagatggcagggtgtgggaggatggccatgcctggggggcagaggcaggcaggctgcactggagggaaacaccagcagggatgtgggcactcctccagtgagccaacagcgagcctgcgcctgccccagcccaggcctctccctgggggctcctggtgcccaaacacctccggcatgtctgtccaggggtgtccatatgcacaagccctccagcgccccgcccgatgagcacctcctcccatgctgtaccctccctgcccagtggatccgccggccttctccaccctgccttctgcctgtgtctcgaatcccccacctccctctgtgtccttgggacagggggacatccgcctccatgtgagagatgcagaaactgcagctgggagaggggagggcactggtccaaggtggtgctgcatggggatccccagtgccctgccaggagcacctccaacacctgggcagtgaccggagcagcttgagctgggatgcaggggtgacagcatctcacacaaaggagaaccccacctgtggccactgccccccagcagacacggcctgaagccacgtaacactggctgctggcgttgggggtgggacagggctttaggtcacagaggcagggagcacaggcgtgggcctcctcaatctccctcagccccagccagagccccctgagcaagggtggagcgggcggagtcggtccagcaccggcgcccaagctctaggctgggctttgggtgagccacacctgcgttccaggtctcagtttcttcacctgtcaaaggagaaggtggacaagatgtccaaggcccttcgtctctgatgtccctgccgagggaccccaactcctgttccctgcctggtgccgggcagggcctgtctgggcggctaacacatctcattgcgcccacaggtctgggagaggaagtgctggtggccgccctctccctgcctccccacacagctcctgcctcacaggtgccaacaacagcctgtggctcctgacacccacaacagctgtttcctagccttcctgtgaccacagaaccactcttgaagcagaagtgccctcgcaggacgagtaggtagaacaggtctccacagaggtgcctggggaggaggggtggggcgagacgggctggcctggttccgagcatggtgggaaaccacgggtgcacaggcccagcctctgcagcagcacctcttcaggggggccctaaaccaacgcatcctgacccctctccccgacgcttcctgatccctctccccgacgcgtcctgcctcaagccactgtgtctcctacatgttgttctccttgccacctgcccattttgcatctgctcggacaactaccttttttcaaatcccaactccagtgcagccccagcctcccctgtcgtcactctggcctgtctgggttgagcgtgtatcacttgcgtatttcttctcaggcacagcaatggagtctcccaaggactgagtcgcaagactcgggtaagaggggacagtttccaacctgcacgtgacaagccttacactcacctcaccctcctaggcctcagagatccctagaggcggctcagagagaggagagaggcggccatattctctctcctcactatgctccaggcaggtggaggacagataccctcaagcctgccccagaacctggagccctgaagcagccacagacactgcacacactgcagacaagtccctaggcctctctgggcctcactttcccacctgagaagtgccgggggtggacagagtctctcatcttggggttcgttattctccaggtctgatggcagatgcccagacagtggcagtgtgggctctgcacccgctggctccgatctcagctcctcctgggaagctgcatgaccttgggcaagtaccttcatttcctcatggggataataacaatccccacccacaaggttgttggaaattaaaatgaattcatgcaggtgaagccctagcaggggatccacaaacggcagctgcacggaccctcctcgtcctcccaccaacccaagtcccatcccaccagacccacagctccctctggggtgaacaggccagcagcgtctcactaccctccgggccagctggaaggctgtaagtgacgcatcagggctgctcacaggaatgctgcagactgtcttaaaggttgaggcagtggccatcatgaccttggattcaacttccacttacagccatgatggaataacagagacggaattcaccccctgccttagcaataaaaaacccggataaaatctatgaagccatggacaacaggcttcaatcagcacagcgattcctgagagaagaggaacaaaccagctgagccctaggatcaccccactatttccaggctgcagcacagggaggggcgcccccgtggagtcttgtggtctccctgagttgaggagacagggttcactctgagtgtagcagctaggatttgcaggacggagtgccgcaggggagagagctgcacagagtgaactccagagacctgcagagggtcccctggagtcttcagctgatagccgagcagcacacgaacgtgaggaaactactgaggctgagcagggaaccactggaaaggggaggctgagcagagaaccaccggaaaggggtggctggaacaattgctggtgctcacgcaggaccgggaatagtgtatgtgcccccagccagaacagaaacccctcctaacacacaggtcctgcagggggtgtcctcagaaggatactgcctcagcagttgacaaataagtcctagaccaggcataagcaaacttcctgaagaaccagagtgtagacatgtgaggctttaagggccatatgttctctgtcacaactactcaaatctgctggtgtaacacaaaagcagccaaacaaagtatataaataaatatctatgttctattgtttataaaagctggcaagaggcttcctttggcctggggtccataatttgcaactcctaccctggagtgaagtctgctctggtcctgcctaataaagcttgacaggaagccacaaaagcattaaatcgtttccaagtaacctaactgcatcccagaacaaggctccaaaatatttaaaggagaaaacaaaacaaacaaaaactacaaactaaaatccaacatgcccggtatccaattaaaaattaccagacacacaaagaaacaagaaaacatgatgcacatgagaaaaaaaaatccatcaaaatcaaccaaaaaccgacacagatgttagaactggcagataaagacataaaaacagttataactgtgttccatgtgttcaaaaagttaggtagagatgtggaagcttttttttagccaacaaatcgaaattcaagaggtgaaaatgcaacatttaagacgaaaaatatactaggtggaattaacagattaaacactatagaagagaaaattagtgaacttgaagacatgtaagtagaaactgtccaaaatgacacacagaaagactgaaagaacatgaacacagcatcagcaaactgtgggtcaacttcaagccatccaatatatgtgtaattgcagtctcagaaggtggaagggttgggagtgagcgagagactaaaaaaataaataaataagaaaaaaatggccaaaacacttctaccatttgattaaagactaaatccaaggcaaggtgcagtggctcatgcctataatcccagcactttgggaggcagaggcgggtggatcacttgaggtcagaagttggagaccagcctggccaacatggcaaaaccctgtctctactaaaaatacaaaaattagcagggcatagtggcatgtgcctataatcccagctacttgggaggctgaggcaggagaattgcttgaacccaggaggtggagtttgcagtgagccaagattgcgccactgcactccagcctgggcaacagagtaagactctgtctcaattaaaaaaaaaaaaaaaagactaaatccacaggtctcagaagagacatgaaaaaactataccaacgcacatcataaacaaatcacttaaagtcagtaacaaagagagcgttaaaaacaaccagaagagaaaagacaactgcatgtcaaggaacaaagtaagtggacttctcatcagaatcactgcaagccacaagacaacaggcaatatctttaaagtactaaatggaaaaaaaaaaaaatcaacttagaattttatacccagtaaaaatacatttcaaaacaaaaggcaaactaaagactttttcaaatataaaaaagctgagagaattcattaccagcagacccgcactccctcctccagctgcaaccccctcctccagcagcacggttgggacagacgtggctgcagcacctcagtttttctatcatgacatggtcccactccccctcccctcctcctcccctccagggggctggcagaattagtgacatgccatctgaagaggcccaagaaggttctctgggttaggaagttctcctaggatccctgggtggtgctccctgccacctcctggcaatctccaaaccagtttgcccatataatgtctctgaaagtctgtcaccgagaggactagtttagctaacagtctcatcttgcctcccagggtaaagggagtctgtgtacttggtaacaaatgctgaccccagccagagcaaggataattaggccaaccagctggcacgcatacaggtgtcccttttctggagacagggaggggtggtgatggccactcccattttccagagggggtgtcactgtcccagggccaccctgtcaactagtggcagaggtctcctgttcctaggcttttctcctaatgggggaccctgtgtccattccaacctctgaacccacccacagcctcccagaggccacctcagctcttgaaagaaatacctgaccatcagcactgtctggaaggttaatgcctgggcctccctggctctgccatgccttccctgggtggcccatggcgggtcacttcccactctaagcctcagcttctcttcttggtaacatggggagtgaaactggatgaactctgaggtcccgttccccttgacattcatcagctctgtgaacaccttccccaccctctgactattaaggctgaagcctcattaaggccaattaaaggaagatcaggccttctgagcaccaaatggctgcagtgggttggggtcaagaagcccaggctaatcatgcccagagcgctctgaccaggaggctcagcctagcccagtggcatgaaggcactaccctgagtctcctacctcccccagacggacatcagcttcctggtcatggctcaggaatactgcaaagacaaggggctggcagagcttggggaaaggccatgaggtgaccaaggctgttccctgtggatgaggcaagagggcaagatcctttcccgctggccgcaaggagcttcagaatcctcagagcttccaggcttgcaggcgcaggatccagccaaccagaccatcccatgtgggcagcaaacggcaccagctgagaattttcaaacaggaaaatctcaaaactatagattcaaaagcctttaaaacctcagcttctccagggtccaagagcgacagacattggggccatcaagcatcctaatgccccagaaagcctggcttggaaaggacttgcccaaggtcacaaagcacaccagggcagggctgaggcttctaggccacctggtgcccacatgctctctgctgcgttccagtgagcccctgcttgaacttctcccaggacagggagctcaccacttccaccccagactactcacagagagaagctctcaggacaggagtgaggagtgaaggtggaggaggcgaggggagagatctggcatctaccgatgccagctccatgccagacacagagtgttttacacaccacactttttcccatttaaatctcactgactttatgaggcaggtgttagctgttagcactaccatgacactgaggaggaaggaacagaaggtcagagaggccaagcaactatctccaagcagccactaaagataacaccagagctggggctcatgcctgggtcccagtgatacggaagcctgtcttcccaccaccccacatggcatttaacctggcaaggtactcgagcccaggggtcattcagacccttaaaggggactaggacagcccaaccaggccagggcctgccaggctggggccaacgtgggccagggcacagggtgggaccccatcttcctccccagctgctctcaaggcagagggtagctcagtgcttttggatgctcctgtctatcactgcgtcaagacaaggcctgatccccattttacaagtgaagaaactgaggccgagggtcctgcagcatgcaagtggctaagtgggaccagcactctctgctggcccaggggccaggaccctcagctgcagggagaccctctccagccagggagacccaatccaggtccagccacacctaagacccttggtgtaaccttatgaaggccccagccgactctgagcctcagtttccccagctgtgatatgaacatgacggcaggccctggctcttggggttgtgggaaggaggccagcccagtggctgagcagctgcctgtcccactggagtgcccagacgggcaggcactctctccttagagctccttcctcgaagggctgctcccggctctcctcgaaactcttaattaagggaagggagcctttggagcgcacaggagttaacacctgggattactttatcagatggttccccacccactctctgacctgtggtgggagcctgggccagctgtgcgccccacaaggtgtcaactgggccacctgtggcctctggcagtgtggggagctgtcctggcactgcccagctaaaggatgcaatgagtggccttcctcctggtccccaggccacagagctcaccctgttcttgtgagtccccgtcccagccctcctccagagagcccagtatttagctgccaaggagcctcatgaaaacgcttttactgccaggcacggtggctcatgcctgtaatcccagcactttgggaggcagaggcgggtggatcacaaggtcaggagttcgagacccacctgaccaatacggtgaaaccccgtttctattaaaaatacaaaaattagctgggcgtggtggcgcacacctgtaattccagctactcaggaggctgaggcaggagaatcgcttgaaccctggaggcggaggttgcggtgagcagagatcgtgccactgcactccagcctgggcgacagagcaagactttgtctcaagaagaaaaaaaaaaaaagaaaatgcttttactgtcctgagtcaacaggatccagcagtgaggctctggtgctcccatgcaggggtagggctcagaaggaacagtgccactgcttctccagggaatgggagggtgctcagggcctgcagactgggggtctcggcccagtccctccagatatcagttctgtgacctcaggccagttatttgccatctccgagccccaccaagcctcagtttcctcatctgcacaatggagacaacacctactttccagagttgtggggaggattacacagcatggtaaagtgcccgctcagcacctggcgcggggctggcatttagtaagcacctcattaagctgcttctattctctcagagccaagctgtgggccaggacttcagtgtgtgaaggcgggggcctgacagaaaaaatgtggggtgaatcaggcttcgtgaaacctgggttcgactttatttctctgggtctgttcccaagccctggcctggcatgcagagatcagtgttctggccctggccaccggcgcctcacctgccctcagtttcctcaactgtgaaataaggaaggtgtgatctgtccctgccctggggcctcaccctggggctggtgagggatcctgctaaggcccccctgctgtgtcctgttgaggggggctcagcatctgctggaggagcaaccagctagaacatctacatccagctctggctgaggaagccccaacccagcccagcctcacgccttctcaggctgcagccaagtgaggccggggctcgcccctcccaggcgtgatcttacaagcccgtcctctggtatgtagttggaaccccacagcaggttttttcccagataaatcatggctcctggggctaggggaggggcaggcagttgaccttccatcttggagtaggagcccactagggctggagggaggctggagggcacaagctgctgagagtgagacctgggacccacccgcctcttgtcccaggggagtctaggatcacagggcagcaaggtgtcagggctgaaggggcccctaacagtcttcaatacctgttcccattttacagatgggatgaccggggcttggagaggagctggggcttgttccaggtcccacagtcaggcagaggcagagcacggactcttggctcctggtcctgctgtccactagttccattctagtcatttgggaacaggggggactgacagcagtcctgacaggaacacagccgctcccctaagtgctgcgtcacttccctgccccagggtctgcctgttgtgctgacgacaggtaaggtgagtgaggaggcggaaggctgggctgtcctgactcagccccagcagccccagcctaaagcccccggtgggaaggggccagtgtgcggcaaggcggcccaggcagagggatccccatcctaggcagggggcaggcagagttctccctacacaataccagagtgagaaggggaggtggaagcatgggcacgagaggtgattcatggggagagataaggcagggagcgctcccaggaagcaggcagacaaagcgccccgtcagcatccgtcagtgtccgggccctgcccctgtgagcctgggaagcagctggggcaggacagctggaggactgcagtggcctggatgagctgcccctcccagcccctgcctgtcactctgtcctgccagggccagggcacaagggatagcctagagtttgagggaaacacaggcctggtccccacccctctacccgagaactagctaggtgaccttgggcagcgactaaccagtttctacatctgaaaaatgagacagataacactagctgagattataaagcgcctcgcactcagtcaacacttgctattgttattatccctgcccacacatgccacacaagcctgggccacaggtcccaggacagatgtggcagggaaggaagtgcccagggcagaaagcaggggcttggctcaccacaatgctgtggagtcatgaacaaatccctgtccttctctgtgcctcagtatccttgtctgtcagatgaggagcttagtctctactgcctctgaggcccccactgtgggacccttgaggactccctgaggtctgagagtagggagcagtttcagcagtgagtgccccatcctgagggctggaaaagcagaaagcagggcccacctgtccgaggctggaggacatcactcactatggggccatgtagacagactggcacccaaactggagaccagcttcttcctggctatgtcaccttagacaggtgacagcaatcaccttgtgggaagcaaaggaaggcaatgtcaccttaggtgacactaataaccttgtgggacttttgtgggaagcaaaggaagctccaggtggctcatgggactgtacggagtggctgggtcacagctgtagccagagactcagggaggaacctggggtcagcaggtgaagtcctggccctgggagcccctatctggcccatcgctgggcgggggatctgtctgtctgcagaccctctggctgttcccatctgcctccttcctgtcgctgacaaggaggggaggcacagaggagtgggaaccttggcacagcaggtccccctacccatggcctcagtttccctattttcaagatggaagtggaggctgggtaatgggatcccagcaggctctctgtggggactgggttctctagcctccagccagtcatccccatcaggcacagacatcagcagcacttcctccacaccacagcaggtgtggggcgggtctctcagtctgcaaactatgaaggtcccttcctcctccccctcctcctcctcttcctctaactccttccttacttttgtcacccgatattccatcttcacaatagccaaagatgcagcttttatccacaccacctccatcttatagatcagaaacccgaagcctcaaagctgcccagggtcagtcagtgaattgagagcagccaggccaggggccaggcgcccccacccagctagctgacccaactggtccccttgttgggcagggactccaccttcctggaaactggggccagggccaggggccacctcaccagttcttgacccacgtctggtttctctgcccacgaacttccccaaggccctgtcagttagccaggatggtccccgaagccagcattctggtcttctgcaattggctgccctgctctgggactggaagtataaagggattagacccagctaggaacacctcatcccacaacctgaggcccagacctggcttcagaatccttctcaacacagctcactaggtaagctttatctatcaaattaagatgtgcttggaaacgatgagaaggtacttacgtgcagcaggcattagcacctgctcatggtcacaactgtccagcagtggcctagctgtctctgcaaatggcaagcaccccttctcagaatgtgtgacggtgtgtcagccaagaatggccccccacagctagggcactgcatagcccaacaggggtggagaaggggagggccagagaaggcttgaggtcccttccggtggcaaaattcaggtggacaatgctcaggtggactcactccacttccacagatgaggaccacacctccctcacccaagcatcctggcctggaaagtttccaccattgcaaagctcacaaagaggctcagagagggtgtgcaatctgctcccagttgctcagcacagctaggaaacaggcagtgttgaacaaggacctccaggccagtctcagatggacttggaccatgcctattccctcaccccacaacaaaagctctccccaccagagagctcatggtgtgtgcgcgcctttacagtgaatcagagccactctaagggagagtgagaggaagccctggggttcctcccctccccactccaccctatctcggtgccttcttctggggaaccagaaacaccctccaacaataaagaggccctttgagacggggcagcccactgtcacctgctaggacctgggaaccctaccctgcaaagaaactgcggatccccacgaaggtggggaggaaacctccacccaagaggcagccagggaaaacagcagagatccctagaagcccatgttgggctcccgttttgggctctgagtgagcctgtattgagaggggtccggtggctggttgggccatggctccaggagtccccgcgctgcctcaccttctgtgcctggctgatcatcttccgcaccacctctttgatgtgggcctgcccgtctatggggggctgcatgtagacgctagcccgggtcacgccgcggtaggcgatggtgtcgggccagcccaggtccagctgcgggatggagcggtccgacttctggggccagtactccagggagggcagcggctcggcctcgatggggaccccatccgccccgctggcttcctcgccgtcgccgaccccattgtcctcgggcccctgagaggggcccgtgccccgagggtcctcagagcccgggtcgtacacctcgatggtctccaggatgcgcttgagctccagctccgagaggaagtctcggatgttctcccgcttgagcacctcgtagaaggcgtcccggccgcgggccaccagggcctccagcgccagccgctgctcctcgctgtagaagaactcaggcttggactcgctggagcgccagttcacatggttgtcgtccagacactgcacctgagagaaggccatggcgccgcctgcccgggcactgctgccgggggtgggtgggcaaggtccagctcctagctccggcccagctggggcaccgcgcgctcgggggcctctccgcggcctctgcttctctgcccatgagcaatctgcgggaaagacctgatgagcccggctcggcggggagggcgggccgcgcggggaggggcggcgggggcggggccgggaactcaggtgggcgtgggaaggacggggctggggctggggctgggaagatgaggtgggggcactggactgggatgggaagaaagtaagggatcggaacagcggtgagggagcggtgggccacgtcccagggctcagcgtgcctctacgtgcagggaacccatatcccagatttccggagctgcctgaagtcctcgcaacttctgagggaaactagggcagccggggaacttcccagtagcttcttagagtgggaggcggccccggcacagaggcgccccgcaaaccgagggcttccgggtaagggaggggtcttaaaatttccgggtgccggcaacccaggaggcctgcccggaggaggctggggctctgggaggggtccaggagacccagaaacgcggttgcggggcggcgacgccccgcgagacccgggatccggggggcgcggccgggacttgcttaccgagcgggcgctggcggagcggggcgcacacgcggcggc

SEQ ID NO: 1200 - DNA, 68528 bp, Homo sapiens; identical to SEQ ID NO: 1198

SEQ ID NO: 1201 - DNA, 68528 bp, Homo sapiens; identical to SEQ ID NO: 1198

SEQ ID NO: 1202 - DNA, 68528 bp, Homo sapiens; identical to SEQ ID NO: 1198

SEQ ID NO: 1203 - DNA, 70017 bp, Homo sapiens
cctagtcctgtatgtgaggactattaattgttttttgttgttgttgttgtttgttttgtgagatggagtctccctctgttgcccaggctggactgcaatggcgcagtcttggctcactgcaatctctacctcctgagttcaagcaattctcctgcctcagcctcccaagtagctgggattacaggtgcgtaccaccatgtctggctaatttttgtatttttagtagagacgaggttttgccatgttggccaggctggtctcaaactcctgatctcaggtgatccacccgccttggcctcccaaaggcatgagcctcccaagggcatgagccactgctcctggccgaggggattaatttttacccgcacctcagggttattgagtaacaggctggctgggtttgcaggccagcgtgttcctggtggcagccgctcactcattaacacttctggaagtgctgcatgtctggttaaactgcaaatgctttgcaaagtcacgagtcatgtcactgagcagaggcgtgagactgccggccagccctgctgtgtacactgatagaattagtgagcgagcgtcccactctgatggaatccagatggaactcgtcactgtcactgcggtggagacggtggggccacatctgcactgaatcctactctgcgccttcaatggctgcgtaatggcggatggccatttccttgactaggatgagacattgcctactctgcgtggctgctgtgagcgtgaaatgggatcatgtgcggaacagccacgcatggtccgtgaaatgggatcatgtgcagaacagccacgcatggtccttggtgtgtgacagatattgggtccctctgtggtcccaggcagacattgcccggggtgggggccgaatgcatggtcaagttgaggggcctgggactgtttcacgggtctagaaaaagaaagcagaaacgctggaagcaggactttattgtccgacatggggctgcctctgagcctgggctgtgttggctggacgtgagccataatgcaggtgtccccctcccaagccctgctcagtccactcacagcccgatggccaagggaggacatggctgcccgccacggcagtatcttcagaggtgaggcggttgtccctacgctctatgcttcttatacaaattagatataggtgaagccacccattaagcaacccagcctttctgggactatttgggctgcctccgggtccactaaatgcggttcattttccccaagccccctccgagttcaaggaggctccttcctttcctcctcccacttgcttctcccaggctccctgactcctgcgctctgggatctgcaccccaccatggggtgaggaagctgaactgcatggtgaggcagctgccctgcatgcagccacatcatgggctggagatgccactgtccgcttggtttaatgatcaatgagctccctgccaggaaaccctttctgacctggtttgcccctcagtccctcgggctcatacctagtgcctgcggcaggacagccatggccgccaactccaccagcgacctccacactcccgggacgcagctgagcgtggctgacatcatcgtcatcactgtgtattttgctctgaatgtggccgtgggcatatgggtaaggggacctgtggtggtgttggccaagtgggctctcagggttggtgcttggggtgggaaccggggtccagcatgtccctgtggtgtcagcattggtcccagctggtggcctagtgatccttgtggtcctcctcccagcctggggtagacttgcttggagaccttgaccaagcccgtttctctctttgggtaatggcgtctccatctgcaaagtgaggaggaggaaattctctctaacaggtaactgggcttttgtgctgctgcccagctggagtccttgggtgtggcccatcagcctcctggtcccagtctccatggtgtcagtgactcctgtctgcttgaacaacaggctccccgggattccctggctgcaccccagagctgctggatcagaatccggaggcagggagggccctgggaactgggggtctttattttgaacaagctccctggggatttatgtcctgtggcctagccctagatcataagccggttctttctcccttcataacagtgagaaatgagcagagatctgaccccacacacagattccaggggcagcggggcccctggggacaggctgtttcatgtgcagatggagaaaccgaggctctggccctgcagcaagggaagggctcctctggtctatcgtggaggccttcctgagggaaggtggacacagcctggttcaggtcacctgctccacgcttagcgcctggggatgttgggctccacttcttaagccccagaggtccccagcctggcatccctgagccctgacagtctcctggggagaatgagtaccccttctttttttttttttttttttttaactgagacggagtctagcactgtcacctgggctggagtgcagtggcactatctcggctcactgcaacctccacctcctgggttcaaacaattctgcctcagcctcctgagtagctgggattacaggcgtccactaccacacccaggtaatgttttgtatttttagtagagacagagttttaccgtgttggccaggctagtctcgaactcctgacctcatgatttgcccgcctcggcctcccaaagtgctagaattacaggcgtgagccaccgcgcccggccgagtacccgttcttatcttccataacccctggcctaagcacgaaggcctggcaaacaggagactggtcacgtcccctcagcttcctgggcctcagtgttctgatctgttatatggagacaccacctacctggggtgaggtctgctatcaaggggcccacacaggaccagaccttgctgctgccattggttctacagtggtagcagtggtggtggtggtggcagttgtagcagtggtgattataagagtagcagccgcagtcattaaaattaattatcacaggttggatttcaaaaatctgaaacccaaaatctggaacattttgaacaccaacatgatgctcaaagcaaatgctcattggagcatctcagattttagagttttgggttggggatgttcaactggcaggtattctgtaagtatctccaaatctgaaagagtccgaaatccaaaacttttctggtttcaaatatttcggataacggctcctcaacctgtatgtgattaaatattaactcacaagtagcccagtgctggccatcggcaaagccgagttcaagtctcggctctgctctgtgtacttaagtcacttaatctctgtgggcttcagtttcctcaaacacgcaatgcgggtttctgtgcagcccacatctcagggctgttccaaggagcaagggtccaatggaagtgaaaatctgttgcaaactgtaacgtgctatattcctgtgacagttggtggctagaattcagaggaggaggtgcccacgtggggcagaacagacagtggagggtttctggatgaggggaggtaagggccaggcaagatctgaagagggaaagaggaggggagacaaggctgtcctggctagcacgtctaagaaagatgttctgggcacctgaggccagaccctttgtagcccagtgacttgggccaccagcccttgttgcccatgacccacctctcctagtgagtcagcttgctgtttgcaggctggtgcccctggaagtagggctgtaggagttctgccctgtccctcctagcaggctaggctggcccagctgggagcggctggcaagagagcagtgagcacatccagaaaagatcagaaccagacagggaggatgctggagatgcatcccacagggagaagcagacagagcaagccaggcaggtgcagccctgcaaagatgtttagatggtgggcctgggagagtctggcgggggccggggggaggcctttaaggaagagatgttcctggaggaggggactttgagctgagcctttgcattcattaaagtatctgttaacaagtgactgaaaactgctttcaaatgagctctaagaatataggaaatgtaggccgggcgcagtggctcatgcctgtaatcccagcactttgggaggcctaggcgggtggatcacgaggtcaggagtttgagaccagcctggccagcatggtgaaagcccgtctctacttttgtattattttgtgataatacaaaaattagccaggcgtggtgccaggcgcctgtaatcccagctactcaggaggctgaggcaggagaattgcttgaaaccggaaggcggaggtcgcaatgagctgagatcacgccactgcactccagcatgggcaaaagagtgaaacactgtatcaaaaaaaaaaaaaaaaaaaaaaaaagaattcaggaaatgtaattgtgtccagcaatagaaagggcttcaggtgcagtatgatccagggattcacagcattattaaggatacagctacacctcactttggttctctcagcctccatccatgtgtagctctgtcctaagcccagctcccctcgtgtcctgatgtgaaatgaccagccctgcgattgagcctgagttgaaatccaggctgcaccacttgctagatgggtgtgttttcatctctgagaccatcagtttcctcattggtaacatggcacctgcttcatagagctgttgcgaggactaagaactccacacagatcaagaagttgaagccaactctggcatgggggccttcggggaaccttaaatgggtacatgtggcccccagcaactgccagcagcccccagagccccagatataagaaggcaactggcaatgcccactataggcttgaaagatgagaagggttaggaaaaagcatgggctgtaaacatagatgctttggagttgtgcagtgcacagcgtacacatctggatatggccatcctggccaagactgtgagccttcagactatgctgcctttagtacagcaagatcacggcacacaaagagaaagtggtgggagttggagctggagagaggcaggagccacatcaaaagttctgaactgggtgtggtggtgtccacgtggttcctgctactcaggaagctgagatggggagatcacgtgagcccaggagttcaagacctgcctgggcaacataatgagaccctgtcttaaaaataaaaataaataggccgggcgcggtggctcatgcctgtaatcccagcactttgggaggccgaggtgggcagatcacctgaggtcgggagtccaagaccagcctgaccaacatggaggaaccccatctctactaaaaatacaaaattagccgggcatggtggcacatgcctgtaatcccagctactagggaggctgaggcaggagaatcgcttgaacccgggaggcagaggttgcggtgagccaagatcgtgccattgcactccatcctgggcaacaagagcgaaactctgtctcaaaaataaataaataaataaataaataaataaataaataaataaataacaaatagataaagctttgaatggtgagtacatacaatgaagcctaatcatcctgagtatagggcagggcaattaaagtcaggaagaaagagacctgcatattgatggatatattttgtgatccagccttatgtatgttctgaaaagaaatacaaaatttgtatctaaatacctgtcctgtgtccctcttttcaaattcttctgttttttcttttttctttctgttttttttttttttttttttttctgttttgagacagagtcttgctctgcagcccaggctggagggcagtggcgccatcttggctcactgcagccttgacttcctggtctcaagtgatcctcccacctcagactctagagtagctgggattacaagcatgcaccaccacgcccagctaattttaaaactttttatagagacagagttccactatgttgcccaggctggtcttgaatccctggcttgagtaaccctccttccttggcctcccaaagtgttgggattacaggcatgagccaccacgcctggatgatttaacttaaatttctcccatccaaatagcactaaagacaggcttgaaaaatccatgtactcactgacccttatctcagcatgctacgtgtactaacccactaaagctcataaaaaccctgtgagggttaggaagccaaggcaggcagatcacatgaggtcaggaatttgagaccagcctggccaacatagtgaaaccccctcctactaaaaacacaaaaaattagccaggtgtggtggtgcgcacctgtaatcccagctactcgggaggctgaggcaggagaaccgctcgaacccgggaggtgaaggttgccgtgagccaagatctgtcactgcattccagccagggtgacggagtgagattctgtctcaaaaaacaaaacaaaacaaaattcatgaaggaagaacttcttaggaccacattacagaggaagaaaccaaggcatacgcgttcagtaacttgccccaggtaacacggccaggaagcagggaagacaggattttactctcagacgttccgactccagaatttttattccacttacatggaggacaaaattctatactccccgtaaaccaaaggcatgtgggaatacgtaggtaaggagctgactgcttctgttctttttataaaagttgagataaaatttacataatatacaattcatcattttaaccattttattttattttattttatttatttattttgagacggagccttgctctgtcaccaggctggagtgcagtggcacgatctcggctcactgcaacctccacctcccgggttcaagcaattctgcctcagcctcccgagtagctgggactacaggcgcctgccaccacgcccagctaatttttgtatttttagtagagacagggtttcaccatgttggccaggatggactcgttctcttgacctcgtgatccacccacctcggcctcccaaagtgctgggattacaggcgtgagccaccgcgccagcccattttaaccattttaaagtgtgcaattcatggcatttagtacatttgcaatgctgcgcaaccattacctgtagctagctccaaaacattttcatcctgtccccatcaaagtcaagcaccgttcttcctgcctcccagcccctggcaacaactcatctgctttctgtctctataaatttgcctgttctggacttttcatataaatggaatcatacaattcgtggccttttgtgtctgtctgtgttcatgaagcatcatgttgtcaaggtccatccaagttgggcatgcatcagagcttcattcccaagatatttgttgtttttttccagacaggatttcactctgttgcccaggctgcagtgcagtggcacaatcaccgctcactgcagcatccacctcctgggctcaagagatgctcccacctcagtgtcctaagtagcgggggccacaggtgtgtgccaccaaaccctgcattttttgtagacctggggtctcactatgttgccagtctggtctcaaactgctaggctcaagtgatccgcttacctccgcctcccaatgtgctgggattacaggcatgagctactgcacccaatagaacttcattccttttgaagactgaataatatttctttatataggatataccacattttgtttatttactcatcagtcgacagaaatgtgggttgttttcacttttggctattatgaataatgctgctatgaacattcgtgtacaagtttctgagtggatgtgtgttttcaattcttttggacatatacctaggagtggaacttctgggtcatatggtgattctatgcgtaaccttttgaggagctgccaagccgtttcccattcgacttcccagcagcagtgtgcgggcttccaactcctgtcccttttctcctcttgcagtcctcttgtcgggccagtaggaacacggtgaatggctacttcctggcaggccgggacatgacgtggtggccggtgagtgcaccctgacttctcacacacccccactttgtccgtggggctgtgtctgatctctaggtcacctggcatctgtatctttgagccagtccaattcagtggagcaggccggaggctggcaggaggtccccaagtgaggggcatagggctgagctgctagaaattgtgtaaggggcaggggctatggagtctgaaacttacatccgctccttagctgtgcagctagtcatgggtagaacacacaccctgggctcctcatccgtgaggtggggctaggaccccgcttaggtttgtgaggatgagggagaagctattaggcccaggatggggccggcgcagggagcctgctgctgatgcgtttccctttctctcctccagattggagcctccctcttcgccagcagcgagggctctggcctcttcattggactggcgggctcaggcgcggcaggaggtctggccgtggcaggcttcgagtggaatgtgagtcctggaggactggcggcctgtgggagggccagggcacaggatgtggtcgcagcactggagggggacagctcccagtggctggtgtcagccgatgtccaggtgggctctgtgcagtgctgttcctgggccaaatcgtgtcttcagaataccaaggtgctggatggcacgactggcagggagctgtgggccttgcccagacctagagaggggaaggagccacccaggatctcatggcaagtcaggaggggctgggggaagccaggcctccggatggctcatcccagccatgtctgctttgtctctggagcagagctgtgggagctgcacctgcagtcctcacctgtctctgtccccataggccacgtacgtgctgctggcactggcatgggtgttcgtgcccatctacatctcctcagaggtgagtctactcatggggcctccagctggggggctgggccttggtccaagttggtggtagtaatgggcaggaccaccgtggcctcacatcaggagttggtaaactcttagggctgggtttgctattagcccgactaatatttctatcaacctgctaaggtggatcccgactaatatttctatcaacctgctaaggtggatcccctcagacctcagcctgggtgccgtgttggctggtttccactgccctgagtgctgcatctcaggaataatgtcccatccagctgggcacataggctgtacaactgggccatgcacctggtttgcacacctggcccacacacctgggtagcatacctgggctgtacccctgggctgcgtacctgaatggcacacctgggccgcacaattggctgcaccatcgtcgactctgcccactccttcagccccagccatgcagccactaagtccagtcaactccacttcctggatgtctctcagcctgtccccagctctgcccctcacagccacctccctcatccagcctcatcatagtgcacctggatttgtcataacagcctctaaacttgtccctctgtcccagccacggcccctccaatccattcctcgtctcagccctaaagagccagtctagggatctcagcctgccactcccctgcctgacaccctcggggcgcagccggagcagcccgggattccaggccgggtgctggggctgtaaggggtcagtgcctgggccttgcccttgagaggctcgcagctgctttgtggcggggggagaggcagagtgattgagacaggccctgcctggagccctgggcatcatctggaggatgcttagcccctacccatgtgccttcccagatcgtcaccttacctgagtacattcagaagcgctacgggggccagcggatccgcatgtacctgtctgtcctgtccctgctactgtctgtcttcaccaagatatcggtgagctgcccccggctccctgctggcatagcctggaaacatcgccaatctgtgggcccctcaagaggacctgacatcttctcattcatctctgccttgtttaacagctgggcaaattgaggcccagagaggggcaatgacttgcccagggtcacgcagcgagtctggacaggtagtccagggcccccggggtgtaggctcagcagccagccctagtcagggacagaacacaacctggtgacctctgctttgcctcaggttctagacacagggtgttaggacggttctcggtctgaggtcagttctggggccggcaccggggtgagccacgatctcccactagggggcgccaaaagcccacgtggtcttagccacatctggtctgcactgagctgacctgcctctcaccccaaggctggtgggctccatcactgacacccatccttgggggcctggccctgcccccacgggcatattaagagcaggagcacacctcgaatgtcagggtcaggagaagcatagagctcatcttgtccaagcccctgactttacagagagggaaactaaggcccagagaagggaaagagcttgtcctaaccctcccggtgacctcatggcaacactaggccttctgctctcactccaagtccctgggggcagctagcttcatccagccccaggcttctgaaggggcttgagtcctggggctgcctgattctggctgagagagctgacactagcccctgcgacctccgagcctccctgtgcctggggctcctcccttgtaaggaggggcggcagaccttgtctcctagggctcctgtgagttggtggtagcaatgggcaggaccaccgtgtgagggctgctgtgtctgcgggaagtgctctgtgaggcccagctttccctcagaggcaaatggcctcctgggccctcttcattcagtcctgggactaggaaagcccagaagaggcgtcgatttagtgaagggaatggaggtgcagaggccggagaggtagaggcctcgctggtcagccaggagctgtgggcagggctacctgggaagagggccctaaagggtccatccagagcccccacggggccccggtgggggtctcatgcagcatctgacccgccctctcctctcctggggcatcccctcggcagcctcagcctggcctctatctgcactggtgttgctaggtgactctgaggggattcccagagtgtctcatccttcgtgtgggcaggtctcaggagtggccagcagcaaaccccgtaccgcagtcttcgccagatgcccttggcgtactgtaggaggtttgctttctctgggagccctttagagtccggagggacttggccttggcctgcccttaaggctgagtttagagctttccactcatactcttccttcctctcccacatttcttgatctccaccccacccccatgccagccacccccatgccagccacctccctggaaaccagggatacagaaataaacaagacctggccctggtctgccaggggctcgcactgtggtgagaaatagatggatgcatgggacaggcatgaaactcagaagaggacacagcggggcttgctgggggtggcatttgagttgggctctgatggagacagggatactgatgggggatgggagcaaatgacaaagagagaggtgggaagaggcaggatgtgtctgggggtggtcggggctggaggcttagactctaggagtcactaagtcagacacttctggggccagataaagaacagcgtggagagaagctgggagtgagtaataggcagtggtggggacaaaggcaaaccagagaacgtgccccaggattgacacacaacaggcccgtgtgccacatttgcctctcggctgccagttttcagggtctggcctgcagtgagagatgaggcaagggaggtctgattgtaagaggttgaagtgcccaaggtgcccaggtggagcgggggtggtgtttaggagccggggtggtgtttaagtgggagagtgacatggtcgtgtttgtactttgtgctctctggaatcttccagagggtggactggaggtgagagagacaagaggaggccaggcttgtgaggaggccccaggtaggtctggtgagggagggagactgagccatgggcacagggttctctgccccctgtttcaccctgctggcttctctgcagtagagcttatacctcacactcggagagtcctgaaagtggatggcttgggcggaacttctagaaaggcagagggggccggcgtggtggctcacgcctataatcctagcaatttgggaggctgaggcaggcggattgcctgagctcaggagttcaaaaccagcctaggcaacacggtgaaactccatctctactaaaatacaaaaaaattagccaaatgtggtggcatgcgcctgtagctactcaggaggctgaggcaggagaattacttgaactggggagatggaggttacagtgagctgactctccaaaaataaaaagaacaaaaggcagagggaagagttcagtgaagtgggaggaccttagaaacaatcttgtccagctctccgagtttacagatgacacactgaggtccaggtcacagcgagtcaggcagggactactgttagaacccaggtctgtgcctcccaccacaagaggcccaacctcagccctgctgccctgaagcagccaggacgtggcctttcaaactccactttgtgatgggggtgattcagtttacccaactataaaacagggagcacccactcacatcaaggctgggcttcagaaccaacgctggggctgcctggatgaagcagagggcgaagcttgaggaatgctaattgctgggcttggctgcgagaggactggggctaccctggctgtttgaagtgcacgcgcccaggcggtccccagaggccctgacctcactgggctgtgccccgggaatgcctcacatgtctgcgcatccagcacccgtcccagccactgcccgtgtggacagagatcttagggtgcctgctgccatccctcaggcaggggcactggcccacaggaggaccggcgatggcagggcctggagaatcaccaccctgaccctcagacgaatgggcccaagcccagctccatcattgtggggctctagccagtcatttaacctctggaactgggcacgatgccccatgccacttgcagtaaaggtcctccacgggggtcgctttgcgccctcactgacctcacccctccctcgccctgttgcccccacccgctccagccacactggcctctgcgcttccatgaacacaccaggcatggtcctgcctcagggcctttgcatttgctgtggcctctgcctggaaccttctgcctggatatccacgtggctccctcatgtccctcaagcctttccactctctccatcttcacccccatccccgcaggccagcccccttcctctctctacccccatggactcggaacgcctgctggctgtgtgctccgttggttcccttgctcactggccgcatccccagggctgcccacatgcctcgtgggtctaggtgagagaatctatgccaggggtcagctcgttttttctgcgaaaggcctgagagtaaatattttcagcttcacaggccacccagtctctgtcctcactcctcaactctgcccctggggcccgaaagtgcctgcagacaataccataaggcatgactgggcctggcctgtgggttctgggctgccactccctgccctatggaaatcacctacttactgtgcacctactgtgtgccaggccctgggtgagccccccacacccatagatgctttctagacagggggtaaggaaacagaccaaggaaatcataagaaatggtaaaagtgtgacaaaagaagcaaacacggtgaaggggggacagaaatggggagacaggagcagggagtgggctcactggagacagggcagtctggggtggaaatgccagccttgcagccacagggcaagagcttggcaagtccaggagtgggaagctcatggggctgggggtgtctagggatatggaggggcagcaatgaccaagagcggagaggcagtggggaccacgcagagcctctgggcagggcctctgccgggcgggggtgcaccttattcctggaatggtagaaatgcagaacctgaccgggtgcagtggctcacacctgtaatcccagcaatttgggaggccgaggcgggtggatcacctgaggtcaggagttcgagaccagcctggccaacatggttaaaccctgtttctactaaaaatacaaaaaattagccaggcgtggtgacacacacctgtaatcccagctactcggaaggctgaggcaggaaaatcgcttgaacccaggaggcagaggtttttttaaaaaaaaaaaaaaagaggaaatgcagagccccagatcttccttgcacaagccaaatgcaggagggaccagtgaggggcttgcaaggggatcgggcccagggtgggggcagcagaggttttggggagtgggtgtgtgttttggagacggaatccatagcagtggccggtgggtcagaggcggggagtgtggcaaaggggagccccggaggacggtgatggcctccatggaaatgggcaaggctcaggggcagaggacaccaaaaagatttgggagaaatcacagtcaactcctagtgtcagtgcagagcccacccagcttctctgctgtcccacgaaggatgggagatataagttccatgtgggaaggtggctgagagcgggcagggcaagggcccaggccgggcagccagagtaccagggccggttcccagcctccttcagcctcagacacgccctggagtgaatggtttccatcggctgggagatggagtgaggctccttcatatacgtggggagcttgggggtctaagctgtgcagagcccgccagatcagtcccacgctgcaccacagggcccacacgtcctctctcagccttgctccctccctgtgtactgggctcccgcccttgcaagcccccagtggtggctacatggtgccaggagaggagtggcttgctgccaacagtgtgtgctctctgggaggtcccctgccatgagtttcctccccaggacctcacaggccccagggtcagccagcaggaagggcacgtccttggggcccacctcttaggacggtgggactttgacaaagtcatttcacttctccatgcccaggtgccccccactgtggagtggagtggattaccacacccacctggtaggatgctatgagcagcactgggggagacctgaaagacatcagggcgccgtgtggcacacacgcacatttgtcacctgtcaaaagtggcaagtcagcagggagtcctggaggacaaccagggccgtgaagcactggcagggtttctgggtacaagatgaagggaggaatcgtgggggtcctgcatggggaggaaggagcagggtagtggaaaggacagtttgtgcagggtgaatgtggggccacatcacaggagcaggcaggcacctctggacagcagcctggatcaggctgctgagctgggggtggaccagttgctccggccccatgggtggcagcctggagtgaggtcctggttcagcctgtgccctgggagtggcccttcctcggggatgctgttccctggtgcagtcttgttgattttgttcccagagttttgcctccatgggcaagttcctctgcaatttgggccttgacctccccatctgtgccttctaggagttggaatagactctgggccgggtgcggtggctcacgcctgtaatcccaacactttgggaggccgaggtgggtggatcacctgaggtcaggagtttgagaccagcctggccaacatggtgaaaccatgtacaaaattagccgggcttgatggcacacacctgtaatcccagctactcaggaggctgaggcaggagaatcacttgaacccgggaggtggaagttgcagtgagccgagatcgcaccactgcactccagcctgggtgacagagcaagactccgtctcaaaaaaaaaaaaaaaaacaacactctgcggttgctcctgggtcactggggagggaggcacagaggagagctggctatctcagacagtcccacggagcatcccgtgccagggtgagggggtagaggggctgcagggtgccggcagggtggaggggctgggtggctggctttgtgtgctccacacccacttccccatggcacagatcaggggcactgaggttcaggggatgaagtggcctgctcaaagccatgtggctgggacatggcagaccaggggcacagagccagggctgtgtggctcttggcatctgtcaggctgaagctgccccggcccacagaggagtgctcgggctgcaggaagggtcggatagggctaagtgatgtctgaattcctcacccgggggctgctcgggagttgcaggcaaccgcacacctactgggcctctagcaacagcagcaaacgttcactggatgccatgtagtgtccagtctataggggagacagcagtgaaaggcccaccccacacccttgctcctgccgttcctgcacctgcgggacttctattcagtctttggggcctgccaccgtggaaggaagggcaggaaggagggaggcaggagggagggcgaatgaacaatgtactcgaggagcagaggggctggcacggctgtgttttgaaacatgagaagcagaggctgggatgttccagggcagagggaatctggtgagccggtgagcaaagactcagaggcagctaagtgctgggcatgggatgaagggccatgtgtctggcgtggccagagccaaagaccgggcacacagacccaggttctgtccagagacagccagggtccagcaggagtctggagcagtgactgtaggacagaagcttgcaggctgcctgtggtgggccttctagaagcctcctgctccctctcggccttccctctcctggtaactccaatctctgatacctaccaggggctgactttggggaagtcctttcccttcctggggcctcagtttatcctctagtctgatggggcaggacttgaagagtccatcctgctctgatattcagcacctctgcgcttctctacttgggctggaggcagatcccgcccccaccccccaccacaccttcccctgaactacctgcccttcctatacacacacacacacagccaaagataaggaccagagccggggttctcctgaaagcccctggctagtttccaaactggctggtctctctaagacaggttgagagaggcgcctggagggagaggtacaggaagcacaggctttggagccagatcccatcctgcctgggccctgtgtcagaccccaggaggcagggatccctgcctgggggagctcaaaggggcctggggcctgcacttcctgggcctcgtgcagatgtgtccccacactaggaagcacagggccccagccttctcaggaagctcctggcccctgaggctgtgtgttgggtcatctcgcatctcctgagtcaaagcagaatggtaggtttaggaactcaggggtggggcaaggtgaagcctgttactagcccatgtcccagagaacagggtcctgcccttcctctcactgggcccctactgccaggtggagggtgggattctggtctttgaggcccatgccaggcagaggttggcctccaggctagcgctcctgcctttaggaggagcagccacaggttctgggagggcaggggctgtgtccagtcagtgtggagaccagcttcagcctgagacccagcctctgagccactattggcttcagttccaaacccactggggggtgggggcaggaagcaaggctgcccctctgtttcctggtccgcccagcacacacttttcctgaggcctactggtccgcccagcacacacttttcctgaggcctactggtcttcacagactcctcacaaactcatcaaggtgcccctgggaaccgaggggacagggctctgccttttatcccctcgggaaggggccagattcaataacaacactgcttttgggaaaggcattggccactttggactttattagcaacagtaatgtcccctgacatccgcacaagcttgtagctccacggccaggtcttcccccaacctcacaatggccccgtgatgcaggcaggcaggcgagtgggggtctcccctccttatccacaggccaccgaggcccagagagggccttgcccgaggtcacccagggagtggcttgctggagccctgggaataacagtcccacacaaggctctctccctccgcagctggacctgtacgcgggggctctgtttgtgcacatctgcctgggctggaacttctacctctccaccatcctcacgctcggcatcacagccctgtacaccatcgcaggtatggtgcctgcagcagggaggtccacccaggggacgtgtaaaggggtcagaaggccacctccccctacaggcccgagggagcagcccaggaagtggccccagcaggagccccagaagttcctccccgtgtccctcctccctggggccagggccccctccagcaaccttgcttccactggcagggggcctggctgctgtaatctacacggacgccctgcagacgctcatcatggtggtgggggctgtcatcctgacaatcaaaggtgaggacagagtctgtggccatggcggggctgtccccacagcgagccctttggagtctggcactgcccggcactgtgcaggattcatgccgttggggttctgggtagcatcgctgggagtgggtgggttcaggaggttgagccactaggcagtcagcccccctgctggcccctcagggactgccctggctggtagaggctacccaccctgctgccccgctgttaccagctctggccctggcaaggagctgactcaggaactcagggccagccacacccgcattggctcagcgcttgatggtgaggtggggctgtaggcgggtgtgaaggcacacaaccaggaggccataaaactgcctgggcagctcctccaattgtttaaaagcatgtacaaaatgccaagaggtgatgctacctcctgcaggacaaaggccagggaggaaagaagagagctgggagagattggcgatactagtctggaacagataggaaactcacagggctgcccggagagagcgtgagctcaccgtccctggaagtatgtaagcagagccaggaggatccctcagagagtgaacaaatctctaaagactcttccagactcagacactgggaccctgtggctgagcagtttctaacccttgaatggcacttgttcatttgctctgagcctcacacaaaccctcggtctgaatacagagcctgacctgagctccatgggaacagtgatgctggggagaccagcatccaggcagcaggctgcctcttccatgtcccacttggaaaaggctagggagtagggcctggggtggaaacgggttttcctacatccaggcttctccctctcagaccaggggctctagtgtccctgggacccaccgcatgagagggatcccagcagccaggcccagtctggaagggaggggagtgacacagacacagatgggccagggcttggccatgccgggccctgaccccgaggtagacaggaacagtgaggtgttttggactggagaggaaaaagccccggcttgagcccgccagatggtctatatggtcttggtggaggccccatccctctctggacctgtctccctcttctctgtgcctcagggggtggggccacatcaccaccagccactctcagctctgctaaaatcacacccttcaggtgatcaggatgaacactttagaagcctcaggaaggtcctcaaatgtcaagaaaaattacttttgcttccttgaatcgacaatcggaaacctggctgagaaccacttgcccaaggccgatgagtgtccagaggccaacagtgactcctgctgggccagcgggacactggggtgcccatgtgcaaaatgcttacttaatagtattattttaaatacgaataaaatagtcattcaaatacaccttaaaaaaaaaaacaaccctctaccctcacacctttccaaacactgggaaagatgaggtggaaaaaactcaagtttgatgcatcaggaagtttcttgtgagatgaaggcaggggggagcccagggagtcagggccccgcaaccaccaaactgtccctgttccaccctgacccctccagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtgagtgccaacgtctcccgcccatcccaccttcctgccgtcccagtgggctctggtaggcccaggcggcctgtctgccctccgcgtcatgagtctgggctggggcctcagaaggtgtggctccaggctgggacatgctgctaggggtctttgcggtcccggggggcttgagccctccgtttagaatccgatgaggcccactggctaccgcccgtcctggcctttaggtgcttcgactgagacagtttggagtatgggattccgaagggactcggatgctcctcggtggccctgccatcggtcatggggcgggcattttgggccagtcttgggctgccgggatccggaagcaggcggggtacctgacctcccttggcctgccagtggtgggggccagccatggctgggccagcgtttctggtagagctctggacgctgtcagcagcagagcggtacctagggggtcctgggaagccgtctttatccctagtccctgaggcagggaccctgtgatgatgaaactgctggccctgggagagagagagcagagagtgaggctgagcaagaagggccaaccccgccccagcacaggaccctgctcaggcacacaggagccggcaggcccgggttcgcctcctggctctgccattcaccagggagtgggcctagaccagttggtttagtcactcgatgcctcagttcccctgtctgtaatatgggaataatcctgccctttgtgggtgtagcaaggcagcttcctcccagctcacccccgcagcctcctctattccgacacaggcctgggacgtggttggaaatgggctgaatggggttgttggaggcaatgcaggagtttctgttgagtgcagggggtgactctggccctgccctcaagaccctgtcaccagccctccaggtgacctcagatgagctgcttcctgtctctgggcagaagcagatggtgcccttgctttgcttgtcccaaaggccgtgggcagctccagggagcatgggggtgggaaaaggcctgtgaagcagtgggcacaggccccacaattgtccatgcctctggacccagccccaggggtccaccataggacaaggcagccacagccagcctctgtggaatgaacgatcacagcgctcacacaagcctttcccacgtggcctaccctgggagtaggcccgaccagctccattcataggccagagcactgaggccagagacagagctggatccgaacccagagtggagtgacttttccgtggttcccgactctgctcttcctctcccaagcagcacgggctccatcagtatctgcccagagaccctccctgggttccaacagtaagaacggacctggccgggggcggtggctcaagcctgtaatcccagcactttgggaggctgacatgggcggatcacgaggtcaggagatcgagaccatcctggctaacacagtgaaaccccgtctctactaaaaatacaaaaaattagctgggcacggtggcaggcgcctgtagtcccagctactcgggaggctgaggcaggagaatggcgtgagcccaggaggtggagttgacagtgagcagtgagccgagattgtgccactgcactccagcctgggggacagagcgagactccgtctaaaaaaaaaaaaaaaaagaacagaccccaactaggagctatcagaagctctggaaggctgggcctcagtttccccatctgtaacacgtggtcctcaagcagggcccctcatgctccggcatgctgtgctcacaagctgcccacatccgccatgcctcatgggagggctttccagggaacatgtgggctcacagcaggcgtctgcccagttctcctgggagggctgagggccagccccagtgggcaaggggctggtgaaaggttggccgtggagggcacagtaggcaagtggtaccctgccaggctgagcccctttacacccgccacctcccacctcctcccaatgcagcatgggcttggcatggcacggtcttctctgggtggaacatcagtcaggagattttcccatcaaggccaaacgaatctgcacatgtcctggccttggggtcagggttgggcaggccccactgcacagataaggagcccgaggcccagagaggatcacacagggaggtggaggaggaacactgctgaccccaggtggttcaggacaccaaccagcattggagctgtagcctggcctctgccctacctccccatcctctaccccttgggctgggtctgcctggtggatgcggggcctcggtccagaaacccaggcactagtcctacttgaggttcctggtctctgtgtggctctcactgacactggggacttttaggggcacctagaggtctgactccactttgctctgtggccagggtagccctcaaagatagccacagtctagtcagaagggaggtagcagttctgtgtgttgagaccataggggtgttttgcttttttttaagatggagtcttgctctgttgctcaggctggagtgcagtggcaccatctcggctcactgcaacctccgcctcctgggttcaagtgattctcctgtctcagccacccaggtagctgggactacaggcatgtgccaccacactcggctaatttttgtatttttttttaagttttttttttttttttttttttcccagagacatagtcttgttctgtcacccaggctggagtgcagtggtgtgatctcagctcactgcaacctccgcctcctgggtttgagcaattctcctgcctcagcctcctaagtagttgggattacaagcgtgtaccatcatgcccggctaatttttgtatttttaatagagacggggtttcaccatgttggcaaggctggtctcgaactcctgacctcgtgatccgcccacctaggcctcccaaagtgctgggattacaggcatgagccaccatgcccagccaatttttgtatttttagtagaaatggggtttcaccatgttggccaggctggtcttgaactcctgacctcaagtaatccacccatcttggcctcccaaagtgctgggatacaggcatggaccgttcactatcttctggctcatccatgacaagtaggtggcatttttctaaccagaaacaaaaccagtaacaaagaggcaaagggtccagtggacagagccctggtctgggctcccgtctgggctatgcccctgcccctccctgggccttggtgtccctgtctgtgaaacagggcagtgcacagaccagaaggcctcccagggtcctgccagctctgtcacctgctgatgccgcagctccaggccgggtgccctcccttagtcagtagcagccacctcagtcataacagcaaccacagctttcgtgggcagcgtgctgactccaatggccacaccccaaaactcactcatcatcttccctgagaaagagaactcacattcaccggaggcccttgaggagccagggacaggcttggccggctacactagcagcctcacttaagtcgttgcaacaactctcctcattttgcagatgaggagcccaaggtgaaatggccactcagggagtgagtgccggcttcctcagggaagagcgcctggctgggactagacaccagtgctgggaggtgggggtgagcagtggcctgctgacatctgagttgggggcccagccttgctatctgacagtcaggggtggggaaagcccctgccctattcagggggactggcaggcctcacagctcatggaaactctgagcctcagcttctctacttggggtgacagcacctgtcccagggccagctgacatgagcacagattggaatatagaggcaaatatcccaccaatggcaaaaagacattcagggtcttagggaaatgcttctctcccaagcacctagacagaaccaccgtctaactctctcattgtccagatggggcaactgaggcccaaactgaggcaagggcttctcccaagtcacagcaagctggcagagaagcaggaaggacagcagcttgccctgcgttcggaggctgcagcccgcaggcattcctagcctctgtaattaatgtttccgtgacatccacagcttaggggtaaatgctgggagccgtccgttaaactagcaagcttggaaagtaagttaaaatcacggaggcagccggatgcggtggctcacacctgtaatcccagcactttgggaggccgaggcgggcagatcacctgaagtcgggagttcaagaccagcctgaccaacatggtaaaaccccatctctactaaaaatacaaaaaaaaattagccgggcgtggtggctcatgcctgtaatcccagctacttgggaggctgaggcaggagaatcccttgaaccctggaaggcagaggttgcggtgacccgagattgcgccattgcactccagcctgggcaacaagagtgaaactccatctcaaagaaaaaaaaaatcatagaggcttcctgctcctgagttgcagctggtgacttaaactgtggaaccgcaaaggaaaactagttacgtttcagagtcataggtcgtacaactttgtgaacgtactaaaaaccatgggaacagtgtacactttgggtgaattatatggtctgtgaatatctcaataaagctgtttaaaaagtaactcttttgggctgggcacggtggctcacgcttgtaatcccagcactttgggaggtcgaggcgggcgatcacgaggtcaggagatcaagaccatcctggctaacaaggtgaaacctcgtctctattttaaaaatacaaaaaattagccgggcgtggtggcaggcgcctgttgtcccagctacttgggaggctgaggcaggagaatggcgtgaacccggaggcggagcttgcagtgagccgagatcgcaccactgcactccagcctgggcgacagagcaagactccgactcaaaaaaaaagtaactcttttgaagtagaatcgtaatatcagtgctgggagagatctcagacattatgggtccaaattaccgctccctcctcccattctgcaaatctggaaaggcctggttaggatttgctgaaggctcccagaagggccggtgtcctcagatagcttctagcctccctctgctactgaactgcaagctttcaaaaccccaggtcttaaagcacctgaactctgccagccatgcaaacacagttggcgccagtgtctgctcctggcactataaatgtgccagctgctgtcatgagggtccaggagatgagggtaggggtgtatgtccccataccaccccacccagggtctcctccagccctgacaattgccaggggtggtgggctgggcaggatccacacctcccctattgacaggtcaggggactgagtccctgggaatgagtgtacctcggctctcgctgcttggcctgctgaagtgagctctcctggtgggaccctgacagtattggggctttgagtgtggctgttttgggcaggtcagaggctaatgggacatcatcgtgcctcatgcccattccctgaggcccaccaaggaccaatcctgacacaagtgtccctcaggcttggactcaccccgtctcgcactccacccccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtaggacgggctccgggcactgaacccaggctgcagggcacccagggttctgggaccttgtcctgcaaacgtcaccagaagaagaggcaaaggatagatgtgaactgttccccaacctggggagtggggagagtggtcctcagggccacaatcaaagggattaacatggatgtggcttggcacaaggtctggacaggtatcacttactgctgtgtgacctcaaggctgtaaatgaacgtccctgtgccccgccttttcctcatctgcaaactagggactgtgccacccatctggcaggtgccatcaagatcctctaaccacaggctttggagacctctaggtggggaaacgtgcattttcttaggttgccttttcaggatgctgggaccaagagtccccagcattaatgatggccttccatatggccctggccggttcccacccctgcctgttcatcaagtttccccatctgtaacaagggaattgaagtcatcagagtcagggacatggtagcccagaagacaacagctcgagctcttgggtggctggcagggagggactcgtgacccctggtgtgcagggaccctgacccacctgtgcctccttgtctgtggagcgctgggcctgcatcctcttcaacgcatctgcttcttctcttccccgactctgggcccatggggagccaccctggggtccaacaaaggtccctcgggttatatggggggcactcagctgccggcgcggtggtggggttggcccgttggccacttgctctgagtggcgcctccggagagggactgagtgctctctcacctcgaagtactcctctgacacagaggaagccactgagggccgtcgggggccagggccacggccggagctgcctgagtggctgtcctggtcactgagggttacgtagtcgtcatcatcttcttcttccaccccatccagcccattggggagccccaccccgaggctctcggggtcatcctgggtcacagatagctgccgctggagtggggcgtggcctgggcctgccatcctgggtagcctatggtctgtcccattctggggagcttcctctttggggagctccaggacccagccaatatcactgctgtcccgggctagtacatctgccacagggactgtccggggcttgggcacggggggcaatggctcagggtccccctgggggaggccgttctcagctgggacaccgtcctggggggcactgggctctgggggagggcaaggctctggacggggcctgctgtcctggctctgcttccacagctggtgctgggcgctggcctgggaggtgtcacggatcttgatgcggttcatctggctgggctgggggttccagatgttggggtcgatgatattgatgtagcccaggatgtcgctgccaggctccgggtctggctccacccacgtgggcaggtactcaaacatgttggccctctccaggtgaagcagtcctgggtggatgggtggcagcagctcggggagttcccctggatgctcagccagcgctgggcctttcagccccaggggcttcttggcctcctgcttctcagaggagatcttggcaatctcgtcgacgctcttggccttgacaagtgcgtacttggggttgacgagcttcttggccacagtgcccgcgggcaccagggggaccacagagggcagcacaataggctccggctccggttccttctccatagggatgcccttgaggctcacactgtgtgacatgaggtacagctcctggaactgccggtcaaacatctccaccacctggccagacagcacagagatcacattccggtccgtccgcgcggccgaccacgtgaagctgcaacagagggagggggcgctggtcaggcacatgaccctgcttcctccgcccagcccccgtgcacccatagccgctgggcctcagactgtggccacagggccctgggatcaagaagtgaatgggggcagagagcaggtgcatactgtggggtcagactgagtcggatgtcaagcaagttggttgcaccaagcccattcccacctctgcaaatgacagggcactgtgctcctctcaggctggtacaggattcactaagcagctcaggaaggccctggacactgtggggggttctgcatgtggtggccgctgctgccatgcgtctatgctgccaccaacccccatgtaaccatgggcagcgcccaccccatgccccatgtggtggtgcccacagagctggccccatccctaaggacggctctcagagtgacccccataggcttgcgaaggcacggcctggccacaccccacctccaggccggtgacatctccaagctggaacaacagcgtcctcagacaaagcccttctctgcctgcctccagagacagacaggcgggcagatgtgctccagccctgcgcacacctcagcagccttgggaccaatgaaccggaataaccagggttaggattaagggcagaagccagttgggagccagaggtacctctcgcacaacttccctgaaagctggagagtcacctgtaggagccgcacacagcccggtctccatccacaaacatgaacttctgggccagggcacccttgaacttggttgccgaccgcgtgaagaactcagttcccccgctgctccgcactctgagattctgttttgggaaccaagagacagaattacacgactgcaaccctgaccacacagggcgaggggaggacggcagctgcccagggctcagaggggactctggagtagtcaggaggggaagaaagaggctgtaaggcctggagaaaggggctggtgtgtctgggactgcagggctcagggtaaggagggagctgctgagccgtgaagctacagagcgggcaggcactggtacaaaggggttggcataagatggtctgggctttggccctaaaggtgtctgaagagcagcatcaggcaggaaaaggcttacacagccagccagcttgggaaatgctgccgtgggtggtggatgctatggtggggtcctgagcgggagggtgatgtgcacacgttttagaagtgtctcgtggatggctagggggtgatgcagccagaggagggcaggaagggggcctgccctgcagaatctgtgccttatactccgataagtctgtggccctccagggtgcgtggccctacccggcctctcccctgtgcttctcaacacccctgtctctgctgggctctgctccgaggacaggactcacagcaaacctttctccttccccatggccaggacaccacccagcacccaggccaggtcctgtaaatggtcagagattcaattctgtgccggcttacactgtttggcccaggagcaggccaggaaggccctcagagactgtggccaagggagctgagacccaaggagaagagggctccttgggcatgaggagcacagcgggcccctcaactgcctcagctccaaggccaggtcgtcaccggccttttcctggaccctgaacacataagggccctctgtcccagtgtggagtctctggagctgccaagggcctgtgtgttatgagctccaggtgctgacttccctcccccaggtagcaggacctgctgtgagggaggagcagatggtaaaggctggtgctgggcacggcagaccccaggaaggacagggcgagcctggctggaacccaagtgtcgaggatggccaagggcatcccgaagtagaatcacaggtgtaaaggggacctggggctcatctggcccctgtctagggcagtgtgtaagaaatgctcctgggtgccctgagggtctgactcaggaggcctgaggtcaggcagggaatctcagttttaacacccactccagggattcctgactggtctgcctgcatgcctcctgtgatgggagtctcactccctcccgaggggctctgtgccggcttctggctctcggctatgacgtgttcttagtcaggctgagctgtgacgtactggtctgtcccctcacccactcactggccccagcttattcaccccactcattcacatagtcatcaacccctgccgaggcctccagctgcagagatgcctgtgatgaggatcccacctgggaggtgaaggggaggctgagggggtaaacgaaaacaagctgaatgcccaggatcgcagaggagtagcctgaagtgtgaagggctggccgggaggctcccgggagaggatgacataggtcacagggggaggtggggaagcattccagggaagggactcaaagaccaggcatgagaggcctttgtacaagagcacctcaggggaggaggggtgggtgatggagcctgcagagcgagcaggggcgggctcctggtaaaagaccctgcaccggcttaagagcctgagcttggccctggggccagtagggagccatgggaggatttacagcaagagcgatggggttgggtgtgtatctcaggagcagtgctggcatcaggcagtgggtgtgtgaggtgaatgctatgggagaggaggggagcctgagagagcagagctgcccgccatgccatccagcctcctgccctgccagtcctttccgtgtcccagacccctgtggctggggtggccccaggcaagcaaccacagaggcaggcaggtgtgggccgtgggtgagtccccatctgatgcccacctgtgggataaaccatagccttttcatagggcccagtgcagaaggcagataagcctctgctcccagggccgccctcgccggccccccaccccgcaggctgcaggtttgcacacagccagctcagcaggaagctggccacggcccaggacaattagcgctcgtgactttgtacccaacatggagcacgctcggggttgagaagtcggacaaagatcctggaggtggtacgaggccttccctgtcactgagcccaaccgagcccagctccaccgcctcctgcaggctcctggcccggccacagacccctccttagcctggaaaatcggccgccagcatcaggacccttctggacagtgtctgtccccacccatcccaaaccttgtcctgatgagggctcggaaagtcaccacttccatctcagagtgactcagcctccgtgtgagccgcaggcctcggctgggccgctgactcgctgtgactcgaagcaagtcccgggcccttgctgggccttagtctcccttagcacacagcagggcgggcctccaactcttaggcctgttctacctggggctcagcagcaggtgggggcctgcagcagggccccccacctcttgcctcatggcctgctccccagcttgtgcctggatgggccccaccccacggggcctggcctggatgaggtaacgtctcaagactctgggctcgtgtgcgcagaggtggaggatcccacaaagctgcattgtctctgagctcctgggacacccccggcacaggacagcagatgggtggagggatgccggggctggcccaagaggggtgccctggaaaagtctttggaccctctgggacctcagtttcctcataagtaagagaggacgtcaagggcgagtcagggcaggggaggacggccgggtggtgcttcatctgctctcagcgggtggcaaggcaaggtgggggctccagggctggggcaaactacagcaacctgcccccaatccccccaggcctccaggccacatgtgcttaaaggacatgtgatccaactgtgccaagcccgctggtgcgaggcagagggggctgagcccaggagcccctggagtgggtctagggtctaggcattcctgagctccagtcaaacaggctccaatcctagcaccaaatggacgccaaccaaggcctttctttccacgcctcagttttctcatctatgaaagggtctactcatccttgtgctgcaaggctgctgtgaggactgaatagagccacagtacaggtggggccctcccagggaaggtgtccagctcccagtgggtgccccatgaactggaagtggcgcagtgggctgtgggggaccaacacagaggaccacaaaacatccaggagggatggactgcccagggaggccaggactgtcagccgtactgggtgggtggttggtgggctcaggtagggaaagtgacctgcccactgtctcccagtagccctgggctgggccgggactgaggacagggctctttcatcacccacctcctcagggccctgctggccaaacaccgtctcctttaatttcaccctcacacaaccccgtgaggcatcactatggccatggggcgctcgaggcccagagaggtggaaccacacgcccaggtcccacagcaggtcaacagccagtgagccatgtaggcagcaccaggacagcctgtgctggcaggttagctttggttttggttttataatggaagccagtgattacttcccctgcccatagtgggatggccattcctaggtttattgatagttgagtagttagtgtgaatgagtagaggcccggtagagcagtggggaggtccagagatgcatccttgaccaggtctgagctgggaacagtgaggccaggcctagtgtgaggaatgcaaggaacagagcccaacatagcagcaggagcctggctgcctgaggtgcaggcctccagcagcctctactctcctctacagggcctgtctcgctctctgtggagggtggagaggggtggtcaacactcaccctggacttctccaggctgttgtgaagttggggtggtgggccctttgtgaaccacatttggcccaaagtatgtgacggcatgtaggggcagggccagcctagctccaaggccctggtctgaggggctcctctctcccctaggccaaggctgctcagcctctgcacaactgatacatgtccccttttgtgtgggacctgtccccggcagtgtaggatgtttaacaacatccttggccactcaatgctggtagtacccccaaggtggacagttaacaatgccaaatgtccctcagcagagtgaatcccccccgtttgagaacccctgccttggccgggcgcggtggctcacgcctgtaatccccgcactttgggaggccgaggcgggcggatcacgaggtcagcagatcgagaccatcctggctaacacggtgaaaccccatctctactaaaaatacaaaaaattagccgggcgtggtggcgggcccctgtagtcccagctactggggaggctgaagcaggataatggcacgaacccgggaggcagagcttgcagttcacgccactgcagtccagcctgggcgacagagcaagactccctctcaaaaaaaaaaaaaaaaaaaaaagagaaccctgccttataccctgaatccaccacagacccaggcccaggtagagacagcaagcaacacccaggcatccccggggaacgggggaacctgggcagcggaagggctgggtcgtgcctgtccagcgtgaggcctgagcggcagcgatcctcacttcctcaccgtgtgccttcccatggccatcccagctgatgcttctttgttcatcagaaacgggaaacgggtctggcctttgcccaggggctgctggtatttccagtttggctgcacgaagtcaactggcttttcagatggcccaggcatctcatggctcttgtctgtcctaagctggaagcctcaggcccagcctgtctctggttggcctgggagcatccctccacacccagtatcacccccaaaagcagccaagtcatgcggcctggccctgtgaccctagagggtgtcagtgaaagttctggccctcttcccaaggcctgctccctatttgtcatttggggtggtcattcccatactcccacatggagggccactggggccggccagggcaaccggctgaggtgcttaggaatggctgggagccccacatttggggagacactggtgcacgctgctcccacctcacctggggaccaggagtgggcttggcccaagcaacagggcagcgtttcgagagtgtgttggtgtgggctccaagctcaggaggaaggagccgagtgagggtgaaccacagccagaccctggcgcagagggaaagaaagccgctcagcactcagaccagagctgcgtctcatggcggggctgtgcctgtccctagccaaagccaggatgggaagggagctcgtgaccgaaggcccaccgcacaaacggcctccttcactcttcacagcacccctgacagataaatgaccatgtccccattttgtagacaagacaatggaggcctagaaggattcagtgactctgcccaaggttaccatgcaggtggcacagctggggctcaggactggctcctggtatcacccccaaactggcacctgacaccccaaggtcaaaaggatgaccctaccagaaaacctgtaccctgcctgggcccaaaggagctggggcaggttggtgcagagctgggcaggggtggcagtggctgagggcaggcccagggattatcggcaaaggaagtgctcccgggacaggtctgggcccagctagctcaaggtgagggaggtaggcagggaaggcaggccctcgacagggggtgacacttggctggggctgggctctcagggcctctggccacccgcccagggctgtagaagggcaagctcagaggcgagaatgaggaagccaggtcacactttcccatggaggcgtctagctcctggatatgtcaccctacagactctgccaccttccctggggaagcgaggcggctgagcagggcaggcggggccagggacctgcagtgccagctgccttccagctggtcacagccagtggaagggctgggggtggaacagggcaggcctcatacccaagcccctaccccagcccagggcctgggatttagaatgtgtggttcttgccagtagctgtataactttcctcagcacacacagcactttacaaccaccgtctcctttaatttcaccttcacacaaccccgtgaggcatcactatggccatggggcactcgaggcccagagaggtggaaccacacacccaggacccacagcaggtcagcggccagtgagccgtgtgggcagcaccagggcagcctgtgctggcaggttggctttggttttggttttataatggaagccagtgactacttcccctgcccatagtgggatggccattcctaggtttattgatagttgagtagttggtgtgaatgagtagggtgggagtgctagaagattggttgagccaataaaaaggataagagaaattaatataagggatcaagttcatcctttgatgctctgtgttattatttgtagttgtttattatttgctgcttgagtaccagggatctgcagcctccttgtcagagctgatttgtcactattggcttttaggcgccacccctaaattggtcggaattgctttgggcaaggcatggcctccctcggatctcagtttctccatctgtcttgtgggagcctcatctgaatgacctcaaggccccttcaggcccaggcactccaggccccccacctgccccattgcctccggcttcctggaaactcagaactctgcaagcagcggagcagccagggcttctctgctgagaaggggcctgggtggaaggcgaggcctctggagtggctggccccaggttagggtccctgctccaaaccgacaggcttgctccctgcttgcgtctgcacgctgggggaagtgcaaagcactcgctgggcctggggcaggggtacggtgctggtggggccccactggggtctcttcctgggcatcgggcagggccaggccttctgcagtcaggtttccaaagtggcctttccacactggctctctcaggcatgagctatctgccactggaatcgattcccagcactaattacgcggcggggagtgaggtgggtgtggggcttggggccaacccaccagggagaccacattaaaaatgtcccaagagctagagactcaccacggagtgctcacaaccacttgaaaggactcaaccggaggcgttggggttggagggggtgggcgcgcctgacaaatgctgacaaattacaggcgtggagcccggccccttgttaaccagactggcggtgccccttctcctaggaccacaagcctgaaacctgcagaattttgacctgtcagacactggtgctgagcccaagggtctggagcaggcctctaccccactatctttaacttgctagcagtgacatggggtatgtggctccattccctcatctgcaaaatgggaacaactccctatcccactaggctgttgtgaggattaaattaaccaatgcaaagtgcctgtgacagggcctggcgcacggccaatgcaagagaagtattcgccgtcatcacgcacgctcatctgctctcagggaaatgctctgcacgcagcaggtgccaagcgatggctggcagaaggagggctccagacaccaaatgccagggtgtctgggcagaagagcgttggaccaatgagatcctgtagcccagagaagggaggtgacatgcccaaggacacacagcaaaacagtgctgagaaccacagcccaccctgaccccatcggcagccttctctgatccacttctgttccatggtttcccccaccccaaaggttctttctcctctgctcttgtgccttaaattcacttcaactgtgcagccatcgcagaagccttccctggccccagcctgagggagcttcctctgtctgagccagaatctaaaaccagtaaatggaattctaaggagacagatttgggcttaacccaagaaaggacttcctgggagttgaagctctccagaaaggccacgagctacctgaggaggcagtgagcacactatcaccagaggtatgcaagcaaacagataaccgatgtggcatgggctgctctgaaataacatgatgcagcacttggcatgagctccagcacctggtcagcaagcacctaatcagtgtttattttatctctgccacgttggaggtagtgagtatcctgcccctcagggaattcaagcagtggctatgtgactgcttggcaggaggctctaggattactggactctgagtgcctggcacaggactccgtccagagcaggcaggtactcgaagtgtttgttgacagactgaatgacccctgccctccagccacccaggcaagtgaggagcctgctcaccttgaggtgccccaggtgcatgcaggcccgctcacacatgtgcaggaagtacttgacgttactctcatccacgatgatgtacacggccactttcctcttgaagccggcgtccagcaggtccttgaagatgtccacgtcggtgaacatgtccatgaccacagctatcacctgggagcaagaagagagactagggcctgtcagacagtgcagcagtggggacagggtgccctggcagagcgcacagccctcccatgccaccagcctctcacaggtgcccactctggccctactcctggagcctcaggcccgggaccaggaagtgaggggccaggggcctctcttgccctgaagttctagttgcagtcccagctctgggctcagcccaggggccctgtgttggtgcattcccaggccagggccggctacgctctgccctccttgtaacacctgggaatgctgagatgaacctgatgtgtcaatgaccggaagggcagcagctggcgtggcggctcgctggggcatcccctacattcctgggctggtgtggactttggccagtgtctaaacccagatctcttcctgtcagctgacaacatctgtccccatagcaggtgacctcctgctggacctggctcagggtggggccccagtggtcagggccttcccccagcccagccaagcaccaccaacagggcagggggcctggctgagtgaaggtgcaaggtggaacatgcagaaggacaggatgaggtggtatgggcccggccccagtggggctcagtgactgtcaggcttctctcacacctagtcccctccctgtcccttggcagcaaggggagggagtcaggacagggcctgtgcctgggcacagccgcctacactgctgatgcagacacatgtcccacttttgggcagccccacccctcccaccctccgagcctggcaccaccatccctgtcccaggtctgaggaccacctggagaagaggccagggacctgccctaggccacacagcaagctggggacagagtcaggctacagactaccctgacttgtcagagagcaccccagccttgctgggatgcggagattcagggtggtggaggcggcctggagcctgctggggatgtgtctgcacgccccaaagtgagctcaccaggctggcccctgcaggcccatctgggctcctcctgggcctcaggcccccatcgttcacctggcaccaaagcccaaactccagcagaggggagggctccatacctgccctgcctcaaactcactgtgtgaccctgagcaaaacacctggcttctctggacccagttttctcatcagtatagcatgctccatctctcaggagaatggagcacacctgaataccgcagcacctgcaaagagcccgacggggggctggggcgggggctcggtgatgcccgtttgctgcctttctcccacagtcaccccgcacgttcccatttacagggggtcttgtcagcctgactcctgcagcctctcacaggcaccatggtggtgacagcccagcatgcagccaggtaaactgaggctcaatgaggttgtaaggcttgttggatgtcgcaaagcaagttgggccagggcctggacctacctccgagtcaggtcagggttggtctccagtaccttctcttggacgtttagtctcggagagcctgggagagagtggtccccccagagcggacagcggaggtgtgggaccagctgggactcccagaactccaaggcctagggttctctctgttctctggggagatgactgctccctatctctctgtttctgaagggctgttttggggcagagggagtagctggttgatgcagggtctacgactcgcaggggaggcagatgttggcaccagatggggaagcacttgctgcccccagggctgcccaaggttaaacagggatcttaagagggagctcactccctgacctaggagatgttcaaggaaggccagagactgcttggagcgggggtagatgatagggcagagaagacacgatgcaggcaggtcaccatgaccctggaggcagtggtgttgagacactgggcaggggtgtgtggtggtagcagggtcctccctgcctgggatctcccagacccaaagcctctccagccccagaatctccttagttaagccacttctgagcaggcaaacagcctcacgtgccaccctggaaaggagcctaatgagggcgcagtaggcatgcttctccctggagggcaccaggccctgcctaccgtggcagatggggacttgccctgggcttgggctgggggacgtgccccagcaggacccgcaccatgtgcgccactccccacattgccctcagccaggcagggtgcctgatccagggaccatctgctgtcaggttggatatgttggagcctgcactccaaaatggatccccccacagtcctggctctccccaggcattgggttcagtgcctagggtggtcagagatgggtttgtaacaggcacgagcttatgctggggatggggagggggagcctggtgctcccccaggcaacccccaacagcctggcctgtccatggagccacaaaggtttcttgggggcccttgagtcctgtcatgccctttcccattttatagacaggaaagctgggatcacagtccatgactgaggctagaacccagggccctgtcccacccagagcaccttctgcacaagagactgggcatcagtcctgggcccttgagctgcttgatggtttataaggagcctttacagctgttaccttgttcaggcctcacaagcacaccgggaggcagtggttctttttcccattttgcagataaagaaactgaagcacagaggcattcgccaccttgcctaattctgttgggaggcccagctcacttgtgacaccatgagctcagcaagagcagagcccttgtctgagcccaggacggggcctggtttaaggaaggtcctggggagcttttatcaactgagaacaagaccaactggcttggtctgggaatgactgcaggaatcagggcatctgggaccacagcccctcctgggcccttggcttccccatctgtcaaatgggggtgtgggcctggcttgcccctgtggttctatccagttcacacattgtcagagctggcccaagtcaagaaaagtaccagatgcttcacgtagccccaagcccacacgtcctctcagaggtcctgggcagggcaagggctgtggaaatgagaggggaggctgactccaaagaccagctctacctgctgttatgtcaggggccacactgggcaggaggcgggtggcctgggtcccatcactgagcttgttccgctcctgaggcaggaaccagccatgtccatgtgagcagctggcacaggggcaggcatggcaggcgggcacgtgtgtgtcctgcaccccaggtaccgttgtcaaagccgacgggcagctcccagcccagcagcctggaatctgcgcaggccacacagcccagctcccaagtgaaggagggagcccagtggtccctgtgcatcttactgatggacaggcctctgctgggcggccttgaggcctcgaagatgcagctgcagaacccaggaggcccaatgcccaagacaaccatctgactcctgccagggtgtgggaggatggcccaagatggcagggtgtgggaggatggccatgcctggggggcagaggcaggcaggctgcactggagggaaacaccagcagggatgtgggcactcctccagtgagccaacagcgagcctgcgcctgccccagcccaggcctctccctgggggctcctggtgcccaaacacctccggcatgtctgtccaggggtgtccatatgcacaagccctccagcgccccgcccgatgagcacctcctcccatgctgtaccctccctgcccagtggatccgccggccttctccaccctgccttctgcctgtgtctcgaatcccccacctccctctgtgtccttgggacagggggacatccgcctccatgtgagagatgcagaaactgcagctgggagaggggagggcactggtccaaggtggtgctgcatggggatccccagtgccctgccaggagcacctccaacacctgggcagtgaccggagcagcttgagctgggatgcaggggtgacagcatctcacacaaaggagaaccccacctgtggccactgccccccagcagacacggcctgaagccacgtaacactggctgctggcgttgggggtgggacagggctttaggtcacagaggcagggagcacaggcgtgggcctcctcaatctccctcagccccagccagagccccctgagcaagggtggagcgggcggagtcggtccagcaccggcgcccaagctctaggctgggctttgggtgagccacacctgcgttccaggtctcagtttcttcacctgtcaaaggagaaggtggacaagatgtccaaggcccttcgtctctgatgtccctgccgagggaccccaactcctgttccctgcctggtgccgggcagggcctgtctgggcggctaacacatctcattgcgcccacaggtctgggagaggaagtgctggtggccgccctctccctgcctccccacacagctcctgcctcacaggtgccaacaacagcctgtggctcctgacacccacaacagctgtttcctagccttcctgtgaccacagaaccactcttgaagcagaagtgccctcgcaggacgagtaggtagaacaggtctccacagaggtgcctggggaggaggggtggggcgagacgggctggcctggttccgagcatggtgggaaaccacgggtgcacaggcccagcctctgcagcagcacctcttcaggggggccctaaaccaacgcatcctgacccctctccccgacgcttcctgatccctctccccgacgcgtcctgcctcaagccactgtgtctcctacatgttgttctccttgccacctgcccattttgcatctgctcggacaactaccttttttcaaatcccaactccagtgcagccccagcctcccctgtcgtcactctggcctgtctgggttgagcgtgtatcacttgcgtatttcttctcaggcacagcaatggagtctcccaaggactgagtcgcaagactcgggtaagaggggacagtttccaacctgcacgtgacaagccttacactcacctcaccctcctaggcctcagagatccctagaggcggctcagagagaggagagaggcggccatattctctctcctcactatgctccaggcaggtggaggacagataccctcaagcctgccccagaacctggagccctgaagcagccacagacactgcacacactgcagacaagtccctaggcctctctgggcctcactttcccacctgagaagtgccgggggtggacagagtctctcatcttggggttcgttattctccaggtctgatggcagatgcccagacagtggcagtgtgggctctgcacccgctggctccgatctcagctcctcctgggaagctgcatgaccttgggcaagtaccttcatttcctcatggggataataacaatccccacccacaaggttgttggaaattaaaatgaattcatgcaggtgaagccctagcaggggatccacaaacggcagctgcacggaccctcctcgtcctcccaccaacccaagtcccatcccaccagacccacagctccctctggggtgaacaggccagcagcgtctcactaccctccgggccagctggaaggctgtaagtgacgcatcagggctgctcacaggaatgctgcagactgtcttaaaggttgaggcagtggccatcatgaccttggattcaacttccacttacagccatgatggaataacagagacggaattcaccccctgccttagcaataaaaaacccggataaaatctatgaagccatggacaacaggcttcaatcagcacagcgattcctgagagaagaggaacaaaccagctgagccctaggatcaccccactatttccaggctgcagcacagggaggggcgcccccgtggagtcttgtggtctccctgagttgaggagacagggttcactctgagtgtagcagctaggatttgcaggacggagtgccgcaggggagagagctgcacagagtgaactccagagacctgcagagggtcccctggagtcttcagctgatagccgagcagcacacgaacgtgaggaaactactgaggctgagcagggaaccactggaaaggggaggctgagcagagaaccaccggaaaggggtggctggaacaattgctggtgctcacgcaggaccgggaatagtgtatgtgcccccagccagaacagaaacccctcctaacacacaggtcctgcagggggtgtcctcagaaggatactgcctcagcagttgacaaataagtcctagaccaggcataagcaaacttcctgaagaaccagagtgtagacatgtgaggctttaagggccatatgttctctgtcacaactactcaaatctgctggtgtaacacaaaagcagccaaacaaagtatataaataaatatctatgttctattgtttataaaagctggcaagaggcttcctttggcctggggtccataatttgcaactcctaccctggagtgaagtctgctctggtcctgcctaataaagcttgacaggaagccacaaaagcattaaatcgtttccaagtaacctaactgcatcccagaacaaggctccaaaatatttaaaggagaaaacaaaacaaacaaaaactacaaactaaaatccaacatgcccggtatccaattaaaaattaccagacacacaaagaaacaagaaaacatgatgcacatgagaaaaaaaaatccatcaaaatcaaccaaaaaccgacacagatgttagaactggcagataaagacataaaaacagttataactgtgttccatgtgttcaaaaagttaggtagagatgtggaagcttttttttagccaacaaatcgaaattcaagaggtgaaaatgcaacatttaagacgaaaaatatactaggtggaattaacagattaaacactatagaagagaaaattagtgaacttgaagacatgtaagtagaaactgtccaaaatgacacacagaaagactgaaagaacatgaacacagcatcagcaaactgtgggtcaacttcaagccatccaatatatgtgtaattgcagtctcagaaggtggaagggttgggagtgagcgagagactaaaaaaataaataaataagaaaaaaatggccaaaacacttctaccatttgattaaagactaaatccaaggcaaggtgcagtggctcatgcctataatcccagcactttgggaggcagaggcgggtggatcacttgaggtcagaagttggagaccagcctggccaacatggcaaaaccctgtctctactaaaaatacaaaaattagcagggcatagtggcatgtgcctataatcccagctacttgggaggctgaggcaggagaattgcttgaacccaggaggtggagtttgcagtgagccaagattgcgccactgcactccagcctgggcaacagagtaagactctgtctcaattaaaaaaaaaaaaaaaagactaaatccacaggtctcagaagagacatgaaaaaactataccaacgcacatcataaacaaatcacttaaagtcagtaacaaagagagcgttaaaaacaaccagaagagaaaagacaactgcatgtcaaggaacaaagtaagtggacttctcatcagaatcactgcaagccacaagacaacaggcaatatctttaaagtactaaatggaaaaaaaaaaaaatcaacttagaattttatacccagtaaaaatacatttcaaaacaaaaggcaaactaaagactttttcaaatataaaaaagctgagagaattcattaccagcagacccgcactccctcctccagctgcaaccccctcctccagcagcacggttgggacagacgtggctgcagcacctcagtttttctatcatgacatggtcccactccccctcccctcctcctcccctccagggggctggcagaattagtgacatgccatctgaagaggcccaagaaggttctctgggttaggaagttctcctaggatccctgggtggtgctccctgccacctcctggcaatctccaaaccagtttgcccatataatgtctctgaaagtctgtcaccgagaggactagtttagctaacagtctcatcttgcctcccagggtaaagggagtctgtgtacttggtaacaaatgctgaccccagccagagcaaggataattaggccaaccagctggcacgcatacaggtgtcccttttctggagacagggaggggtggtgatggccactcccattttccagagggggtgtcactgtcccagggccaccctgtcaactagtggcagaggtctcctgttcctaggcttttctcctaatgggggaccctgtgtccattccaacctctgaacccacccacagcctcccagaggccacctcagctcttgaaagaaatacctgaccatcagcactgtctggaaggttaatgcctgggcctccctggctctgccatgccttccctgggtggcccatggcgggtcacttcccactctaagcctcagcttctcttcttggtaacatggggagtgaaactggatgaactctgaggtcccgttccccttgacattcatcagctctgtgaacaccttccccaccctctgactattaaggctgaagcctcattaaggccaattaaaggaagatcaggccttctgagcaccaaatggctgcagtgggttggggtcaagaagcccaggctaatcatgcccagagcgctctgaccaggaggctcagcctagcccagtggcatgaaggcactaccctgagtctcctacctcccccagacggacatcagcttcctggtcatggctcaggaatactgcaaagacaaggggctggcagagcttggggaaaggccatgaggtgaccaaggctgttccctgtggatgaggcaagagggcaagatcctttcccgctggccgcaaggagcttcagaatcctcagagcttccaggcttgcaggcgcaggatccagccaaccagaccatcccatgtgggcagcaaacggcaccagctgagaattttcaaacaggaaaatctcaaaactatagattcaaaagcctttaaaacctcagcttctccagggtccaagagcgacagacattggggccatcaagcatcctaatgccccagaaagcctggcttggaaaggacttgcccaaggtcacaaagcacaccagggcagggctgaggcttctaggccacctggtgcccacatgctctctgctgcgttccagtgagcccctgcttgaacttctcccaggacagggagctcaccacttccaccccagactactcacagagagaagctctcaggacaggagtgaggagtgaaggtggaggaggcgaggggagagatctggcatctaccgatgccagctccatgccagacacagagtgttttacacaccacactttttcccatttaaatctcactgactttatgaggcaggtgttagctgttagcactaccatgacactgaggaggaaggaacagaaggtcagagaggccaagcaactatctccaagcagccactaaagataacaccagagctggggctcatgcctgggtcccagtgatacggaagcctgtcttcccaccaccccacatggcatttaacctggcaaggtactcgagcccaggggtcattcagacccttaaaggggactaggacagcccaaccaggccagggcctgccaggctggggccaacgtgggccagggcacagggtgggaccccatcttcctccccagctgctctcaaggcagagggtagctcagtgcttttggatgctcctgtctatcactgcgtcaagacaaggcctgatccccattttacaagtgaagaaactgaggccgagggtcctgcagcatgcaagtggctaagtgggaccagcactctctgctggcccaggggccaggaccctcagctgcagggagaccctctccagccagggagacccaatccaggtccagccacacctaagacccttggtgtaaccttatgaaggccccagccgactctgagcctcagtttccccagctgtgatatgaacatgacggcaggccctggctcttggggttgtgggaaggaggccagcccagtggctgagcagctgcctgtcccactggagtgcccagacgggcaggcactctctccttagagctccttcctcgaagggctgctcccggctctcctcgaaactcttaattaagggaagggagcctttggagcgcacaggagttaacacctgggattactttatcagatggttccccacccactctctgacctgtggtgggagcctgggccagctgtgcgccccacaaggtgtcaactgggccacctgtggcctctggcagtgtggggagctgtcctggcactgcccagctaaaggatgcaatgagtggccttcctcctggtccccaggccacagagctcaccctgttcttgtgagtccccgtcccagccctcctccagagagcccagtatttagctgccaaggagcctcatgaaaacgcttttactgccaggcacggtggctcatgcctgtaatcccagcactttgggaggcagaggcgggtggatcacaaggtcaggagttcgagacccacctgaccaatacggtgaaaccccgtttctattaaaaatacaaaaattagctgggcgtggtggcgcacacctgtaattccagctactcaggaggctgaggcaggagaatcgcttgaaccctggaggcggaggttgcggtgagcagagatcgtgccactgcactccagcctgggcgacagagcaagactttgtctcaagaagaaaaaaaaaaaaagaaaatgcttttactgtcctgagtcaacaggatccagcagtgaggctctggtgctcccatgcaggggtagggctcagaaggaacagtgccactgcttctccagggaatgggagggtgctcagggcctgcagactgggggtctcggcccagtccctccagatatcagttctgtgacctcaggccagttatttgccatctccgagccccaccaagcctcagtttcctcatctgcacaatggagacaacacctactttccagagttgtggggaggattacacagcatggtaaagtgcccgctcagcacctggcgcggggctggcatttagtaagcacctcattaagctgcttctattctctcagagccaagctgtgggccaggacttcagtgtgtgaaggcgggggcctgacagaaaaaatgtggggtgaatcaggcttcgtgaaacctgggttcgactttatttctctgggtctgttcccaagccctggcctggcatgcagagatcagtgttctggccctggccaccggcgcctcacctgccctcagtttcctcaactgtgaaataaggaaggtgtgatctgtccctgccctggggcctcaccctggggctggtgagggatcctgctaaggcccccctgctgtgtcctgttgaggggggctcagcatctgctggaggagcaaccagctagaacatctacatccagctctggctgaggaagccccaacccagcccagcctcacgccttctcaggctgcagccaagtgaggccggggctcgcccctcccaggcgtgatcttacaagcccgtcctctggtatgtagttggaaccccacagcaggttttttcccagataaatcatggctcctggggctaggggaggggcaggcagttgaccttccatcttggagtaggagcccactagggctggagggaggctggagggcacaagctgctgagagtgagacctgggacccacccgcctcttgtcccaggggagtctaggatcacagggcagcaaggtgtcagggctgaaggggcccctaacagtcttcaatacctgttcccattttacagatgggatgaccggggcttggagaggagctggggcttgttccaggtcccacagtcaggcagaggcagagcacggactcttggctcctggtcctgctgtccactagttccattctagtcatttgggaacaggggggactgacagcagtcctgacaggaacacagccgctcccctaagtgctgcgtcacttccctgccccagggtctgcctgttgtgctgacgacaggtaaggtgagtgaggaggcggaaggctgggctgtcctgactcagccccagcagccccagcctaaagcccccggtgggaaggggccagtgtgcggcaaggcggcccaggcagagggatccccatcctaggcagggggcaggcagagttctccctacacaataccagagtgagaaggggaggtggaagcatgggcacgagaggtgattcatggggagagataaggcagggagcgctcccaggaagcaggcagacaaagcgccccgtcagcatccgtcagtgtccgggccctgcccctgtgagcctgggaagcagctggggcaggacagctggaggactgcagtggcctggatgagctgcccctcccagcccctgcctgtcactctgtcctgccagggccagggcacaagggatagcctagagtttgagggaaacacaggcctggtccccacccctctacccgagaactagctaggtgaccttgggcagcgactaaccagtttctacatctgaaaaatgagacagataacactagctgagattataaagcgcctcgcactcagtcaacacttgctattgttattatccctgcccacacatgccacacaagcctgggccacaggtcccaggacagatgtggcagggaaggaagtgcccagggcagaaagcaggggcttggctcaccacaatgctgtggagtcatgaacaaatccctgtccttctctgtgcctcagtatccttgtctgtcagatgaggagcttagtctctactgcctctgaggcccccactgtgggacccttgaggactccctgaggtctgagagtagggagcagtttcagcagtgagtgccccatcctgagggctggaaaagcagaaagcagggcccacctgtccgaggctggaggacatcactcactatggggccatgtagacagactggcacccaaactggagaccagcttcttcctggctatgtcaccttagacaggtgacagcaatcaccttgtgggaagcaaaggaaggcaatgtcaccttaggtgacactaataaccttgtgggacttttgtgggaagcaaaggaagctccaggtggctcatgggactgtacggagtggctgggtcacagctgtagccagagactcagggaggaacctggggtcagcaggtgaagtcctggccctgggagcccctatctggcccatcgctgggcgggggatctgtctgtctgcagaccctctggctgttcccatctgcctccttcctgtcgctgacaaggaggggaggcacagaggagtgggaaccttggcacagcaggtccccctacccatggcctcagtttccctattttcaagatggaagtggaggctgggtaatgggatcccagcaggctctctgtggggactgggttctctagcctccagccagtcatccccatcaggcacagacatcagcagcacttcctccacaccacagcaggtgtggggcgggtctctcagtctgcaaactatgaaggtcccttcctcctccccctcctcctcctcttcctctaactccttccttacttttgtcacccgatattccatcttcacaatagccaaagatgcagcttttatccacaccacctccatcttatagatcagaaacccgaagcctcaaagctgcccagggtcagtcagtgaattgagagcagccaggccaggggccaggcgcccccacccagctagctgacccaactggtccccttgttgggcagggactccaccttcctggaaactggggccagggccaggggccacctcaccagttcttgacccacgtctggtttctctgcccacgaacttccccaaggccctgtcagttagccaggatggtccccgaagccagcattctggtcttctgcaattggctgccctgctctgggactggaagtataaagggattagacccagctaggaacacctcatcccacaacctgaggcccagacctggcttcagaatccttctcaacacagctcactaggtaagctttatctatcaaattaagatgtgcttggaaacgatgagaaggtacttacgtgcagcaggcattagcacctgctcatggtcacaactgtccagcagtggcctagctgtctctgcaaatggcaagcaccccttctcagaatgtgtgacggtgtgtcagccaagaatggccccccacagctagggcactgcatagcccaacaggggtggagaaggggagggccagagaaggcttgaggtcccttccggtggcaaaattcaggtggacaatgctcaggtggactcactccacttccacagatgaggaccacacctccctcacccaagcatcctggcctggaaagtttccaccattgcaaagctcacaaagaggctcagagagggtgtgcaatctgctcccagttgctcagcacagctaggaaacaggcagtgttgaacaaggacctccaggccagtctcagatggacttggaccatgcctattccctcaccccacaacaaaagctctccccaccagagagctcatggtgtgtgcgcgcctttacagtgaatcagagccactctaagggagagtgagaggaagccctggggttcctcccctccccactccaccctatctcggtgccttcttctggggaaccagaaacaccctccaacaataaagaggccctttgagacggggcagcccactgtcacctgctaggacctgggaaccctaccctgcaaagaaactgcggatccccacgaaggtggggaggaaacctccacccaagaggcagccagggaaaacagcagagatccctagaagcccatgttgggctcccgttttgggctctgagtgagcctgtattgagaggggtccggtggctggttgggccatggctccaggagtccccgcgctgcctcaccttctgtgcctggctgatcatcttccgcaccacctctttgatgtgggcctgcccgtctatggggggctgcatgtagacgctagcccgggtcacgccgcggtaggcgatggtgtcgggccagcccaggtccagctgcgggatggagcggtccgacttctggggccagtactccagggagggcagcggctcggcctcgatggggaccccatccgccccgctggcttcctcgccgtcgccgaccccattgtcctcgggcccctgagaggggcccgtgccccgagggtcctcagagcccgggtcgtacacctcgatggtctccaggatgcgcttgagctccagctccgagaggaagtctcggatgttctcccgcttgagcacctcgtagaaggcgtcccggccgcgggccaccagggcctccagcgccagccgctgctcctcgctgtagaagaactcaggcttggactcgctggagcgccagttcacatggttgtcgtccagacactgcacctgagagaaggccatggcgccgcctgcccgggcactgctgccgggggtgggtgggcaaggtccagctcctagctccggcccagctggggcaccgcgcgctcgggggcctctccgcggcctctgcttctctgcccatgagcaatctgcgggaaagacctgatgagcccggctcggcggggagggcgggccgcgcggggaggggcggcgggggcggggccgggaactcaggtgggcgtgggaaggacggggctggggctggggctgggaagatgaggtgggggcactggactgggatgggaagaaagtaagggatcggaacagcggtgagggagcggtgggccacgtcccagggctcagcgtgcctctacgtgcagggaacccatatcccagatttccggagctgcctgaagtcctcgcaacttctgagggaaactagggcagccggggaacttcccagtagcttcttagagtgggaggcggccccggcacagaggcgccccgcaaaccgagggcttccgggtaagggaggggtcttaaaatttccgggtgccggcaacccaggaggcctgcccggaggaggctggggctctgggaggggtccaggagacccagaaacgcggttgcggggcggcgacgccccgcgagacccgggatccggggggcgcggccgggacttgcttaccgagcgggcgctggcggagcggggcgcacacgcggcggctgcggcggcggcgcgaggctgggcgggggcgcgccggtgactcagggccgccccgcttaccccgccgccgccacctgcggtcacgtgccgcccggggcggggccggaagctgattcacccctcgacagacagacagacctggggcggacgcactgcccacggtcccctggtgcccgaattccgaaaatatcagaggcctaagcccaagagctcctggaacacccatcccagagagggacagtgttctccctgaggtcacacagcgggtcaacagccttggcacccccctgtgcccccagggtctgttggtgatcctggatcaaccctggctgtgcccagtttcgccggcgtggcgggaagtccgtgcggctgtatagatacccagctgtccagttgtggaaacaggtctagggtactgggctgggagcccccaggcagggatagggcactgactgacccaaactcagggctttcctgagcagatacccagttctcagtcctaagccctgatcccctctgggaggggtccccggactgcttctgcgtggcgggcagcacccgacctgaaccctagggcagggaggggccaagagggccgctgtgggctggggtcaggcccagctctctgctgagcgtcccctggggttgggaccctggttatggggagcgtggagaccacatctgaaggcaggctttgagggtgggacagcaaagcccattaaatctggcccaacaaacagcccccaccccatcgcgtgccgcagccagtctgcccggcaccaggcccagcccttcctcccatcccccatacttgctctggatctggatggggctggtttgggtcccgtaaggatgctgcttccgtaggctggtgacatctctaggccttgtgccctcaaaccccccccctccaaggccttctccaccattcatggcccatcaggactccttgcctctgagtccactgccctgggcaatgactagcctcctaggcccagcatccttgtggtccccatcactgacccctcaagcatgaagtcctacactctgccatatagccccccaagggctttatgctactgaacatagtggcccctggggaacaggcacacatatttgcatcctcctcctgccccagggccagagaggggaggtgatcccagcgggggagccctgccttgagggtcctgaagacccatttatagcccctctgctactgtggatcccctgtaagaccttctctgagccgcctcagcttctccctgtgttcttaccaatgcacagaggctggagagttcaggaagggagtccaaggcctcactcccacctccaccaccccaacacttctgcagttgatgagcaggaaggttgtatgcacccagttttccccagtagcgacgttttgcataactataatacaataatatcacagccagaaaattgacactggtgcaatccacaaagcttatttagatttcaccagttttttgtttgttttgggacagggtcttgctctgtcacctaggctggagtgcagtggtatgtacaatcattgctcaatgcagccttgaactcctgggctcaagcctcagcctcctgagtagctgggaccagagacaccatgcccagctaattttttttcttttttcttttttcttttttttttttttttgtagagacaaggcctcactatgttgctcagactggtctcaaactcctggcctcaagtgattctcccaccttggcctcccgaagttctgggattataggcgtgagccactgcactggccagatttcaccagttttacatgcactcatttatgtgtgttatacaaccttattatgtgtatagatttgtgtaaccaccattacagtcaagatacagaactgttctgtcactacaaagatctccttctctgtagccatccccacacctcccccgaccaccattcctaacttctggcaaccactaatctattctacaattcaacaattttgctgtttcaagaatgctatataaatggaagatatagtatataaacttttgggattggccttttttcccacttagcataattctccagcaagtcatccaggttgtttcatggatcaatggtttgtgcttttcattgctgactagtattccatggtatggatataccacagtttgcttaaccatttcagtgattgaaggatatgtggggtttccagcttttgattattacaaataaccttgttatgagcattcatacacatatgtatataaacatcaggtttcatttctctggcataagtgcccaagagtgttattcctgggtcctggtagttgcatgttcaaacactgccaaactttttccagagtggctgtaccatttcacattctcaccaacaatgtatgagtgatccagtttctccacatccttgccaacatgtggtgttaccgctatttttttttttttttttggccattctgataggtagatcatatcttattgtggcttaaatttgtgctttcctgatggctaatgtcattgaatctcttttcatgggcttatatgccatctgtttgtcttttcctttgaaacatttgttcatgtcttttgcccattttctaaatggattgtctattttttaactcttgagttttaacttttttacttttttgttttattagagataggctcttgctctgttatccaggctgaagtgcagtggcttaatgatagctcactgcaacctcaaattcctggactcaagccgtcctcccacttcagcctcctgagtagctgggactacagatgtgcaccaccatgcctggctaattgttttttatttttagtagaatcatggtcttgctatgttgcccaggcttatactgttgaatttcaaaagttctttatatattctagctacaggacctttgttgggtgtgtgctctgcaaatattttctcccagtcagtagcttgctttttcatcctcttcgaggtgtcttacacagagctaaagttttaaatgttgatgaggtccagtttatcaatttttccttttatgcatcatgcttttggcatcaagtctaagaactattcactttgttgaagtcaaaatgaaaatgtagagatgaatctctatatttaacgttttatttgggaagaaaaattgcaattcagggcatgcacaaagactgggtggtctttgatgtgtctggagaacacaaagaaggttagaggttttcttgaaagcagaaatgttacttagtgctctttgagaaagttccttggcactggtaagggtttggggagctgaagagttctgactggtaagtgatggtggtaagcaaaattagtcctagatctgtagcaagttatctcagcagctatagataaaactggttgcaggttgtaaaagggagtttctttcaccagccaggctcatagggaattgcatttttggaataatgttatgtaccctgggtgctttcccccactgtcctcttaactctattttagttttgtagacaagaatgatccaatgtgtatgatcaacttttacagcctagccttaggtcctaaagattttctcctattattttccccaaaagtttgatagttttttttaacattttacatttaaatctgtgatctattttgagttaatttttgtataaggtgtgaagtttagattgagggtaggtttttggcctatagatgttctcagaattctgagtttttacagaggaggagacagcctcacagattttttttttttttttgatacggggtcttgcactgttgcccaggctggcgtgcagtgtcacgatctcagctcactgcaagctccgcctcctgggttcacaccattctcctgcctcagcctccggagtagctgggactacaggcgcctgccaccacgccctgctaattttttgtagttttaatagagacggggtttcaccgtgttagccaggatggtatcgatctcctgacctcgtgatctgcccgcctcagcctcccaaagtgctgggattacaggcgtgagccaccgtgcctggcattattattattattatttttttttttttttttgagatagcgtcttgctgtgtctcccaggctggagtgcaatggcctgatctcggctcactgcaacctccatctcccaggttcagcgattctcgtgccgtagcctcccaagtagctgggactacaggtgcgtgccactgcaccttgctaatatttgtattttttggtagagacagggcttcaccatcttgcccaggctggtctcaaactcctggcctcaagtgattcatccacctcagcctcccaaagtgctaggattacaggcatgagccaccgttcctggccagtctcagagatcttaataatcactcaagatcttacagcaagggattgggagagctgagtttgttttgttgttgttgttgtttgtttgtttgtttgagacagggtcttgctctgtcacctcaaggctggagtgcagcggtgcaatcacggttcactgcagcctgcacctcccatactcaaacaatcctcccacctcagcctcccgaatagctgagactacaggcacgaaccaccacgctaattttaatgtttttggtagagacatgctttcgccaggctttgttgtttaattgagatggggtctccctatattggtcaggttggtcttgaactcctggcctcaaacaatcctcctgcctcggcctcccaaagtgttgggattacagatgtaagccactctgcctgactgagaactggatttgtactcaggtctgggagcctttctcctgctccctcctgcaatggcagtgtctggactggctcccgagaatgtgccgggcctggttagggagtagagagcaccttgattactcctcaagggactgtgtccagtgacctccttgggagggaatcattcactcagtcaacagacactggcagaagctaccatatggttgcttgtgctaagcactgttgagacccagacttttccctgaggccccatagtcatagtctgggtgggagacaggacagtcagaggtcatagagttattggtgctgtggaggatatagccccaaagcctgaagggctcagatgtccataatgaattgagaggaatgagtataagttccctgggataaatccagggaagggcagaaggtgggaagggtgttccagggagaaggaacagcaaacacagagacctagaggtgtccaggagagcctggggtgccagaagtctgggtgaaattagtcaaggagagggtggccgagcgaggtggccatagcaaggggtgtgggagggccttaattggagcctgtgataccccggcagcggctggagaggcacggagcgggtttgagcagggaagagcgtgggcggattggtgggtttcgaagttccctttgcttgcttgcagggggagtggattaggaggcacagcaaggaggtagtgcagttcgcctaataatcaaacaggactgggcattggccatggggagggaagacaaggggacgaggaggggcaacccctggcttctggtgtgggccttggctggacggggagctgatgcaaaagtggggcccagtggggagctcctaggcctgcagaagccagtaccctggcaaacccatagacccctgccagctccccagttctcactgcccccagctctgcctccccggggctgcttactctggagtcctgggggactgtgtttcaatggtgacaccactgccacggttctcataaagaagttctttcttgctgctcagcacaaacacttggtcaaaccagtgggactcggggcggtttcccatgccgagagcctggaatgggctgaagaaactcacaaagaatctcctgactcgggctttctgaaacatatatggctgcaacgcctcacctgtccctcccaggagggctgggtcctccgagtgccagtcagcctgcctaggttcagagcccatcagcagtggctcatcacctgtcctctgaatcctggaccccagtgtcctcagagttctgccatggggcccccggctctgtcttggatccgactgtgtcccccaggcaagttatgtcctttctggtcctgaaaaactaatgggggtagaggtggtagggtagggcagctggatcaaacagtgcctgaactcctcatggctctttctgggatcccttctcccactcctcctctcctcctgtgcctttcctccctcctccccaccatgcagtcacttattcattcattcaatcagtgttcccagaaagtctcttctgggcccggccctggaccaggcgatacctgggacttggagatgattcaaacccagtgtctgcccttggggagcctccgtcctggtggggaaggtagactatgtaaacaaacaactgtgattcaatctttggccttaggagcccttgggaggaagctgctactgccttgggggttgggagagtcagggaaggcctcagagcacaagccctttgcaatgggccttgaagcaggaggtaaacaagggtgtgggtgggtgttagacggacagtggtgccctgggaggagggactacgtctgcaaaggcatggaggcgtccaagtgctgggtgtgtgtgagaaaatacaagcaggtcagggtggctcgtgcacggtgctgggatgggaggttctgggaccaactgtcaagggcctcgaatgccatagaaaggatacttttttcccccaggatgccatgggctgagaggtgggggtagggaggagggtcctgagaaataagtaataggctgagagctgtgactccaaagtgtggagaggatggacaggaggctggggaggagcatgggattgggcagggtgggccccagacgggagggggaagaagctatgagcctggggggctaatgggaggagccagggaggtgcctgggggatgacaggaacctggcgtccgggaagcctggagctcaaacaggctgggctggagactgggacatgttcaagggtgccagggtaggggacactgccagggtaggggggactgccagggtaggggacactgccccaggccagctggcctgggggaaggggtgtgagacccgcccttccccatgggctgggcatctaagaagggacgtatcagaagggggctttggagggggcagtctacagagggagcaccaagtcacagaagtgtcaatgccagccgcccctgctgctgctgtgttgcaactctgcctgcccctaaccagccactgcagtgctgtcagtcagcttgtttctgaactcccccgtaatcatcatcttctggttagctctgcactctgggccctcctgaaaaccccagaagcaggggccaaagctttctagaaagtcttttatgggaggaaaaagagaatgtgggtcaactctcttcatccctacgtatcactaggccaaagtcagccccacgactgctaacaccagcaaatctcactgagcagagcagtgaggagagccccacacctcagggctatggaggtaggccggggttctgcccccacacagggcaggaggccgagggatgcctggatttagggttcagtcgggatctggcctgagcctgggaaattcgtgagtcctttcattcaacagatgagccgtgtgtaccaccccagccatgggggagatagcacgaggcaaaccccgtcctctcaggactcacctgccacagggaagtggcaagaaccaaataaacatgtccaagtcctcccagggatgacaagggatgagggaaagcgatgtggggcaaggggacagacggagaatggggtgggaaggacagaccggaattcgggaaggaggcagtcctcaggcgaggcctggggcaggcctcaggtgggagcgaggagggacttgtggggaggggccaagggtctggatcacccagggtcttgtagactgttgagaggctgagtggctggagagtcctgggcatcagctcagctctctgcagcaggaaatagcctggcgtaaagcttggaccccagggttggagacaggggtgtggatgggctctgaccccacgtcctaagccaggaagttggagcaggcaggcctcgccagcccctgagctttcaccacagccctgctgcatgagctgcagctgtgtgacagcacactcaagccggctgcccatggacagacgcgacttgttgacttgtcgctgagtgaacacaaagcccagggaacaggttgagggcctggggcagggcccatcctgcaggcctctctcttctctagcctccatttccccctttggggagaatggctggggacgaggggggcaagggaggctcaggccccaggtagactctaatggcggacctcacacagcagagccaacggcaggtgagccccctggccaagaagtaggatcaggaagaagagttatgatggagaacagcagggaaaaggattttcagaggccatgccctccctgtggctcagattgtgaaactgaggcccaaggccaaatggtaacaggtcagaggcattgatggagcaggtctgggccaggctcctgcccccagccctatcttgcccaccccaggtgctcatgtctatgaggagagacaccaagtgtccgtctctcgaacagatgatgtgggctgcgtggtgccgtccgagtgcctgcgggcctgcggggccgaggtcggctgctccaacatcgcctaccccaagctggtcatggaactgatgcccatcggtgaggctgtgtgggtgggggtctgggtggagggcgtggggttggacttggggcccaatgagtatggggactgtggaggctgccactcactggccaagaaatttggggcatgtcacttccctgcttggagcctgggtgtcctcatttgtaaattggagataatggcatctacccacccctcagcgttgttgctgggattaaacataatgacacagggaaaatgctgggtgcaggcttggccatgctgtagttcccaccttgggccttcgcttttctcttctgttctgggcaaggggactcgctaagccctccagggctgacaccgagccattgttgggccacagtccctctctaggtcttgagttccctctctaagaaatggatggaataagctccaagttcatccatctccatgagcaagacaagggagtgggtggagaaatgttttggggaaaactgtgatttgactcactttcctttgggctccatcccaaccagcttctgacaagtgaacagagagcccagagacacctggaagtcacacagccaatcagacacagaaccgaggccagacaacccagccaggcaataaatggctgtgccttccgggcaggggggcctatgtcaggcttatcctaggacagacgggcaagagtttgtagaggtaaaggaggtgcttaaaattgcaggagttcttgtagacagacttgaactcatccccagagaggggaggcgaccagcctgaagccacacagcacagagtgggcagttgagcatccttccaccttccttagggctcctcaccctcaggccctcttgagcccacaactcccagaaggcctttcacagcaatgctacccgcacctcctaggggagccctcactcccactctggaaaaccacagagccaaggagagaggggatccactatgcctgctgggtcctgccatgcacaggaagtggcggaaaattccagagactggggcactgcatgctggggtgaggtgtgcatcttgcccagggtgtggccttcaagcagaggccccgcccaagccttcctcaccaaccccaccgcaccccaaagtcctgccgctggcctgctgtgaatccctgggcaatctcttcacttctctgagcttccatttcctcatctgtcaagcgggttaatcatgctttcctcggacgaaggcatgggtgtgaaagtgctttgtcaacgccaggctctgcagaaaggacaggcctgatcgcagcctcagcattatgagtaattatggtcgggcctagggttgccagcaagcctagggctcaagcagccagctccgaagtccccacggtttgtccttggcctccccagtctcctcattctgggtcttgctcacctcaaacctcctcagcttctctccctccccgccctctgccttggaggagcatgcaaatggcgggcgggcctcaggcattagagcccaggcgggaggggttcccggggctgtctcaaggccggacagggtcacacatcccccgtcccaccccaggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggtacgggggtgggggccagtacgggggtgggggaacactacaagggtgggcgcccgcactgactttgagggatgagccggagtttgccacttagagaaaggtggatgccaggaaggagggaagagaagggccagtgtaccccatccataccacctctcacattgctctcctgtccacctctgtgtgatcacagccctcatctgggatgcatctccacccttgagctggattccttctgcaggggccagccctccctccccaaccatgccacagatctctctatctccccgaaaacctgggcccccattcctcctgatggttcccagctgcgccacagagggcccccgggccagcactcaggactggccacacttgggctgccacgtccctcagcctccatggccctggccctactgagctccagcttgtttcctcccagcccagcttgtcccctcctttttcacctcgatgactcatgctgatctttctggactctgcctgtgtcccctcctccgtgcagtcctccctgagaccctcaaccaaggaatgagcctctctccccttcataccccagggacgcttgccagattcttcccacagcacatgtggccattacaggccaagagacctccccgacacccttctccaaatatctgggcgcttcatgaggaccggggctgtgtctggagaacaggtggtgtttggttacatgaataagttctttagtggcgatttctcagattttggtgtatccatcacccgagtggtatacactgtacccaatgtgtagtcttttatccctcacaccctcccagcgtttcccctgagtcctcaaagtccattgtatcattcttttttttttttttgagacagtctcgttttgtcacccaggctggagtgcagtggtatgatcttggctccctgcgacctccacctcccgggttcaagagattctcgtgtctcagcctcttgagtagctgggattgcaggagcgcaccaccacgcctggctactttttgtatttttagtagagacagggtctcaccatgttggccaggctggtctcgaactcctgacctcaggttattcatccacctcagcgggctgggattacaggtatgagccagtgtgcccagcccatcctatcactcttatgcctttacatcctcagaggttagctcccatgtgcacgtgtctatttgcgccctccctggccctccagtcccaccctcttgttgtcctctgagcagtgtggctcacactctgctgctcgggggtccagccttctggcacaacagagcaccccctggccaggagcccagggcacccatcctgggggtggggtctcctccagagctccaggcagctgtcccagggatgcaaaatagtcaggcttctgttggaagggccctgttgggacacgccagaggcgggtgcgagtgagctcatccacgggctcacaggattctccaaaacaaggagcctcccacctctcactgggcaggacacttccatgtccctgtgtcctgggcacttggccccttgaccacttctccccctctggctcccctgcctctcctcagaagctgtgtggcctggggaagaccctgcccctctctgaccatgtgtctcctctgaggccagaccttgctctaagcccctccatgctccagcatcctgggccctgggaactggatgccctcctgccacccagtgtgtgacactggtagcccctgtacctgcccagtggccctcatgtcccctgcccactacttcctggcctcctcacccagactcccacctgcaaccaaaagtcttgacctggcctcctgctgcgccagctcacccagctgcccgtgcccttgaccctccttcccacctcttctgccaagtcaacccccgcccctagccctgcaagcctggcagtcggcctccctgaggagcaaggcacaaggctgcgtggtgcagggcaggttgctcaccctctctgggccccagttctctcagctgccagctggatagagcagaaagggccccgtgccaggtgtcaggctggccagctcaacttcccgtccctcttacagcactgggataccctcaacacccccagcccctcaaagccgtctcagcttcctcctgcccgaaacaccaccattggagcggtatctcctaggcctcgtggtcatggatctctggtagggtgaatggcctgacaacagtctctgtcagggagaggcgaggcttacagagagaagaccaacagcccagaggcctggagaggaggccatcgcagggccgggtgcagtaccatgccggtgaccctgatggctctgtccagctgagcagaggctggaggagccgtcacaggctgggggagagcgatgacccgcccccactcccgtatgcctgccccaagcccccacacctcagtccactgttccgccactgcccccctgccccactctcccctgtctgtgttcccggctgttcagtccgtaaatggggcccacagcctcctggaaaccctgtgcaggactcggagagatctcagacacccctccttgagatgttccacagtaactgtggctgcagcccagggagatgctggagggcactatccaccctgatggtggcatgggagggagtggcattccaggcagaaggagcagcctctgggtttgggggtcctctggcagccaggtaagaaggctgggtaagaaagcgagggcctggctggagtggccccagccctggcacagagatgcagagtctggtgttgggcgggagagctgtgtgcagagggcggggtgggcaggcgttaatggaggcccgcctgggcctttgatgagggcagcgcccgcctgcctgcctggctaggggttaattagccttaatcaaggtggcacctccttcctccaccctctccctcaggcctagaagggaagaaagggagggaggaaggcggacaggcgctgagaggacccaccctagctgaacacatagcctctgtcacccctgccaccacagccagggttccagcgggtcacccaccacccaccttgggggtgaggaatgccaactgacccaggacacaggggtgaggtgctcagccagggaggagcggatggatgccatgccccagcttcatccccttagctgggtcccatgcccctcaaggctcggggagggggtgcctcctcctgaaagccctcctagattgatgtttcctctgagctgctccagcccagtccgagtgtaggtaagaggctcatctgttttctttgctggactctgagtgctgggcaggcaccaggtcccactcatcgccgagttggggatcctagggtagtgtcctacgcaggtgagcacctcaccagtggtttgttggatgaacaagtgtagcatgtgcctgttgtagaggggctcttggcctaagggagaggcaggcaggagctgacacgcaggggacaggaggggacgggctcatgctggcccagcagggctccggcttcacagctggggagtatgggctctaaccccaacccacacctctggctccaaactttgcatccttagtaagcaggttgccctgtgaaggatgtgcagcacagggctgtcggggtggggatgtgccagccagaggtcccagctcccacaaatgccggccagtgtgaaaaatcctagtgtcttcaaataaccaccaggaagtcagtctggcccagatcggggggcagtggtcattcatgcactcaccaaatgcttagtaagcacctactatatgctgggagacacagcaatgaactaaagagatgaggctcctgctctcctggtgcttccattgggaggggaagacaggcagtaaacaagtagacacccaggtaaatgtgcatgtagtgactgggacaggtgctttgaaggagagacaagagggagctccatggcggagctccaagggctggctccgcagagaccccagggcagggaaggagcagacagcacttagagtcaggagctgcacctgcaggatccagggagccaccaaagggtttggagcagggcaggactggccaggtcactggtggtgtggaccagagtccagggaggaggctggagctggggtagcaggggaaagattagagagcaagtcttagtgaccaggggaggtgggagagagctgaagagcctcccacgacgaccgctgcctgccttccactcgcctgcaggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcaggtgggcgtcggcggtctgctctccctggggacgtgccacaatttgctcttccctgctgcctgtggggggagccttggtcctcctcccgtagccccacatgccctgcctccctcctccccagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccaggtgagccagccctgacccctgaccctgacccctaacaatttcttactctggtcccattctcatccccgacccactctgactcagaattttctagccctggactacctagccccgtccctttttgaactcagctgccatcttgccatccccaacctttgatcctgtctgggtcacccccaccctgccatcccccacccccaaccctatcctcactcatttcttacagattgagaaccttacctggtggaccctggctcaggatgtgcccttgggaactaaagcaggtaagtggatgaccctaggcactcctccaccttgaccctggcctggaggcaagggcaccaggtgtaaccttgtgtccttcatctgtccctctccttctgcaaccccctccaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctga

SEQ ID NO: 1204 - DNA, 1153 bp, Homo sapiens
taatccaggacttcttggtaaagttgactgaagctatattagatatttccccacaaaaatactatttgcattctcccactccctccctcccttgatgggacaacatcctttatttttccttgggcatacatatcattacttccaatttgaaacaagttagtataagagggagagagagaggagaggagaggcagagagagaggagaggagagagagagagaggagagagagaaaggagaggagagagagagaaaagattgagagaggggagactgttttaagtggtattatttttcccataggctgtccttgtcactctttcatggctacagtttgatcggaattagctgccagggcctccgccggcttgggctcttctgcggaggctgtgggggcccgggccttgggtgtggaactaggggcttcctggctgcggggggtctccttggaagagggggcagcctccgagctgctgcggtttgcgtatcatgctggagcccgtcacttatggtctcctgggtggcaggagctgcaggcgccttagtctttttaggtttcccttcctccttgctgggctcctccccagtggtagggtccgcgctcttggcccgggccgtggtgacttcggcagctttgggggcctcgccgccattagcagggacgggggctgcctgctctttctcggggggtcagccttggcctctgcgcgctctctgtcttctcgggctcttccttcggggtctcctccttggcagccgtggcatccttcttgccctctgtctcctcggccttgccctccgcgtcctggtcagacttcttgccctccatggcctcggcgggctctgcagctgcctggggctcactctccttcggggaccctcctcttcccttgccacgccctcatccttcttgtctttgtccttggctttctcgtcgttcacattgtagcccttcttcttgctgagtttgcctgtcatcttggagtttggctctgggtgcctgtgcagcccctgggtgagcgcggtgcccccaagaggccagggtccctggcggtgtctagctcatgcctggccgctggcggaggctctctcctggctccatggcggaggccagagcgaggagccagttgtagtgctagctccgcctttgtcgc

SEQ ID NO: 1205 - DNA, 62380 bp, Homo sapiens
cagggcggggcgcagcgggcaggcaagggcggccgagcgggcggcgggcatgagcggggcgggcagggcgctggccgcgctgctgctggccgcgtccgtgctgagcgccgcgctgctggcccccggcggctcttcggggcgcgatgcccaggccgcgccgccacgaggtgagtgcacacctcctaccgccgcccggccggctacgagcgcagcgtctcctctccgcggcgccgcccctatctccgtgcgcggcgccgagcgctaggccgggccggaaccgcccccgtggcctgggctgttgctgcgacttcgcggtcccgcgccccagaccggaggccggacttcggggtgctgcggccgggccccgcggaggcgggggagggggcggttcggaccgcggcggagtggaacctgggcgcccaggcggcgcccaccccagcggagcctgcgtcctggcgccttccgtctaaacagaggccgcggatcgggacgccgggaccccacaaactggcagccaggaggcgggccagccgaggatcgggggggctcggactccccctgcacccagtccactgttcggagggacttagagcagggtcccttccctgagggcctcgcccccgaggacgtggcgccggagccgtgcgacccattggcttcagcgggtgggaagcctggggccgggacgcgcgttcgccccgcgctggggttgaacctgcgtggatgtgcggcgggtgaggaaccgcggagaaggcggtgggggcgcggcctgcagcccggtcccgggcgagccctccgcgcgtctcccctcggcgcgttttccctccagggtgactgggaagccgccgccgccgccgccgccgcctgggaggggccgggctgggcgcttttgccccgggccccggaccccgggcgtttgtccggtgcgctggcttaagaggcgctcagctcataccgtgattgcacaactggcttgctctccgaactcggtggggaaaacggtgacaaatacagattccaggtctccatctagacccctgcaccggggagccccaggccctaggtccttcgcacacgcccctcccagaggggtcgggcaagcatcgcaaacccctttgggtaggagggacggtgggagtcacctgtctttcccctctcgcgcccttttcttggtcagaatacgaagttttagtgtctgtgtatggagttcaaacgacccctcctctccaagcagaagctggaggagaaaggcgttgtgaattttggaaaagcggctcagaggattacattttgtgcgatccttgatccacccaaccttcatctcctgcgctcccctcctttaaaattgcaaggaccccggggaggttatgtaatctgcctgatcacaatttgtcagggactgatcccgccgaacactctttgcattttagcgccagtattagcttatcaaagggcacttacttttagagagaggtggtttgtaaatagtaatcacacgtagtgaggggaagccgcgttgggaccgcaaggctttccctgtcacctggagcccatgtttgggccgcacagctttcctactaaaaacgtcatcatcttccttctttttgaaaattcagcatttgcttgaagaaaaaaaaaagtagactatgtctttaaaaatatgcccagcaaagataactcacgagcagagagctagaccagaaattaaatatttggaaaggaaataaaggtgtaatacacaagcagcacatttatccccgcaccattggaaggtgactttatttggtaatttgcccaccaagacgaggtagaccagaggagagagaaggaaataattgttcttttgtctgtaacgctctgggggtattgccctggaatttcttaggtcagctgctgtgtgggaaggtgacagctttttcttgaagctgaacatcaagctcagtttcgaggtcatatttgatgacttatttgatggcttagtaattgggtcctttggtcgtgtctgtaagtgatacagactgttattattatttttaaaaaccacattcaaataatgcaaagtgaaaaaaaaaggtgtcaaaatccgctggcgttactctgacagtctctagctgtggttccctagctgtggtcttcaccctcggctgcacactcgaatccctttgggaggttcgttgttttttgtgggaaattaaaaaaatcatgctgattgggcagagattctgatttaattggtctggaatggggccagggcattggtaacttttgtagtttttttagagcttcctcaggtaattttgacattcaatgaagactgagcccctctgcacattcccaaatagcatagttagtaacaatgacaatgaagagctttcagcctaaaattcgtgtggataatctaagtataaaacaagtaccttattccgcccaccaccaaaggcttagagaaacatgagtacacacagtacttattccatctacgaagggatgatgatgtgtggagaaattacgaaggaaaagctcatggcttcatggtctcttgggtatgatcaagtgtaggaaaaagtctacagagagtgactagaaatgtgaaaatggaagccattaaaactgaagaagggaaatgaaaaagaactattttaaaacgatgacaaattgacaaaggatttaatatttttgtctttaatgtagagaagttatgcaaatacctcagaaggtgtcagggattaaataaaggtggttaaataaataaatgattcaggaattaatatgaaagtcacatactgatggtaaacatttggaaaacatgttcaaacttgttaatcacaaattcaaaactaaaataattaggacgtgccattttctatccaccaggctaacatatgagggaaacatggaaaggctaatctggctgggcttatagggagggatctgttgaggctcaggagactggttagccgttatgtgcacagttagactgacctcagcttaaatcctggctgctagtaggtgactttgggcaagctgcttgacctcttcaggcctcagatgcctcatcccaaaatggagacaccaggagctatttctttctttcttttttttttttttgagacagagtctcgctctgtcgcccaggctggagtgcagtggtgcgaactcagctcactgcaagctccgcctcctgggttcacaccattctcctgactcagcctcccgagtagctgggactataggcacccaccatcacgcctggctaattttttttttttttgtattttttagtagagatggggtttcaccgtgttagccaggatggtctcaatcccctgacctcatgatccaccctccttagcctcccaaactgctgggattacaggtgtgagccaccgtgcctggcccaccaggagctatttcatagggctcttggggcctggtggttctttggtaagtgtggttctttgtattacctgggagatctcaaccatcacagttgtcattagaaatcagcacaactgaattggagagaaattttgtaatgcatatcagaagctattcaaaagcctgtttttggttaaagattttactcttgggcccggtgtggtggctcacgcctgtagtcctagcacttttgggaggtcgaggtgggcagatcacttgaccccaggaagttgagaccagcctaggtaacatggtgaaaccctgtgtctacaaaaaaagacaaaaaaaaattagctggatgtgctggcatgcccctgtagtcccagctacttgggaggctgaggtgggaggattgcttgaactcaggaggttgaggctgcagtgggccgagatcttgccactgcactccagcctgggagacagagcgagactctgtctcaaaaaaaaaaaaaaaaaaattttaactggatgttcccgatcctgaagaggctctgttggtctctgcattggttggatgtggcctggatcactgtaatgtctatgtgttgagcacttgtttctgtgccagccactttgtagatggtcaagtttagatttcccaacggtttcatgaggcacatactcttatgacccttaatttattggtgaggaaactgaggcaagttgggcttcagattcaagtttaacttgaatttatcccactatgtcatactccaggtcccaaacatcgcttccactgaaagctttccaggagaccaaagaacagaaaaaatgattgtgaaagctttctttggcctagagaaccaaaagctatagtggattattattattattattattttgctgaaagctttatttgttctcacttagggtaaatgaaaaatttcaagatttggctacaacttcattctttgaaaagtaatgttttacagaaagagaggttaggggtactggctctgaagacaaagcttagattcaagcccagcttcaccacttacaccagtcccctgattttgccgtttccttgtgatataaggcactcaggaacacaagccaggcacacagtaagtgttcaggaagtgctggcattatgaagttcaaacagcaccactggtaaatgaagttcagatttcagaggtggagactgtgtatgcagcctcacagctaagtggatgccatggtgaaatgtttagatcataggcctttgagaagaattatcagaatgttagaggaatgggcctcccttggcacccagaaataaacgttaaaggaggctatttcatcatataacaacttccgaacttctagaaaagtgaaaagagaggcttgggtaaggaagatgaaagccctcccaccaccctgcgtgctgacctagggcatccttccttctactctgttgttagatcctcatgatggccaaaaaaaagcattctttaacctaaagcatccccatggctcaatctctaccccttcatcaccaaggaaaagccagctctagtggattaagagttttatactgcagggcttgtcttcactgagagctaaataagggtaaagtaagataaacttaaaaatgagggattgaggcccggcacagtggctcatgcctataatcccagcactttgggaggccgaggcaggcagatcacgaggtcaagagatcgagaccatcctggccaatgtggtgaaaccccgtcactactaaaaatacaaaaattagctgggtttggtggtgcgtgcctgtagtcccagctactcaggaggctgaggcaggagaatggcttgaacccgagtggtagaggttgcagtgagccgagatcgcgccactgcactccagcctgggtgacagagcaagactccatttaaaaaaaaaagaaagaaagagggattgagctggctacgtgaagaattcatgattctgccattcaaatgagtgactagggagcccagaggaagctttcccattacaaaatagagaccgagttcttaccttcctcattgtgttattaagtagttccccatttttttcttttgggtaaatttactcagaggataaattaacttctcttttatataatatcatataaatggcccagttggttgacatgaaccactctgctttgacttttagacaagagcagttcactttatttttcctaccaaattggcacacgtgattttagaatgtgcgtcatctttctgtcatcctcagcacatcatctagtgaactggtgagctgtgtgagtttctggattggggcatgctcccaatccaggattcactgctcccaatccaggagcagtgagtttctctgcccttcagactgaggcttgtcttaaaactgtctgcttacccctctccgatctgccatggaaattaggatattccaaactccaaaacaaagtgatagaaagcagcacttctcaaactttcaagacacgtgcaccccgcccctgggcctcgctaacctgtctgactcaagcaggttctgcatttctaacaagctgcctggctacaatcgcagctcagtaacgtggtaggggagaaagcttgaactttagagtaatacaaattgggttcatatcaattatttcattgaaaaaccgtggtcacaggcagttatctaattcttgagaggcttaatttattcatctgtaaagtggggaaaatacctagctcataagattgtcattattatagggaaactactaaattcagtacatgtcacatcttagcactcgatgaatataagttccttacacgatcctttgatgcactagatttgagtggtgttgactgaatcctcttgtagtagagacatctgtgcaaaaggagacctgtgtgtgtgcacatgcatgcatgtgtgtgtgtgcacatgcatgcatgcacgcacatatatctgcgcatacacaaagtaatgtgtgagagaccccagaaatcccagagtgtaagcttttgagaagcactactggaagcaactgttcacacgaatgtactttgtctctaacacatctttcgggtgccttttttttttttttttaacttttcctaatttctaccagacttagacaaaaaaagacatgcagagctgaagatggatcaggctttgctactcatccataatgaacttctctggaccaacttgaccgtctactggaaatctgaatgctgttatcacgtatgtatcagttcacactcagttctgtttgctttggggcttgtttgatatgatccttaatgctctcatgtctaaagcccttcacaagttaatttcagttttgcagctaaagaaacaaagaagctatataaagagtcggaagaaatacagtcaggggaggatgcctaggaatgcacagcatctatttttatcttttcatctactcatcctttaaaaagccagttctcagggatgaacaaccttgatagactatgttttattttcctcctctctagtgcataaccctcttgctggaccagagaaggaaggagtgagacaccagggtattctccaggggccagcagagtggtgcaagttgagggagtggcagttattccagggccctgcctccctgatgataacaaatgcattttctctgaaggttttactcctattctagaccttgttgctttttaaggacaaggctattctttcatgtaaaataaaatattctactatgcaaccataaaaaaagaatgaaatcatgtcctttgcagcaacatggatgcagttggaggccaatatcctaagtaaattaacacaggaatagaaagccaaatactgcatgttctcacttctaagtggagctaagcattgggtacttatgaacataaaggtgggaacaggagacactagggactatttgggctgcagtacccaagcagtactgaaaaacttgggtactagagctgagtagtacctatagggctgaaaaattacctactaggtactgtgctcaccacctgggagacaggatcattcatgccccaaacttcagcatcatacagtatacccatgtaacaaacctgcacatgtgcccctgaatctaaaataaaaattgaaatgataaaatgtttttgccaggcacagtggctcacgcctgtaatctcagcactttgggagaccgaggtagggggatcacctgaggtcaggagttcgagaccagcctgaccaacatggagaaaccctgtctctactaaaaatacaaaattaccgggcatggtggcacatgacttgtaatcccagctacttgggaggctgaggcaggagaatcgcttgaacccaggaggtggaggttgcagtgagccgagatcgcgccattgctctccagcctgggcaacaaaagcgaaactctgtctcaaaaaaataaaaagaaaaaatttttattgccaaattgagagcttcgttatacctaccatcagaggttgaattttaatttatatttatatttaatttatattaaatttatattaaattcatatatatagtaatgctatatcaaggtgttatgctgtcgtcaaggtgttaggtgtagggcaagtaagaccattattagaataaaacaagtaggatcattggcatacaacagtgatgctgtggacaaattaaagaattaaaaaagaggccaggcatggtggctcacacctgtaatcccagcactttgggaggccaaggagggtggatcacctgaggtctggagttagagatcagcctggccaacatggtgaaaccccatctctattaaaaaatacaaaaaattacccgggcatggtagcaggtgcctgtaatcacagctacttgggaggctgaggctggagaatcgcttgaacctgggtggaggcggaggttgcagtgagccgagatcgcaccattgcactctaacctgggcaacaagagcgaaactccgtctcaagaaaaaaaaaaaaaaagaaagaattaaaaaacaggaagacaggccgtgcacggtggctcactcttataatcctagcactttgggtggcctagtgggcagatcatgaggtcaggagtttgagaccagcctggccagcatggtgaaaccccgactctactaaaaatacaaaaattagctacgcacagtggtgtgtgcctgtaatcccagctacttgggaggctgaggcaggagaatcgtttaaccccgggaggcagaggtggcagtgagctgagatcgagccactgcactccagcctgggcatcagagcgagactctgtctcaaaaaataaataaataaataaataaataaataaaggaattaactacacgagactgttttaagaaaaaaattgccgatttatttaaaagagcatggagataattatgtcaggaaaatgtataaagaagtgacacagggtttgtatttaatcatagtggtagaaaatatcccattattgcaaaaaagattttaccctggaaactggaaagacacttatgactcttttaactagagactgataaaattatgtctagacataaacttttaaattttgaaatttaatgataatttttaaaattttaggccgggcgcggtggctcacgcctataatcccagcactttgggaggccgaggcgggcggatcacgaagtcaggagatcgagaccatcctggctagcaccgtgaaaccccgtctctactgaaaaaatacgaaaagttagccaggcatggtggcgggcgcctgtagtcccagctactcaggaggctgaggcaggagaatggcgtgaacccgggaggcggagcttgcagtgagccgagatcgggccactgtactccagcctgggcaacagagcaagactctgtctcaaaaaaaaaaaaaatttttttttaaattttaagcagatgtagattataggagacacaagtatgcaaaaaatgcaaattataataacttcatacatttagtaaaccagataataaaaatctggggctgatggaaggatatctttaagatatttaaggtgaaggtatgcccaagagatcagttactagctgagttgaagaatttcctgttctgtttccctctttatctcacttccttaaagtagaaagaccttttattttatttatttatttattttaagacggagtcttgctctgtcgcccaggctggagtgcagtggcacgatctcacctcaccacaacctccacctcctgggttcaagcgattctcctgcctcagcctcccgagtagttgggactacaggcgcccgccaccgcacccagtaattttgtatttttagtagagacagggtttcaccattttggccacgctggtcctgaactcctgaccttgtgatccgcccgcctcagcctcccagagtgctgggattaccgacgtgagccaccgcgcctggccaacatttagttttttataagtaagatgttctcagtatggtaaacagttaatgtttctgtatctttaaaatattgctaaaaaaagaagactgagccctgcgaggtagttcacacctgtaatcccagcactttgggaggccaaggtgagaggatcacttgaggtaggagtttgagaccagctggggcaacaaagtaagtcctcatctctttcaaaacaaaacaaaacaaaaacaagactatacaatgtggaaaatacataaaaaagaaaagatattgtgagtatttaaaattgcttttggaggccaggcgcggtggctcacacctgtaatcccagcactctgggaggccaaggtgggcggatcacaaggtcaggagatcgagaccatcctggccaacacggtgaaaccctgtctctactaaaaaatacaaaaaattagccaggcatggtggtgggctcctgtagtcccagctactcgggaggctgaggcaggagaatggcgtgaacccgggaggcggagcttgcaaagagccaagattgcgccactgcactccagcctgggtgacagagcgagactccgtttcaaaataaataaataaataaataaataaataaataaaataaaattgcttttggaaagagaagagctatatatatatacattagtaaataaagtattaaaaactaaaatattgcactcataaagaatacaatgaaaacttgtactttttgatgaagtagatattagaataaaaggggctagttaagcatttgcataaatagtaaatactaatgctaaaatatgaacaccctaaataaaaaggcaccaaatttatgtgggtccccaaagtacatcgaaaataatggtagcagctaataatacaaaacaaagtcgtagtagagacaaatgataagatactcttaccagggcaaacattttgaaggtttcatcatagagctggtgaactgagctgaataatgtcagggagtgaggtggttaagagcttggattctgcagtccaagtgtctggtttgaatcccacctctgtcacttgtgttactttgggtatggttctcaccttctctctgcttctcttcccctgtgaagctggaaaaataacggaacctgccgctgagctccttgggagtgtttcgtgactgagtgtctgtaagctgaagcagagcgagacctctccacgtgtcagtgttactggcaatagaaataagtaacacgtgtggcagaaattaaatgaaaaaagtagataattaaaaaattcctgtatatattcgtttcacaaaacactcatcatatgttaagtcaaaagagactggataaattaaaaaaagcagggattatgtattctacctcatacttctgcacaacaaagaaacaaactaatataataagggttataatataaatacgagcatttcgttgaaaatctttagatcaggccaaagcaattcctatgaaaaaaatgcatgtaaatgttcataataataaagacgatggtaatagaaattgcagctactgtttcctgaggacttgttcagtgttttaggtctgtctcatttaacttacaacactccagtagagagattctatccaggagagaggatttgctggagatactgaaattaagagaaataaagtgacatttttctgggttacctagctgttaggtggcaaagctacaattcacccctccctgtagctttggaggttggtatttatgttaatcagaaagaaaaggggaggctggatgcagtggttcatacgtctaatcccagcactttgggaggcccaggtgggcagatcacttgaaggttgggagttttgagaccagcctgaccaacatggtgaaaccccatctctactaaaaatacaaaaattagctgggcatggtggtgggcgcttgtagtaccagttacttgggaggctgaggcaggagaatcacttgaacctggtaggcggaggttgtagtgagctgagagcatgccattgcactccagcctgggtgacagagcgagagtccatctcaagaaagaaaaggggaaatgcaaagctattcagtagggatctcaaggtttttgaaagcaaacagtgtaatcatccaaacaaaaagaaaaagaagcaataatattaataaatacataaggtagaaaatgatagcagaatcgaagtaagaacaagctgagaaatgattttttatttttgaggcagggtcttgctctgttgcccaggttggagtgcagtggtgtgtgatcatgactcactgcactctcaaactcctgggctcaagaaatccttctgcttcagcctctcaagtagctaggactataggcgtggaccatgacacccagctaattttttatttaaaaatttttgtggagacaaggtcttgctatgttgctcagactggtttggaactcctggcctcaagtgattctcctgcctcggcctcccaaagtgctagaattacaggcgtgaaccacagatctggatgaaaatgatacatttaaatgagaaaaataaaggttaagtggagagatagccaataaccattgatatcaagactaaacaggaaaaatatcagtgtttcccaagttaattaatatacttaatttctattaatatgtaaatagaattcattatatagtctacataaataatttcaaaattcatatgaaaaagtaaatgagtcagaggatcaaaagacggcccaaattggtctgagtattgtgggttattgttaagctgatttaatattgtctcccccgacaaccatgcttgactagcttaaaagaaaaaaaaaaaggcccaaaaggagattgggcaatgtggagacttgctgtattagataagatatattgtgaggccataatcgtttatgtagccaaaaaagagaaatgaagactaacagaccaatgtaagtgtgagaagtagaatctaatttatgtaagaacctagagtattataactaagaccatggggaaaggtatttaaaattactgtataccatgtatcaagtactccaagaggattcaagttaaaaagtaaacccacaaactaaaaaaaattttaaaaggcagaatacatttttaaaaagttttttttttaattgacataataatggtacatatttatggggtacagtatctcgaactgctgagctcaagtgatccgcccacctcggcctcccaaagtgctaggattacaggtgtgagccaccgtgcccagccaatgtacacgttgggtaatgatcaagttagggtagttaacatttccatcaccaaaacacttgtcatttctttgtggtgcgatggttcaaaatcatctcttcatctattttgcaatatacattacattattgttaactatagtcaccctactgtgccatgtgtcaccagaactgatcccattgtaactgtgacttttacacctgttgatcaacctccatatctcctctttcctactaacctctatttactctctacttctatgaggtcacatttttagcttttacatacgagtgagatcatgtggtatttgtctttctgtgtctggcttatttcacttaacataatgtccattaggcttatccatgttgctgcaaatgagaggattttattcttttttatggctgaatagtattcctctgtgaatatattgcacatttctttgtccattcatcggttgatggatagttaggttgattccatatcttggctattatgaatagtgctgtattaaacatgggagtacaagtatctctttgacaaactgattttcttttcttttcttttttttcttgaaggatgaaaatgagattgatctttattgtagaatccaggccagggggctgctttgaaggcaagaatttcatgctagaaattccttattagccacacaaacttcttgtagcaagatagacttgtattactttttttttctttattatactttcagttttagggtacatgtgcacaatgtgcaggtttgttacatatgtatacatgtgccatgttggtgtgctgcacccattaactcatcatttaacattaggtatatctcctaatgctatccctcccccctccccccaccgcacagcaggtcctggtgtgtgatgttccccttcctgtgtccatgtgttctcattgttcaattcccacatatgagtgagagcacgcggtgtttggttttttgtccttgcgatagtttgctgagaatgatggtttccagcttcatccatgtccctacaaaggacatgaactcatccttttttatcgctgcctagtattccatggtgtatatgtgccacattttcttaatccagtctatcattgttggacatttgggttggttccaagtctttgctattgtgaatagtgccgcaataaacatatgtgtgcatgtgtctttatagcagcatgatttatattcctttgggtaatccagtaaagggatggctgggtcaaatggtatttctagttctagatccctgaggaatcgccacaccgacttccacagtggttgaactagtttacagtcctcccaacagtgtaaaagtgttcctatttctccacatcctctccagcacctgttgtttcctgactttttaatgatcgccattctaactggtgtaagatggtatctcattgtggttttgatttgcatttctctgatggccagtgatgatgagcattttttcatgtgtttgtgggctgcataattgtcttcttttgagaagtgtctgttcatatccttcgcccacttgttgatggggttgtttgtttttttcttgtaaatttgacaaactgattttctttcttttggatctatacccagtagtgggattgttggatcatgtggtagttctattttaatttttaggaaccttcatattgtttcccacaatggctgtactaatttatattcccaacaacagtgtgtaagagtgcccctttctccacatccttgccagcatgcattattttttgtctttttgatagtagccaatctaaataactgagttgaggtgatatcttattgtggttttgatttacatttccctgattattagtgatgtgcattttttcacatacctgttgggatttttatatcttctttttttcccctgatacataatagttgtatatgtcttttgagaaatacctattttgatttattgcccatttaaaaaatgagccttttttttgctattgaggtgtttgagttccttatatattctgtcagatggtagtgtgtgaatattttctcccattctatagcttgtttcttcactctgtggattgcttctttcactgtgcataggcttttttactttagtataatcccatttgtctagatttgcttctgttacctatgcaccagtgtcatgcaatgtttcccccatgcttacttctagtagtttcatagtttcaggtcttacatttaagctgttaatccattttgagttggtttgtgaaagatatgagagataggggtctagtttcattcttctacatgtaaatatccagtttcccagcactatttattgaagagactgtcctttcctcaatgtgtgtccttttttttttctttttttaagatggagttgtgctctttttgcccaggctggagtgcaatggcacatctctgcttactgcagcctctgtcttccgggttcaagtgattctcccatctcagcctcctgagtagctgggattatagacacccactaccatgcccggctaattttgtatttttagtagatatggggtttcaccatgttggccaggctggtctcgaattcctgacctcaggtgatctgccagcctcggcctcccaaagtgctgggattacaggcatgagccactgtgcccagtcacctacttttttgatgtagacatttattgccataaacttctctcttagaactggttttgctgtattccataggttttggaatgttgtgcttccattttcatatggaaacaacatttttagttttaaatttctttttacattttctcaagaaaattttaaatttcttttaaattttttcttttctgagacagagtctcactctttcgcccaggctggagagaagtggtgtcatctcggctcactgcaacctccaccccctgggttcaagtgattttcctgcctcagcctcccacgtaactgggattataggtgcccaccaccatgcccagctaatttttaaaattttttcattgactcattggttattcaggaatatgttgtttaattttcatggatttgtacagtttccaaagttcctcctgttactgatttttagttttattccattgtggtcagaaaagataattgatatgattttgatttttaaactttgtttagacttgtttgctccctttaggtctattaataattcctttatatatttagttgttacaatgttgggtgcaaatatatttataactgttacatcttcctgctgtattaatcattttatatggccttttatataatggccttctttttctctttttacagtttttggcttaaagtctatgtcttttgtattagtacagctactcttgaccttttttgtttccattttcatagaatacctttttccatcccttttctttgagtctgtgtgttcttaaaattgaagggagtctcttgtaggcagcatacagttgggtctgttttttttaatcctttcaactattctatgtcagcagaatacatttttgaattaatgaagcaatagaagaaacaacaagccagattagtatggctatattaaaaatttaaaacttataattgaaaacataatatagcaggatgaaacagaaagcactagaatggagaaatatttgagagggttaaaagtttaatattatagtatatgaggacatatttctaagattatgtcaagggaacttggtatgtaaacagtgtttcacaccataggaaacaaaataacaaaattattgaattatttaatttgtgatcattttaaaatataatcttaatgctgtgatataaatatctagtaactgaacaaaaaatgattttaaaatcctagtaaagctggtgagaaataaatatattgctttaatttgatttatttaactaatatttggtcatttgtaacgggagctattaaaatgactatttttttaatccagtaatcttacccttagaaatctgctttagagaaagaattgaaaagaataagaaccttggccaggcatggtggcttatgcctgtaatcccagcactttgagaggctgaggcaggtgcatcacctgagttcaggagttcaagacaagcctgggcaacatggcaaaaccccatctctaccaaaaagtacaaaaaactagctgggcgtagtgatgcgtgcctgtggtcccagctacttgggaggctgaggtgggagaattgcttgagcctgggaggtgaaggttgcagtgagctgagatcatgccactgcactccaacctgggtgacagagtgagaccccatctcaaaacaaaaataaaacaaaacaaaaaagtaataagaacctcatgtgtaggtcttttaaaacacataatttatatagcaaaaacaataaatagattaaaaaagctttgaaaccagcctaaatactcaaagtatttgatggactgactagaatacatatattaagttacaaatatgcacattagataaaatcatggaaacttacttgttaatattaaatttatgcaagacttaatgcaagacttaatgtatgttctacttattgatttgtgaagtttacctatgaagattgtacaattccatagtgacacagtgattttttttttgttttgttttttgttttgagacagagtcttgctctcttgccaggctggagtgcagtggcgtgatctcagctcactgcaacctcctactccctggttcaagcgattctcctgcctcagcctcccaagtagctgggattacaggcatgtgccaccacgtccagctaatttttgtattttttagtagagacagggtttcaccatgttggccaggatggtcttgatttcctgacctcctgatccgcctgccttggcctcccaaagtgctgggattacaggtatgagccactgcgcccagcccagtcattgttttagtacaaaataataggtaaatttaaattattgaaatgtagaggtttttttataagtatgaaggaaaagtcatgtcaggatctccagttggatatttatgtcctccagcaatcaacagatgttgaaaaacctctggcggttgacctgttgtgcttttatttacagtgcttgtttcaggttctggtaaacgttcctcagagtccaaaagcagggaagcctagtgctgcagctgcctctgtcagcacccagcacggatctatcctgcagctgaacgacaccttggaagagaaagaagtttgtaggtttgtgcctgctttgttgtgatctaagtgaagtctgcattttctctttttctattttggttttagctttttttctctttacagtatttttctttatcttttctggtccgtacccaggaacatgtattattctgcctccatgatattagcaaaatccaacttcttattttctaatctaaccacttgtcttaattttacctaatgtttgtaggttggaatacagatttggagaatttggaaactattctctcttggtaaagaacatccataatggagttagtgaaattgcctgtgacctggctgtgaacgaggatccagttgatagtaaccttcgtacgtatatgttctctgctgattttcacatttgcattttcagaggtttcagtttttgagtactgtttgtaaagcaaagcagtccatgacgctttctgtagttgaaaacctaaatcttaggtcattgatgagcaccactccccccaaaaaatccacataaattataggttatttctacttagttatgatgtatttaaaatatgtttattgtattatctgtatataataatacaattatgtgacattaaaaaattatttattggcctggcatggtggctcatgcttgtaatcccagcactttgggaggccaaggcaggcagatcactcgagctcacaagtttgagacgagcctgggtgatgtggtaaaaccccatctctacaaaaaatacaaaaattagctgggcctggcgatgcgtgcctgtagtcccagctacttgggaggctgaggtgggaggatggcttgaacctgggaggcagaagttgcaatgagccaagattgtaccactgcactgcaacctgggtgatagagccagaccttgtctcaaaaaaaattatatgatatatcaatacattctcatagtttttagtttaattatgaagcattaataagccaaaaatgttaatgcagtggaaagaaactagaaatagggtaattgactgtcaaatatctctccttgttttaggagtgagcgtatagtatttcctgtatatcttctgctgccagtccagagatcctcttaggttaaggagggatcattcattatctaataaccccactgaagaaaatctgccattcggaactccctattaggtaacaatgtatgtgctgccttttgaaaggcagtaacaaatccctgtggtgtgaacaagtactgttcacagggaagctattaaagactatgaggttatatcaaaagaacgcaggagccgatatgaaagggccaatgtaggacaatttaagcattaagaagaataatatatgtagtggaagaaaaataatgaatgtataaaaaccatgaggtcatatgaaactaagatgagcaaggcctgccttcccaaagaaaacaaaaacaatgctttgtctttataggtaatcagggcacctgatgttaactgtgtgatttaaaattgtcagttgaaaggagagatttaagcatttattttgcccgttttaactgtaattcagggtaaccaaagatagtccctgttgagggaaaattctgtggagaagaattccaggtaataaatacagcaaaagggcaggatatgtcgcaacccttaatgaagtaagtgattgtgattcaggcatatactatatgagtggatgaaaccacgaggtgaaggggaatttttaccagctgaacacatccaccagtcatggggcaaccgcaacaggtacactttcagtgttggccaggaagttattgttaatttcatatgacattgtgtttatataacaaaaggcccatttcaaagatacttttagttttgaaatagttttagatttgtagaagtgttgcaaaaagagttctcaaatatccttcacttagcttcccctaaaccctaaactgtaaaatcacagtgtaattatcccacatactattactgaaaccagcaacttaacattgttcttaacattgaacataatattgatacagtactgattggggttatttaaatttctctaaatgtcccttttaatatccttctccggtgctggatttgaggtaggatcccacactgcatttagctttcagatctcctttgtctcctccagtctaggacagttcctcagtctttctttgtctttcatgaccttgatggtttgaagggtaatgtctggttgttttgtcaactgtccttgatttggatttgcttgatgtttggtgttttctcatgaataggtagaggttttgcattttttactggtatacagcaaaagcgaggctgggtccttctcagtgccttgtgtgaggaggcacacagtgtcaggctgtctttacaagggctttagagacacatcctgaagtatgtagggatgaaataacatgatgtcttggattcctaaagaaatagtttagccagaaaaagcaggacatgggggtgggtgggtagttatagatgaagcaacagggacaatatcttgataattctaggatctgggtgatggattatatatagggtgatggtaccattctctgtgcttttgtttatgtttgatattttttataatgacaattatcactcccttcagggtgagcataggaaattcagcatgagaatataggcttcccctcactggttttcatttatagataaatgtaatgatgtgatgtctttgatgttcatgatgacatttttgggggctaatgtgttttcttctctttttctagctgtgagcattgcattccttattggtcttgctgtcatcattgtgatatcctttctgaggctcttgttgaggtaagatatttggggaggacgccactggaaaggcagagtatagaaataacacattcagaaggggcagctgtcaccctcaagtggccatattcttcgatgatatgaacatttctgtgtcccccatgtccatccagtgctaggcttcagggactcatgtagactaagacgtggtctctgactttagggaagtgatattaaaggtgcttgtggattttttccttccttcctcccacatggctgaagaggaagaaaatgcttgagaaatcattatttcctaaagcatccgactttttaacgagcagaagtggctcatgacaattttaggaggaggtcgctgcactgaactcccttccccctctctggccctgagccctgaggcaccttctagtccagctgcccaacctctgccagcccaggcatctggtggcacagatgtatgcctggtggctgttcttctggacctcgcacggactccctgtcccttggttagtttgttagccaatgtggagaagggactggtcctgctctgcgtggtgaatagcgattctggtaagagtgaattagtagactagaacaagaaagtaaaatagatccagttttaattaactttcaaaggaaagtttttttcatgttttaaaaagaataagagtgaattttctcatgcttatcttgttagggtctcaagaagaaccacaaggttttattgatgagcaatatccaaactgaaagaatgaaaacctaacctctaagtcggctagcttgggaaaccctgaagctttggggaatttctgcactgtgatactctagctttgtacatcttagaaatagtataattccatgtgtgaggaccccaactgtgtatagggtaaaagaaccacatgttgcccagaagccggtgtgtaacctgttttttagggatagaggaagattctagcagtggagtttcatttctttgagttaaggtattatctcatcaaccttttgataaaatgcaaatgctatttcagtatatcaggatgcttttcacgtaaatggatctattatggattttttttttttttgagacagagtctcactcttgtcatccaggctggagtgcagtggtgccattatggctgactgcagccttgacttcctgggctcaggtgattctcccacctttgcctcctaagtagttgggactacaggcatgcatcaccatgcctggctaatggtttttttttttttaatttttgtatttttagtggagacggggtcttgatatgttgcccaggctggtcttgaactcctcgactcaagtgttccatctgtctctgactcccagagtgcagggattataggcatgagtcaccacacctggtcatattacatgactttttaaagtaattggtagctaggccgggtacggtggctcacgcctctaataccagcactttgagaggccaaggcagatggatcacttgaggtcaggagtttgagaccagcctggtaacatgatgaaatcccatctctactaaaaatacaaaaagtagctaagtgtgatggtgggtgcctgtagtcccagctactcaggaggctgaggcacgaaaatggcttgaggttgcagtgaggtgggagggaggttggaggttgcagtgatctgagattgtgccactgcattccggccggggactctcaagaaaaaaaaaagtaattgatagctgagatcaagcattttcaaagggaagagattccaccttgccccatgtggaactgaaactactctttgcacatgatgctgcccttccagcctgcgggcagaatgctcttcttgacaaagcaggagtcccttattccttgccccctcgctttccaacatacccagggaggttcagatgactgtgagccaaaaaacaaccagaaaaagtcgagagaataaagagcccctctctttttcacttaggcaacaagcatgaacaagaaaattaagtatttttgttttatttttagaaatcttaacttctccttttcaccctttttttttttttttaattttttgaggtggagtctcactctgccacgcaggctggagtgcagtggtgcgatctctgctcgctgcaacctctgcctctgggttttaagaaattctctgcctcagcctcccaaatagctgggattacaggcacgtgacaccatgcccagctaatttttagtagagatgaggtttcagcatcttggccaagctggtcttgaactcctgacctcgtgatccacctgcctctgcctctcaaagtgctgggattacaggcgtgagccaccatgcctggccacccttctttagatgtgtctattttaacattttacatgtgatggtgatgttatccatgttgaataaactagaaatcagagttgagttgtgagggaaaaagagaaattgcaaatgtatgccttgggcatatggatcatatttggatactgaattgaaccactgaactataaaaacatgttatgaaacagggaaactgcactggctatgtgacggtattaaggaattactgctaacatttaaaaatgtgataagggtattgtggttatgtttagaaataaaaatagtccatatccattagagatacatactaaattgtttttgcatgaaatgatatgatgtctaggattttctataaaacaatccgaggcaggaatgagggacagtgggtgagaggacatatgaagtaagattggccatgtgtcgacacttgttgaagctggatgatggaggtccattattcaggcaaaccctgtgttattgtgctttgctttattgcacttcacagatattgcatgttttacaaattgaaggttcgtggcaaccctgcatccagcaattcttttttttttttgagacgtggtctcattctgtctcccaagttggagagcagtggtgccatcacagctcactgcagccttgacctcccacactgcagccttttgatttaaagcgagagacgtgcagccggacaccatggctcacacctgtaatcccagcactttggggggcctaggcaggtggatcgcttgaactcaggagttcgagaccagcctggccaacatggtgaaacccccatctctactaaaaatagaaaaattagctgggcgtggcggcgcacgcctgtaatcccaggtactcgggaggctgaggcaggagaattgctggaacccaggaagtggaggtttgcagtgagccgagatcgcgctactgcactccagcctgggtgacagagtgagactccatctcaaaaaataaaaaataaagtgagagacatgcaactctttcttttactcaaacgcttagaagccattgtagggcaattataattggcctaatttcaatattgttgtatctgaatgaatagagaggcccaaagagagggagggagatggaggaacagtcagaacatactcaacgcttattgaccttattgacctcccaggcacaagcagtcctcccatctcagcctcccaagtagctgggactagaggcatgtgccaccatgataatttttttttttttttttttttttttttagtagagatgaagttctcactgtgttgcccaggcttgcattgagtaattctgttggcaccatttttccaacagcatgtgctcacttcttgtctttgcattacattttggtaatcgttataatatttcaaactttttcatactattatatctgttatggtgatctgtgatcaatgatctttgatgctcctactgtaattgttttgggatgccatgaaccctgcctgtataagatggtgaacttaatcagtattgagtgtattctgactgttccacccactgactgttcccccatttctctccctctctttgggcttctctatcctttcagatacaacaatattgaaattaggctaattaattatcctacagtggcttctaagtgagtaaaagaaagagttgcatgtctctcactttaaatcaaaagctagaaatgattaaacttagtgagaaaggcatgtcgagagccatgataggctgaaagctaggcctcttgtgcccaacagttagccaagttgtgaaagttcttgaagaaaattaaatgttctactccagggaagacacaaatgataagaaagtgaaacaggctgggcttagtggctcacacctgtaatcccagcactttgggagcctgaggccagattattgcttgaagctaggagttcgagaccagcctggccaacatggcaaaaccccatctctactaaaaatacaaaattagctgggcatggtgttgcatgcctgtaatcccagctactctggagcctgaggcaggagaattgcttgaacccgggagtcagaagttgcagtgagctgagattgctccactgtactccagcctaggcaaaggagctagactctgtctcaaaaagaaaaaaaagaaaaagaagaaaatgaaacagccttactgctgatatggagaaagtttgaatggtctggatagaagatcaaactattcccttaagccaaagcctaatccagagcaaggccctagctcttttcagttctgtagagactaagagaagtgaggaatctgcagaagaaaagttggaaactagcagaggttggttcagaaggtttaaggaaggaagccatttccataacataaaagtgcaaggtgaagcggcaagtgctgatggagaagctgcagcaagttatccagaagatccagctaagataattgatgaaagtggctacactaacaacacagtttccatgcagatgaaacagccttctattggaagaagatgccatctaagacttttaatagccaggaaggagaattcaaagcttcacaggacaggctgactctcttgttaggagctaacgcaactggtgactttaagttgaagccaatgctcatttaccattctggaaatcctagggtccttaagaattatgctaaatctcctctgtctgtgctcaataaatggaacagcaaagcctggatgacagcacatctgtttacagcgtggcttactgactattttaagcctactgtcgagacctactgttcagaaaagaatatttttttcaaaatattgttggtcattgacaatgcagcaagtcacccaagagctccaatggagatgtacaagcagatgaatgttgttttcatgcctgtaacacaatatccattctgcagcccatggatcaaggagtaatattgattttcaagtcttactatttaaaaaataggtttttataaagccgtatagctgccatacatagacagtgatttctccaatgaatctgggcaaagtccattgaaaaccttctggaaaggattcaccattgtagatgccattaagaaatttgtgattcatgagaggaagtaaaattatcaacattaacaggagtttggaggaagttgattccagccctcatggatgactcgggggtttaaggcttcagtggaggaaataactgcagatgtggtggaaataaaactagaattagaagtgaagcctgaagatgtgactgaattgctgcaatctcatgacaatacttgatcagacaaggagttgcttcttatagatgagcaaaggaagtggtttctcaaggtggaatctactcctggtaaccatgttgtgaacattgctgagatgacaacaaaggatttagaatatcacataaatgtagttggtagagcagaggcagagtttgagacgattgactctaattttgaaagaaggtctaactgtgggtaaaatgctatcaaacagcatcacgtgctgcagagaaatcttgtgaaaggaaaagtctgtggcaaactgtattgtcttgatttcggaaattgccacagccacctcaacctacggcagccaccaccctgaccactcagcagccatcaacatggaggccagatcctccaccagcaaaaagattagaacttgctgaaggctcaaataatcattaactttttattagcaatacatttttaaattaaggtatgtaaactgtctttttgtgcataatggtattgcacacttaatagactatagtatagtgtaatatataacttttatatacactgggtcacagaaaatttgtgagagtcactgtattgtgatattggccttattgtggtggtctgggaccaagcctgcagtgtcttgagctatgcctgtactggtttctctgcttctgtgtaactgttcatgaccaaaaaataaaaggggaaaaaatcctatgcactggataatttgtttatgccagggtagggtatacttttcaaaagatttcttcccaggtagaaatctcattttaaagaaaaaccagttaatatatttatcttttgttagtcatgtaaatcaatttaatgttatctggatatctttcttttctttctttctttttttttttttgagacagagtcttgctatgtcacccaggctggagtgcggtggcaccatctcggctcactccaagctctgcctcccgggttcacaccattctcctacctcagcctcctgagtagctggaactgcaggtgcccgccaccatgcctggctaatttttttgtatttttagtagagacagggtttcaccgtcttagccaggatggtcttgatctcctaacctcgtgatccgcccgtcttggcctcccaaagtgttgggattacaggcgtgagccaccgcgcccagcctggatcattttgaattaaagcaaccatattcaaaaagaacccagtacattaactatttgaatcaccccaaagttgctttcaacttttcccagtgtgcacatatgcatttttgtttgtaattgaatgtaaatgttaggtttttgctttttgtatttaatagttgatctttttttttttttttttttttttttgagatggagtctcgctctgttgcccaggctggagtccagtgggcgtgatctcggctcactgcaacttccctccgcctcctgggttcaagcaattctcctgcctcagcctcctgagtagctgggattacaggcgtgtaccaccacatctggctaatttttgtatttttagtagagacatggtttcaccatgttggccaggctggtctcgaactcctgacctcaagtgatccacccacctcggccccccaaagtgctgggattacaggcaagagccaccatgcctggcctaataatttatatcttcatcttaatgtttctttgtgtgggcagagcccacattcttttgctttcatgactgtatcacatcctatcacacagctgtcatattctgtgtttagtcatccttgttttgagtaaatttggttgtttccaagtttttgctattttaattttaatagtattattagtgagaatcccagccacggggaatagttacctcatttaccttctgaagtctttaatgaaagctctgtcatcattcctgttttattgatgaggaaactatgctgtcagagttgagtatttataagtagagctgctgaaaattgtgatttctatttttatattgttaaaaaatgtttagaatgtttaattacttagtaatatagaatatgagctttaattttatttccatataatatccaatcatttaaaaaattctgccaatgaaaataaattaattgagccctttatttattttcagtttggatgactttaacaattggatttctaaagccataagttctcgagaaactgatcgcctcatcaattctgtaagttatgagatgcatagtgtattgcccaggtggttttctaaacttggaatttatagtttcttatttaatcattattgtccagttttatgtttatattgaggaaggccaggttgtagctcccgtattcctaatagagagcagccctctcttcagctgctgggaagggctccatcccttctcttgcttcagtgacattggaacgttccgctctatcaggatacctgaggtagagacatttttcactctgcaggcagcattgttgaatcaatccagttaagtagagagtgtcaaagttaaaacaaagaaataagagacaacaatattaaatctataaatgctgatggcctcctctaatgatttaaatatgtcattaaatttttgttaataaattcaggctcatttatggggatgttggcttctgtgcttgtgctagatgcacttacgactagtttttttggtgtcatttatcaatgtggccactggcaaactcagtaaaaggcaggaaaagctgataaagtacaaaaccagacctctagatgggatctttacaaaagcaaatccaagtattgtttagaaaaacttttttattttttgagacaggatcttactctgttgcccaggctggagttcagtggcgtggtctcaactcgctgcagcctcaacctcctgggctcagatgatcttcccacctcagcttcccaagtagctgggactacaggtgtgtgccactccacctggctaatttttgtattttttgtagagacagggtttcaccatgttgcccaggctggtctcaaactcttgggctcaagagatttgcccaccttggcctcccaaagtgctgaaatcacaggtgtgagccactgtgcctacagaaaaactattttttagctttctaaactatttttagatttctactatatcacattctttcctaaagaaataaaaaattgatgccggttgcggtgactcacgtctgtaatcccagcactttaggaggctgaggcaggcagatcatgaggtcaggagtttgagaccagcctgaccaacatgatgaaaccccatctctactaaaaatacaaaaattagccggacgtggtggcgcatgcctgtaatcacagctacgcaggaggctgaggcaggagaatcgcttgaccccaggaggtggaggttgcagtgagccaaggtcttgccattgcactccaggctgggccacagagcgagactctgtctcaaaaaacaaaacaaaacaaaacaaaacaaagaaatcaaaaaatgacaaaatgaaatttaccccttagcattatgagttgtcatctttctccctttttttctgaaggagctgggatctcccagcaggacagaccctctcgatggtgatgttcagccagcaacgtggcgtctatctgccctgccgccccgcctccgcagcgtggacaccttcagggggtatgtgggcctccctgtagcacagtgggtgcaggtagtcacaggactacataattgtacatacacacacttttagcttttaaggacttttacatatcttttactttctaggctaggaaggatttcttggatgtaaaagtaaactctgcagcctctccagtctggaagaccatcatgatcctcagtgtctgtattgacagaggagtagtggatgaggccagagccagtgtccacttggatacgtggtctgctgagtgaagggcatttttatttgggcaagtcgctgttacttggggctgcagactgtatcccatgtccagtcagtagcttgacggctcagaagatgcactagtctagcaaggaaacaccagcatgtggcagagggagggctgatcctgcgctgctagcagagtgacttgagtatcaggccctcgtgctagcaaacccatagccctggtagaagaacaagggccaggactgaaatctgaaaataaagtttaaaaactgtatagcgaagaataaatacacaggtatcagctcttttatttctacatactgaagccttctgaactctagtgacaaccctataactttgccccagtctcaccagagccctgagtgccctggcaggtagattggaagcaggtagtaagaacaatatgatcataatgaaacttgctaacaattctggagttctcataatgtgccagtcactgttctaactcgtcttaatttatttaatctcttagtaatcctatgagatatatacttttaatgtgcctgattcacattaaaagtaaaagaaattgtgctgctgagtgaagtaacttgcccaagctcactcaggtaccaaataggaaagccagggtttgatggcaggcacttgggttacagagtctcccaaattagtctgttgacacctaaggtcagcaccctcagcattctgcacagttagcctcaaacagtagcacatccggaatctattactctgtcttttagatttccattgctacttttggagataagatggtcacagatagacaggaactaacatttattaagtgtctaaaatatgctgggcactggttagctgctgtaaaatacatcattctccttaaaagtcacatgtggttagggcactttcttttacagatgagcacactgagtttactgatgagaaccttgcccagggtcttatggctaatgacagaaaaggatctaagattggaattctgagctcgctgactcagctggctgtgtgccttccaccagagttctttaacccgagacatctaaataattagcacaaaactgagttattggaaatattttgcaatgttttcaagttacatagtttaagactgcagtatacactttggttaagacatcatgttggcagtgttggcaatggtcctaactgtagtgcatggtcctaattgcgatgactagaaaataatcgcttcttggccttgatgtctcatcttgtgtaataaaatgctcagtagaattgcattgttgcatgattgcaccttgtgagtataaatgtgtcttcagttcagcccttccttttcacatagcaaaccctgaaaggcttctctttgttggcttcttctaggattgctcttatactcatggtctttgtcaattatggaggaggaaaatattggtacttcaaacatgcaagttggaatggtaagatatttcctaaaagtaatgttgcttatatacgtccttcacagagcttcagggcaggagaatcactcagcattctccccagaaactccagaaatgagccccagcagcctcctctgagccactgagctcctgctccctcctagggtgacctgtagatgattctgcgagccctttagttttgttcctccttttgtgtgctgtgaatctgtaaagcttcactgtaataacagactctagaagtttctgctgtgggactgagggactctgcagaatatgttatggatttggttgtaaatgatcatggtcatattctagatatgccttctattacagccaccatgctcttgggggctctgtcttctaggacttatggtcctttttgagatggcgttgaactaggattggtctgagtggtggtgaataatatctgtaagtctggcttggtagttgctttacaaatggattagtgcttcttaaacataacaaacgtgtctacatatttctagtttggttttcctgtgtctagttatgttcataggaagtgtcccagccaggtccagtgcttggttgcagagtctcaaggaagagtttgtgagtttactttctttttttaaaggcagagtcttgctttgtagcccaggctagattgcagtggtgtgataatagctgaccacagcctcgacctcctgggctcaagcaatcctcccacctcagcctcctgagtagctgggactacaggtgtgtgccaccatacatggctagttttttaaaacaatttttagtacagatggtgtctcactctgttgcccaggctggtctcaaactcctgggctcaagcgatcctcccaccttagcctcccaaagtgctgggattacaggtgtgagccacaccacacctggcctatgagttttctttttctttttcttttttttttttgagatggagtttcattcttgtcacccaggctggagtgcaatggcgcgatcttggctcactgcaacctctgcctcccaggttcaagtgattctcctgcctcagcctcccaggtagctgggattacaggtgcccgccaccacacccggctaatttttgtatttttagtagagacggagtttgatcacgttggccaggctagtctcgaactcctgacctcaggtgatctgctcgcctcggcccccacaaagtgttgggattacgggcatgagtcactgcgcctcccctgggtttactttctataccagtgtgtaatgaagtccacactagatttaggaggtatttgtattctagagtccttttgcttatgctttgtacttgttctgcagggctgacagtggctgacctcgtgttcccgtggtgagttgccggtctgccctcttctcttccacgggttgactccaatctcctgtttttcagatgatgctggagcctctcttctgagacgggcatgtgttatgtggttaggaagtccttccaaaagtcctgttactggatagttctcatacttgacccagtgcctacacgtgtgtataaaagagtgatttggggccgggcgcggtggctcacgcctgtaatcctagcactttgggaggctgaggcaggcgaattacctgaggtcaggagttcaagaccagcctggccaacatggtgaaactctgtctctactaaaaatacaaaaaattagctgggtgcagtggcacgtgcctgtaatcccagctactcgggaggctgaggaaggagaatcacttgaacccaggaggcgggggttgcggtgagcagagatcacgccactgcactccagcctgggcgacagagtgagacttcatctcaaaaaaaaaaaaataaaaaaaataaagtgattttatagggaatattttgttagtgtagatatggtatgccagatcctgaaaccttgtaggaaattatacattctgaacatgtagttcagttccattaatcctgaaaatacttataaaatcctatttcctgaagaattacagtatattggtatcagtgaatgctaataaatatgtaggtgggcaatgatagtcataaactaaaatttaaaataacagttgagtagctcaattctgtctctgatcattcatagcttcttattcttgtgaagggacattgcctatgtgatgtggaatttgtatctttgctatggtgtattaagtgacattgctccctcattagcaggtagtaccagccttattattgttattttttatttcaaattttaaatttttgtgggtacatagtttatatagtatggtagatatgagatattttgatgcaggcatacaatgtgtaataatcacatcagggtaaatggggtacccaccccctcaggcatttaccattttgtgttataaacaatccaattataattttttagttatttttaaatgtacagtaaattattgttgactgtagtcaccctgtcatgctatcaaatacttgatcttattcattccatccagctatatttttgtactcattaaccacgccccctccttccctccccactacccttcccttctggtatccatccttctatcgccctgagttcagttgttttaatttttagctccacaaataattggaacatggcttatttcacttaacataatgtcctcgagttccatccatgctgttgcacatgacaggatctcattcttttttatggctgaatagtacttcattgtgtatatacaccacattttctttctaagtgtctgttgatggatgcttagtctgcttccagatcttggctattgtgaatagtgctgcaataaagatgggagtatctcttcaatatactgatttccttccttttgcatatatacccagcagtgggattgctggatcatatggtacctctacttttaggttttgaggaacctctaacctattgtccatggtgattgtactaatttacattcccaccaacagtgtacaagtgttcccttttccccacctcctcatcagcattggttattgctgtcttttggataaaaaccattttaactggggtaagatgatatctcactgtagctttgacttgcatttctctgatgatcaatgatgttgagcaccgtttcatattcgtgtttgccatttggatgtcttcttttgagaaatgtctgttcagatcttttgtcctctttttttttttttttttttttttttcaagatgaagtcttgctctgtagcccaggtgggagtgcagtggcatgatcttggttcattgcaacctctgcctcctgggttccagcgattcttctgcctcagcctcccgagtagctgggattacaggtgcgcaccaccacacctggctatttttttgtatttttagtagagatgaggtttcaccatgttggccaggctggtcttgaactcctgacctcaggtaatctgcctgccttggcctcccaaagtgctaggattacaggcgtgagccaccgagcccggccttttaatccatttttaattggattattagattttttttcctatagagttgtttgagctccttatatgttctggctatttattgcttgtctgatggggagtttgcaaatattttctcccattccatgggttgtctcttcactttgttaattatcttcttttctgtgtggaagctttttacttgatatgatcccgtttgtccatttttgctttggttacttgtgctgtgtgaagtgttaatcaagaaatcttcacttagtccagtgtgctggagtgtttccccaatgttttctcttagtagtttcatagtttgaggtcttaagtttaagtctttaatccattttgatttgatttttttaatatgatgagagataggggtctaggttcattcttctgcatatgaatatccagttttctagcatcatttttttgaagagactgtcctttctccaatgtgtgttcttggcacttttgtcgaaaatgagttcactgtagctatatggatttagctctgagttctttattctgtcccactatctatgtgtctgtttttatgccactaccatgctgtttttgtttctatagctctgtggtataatttaaagtcaggtaatgtgattcttccagttttgttctcttgctcaggataactttggctacgctgggtcttttgtggttccatataaatttcagcatttttttttctatttcagtgaagaatgttattggtattttgatagggattgcattgagtctgtagattgctttaggtagtgtgaacattttaacaatattaatttttctaatgtatgaacatggaatttctttccattttttggtgccctcttcaatttctttcatcagtggtttatagttttcattgtagaaatccttctcttctttggttaagttaattttgaggtactttattttatttgtggcaattggaaatggaattcctttcctgatttctttttcagattgttttctgttggcatatagaaatgctactgatttttgtatgttgatttgtatcctgcaactttactgaatttgttgatcagttctaatagttttctggtggagtctaggtttttccaaatataagatcacgttatctgcaaacaagggtactttgacttcctcctttccaacttggatgccctttatttgtttctcttgtctgactgctctatttttgtactcattattagtgccatgttgaataacagtggtgaaaagtaggcatccttgtcatgttccagatcttggaggaaaggctttcagtttttcctagagacaccaaggaatgcagcaagagcaaactttcatctctgtgatcccttgccaagtaattagaaaaatcagtattctaacttttttttttttaaagagataatttagggccaggtgtggtggctcatgcctgtaatcccagcacttttgggaggccgaggcgggcggatcacaaggtcgggagattgagaccatcctggctaacacggtgaaaccctgtctctactaaaaatacaaaaaaaagaaaattagccgggcacggtggcgggcacctgtagtcccagctactcaggaggctgaggtgggagaatggcgtgaacccaggaggcggagcttgcagtgagccgagatcgtgccattgcactccagtctgggcaacagagcaagactccgtctcaaaaaaaaaaaaaaaaaaaaagagtaatttagtaatttagtatggtcaaagaaaagaaaggaaatgtgtattacttagactaaatggagagagaaaaagtaagctttcatttttctttcaggtgcagaagggtgtatagaaatgattgaaatgtctgtgtttcaagggctttgagggtgtgcttgtgaatgtcaagttatttgaagacattactgtggcttcgaatcatcatttctttttgataacgaaatgggagggttgtctttggaaattccatttaatattaaagaaattttctcctaagacaggacttgaaggtgcactgtcaaaaaccttccagccccatggggctatattctgaactcttcctctactgttagctcagtattatttcagtaattggctactttaaacaaattatggttgcttctcttttatagcatattataaaatgttactgatatatagacaaaaaatttggaaatggccacctattaataactagattctttttaggtttgtatttattatgggatcttccatttttctatcgatgacttctatactgcaacgggggtgttcaaaattcagattgctggggaagattgcatggaggagtttcctgttaatctgcataggaattatcattgtgaatcccaattattgccttggtccatgtaagtactttttccctctgttatatatattcaggttgaaatatggaaactatatgttgtaatttgagagaaatgcaattcctccatctcaggtgcctgcaaatagaataatcattaggaaagtatatacaatggttgtctaactgtgagcattattattattatttttgaattttagacctgggaggagcctctgagactactcaaacccttctcttgtgcagaggaaaagtctgaggccaagagcgattgaaggttttctctggattatctgagtgtagtgagaggcacagcagggaccagaccaggccgccttggtctccaactttgccccctgctaatgtgatttcatcagctttcttttttttttttttttttttaaatttatttatttattttttattgatcattcttgggtgttgggatttggcagggtcataggacaatagtggagggaaggtcagcagataaacaagtgaacaaaggtctctggttttcctaggcagaggaccctgcggccttggccttccgcagtgtttgtgtccctgggtacttaagattagggagtggtgatgactcttaacgagcatgctgccttcaagcatctgtttaacaaagcacatcttgcaccacccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcggctggccgggcgggggctgacccccccaccaccctcccggacggggcggctggccaggcagaggggctcctcacttcccagtaggggcggccgggcagaggcgcccctcacctcctggatagggcggctggctgggcggggggctgtcccccccacctccctcccggacggggcggctggccgggcagaggggtcctcacttcccagtaggggcggccgggcagaggcgcccctcacctcccggacggggcggccggccggaaggggggctgaccccccccacctccctcccggacggggcggctggccgaccccccccaccgcctccctcccggacggggcggctggccggacagaggggctcctcactttccagtaggggcggccgggcagaggcgcccctcacctcccggacggggcgactggccaggcggggggctgatccccccacctccctcccggatggggcggctggccaggtggggggatgacccccccacctccctcccgggcggggcggctggccgggcagaggggctcctcacttcccagtaggggcggccgggcagaggcgcccctcacctcccggatggggcggctggccaggcggggggctgatccccccacctccctcccagacggggcggctggccgggcggggggctgaccccccacctccctcccggactgggcggctggccgggcggggggctgacccccccacctccctcctggacggggcgtctggccgggcagaggggctcctcacttcccagtaggggcggccgggcagaggagcccctcacctcccagacggggcggctggccgggcggggggctgacccccccacctccctcccggacggggcggctggccgacccccccccccaccgcctccctcccggatggggcggctggccgggcagaggggctcctcacttcccagtaggggcggccgggcagaggagcccctcacctcccggacggggtggctggccgggcggggggctgaccccccccacctccctcccggacggggtggctgctgggcggagacgctcctcatttcccagacggggtggttgccggacggaggggctcctcacttctcagacggggcggttgccaggcagagggtttcctcacttctcagacggagcggccgggcagagacgctccccacctcccagacagggctgcggcccagcagaggcactcctcacatcccagacagggcggcggggcagaggtgctccccacatctcagacgatgggcggccgggcagagacgctcctcacttcctagatgggatggcggcggggaagaggcgctcctcgcttcccagatgggatggcggccgggcagagacgctcctcactttccagactgggcagccaggcagaggggctcctcacatcccagacgatgggtggccaagcagagacgctcctcacttcccagacggggtggctgctgggcagaggctgcaatctcggctctccgggaggccaaggcaggcggctgggaggtggttgcagcgagccgagatcacgccactgcactccagcctgggcaccattgagcactgagtgaacgagactccatctgcaatcccggcacctcgggaggccgaggctggcggatcactcgcggctaggagctggagaccagcccggccaacacagcgaaaccccgtctccaccaaaaaaaaccgaaaaccagtcaggcgtggcggtgcgcgcctgcaatcgcaggcactcggcaggctgaggcaggagaatcaggcagggaggttgcagtgagccgagatggcagcagtaccgtccagccttggctcggcatcagagggagaccgtggagggagagggagagggagagggagagggagagggagagggagagggagagggagagggagagggagagggagagggagagggagagggagagggagagggagagggagagggagagggagagggagagggagagggagagggagagggagagcatttcatcagctttcgatagtgtgcggcagttcacgaatccaccttcactggcacttgtatggcagctgggtttctggaaggagtaatatctttgtcattagtttagtggtgcgcagggacagcagagctgagggaaggcttgtgagccctctgctttgaatgagtatcagagtcgggagggcactagtcactgtcctcaagggccttgcaactgtcgttagcagaagaggacacaaacatctagacaatggccaaatggagccctcaggcaatatgtactttaataggcactagcaagaggtggaggtcacttctagatggtgtttcatatgaatgtggacttggtggatctccaaaaagggagccactgcttccagtaggattcattttagggtttgttgtcaggtctgttcttccggtcatacggttgggtagcagatagggcagggagggtcagtcagtggcgttcttggggtgatacagctgggtagtgggtagggcagggagagtggcttgtgttgggcctgcaaggtcctagcagacgtgcgggttgattgcaaattcctaataggaaagagccagggtcaggcacaggcctggctttatccccacacctgagtaagacgctttggttcttatcccagtctctcatctggccagcttcctgttttgagtttgagccatgtccctgactgaccctccctctattaagagggattggcctgtttttggaagctgggctgagcccatgtctcttgaccgtatatatttccatgtccaagagcttaaaaaagacttacttagatgcaatataggtatgtcttcccctttaggaaacaaataatgttgtcctgggatgagaggagaagtcctggctaacacttgacctaacttgtgtcttttgcagtgtcttgggacaaggtgcgcattcctggtgtgctgcagcgattgggagtgacatactttgtggttgctgtgttggagctcctctttgctaaacctgtgcctgaacattgtgcctcggtgagaaaccatgttttaattaagaaaaactttttttaaattaaaaaaaatgtattgtgtggtgatacggtctcactatgttgtccagactggtccctcactcctggcttcaagtgatcctcctgccttggccacccaaagcgccgggattacaggtgtgagccaccatgcctggccagaaactgtgttcttgttgttgttgatacagggtcttgctgtgttgcccaggctggggtgcagtggtgtgatcttggctcactgaagcctcaacatcccaggcttaagcgatcctccctcctcagtctcctaattagctgggactacaggagcgcaccaccatgcctggctagttttatttattcttttgtagagacaaggtctcactatgttgtccaggctggtttcaaactcctggactcaggtgatcttcctgcctcggcctcacaaattgctgggattacaggtgtgagccaccatgcccagccaaaacagtgttttttaaaaaaagggagaacaaagggggatatggtttttagaacttctaaaatttctgcatgcaatactgtacatctgctaatcaaatacattctgattttcactttcattagttatttttaatctttatgtcaatttttttattataaaatacacgacatgagatctatcctcttaacaaatttgtcagcagacagtaatcacatgcattcttttttcctcttatttttagttgatatgtaatacttgtacatatttatgaggctcagagtaatattttgatacctgtgtatcatacagtgtgtaacgatcaaatcagggtaattagcatattcatcacctcaaacagttattatcatttctttgtgtcaggaacatgcacaatcctctctgctagtttcaaatgcattctgttttatttacttcttggagacagggtctcactctgttacccaggctggagtgcaggggcacgatctcaactcactgttgccttaacctcccaggctcaagcgattctcctacctcagcctcctgagtagctgggactataggcatgcactaccatgcccagttaatgattgtatttattgtagagacgaggtttcactgtgttgcccaggctggtcttgaactcctgggctcaagtgatttacccacctcagcctcccaaaatgctaggactacaggtgtgagtcaccatgcctggcctcattttttttttttttcttttgagagggagtcttgctctgtccgccaggctggagtgcagtggcgcgatctgggctcactgcaaactccgcctcctgggttcacgccgttctcctgtctcagcctcctgagtagctgggactacaggcgcccgccaccactcccagctaatttttttttaaattatcctttaagttctagggtatatgtgcacaacgtgcaggtttgttacataggtatacatgtgccatgttggtatgctgcacccgttaactcgtcatttacattaggtatatcccctaatgctatacctcccctttccccctgccccacaacaggccccggtgtgtgatgttccccaccctgtgaccaagtgttctcattgtttaattcccacctatgagtgagaacatgtagtgtttggttttctgtctttgtgatagtttgctgagaatgatggtttccagcttcatccatgtccctacaaaggacatgaattcatccttttttatggctgcatagtattccatggtgtatatgtgccacattttcttaatccagtctatcattgttgggcatttgggttggttccaagtctttgctattgtgaatagtgctgcaataaacatacgtgtgcatgtgtctttatagcagcatgatttataatcctttgggtatatacccagtaatgggatggctgggtccaatggtatttctagttctagatccctgaggaatcgccatactgacttccacaatggttgaactagtttacggtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccactttttgatggggttgtttgatttcttcttgtaaatttgtttaagttctttgtagattctggatattagccctttgtcagatgggtaggttgtaaaacttttctcccattctgtaggttgcctgttcactctgatggtagtttcttttgctgtgcagaagctctttagtttagttagatcccatttgtcaattctggcttttgttgccattgcttttggtgttttagacgtgaagtccttgcccatgcctgtgtcctgaatggtattgcctaggttttcttctagggtttttatggttttaggtctaacatttaagtctttaatccattgtgaattaatttttgtataaggtgtaaggaagcgattcagtttcagctttctacatatggctagctagttttcccagcaccatttattaaataaggaatcctttccccatttcttgtttttgtcaggtttgtcagagatcagatggttgtagatgtgtggtattatttctgagggctctgttctgttccattggtctatatctctgttttactaccagtaccatgctgttttggttactgtagccttgtagtatagtttgaagccaggtggcatgatacctccagctttgttcttgtggcttaggattgtcttggcaatgcaggctcttttttggttccatatgaactttaaagtagttttttccaattctgtgaagaaagtcattggtagcttgatggggatggcattgaatctataaattaccttgggcagtatcgccattttcatgatattgattcttcctatccataagcatggaatgttcttccatttgtttgtgtcctcttttattttgttgagcagtggtttgtagttctccttgaggaggtccttcacatcccttgtaagttggattcctaggtattttattctctttgaagcaattgtgaatgggacttcactcatgatttggctctctgtttgtctgttattggtgtataggaatgcttgtgatttttgtacattgattttgtatcctgagactttgctgaagttgcttatcagcttaaggaaattttgggctgagatgatggggttttctaaatatacaatcatgtcatctgcaaacagggacaatttgacttcctcctttcctaattgaataccttttatttctttctcctgcctgattgccctggccagaacttccaatcctatgttgaacaggagtggtgagagagggcatccctgtcttgtgccagttttcaaagggaatgcttccagtttttgtccattcagtatgatattggctgtgggtttgtcataagtagctcttattattttgagacaggtcccatcgatacctagtttattgaaagtttttagcatgaagggctgttgaattttgtcgaaggccttttctgcatctattgagataatcatgtggtttttgtttttggttctgtttatatgatggattacatttattgatttgcatatgttgaaccagccttgcatcccaggaatgaagccgacttgatcatggtggataagctttttgatgtgctgctggattcggtttcccagtattttattgaggatttttgcatcgatgttcatcagggatattggtctaaaattctctttttttgttgtgtctctgccaggctttggtatcaggatgatgctggcctcataaaatgagttagggttgattccctctttttctattgattggaatagtttcagaaggaatggtaccagctcctctttgtacctctggtagaatttggttgtgaatccatctggtgctggagtttttttgttggtaggctattaattattgcttcaatttcagagcctgttattgttctattcagggattcaacttcttcctggtttagtcttgggagggtgtgtatgtgtccaggaatttatcaatttcttctagattttctagtttttttgagtagaagtgtttatagtattctctgattgtagtttgtatttctgtggaatcggtggtgatatcacccttatcattttttattgtgtctatttgattcttctcccttttcttctttattagtcttgctagcagtttatcaattttgttgatcttttaaaaaaaccagctcctggattcattgatttttttgaagggttttttgtgtttctatctccttcagttctgctctgatcttagttacttcttgccttctgctagcttttgaatgtgtttgctcttgcttctctagttcttttaattgtgatgttagggtgtcaattttagatcttttcctgctttctcttgtgggcatttagtgctataaatttccttctacacactgctctaaatgtgtcctggagattctggtatgttgtgtctttgttatcattgatttcaaagaacatctttatttctgccttcatttcgttatgtacccagtagtcattcaggagtgggttgttcagtttccatgtagttgagcagttttgagagagtttcttaatcctgagttctaatttgattgcactgtggtctgagagacagtttgttataatttctgttcttttacatttgctgaggagtgctttacttccaactatgtggtcaattttggaataagtgcaatgtggtgctgagaagaatgtatattctgttgatttgaggtggagagttctgtagatgtctatcaggtctgtgtggtgcagagctgagttcaattcctggatatccttgttaactttctgtctcattgatctgtctaatgttgacagtgggttgttaaagtctcccattattatcatgtgggagtgtaagtctctttgtaggtctctaaggacttgctttataaatctgggtgctcctgtattgggtgcatatatatttaggatagttagctcttcttgttgaattgatccctttaccattatgtaatggccttctttgtctcttttgatctttgttggtttaaagtctgtttaatcagagacttggattgcaactcctgcctttttttgttttccgtttacctggtagatcttcctccatccctttattttgagcctatgtgtgtctttgcacgtgagatgggtctcctgaatacagcacactgatgggtcttgactctttatccaatttgccagtctgtgtcttttaattggagcatttagcccatttatatttaaggttaatatcgttatgtgtgaatttgatcctgtcattatgacgttagctggttattttgcactttagttgatgcagtttcttcctagcattgatggtctttacaatttggcatgtttttgcagtgtctggtaccggttgttcctttccatgtttagtgcttccttgaggagctcttgtaaggtaggcctgctggtgacaaaatctttcagtatttgtttgtctgtaaagtattttatttctctttcacttatgaagcttagtttggctggatatgaaattctagactgaaaatccttttctttaagaatgttggatattggcccccactgtcttgtggcttgtagagtttctgctgagagatctgctgttagtctgatggacttccctttatgggtaacctgacctttctctctggctgcccttaacattttttccttcatttcaactttggtgaatctgacaattatgtgtcttggagttgctcttcttgaggagtatctttgtggtgttctctgtatttcctgaatttgaatgttggcctgccttgctgggttgcggaagttctcctagataatatcctgaagagttttttccgacttggttctgttctccccgtcactttcaggtacaccaatcagacacagatttgatcttttcacatagtcccatatttcttggagctttgttcatttctttttactcttttttctccaaacttcttttctcgcttcatttcattcatttgatcttcaatcactgataccctttcttccacttgactgaattggctactgaagcttgtgcatgcatcacgtagttcttgtgccacagttttcagctccatcaggtcatttaaggtcttttctacactgttgattctagttacccatttgtctaatcttttctcaaggtttttagcttctttgagatgggttcaaacatcctcctttagctcggagaagtttgttattaccattcatctgaagccttcttctctcaactcatcaaagtcattctccaaccaggtttgttccattgctggcgaggtgctgcgttcctttggaggagaagaggcgctctgatttttagaattttcagcttttctgctctgttttctccccatctttgtggttttatctacctttggtctttgatgatggtgatgtacagatggggttttggtgtggatgtcctttttgtttgttagttttccttctaacagtcaggaccctcagctgcaggtctgttggagtttgctggaggtccactccagaccctgtttgcctgggtatcaccagtggaggctgcagaatggcaaatgttgctgcctgatccttcccctggaagcttcgtctcagaggggcacccagctgtatggggtgtcagtcggtccctactgggaggtgtctcccatttaggctacttgggggtcagggacccacttgaggaggcagtctgtccgttctcagatctcaaactctgtgctgggagaaccactactctcttcaaagctgtcagacagggacgtttaagtttgcagaagtttctgctgccttttattcagctatgccctgcccccagaggtggagtctacagaggcaggcaggccttcttgagctgcggtgggctccactcagttcaagctccccacctgctttgtttaccttctcaagcctcagcaatggcggatgcccttccccccagcctcgctgccaccttgcagtttgatctcagactgctgtgctagcaatgagtaaggttctgtgggcgtgggaccctccgagccagatgcaagatataatctcctggtgtgccgtttgttaagaccattggaaaagtgcagtattagtgtaggagtgtcccgattttccaggtaccatctgtcatggcttcccttggctaggaaagggaattatccgacctcttgcacttggggtgatgctccaccctgctccgtgggctgtacccactgtctgacaagccccagtgagatgaacccggtacctcagttggaaatgcagaaatcatctgtcttctgcgtcgctcacactgggagctgtatactggagctgttcctattcggccatcttggaacctcctccacgcccagctaattttttgtattttttagtagagatggagtttcactgtgttagccaggatggtctcgatctgacctcgtgatctgcctgccttggcctcccaaagtgctgggagtacaggcgggagccaccgcgtctggccgcctgaccccattcttgatagtattaaataataccaccagcatccagtttgctggttcagtctcttggggcattattgcgattttttcaatttccttgtagcataacatatatatgtgtaaaattcatgtaacgttttggtatctgttcaaatgctgtaaagttcaattttgaggataatccccaggtagggcatgggagagtgatggtattgtgcttggctatttgcattgcttctttatcagaagcatgtcggagtcccatctcatttgtgattacttcctctcttactataaattgctaggtggagttcactcaggtgacagttacttctttcccccacccaccattagtgacaaaaattccgacggaaatgtttaaattcttccatttggggtcctattcaacaatcagttaataaagccgtgttgtcttctagcttctttcaagatacgtaactagcaagttcatcactgaatctcactttctctgggtgcttcctacaatgttagttatctagtttggggggcgttttagtcattgttactctttccccctctgcccttgtcattaatgtgtcctctggctgtggatttccttagggtgaaggacaggcgagacgtgcctgagtgggcacagagcttggtcagccatggatatgaaagctgctattttcagcccttctgtgggacctgagggtccgcggaggtgcatcctgggccatcaccatagggtcaggggttcagtgggacactaagaacaggtgggctgcaccctttcttccttcaaccacagagatccaaaagtttgaatttcgttagtttacttattttatttttaaattttaaatcacaggtatattgatgtataatttacgtaccataaaactcccatgttgaaagtgtacaatttgatgatatttgctctattcagagttgtgcagctgtcaccagtctgtaattctggaaggttttccttaccccacgaagaaccctgcactaaccgccagtcactccccacatcacaactcccccagccccaggcaaccccagcctacttgttgtctctacacatgtacctgctctagacagtccgtatacatgaagtcatataacgtggctttttgtgcctggctgcttccacttagcatattttttgaggttcatccatgttgcatatgtcagcacttccttccaaaattgctgaattagattccgctttagggatacaccacattttgctcacccatttattagtcagtgaacatttgacttgtgtccccttttttgctgttgtgaacaatgctcctatatgtatgtgtacaagtttttgtgtgaacatatgttttcagttctcttgggtataggaatagaattgtctgctgatttcttttgaatgggtgttttgctgtgagatttcatggagagggaacatctggagaacctaacgtagtcagtaagtttttgtattactgccaaaaaggccaagaaatgagtcaccgggaatttcctaaagacatgtgcttagttcccttctatttgcatttagttcacccgtgttttatttttctgcccccactcaggagaggagctgcctttctcttcgagacatcacgtccagctggccccagtggctgctcatcctggtgctggaaggcctgtggctgggcttgacattcctcctgccagtccctgggtgccctacgtaagcgaacccctgggggtcatcccttgtgcatgtcctgttctgcccagtcagaggttctgggctttcacaggtctcgagtcagaggaattctctttccctcttccttctcctttgaggcctgctttgcatggggagaggagattggcacgtgtccagagtgatttccctgtgggtggtgtgagggtcagcttgaatagaattcgggcctcccaccttcatagtgtgggagcagtttgtcagtgagcgtgcatgagccagaaggacgttttagctggctcatgtttggggctctctgaattgggctgcatacatagccaatataaaccatgttttttttttctctttttggagatggaatcttgctctgtcgcccaggcaggagtgcagtggcatgaactcggctcactgcaacctgcgcctcccaggttcaagcgattctcctgcattagcctcctgagtagctgggattacaggcgcacaccaccatgcccggctaatttttgtattttaatagagacggggtttcaccatgttggccaggttggtctcaaattcctgacctcaggtgatctgcccgccttggcctcccaaagtgttgggattacaggcgtgagccaccgtgcccggcctgaggtttttttattcttgtccctctgttcgcccttatgaggtcttgtcatttacatatgcttttcaccttcctagtggttatcttggtcctgggggcattggagattttggcaagtatccaaattgcactggaggagctgcaggctacatcgaccgcctgctgctgggagacgatcacctttaccagcacccatcttctgctgtgagtgagactcgagttcgcttagaactggaactcaggctttcagaagtgaaggaaagtagaaagagccagcaaacgttaaaccatgcccatttaagaaaacacactgagaactgatgattatttgaaaagtcagctaacttaatgactttagggatcactgtatggcagtgtgtaaacattattttggattttaaagtgagaatgtggagctggacacagtggctcacacctgcattcccagctactcgggaggccaaggtgagaggattgcttgagcccaggaatctgagaccagcctgtgcaatagtgagaccccgtctctgtaaggaaaaaaaaaacaaaaaacaaaaaaaaaagcaagtgagaatgcattgtgtaaatgatcatagcacagtgcttttctgtacgtctcaggtcggatttcctggcagcagaccctgagacagagggtcacatgcaggaagtggatcaggcagtccttgcgggggaataaaggaggcaggaccgtgcagagggagaagttgacctgcacggtcaactttgtaggtagccccagcaaaggccccagccaatcttgggggcaccggggtggcgctgcagaattgttctgaattgaggcaaaggtttgggcccttcctacccctggatggtgcggaaggccccctgcagaaggctgatccctggagaggtagctctctttagtcaagggcagatccagaagaggcacctgtctgagagctgtggtcatgaatacttccagcagctggaggaatgaaggttttgtgctgaaagggttggagggctctgagggtgtgtgacagcacctaattacactgttcatttccagatttctacaatttctgcagtaacatttattttataataaaaaaagaaacatatttaaaaatgttatttgccttaaaagaagataggaagctgttgttgctacagtagggttgaccaaaaagaataaatctggaaattaggaaggtaccgtgcattgcatttgaagctggtcaggaaggcgtcatgtcacaaggcctggagccagcgctgtttgctgcccccgctgcaatcacagtggctgctggactgtgacttgtccctgggagtctctgttccctgctgagtgtccacactgcacactttcttagccggaagcattctgcctgttatccctataagttggcaatgaatttctgcagcaaaaacagaaaaccatgacatactggagtgtattcaggtttgtatttggtctaggagctgtttgtacgtgttttcagatcagtgagtgagtgctgccttctgcttctgtttgttaaggtactttaccacaccgaggtggcctatgaccccgagggcatcctgggcaccatcaactccatcgtgatggcctttttaggagttcaggtatttgttcatttcattaggttactttttctgacaatttatgatattttattcactcatttaaaaaccatttcattaaaataattggaagcatattctctcttgtgctatgggcctaatatattctgttatctttgacagattgtgcagaaccaaaagttactgaaattcagcacattcaagtaattagatataattcttatattctcaaaaaaattcttacttatatggcttatcttagcacggcagtttctagataaaaggtttcccttgccaagctgcagtggctcatgcctataacgccaacattttgggaagccaaggcaggaggattgcttgagtccgggagtttgagaccagcctgggtaacatagtgagaccctgtctctacaagaaattaaaaatattagccaggcatgatggcacacacctgtagtcccagctacttgggagctgaggtaggagtatggcttgaaccaaggaggttgaggctgcagtgagccttgattgcaccactgcactcctggctgggcaacagagtgagaccctgtctcaaaaaagaaaaaaaggttttcctgatggagtgtgcagagtgtgtgggtattggtaacattgggaagtcactgtgtcatttgtcacacttctttcatgtacactcatattagtctgtgtgtcctgacctaacaaaatacccgagactgggtaattcataaagaacagtaacactgcaggttcatttgtctggtgagggtctgggctctcctcccaaggtggcaacttgattggggcatgtccttcaggggggacaaatgctgtgtcctcacacggtgtccccaccagctggtgaaagggcagagacaggacttactgcctcaagcccttttctaaggccattcatgagggtggagccctcacgctgcatcccgtgaatgggattgttgcccttatgaaagagaagccccagagacctgccttgcctcttctaccatgtgaggacagaacaagaagtcgccatctatctgaaaacaggccttcaccagataccgaatctactggtgccttgatcttggacttcccaaccttcagaactgtgagaaataaaattctgtttttcagaagccaacaaaaaattttttttctcctctgtgctatctagtgggacagtccctagccagggtcgctgttgagcatttgagatgtggggagtgtgactgaggaactgaattttaaattttacttaatatgattttaaatttagatggtcacttgtggctagtggttcggctgttgggtagtgcagatctgaagcatacacaggtgaccctggaacacctcggggcatggggacactgtccccccatgcagtggaaaatctacagaggacttttgactcccccaaaacttaaacactaatagcctgctgtggacccaaagccttaccaataacatcaacagttgattcacacatattttatataaatattatatactgtgtttttacaataaagtaagctcaagaaaagaaaatgttattaagaaagccataaggaagagaaaatctagtcctattcattaagtgggagtggatcatcatgaagatctgcatcttcatcatcttcatgttgagtatgagtagtaggaggaggagaaggaagaggaggaggaggaggaggaagaagaggaggaagaggaggagggagtagaggaggaggaggatgaggaggaagagggggtggaggaagaggaggaggaggaagaagagaaggagggtgtggaggaggatggggtggaggaagaggaggaggaggggctggaggaggaggagggtgagggtgtggatgaggaggaggagggtgtggaggaggaggaggaagaggaggagggggtagaggaagaggaggaagaggaggaggaggggtagaggaagaagaggaggaggagggtgtggaagaggagtaggggtcggtcttgctgtctcaggggtaacagaggcagaagagaatccgcatataagtggacctgcgcagttcaaacctgtgttgttcaaggatcagctgtacattttggtgatgaaataattttgtatttagaaatacggcctttatctctgtagcactttctagttgatattgtgcttttccatatattccgtatattcatgtaatccctacatacactttctaggtagatcactggagcggtcagtccagtggggaggctaggagtgcagacctggagccacgctccctgggtttgtgtccagctctgccacttcccagctgggtgacctcgggcgtgtggctgactccctcttgtgcttcaacagcacctacttcagaagggtgttgcaaggattgaataagttaattcatgtaaagttctaagaactggcacataaaaaatgttgattaatattagctattactataaattatttttaaagcttctcatcctttgatgttttcaaaaatgaatacctaatttcagagggattgtatgtgaagtccatatttcactgtttttaaatgtttccctgcctcccccaccctgcctctggttccaccctgtcccggtccctcttcctagtgctgcccagactgggtcaccaaacaggcctgtctgacggaacccttgtcacctttgtggagaattctctttgggccctgcctggaagtaagagccacggagcctgcccaggtgccccttctcctcctttccccatgacctgggcttctgcattccctgcagcagtggagatgtggtgtggctaccatgcttcccccgagctctgtgcctgctgccccattctgctcaggagcctcttcctgcggggaccctctggtgctctggcctcacctctgtggctcgtcctctctgatgcctcctcctccccagagagggcgttcatctctggtcccatgctcctctgttagtctccactagtcaaaggcagaggtgatgtttcccgcctccctgtaatcccagcacctagtagcgtgcccagcaagtgaatctctttgtcaggtagttaagacagtggattaatatgaaataaaaatatccctttggcgattcttttggtcacactgtgttatctcctccaggcaggaaaaatactattgtattacaaggctcggaccaaagacatcctgattcgattcactgcttggtgttgtattcttgtaagtaagcagcattcctcgctaaaattcctttccttcacatgtatagatatttaaaaggaataaaatgtttagcaacactgagctagccattgtcaccacatggcagcaggtaccattttcttcacttgaataacagagaggaacaaatctttccacctaaatgcacagatttattttcttaggaaaatgtctttatcaataaggcagtgtttgccatcagatagccaggaatgcctgaagaaatgtgaggtatgggctctgtgtggagaggcgtatcagagagactgggcaaatcagaccaggttgcagacatcaacttccagattatatgggaaagagagttgcaaggttgactgtttgttcatttcatcctgaccgcagccatgcctcctcttcagagtcactgtcatttaatcagtaagcttaccctcttcaactcagtagaatggtgaagagattttgggagagtatttttcagttcatacatttaaaaaaatatgtttccatttaaaagagaaaaatataaggcacaagtttcagccctctctacgtgattaaataactaatatatattggtgttgaaaccaagtgttttctgagataataatataaaatgttaacatccttctcttccccattacaggggctcatttctgttgctctgacgaaggtttctgaaaatgaaggctttattccagtaaacaaaaatctctggtatgtatggaaaaagcatgattttatggatgactgttcatgctgaaattggatttgttccgtacgagcactgaaacgtctcctccacccctcccaggtccctttcgtatgtcactacgctcagttcttttgccttcttcatcctgctggtcctgtacccagttgtggatgtgaaggggctgtggacaggaaccccattcttttatccaggtaagtcacctccaacctcaaacagagctgggatggtgaccaggaggcaggcccagggacctctggagcatccttggtgctggggtcttgagccactgccctagcggcaggtgtccaaaagccaggctgagggaggaagcagcagggcccacattgtcccagcccacaccagatgtcactggcctgctccagagcagtccaccccattttcaccgtgtaggttgtggagtcgttgtatgacagtttgtgactccacctgtttcttcaggctataccaaattgtggaggagcggaaatgattcagggcacattatccagtttctggttctttttttttttttttttttttttttgagacagagtcttgctctgttgcccaggctggagtgcagtggtgtgatctcggctcactgcaagctccgcttcccaggttcacgccattctcctgcctcagcctcctgagtagctgggactacaggcgcccgccaccacgcccagctaattttttgtatttttagttgagatgggatttcacagtgttagctaggatggtcttgatctcccgacctcgtgatccgcccgcctcggcctcccaaagtgctgggattacaggcgtgagccaccgtgcccagcctctggttcttaataatggtgctatgcttgctttcttaatataaatccactactatagagattgtgcattagaagaaatagcaagaggtgatatcaagggataaatggaatgatttagatgcagttccaaccgaggacttagaaacacatcagatcatttcaatgcctcatttcagccctttgattcgaggaatagttacattctttggacctcagattttctgcctagaaaatataagttattaataataattttagctttcctttcagatttagttttcaagaattgtactgttataaaatgaatattatctaataccttttttgtgtttttgagacacagtcttgctctgtcgcccaggctggagtgcagtggtgtgattttggctcactgcaacctccgcctcccaggttcaagtgattcttgtgcctcagcctcccaagaagctgggattacgggcacaccccaccacgcccggctaattttgtatttttagtagagacggggtttcatcacgttggccaggctggtctcgaactcctggccttaagcgatccacccgctttggcctcccaaagtgctgggattatagtcgtgagccactacaccaggcctttcaataatttttgatatggtttatatttaaatacctaagatatgcattacttatttttggcagtagccaacaatggaagtgcacactttctgttttttcattgaactggtttcaagaattaaatagatggttagatgtgactcatctgtgagaaacatgatcttctgtatgtctctctccttaaggaatgaattccattctggtatatgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctctctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagacaaatgga

SEQ ID NO: 1206 - DNA, 29491 bp, Homo sapiens
agggaggggcggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacaggtaacgcccccgcggcggccgcggctcgggacactccctggaggcccagcggccccaagacccgcggcgcgcgcttccggccccggcgcgccaggccgaagttcccgtggcgccgcgtgggccggtgcatggcgctgggcccgggcggctgccgggacgtcgccgcttcccagggcggcgccggcgcgagaccgcggggacgcgaagcagcgaggtctcggctttccgcctgctttaagccacgcggaaactgctgcacccttgactgcactcgttcagctgttcaggcgtcgcgattcgtaaatataagaaatttcccgctctcttccacggcttcccagaacgctgtgtcgctaacaaccagtgaagacccaagggctagggtgcagttctggtagccgggcaggaaaccagggccagatttgctcaccctaaaaacgaagtgtgagggcttccagtggctggctctgcttggagcccagagacattttcatccaatctgtattttagcgcctcgtatcagccaggctaaaggctgaaaagagatttgctactgaacctctcttaagtctccctgcatcgcctcgtacataatacaagtgaggtgtactggggactgcggtaactttcttgcctctgtcaccccgtctttgctgacacccagttccatcagttctttgctttcagatggtaatgttgattcctaattccctgtgaacctgcagagataatcgccttaggtcttacttctgtagttctaggtaaatccattcgatggcttgtttaccttgattttgtgaatgagtagaagtcactacccatatatatttttttgattggagatagtgttttactgatttaaattggtagccccataatcctcaagtctgctctctggattgtgaaatactcaggttctcacgtgactgtgggtgatttcctggtgactaaatacagccttacctttcccaggccactcccccaggctctaggtgtcacgtcttaggtcatgatttcacttgtatttctccctgtataatggacacaattactagcattgcgcattggatgccacagaatctctgctgtcaacagctgatcattatagagaaataaaaagtgaaaggaagggccggcgcggtggctcacgcctgtaatcccagcactttgggaggccgaggcgggcggatcacctgaggtcaggagttccagactaacctggccaacatggtgaaaccctgtctctactaaaaatacaaaaattagccgggcgtggtggcgggcacctgtaattccagctactcgggaggctgaggcaggagaatcgctttaacccaggaggcagaggttgcaatgagcggagattgcgcccattgcaccacagcctggacaagagcgtgactccatctcaaaaaaaaaaaaaaaaagtgaaaggaaaagaatataagtgaaagtgtttaagagaaattttgttacactgggtaggtagttcacagaaatttctgtaagcactcactgttgtcactatacagttattttagcattgcttattaagtagtcattgaatgccgcctgtgtgctgtggatgttttaagtgcttatctcatttaatcctccaaatacccttctaaggttggtaggtaataatactgccctgattttataaatggtgaaactgaggccccaataagtaactttctgaaggtcacacagctattaagtgctccagccaatgttacgacttaggcagttgtcagattccagagcctgtcttattaatgatcacctgcgccacctcttgagtaaattaatagtacttatttttatcttaaaatgtcaattcctagtattttgttactcaaacgttttaaaaatgctgactgactcaaagaatcttactagaccaatgagttagattgatttctaagttaaaaatactgtgaggcagggagcggtggctcacacctgtaatgccagcactttgggaggccgaggcgggcggatcaccaggtcaagagattgagaccatcctggccaacatggtgaaaccccatctctactaaaaatacaaaaattagctgggcttggtggcgcccgcctgtagtccttagtcccagctactcgggaggctgaggcagaagaattggttgaacccaggaggcagaggttgcagtgagccgagatgacaccactgcactccagcctgggcgacagagtgagattccgtctcaaaaaaataaaataaaaaaaagtactgtctacttgctgcaaaaacttatttttctacttataaaactttaaatttgaaaactgttgattagcttttcagcatctgagggttatttgttttaattttactttaatagtttaatgtgtaaaacatattggcaaaacttggtcatgaagaatccaaccatgattacattatgagccctgtaagttattaatatcaatgtaactgtaattattgtcattttaaaaacactagagtcccttttcttctgtatttgaatgtaaccactggttggggaatgtctgttttcagggacagagcagaatgggctgatatagatccggtgccgcagaatgatggccccaatcccgtggtccagatcatttatagtgacaaatgtaagtttgtttatattaggaaaaggtctgtaagttaaatatagtagcagaattggaattcacaactatgtagcaagatagatgacaaatttctgtctaataaaaatctgaatgacttaagatgagttaattttgtgttttttttatgtgtgtgtgtgatttagctttatgattaaaagttttattttgcccaaagactggacatattctaaataataaacgttacagtatagtagataatagctactatgtgattgtggttttcttttctttgctggagactccaccgccagggagattatgcatgtaccacacaatataaatgagttactgtttttagaataaactttggttgctgaaacatcaggatttaaacatatattttggcagtgaagtgttcagctcagttggaatacatttattgatattaaaatgagtggatttttttctttgacaaaatattcttttgtaatgaatgtgaaagtgtaaattgaaggtcgtggaaatgttaattgttagttcttctaggaaagggaaaatgaataaaatggaatgatagttttgtaattttatgtatatatatttctttcagttaaggcttttctaagatcattcttttacaaaagcattttttttctgctaataaaatgacaataaatgtttaaaaaagcataatgataggtttgccgtattaagtgtgcagatatattactaaacttaatgattaagtggaagtagcacagaagtagatttgtaaagactcgagaaatagatcctcactctatgaaagcttaatatgtgataaaaaggacattttatacctttatgaaaagggtggattaatcaaataatggttggaacagttggctgtgcacttagataaaagcagagttgtatccctatcattcttaggatggagaacgtattaggcaagatgtaaacctcagaatcgattaaggagaaggtcagaatatataactgcacggaaatgcaaaactctcatactttgagagatagtatatatgaagagacaattcacaaaatagaaatatctatgaagagatattaaccttactagtgatcagagaaatataaaccataacttattcagattcataagtacttataacagagatgttgggggaaactaatataatcatatgtttccattgaggataaattaacctttttgcaaggtataaaattaacattttgggccaggcgcggtggctcacgcctgtaatcccagtactttgggaggctgaggtgggcagatcacctaaggttaggagtttgagactagcctggccaacgtggcgaaaccctgtctctactaaaaatacaaaaattagctgggcgtggtggcaggcgcctgtaatcccagctactcaggaggctgaggcaggagaattgcttgaacctgagaggtggaggttgcagtgagccacgatcacgccattgcactgtagtctggacgacaagagcaaaactctgtctcaaaaaaaaaaaaaaaaaattaactttgtgaattcttacatacaccatggttagaaaccctaaaggaaaagataagtttgacctgtcaaccgtttatagacaaatatatcaatttaaaacttacacagcagaagaaaccatgagcaagttaaaaagcaagcagcagtgtggaagaaggtatgtcatttaaacaggatccatattaaaactgagacgtttttacaacaggataaggagacagagagtttaatcaaaaaatggacaaagggtatgaactggcaattcacagaaaagaaaatcccattggccaataaaataggaagaatcctttatcattaagaatgacaggttaaaatgagaattccattttccacccatgatttaagtggcagaaatgaaaactgtcttgatattatattaggtattaagatatatgaagagctccatacatttcatatgggatttttcgaatgtttagccattttggaaagtagtttggtatatctgttaaaactggaaaatgcacttatcttacaacctagcagtgtgttgcttctaatttaatattgggttcattctggcacatggcatgagaagatatgcacaggaggttaaaagcacagactttggagccagaccatctggttcaaattctaacttcacattttactgactgtgtaatcttggacaagttatttaactcctatgtgcctctgtttccacctgtgtaaaatgaggatcttggtagtaactatagatgtagtaaattatttacataaaatagtagaatactgtctggctcatagtaagcactatatatgttagctactataatttgcagcattttttgaaaaagcaagatattggaagctatatgtctatcttttggagaaatggataaaataaaatgtatcattgtcatacagttaatactatataaccgttaagaggatttagatctattataacatgaacagatctcagaaacaatgttgagttaaaaaagtcaaagtttgagaatcttcgagcatgacaatatgttgtttataattttttttttttgagatggagtttcgctcttgttgcccaggctggagtgcaatggcatgatcttggctcaccgcgacctccgcctcccgggttcaagtgattctcctgcctcagccgcccgagtagctgggattacaggcttgcgacaccacacctggctaattttgcatttttagtagagacggggtttctccatgttggttaggctggtctcgaactcccgacctcaggtgatccgcccacctcggcctcccagagtgctgggattacaagcgtgagctaccgcgcctggtctgtttataatgtttgaattaaaagaataatgtttcattttaccttttacagtgaatcggattttggttgtttacataggaacctgaggctttggagctatcccagcctgatagcctcccagtttattttatcaatgtgcatatgtgtatgttttatgtgtgtgtgtgtgtgtgtgtgtgtgtgtaagataatgtattatatatatacatttgtatacatatttaatatgttaccattttgttttaaatttgaaattatttggaagcttggttttttttttgagacagactttcgctcttgttgcacaggctggagtacaatggcgtgatctcggctcactgcaacctctgtctcccaggttcaagcgattctcgtgcctcagccttctgagtagctgggattacaggcatgtgtcaccatgcccagctaatttttgtatttttagtagagatggggtttcaccatgttggtcaggctggtcttgagcttctgacctcaagtgatcctcccacctcggcctcccaaggtgctgagattacaggcctgagccactgctcaaattcaactttttaaagatagtgtttagaactaggtaaactttgtatacctcagaattttgtgaagaggagtaattgttcatattcgtgtctgatactttcagtgttacaggctaaaaggaaaaaactgtttctctatagtcaaaatacttcgacaccaaatgtttggatttttcacaccaagcaattttctgtagacaccaactagttgccctacaatttaattcagttctgacattacccagagttagcacagatcccacaggccaagggatcagtgctgcaacatccatcccacttcagatgccattgcaagtagtgggtcaccacattacccacatttaatattctacttggctgtaaatgacccctttctgtttttttcttttcagagacaggctctcactatgttacccagcgtggtctcaaactcttgggctcaagcagtccttctgcctcagcctcccgagtagctgggagtacaggtgcaaaccaccatacctggcagttccttttttttttttttttttgagacagtgttgtgctgtcacccaggctcggtgcttgcgatcatggctcactgcagccttgacctcccaggctcaagcgatcctcctacctctgcctcccgagtagctgtgactgcaggcctggatcaccacgcccgattaatttctatattttttgtagaggcggagtttccctaagttgcccaggctaattttaaactgctgggttcaagtgatctgcctgcctcagtcttttgtttgttttttttgtaatccaatgctcccaataaatatccttgaatacttgcacacatatgggagtatatttgtgagagaactttctagagctggaattactgggtcaaagagtatgtaaattttaatgatttgttgtagaagtatttgtactagtttacactatctttaataatgtacgagtgaaaaatgcaaagctcagagtgtgatgggatctcgtttgcataaaaatgaaggatggaattaggctatatacttgtagatgcatagactatatttggaaggatacactagaatgagttaataatggttgcttctggggaggaggcttgggaatttagtggaatggaaatctagtgtgaacctttttgtactgtttgagttttctgcctttgggcatatttttcagttaaaaatctgatcaaaatgtcagaaaaacagctatatgaatatatttgaatatatgcaaccctaatttttcttttatacataaggcctatgggagatatggaatctggcatgaactcatgcacacacgtaagcagtaagcatacagttatacataaatagtccatgctttttgtggctgaggcactagggcattattagggtggcggccacagccatttgactttattttgcttgttggtataaatgatacacaggccaataaaatatctttataggtatagtgacattatacattatagtgctaattttaagtaagatggtcctaatgtagttgtgtgctctatctctagttagagatgtttatgattacttccgagctgtcctgcagcgtgatgaaagaagtgaacgagcttttaagctaacccgggatgctattgagttaaatgcagccaattatacagtgtggtaagtaatacacatcatcagtattccctgcttaaatgttttacttcaagtggcttttctttttttaaactgtactttaatttttttaaactgtactttattttttttggaggggggtgcagtttcactcttgttgcccaggctggagtataactggtacaatcttggctcactgcaacctctgcctcctgggttcaagtgattctcctgcctcagccttctgagtagctgggattacgggcgcccaccaccacgcccagctaatttttttgtatttttagtagagacagggtttcaccatgttggccaagctggtcttgaaatcctgacttaaggtgatccactccccgcggcctcctaaagtgtttggattgcaggtgtgagccactgtgcctggcctttaatttttatcaaaatagcaattcgcttatgggtttaaaagtcagaagctgcatgaaaagtagcaatctctagcccaatattccctcccactgccagtcccactccgcagaggtggtaagtaactcttagtgatttttttcttgaattaacctccatattctagataatttgcttaactgttattattttttcattttattttattttattttatatttttacttttattttttttttttgagatggagtcttgctttgtcaccatctggagtgcagtggcacgatcttggctcactgcaacctctgcctccagggttcaatcgattttcctgcctcagcctccccagtagctgggattacaggtgcccgccaccatgcctggctaattttttatttttagtagagatagggtttcaccatgttggtcaggctggcctcgatctcctgacctcgtgatccgcccacctcagccttccaaagtgctgggattacaggcgtgaaccaccgtgcctggcttatttttttcatttaaaacattattccttctgtgaaagatagttcattctccactaccctccctccatcacaaatgagcactcaatttatgttcatgctgacacacttttttttttttgtttgtttgttttgagatggagtttcgctcttgttgcccaggttggagtgcagtggtgcaatcttggcttactgcagcctctgcctaccagattcaagtgattctcctgcctcagcctcccaggtagctgggattacaggtgtacgccaccacacccagctaattttgtatttttagtagagacggggtttcatcatgttgctcaggttggtctcgacctcctgacctcgggtgatccaccagtctcagcctcccaaagtactgggattataggcgtgagccactgtgcacggctgctgacccacatttaatagtataatgacattccctctaacagtgtcatttttgttttctttgtaccaataggtaatttgtcgtccagatgctctgctatatgtgaagtatcatttttctattgaacacaggtcatccttcagtttcatttttctcttcaccaattggatgctgcatacctggttttcagctcattcatgtgttagatcccctgtgtcctagatcgtatacctttctctttcttgatttactttctcattttatagagcacatcattgagtagaaagatggaaaataatttttgggatttatacaattaaaaatcattagtctcccttcaactttagtaataaaattgtagattggaaattattttccctcagaattttaaaactctttttctgtttctcttagcttcttttcaggttgagaagatttccattcctttgtttaaaacttttctttttctctttatgttctggggatttttctgggttcttctgataatttcttctctttcctctgttttctttttctggaatgccttttagttctatgttgtatctcctcaatttttcttattttcatttgtttatctttttattttcttttgagataatttcatcaattttattttctaactctcgtatggatttttaaagatttctgcattcatttttaatttgggggagctgtttttttgttctgtgaatatgcttttttttttttgagacagagtctcgctcagttgcccaggctggagtgcagtggctcgatctctgctcactgcaagctctgcctcctgggttcacgccattctcctgcctcagcctcccgagtagctgggactacggacgcctgccaccactcccagctaatttttttgtatttttttagtagagatggggtttcaccgtgttagccaggatggtcttgatctcctgacctcgtgatccgcccgcctcggcctcccaaagtgctgggattacaggcgtgagccaccttgcctggcctgaatattcttttttaaatagcatcgttcgtgtgtgtgtgtgtgtgtgtgtgtgtttaatttcatggatgtgagatcttctcatctcttttgttctctttcatataaatatttttctcaaatggttggtaattcttgactttctctttatgcgtataagagagacaggaaaaatcctgattggaagccctgtgtgtggcaggatttgtcagctgaagggcttcgctgtgaagttactgagtggggatgtggctgtgttgtagtgaaatctcactagtcagtatttaagtcttttctcttggacagtgtgtctctcaaagaggattaagtagtttattgcctaaggagtgtacatttaactgccacagttctagggtgttaggcaggggaagatggtaggagagtctcactgtttaggataccaactttttgctttttgcagatcttatcctgttgtaatttgaaatagaaacttttttttctaagtttgtatatcaacattttaaatgtccttatttccaccctttaactcaccctgccttccagtgtgccttgtaacccattctgcttcagatttttccagagaataaagccacttgtctcctgcccaagacaggatgtcacttctgtcatggtagtgggaacggtcttggccgccaaggactctttatatagactttccactgtttttagtcccagttttggaaatacgtcatacctctgatttctggaattttcttaaagtcttattctgtgttttagttaaatcttgtctatctgctcacacttcccataatgttgttgacctcttccagttgccgtggtatctttgccccgattctctttgttcttgtgggtttattcctttgttgtcattttagtggggttttattagggagtgagaataaacttgtttacttaatctaccctgtttaactggaattctcagtgtgtttcatcatttttggaactgacagtacacttaaaagatttcctgtgagtttattgctgttttgaaagaagcagtatacctggaatccttacccataaaagccaagggcttatatttacatgctctgggaagtctactttttttttttttttggaataataatggagagaaatactgttgtctctcctatttagcattttattttattttatttttattaatttttttgagatggagtctcacgctgttgcccaggctggagtacggtgacgtgatcttggctcactgcaacctccgtcaccggggttcaagtgattctcgtgctgcagtgtcgcgaatagctggaattacaggtgtctgccaccacacccagctagttttgtatttttgtttgtttgtttgttttttgagacggagtcttgctctgtcgcccaggctggagtgcagtggcacaatcatggctcattacaacttccgactcccggcttcaagcaagtctcctgcctcagtctcccgagtagctgggactacaggcgcatgccaccatgcccagctaatttttttgtatttttagtagagatggtgtttcaccatgttagccaggtctcaaactcctgacctcgtgatccgcccacctcggcctcccaaagtgctgggattacaggctaatttttgtatttttaatagagatggggttttgccacgttggccaggctggtctcaaactcttgacctcaagtgatctgcctgcctcagcctcccaaagttagcagttcattttaaaagctaataaaattaggtcctggaatgtcccttactatatatcgagttggaaatttttgaaattttgaagtaaaactagaccagaactaacgacgtctttaggaaaattccttttgttggtggtggtggttaaaactccacctatggggaaattaaagacaaacttgtttcatttacaagtagcatttttgtggttgttctagaagtattttgttaatgtttataatagaattaatttattatatggataatgtatgtacacgaacaacgtgtactgtgtagggaaagagatgtctttgattttcatattatagaacataggtgaccagagtagtacctgaaaataattttagttggttggctgtcattacttaagaatcagaaatttacttttcttctatctcatacttgttacctttcactatttttttctttttgagacagagttttgctcttgttgcccagtctggagtgcaatggcgtgatcttggctcactgcagcctctgcctcctcggttcaagtgattctcctgcctcagtctcccaggtagctgggattacaggcatgcaccacctcgcccaactgattttgcatttttagtagagatggggtttctccatgttggttaggctggtctcaaactcctgacctcaggtgacccacctgcctcagcctctcaaagtgctggggttacaggcgtgagccactgtgcctggccacctttcactatttttactaaaagtgcttcatttcttccagtcaccagatagtccactcacaagcacttaaattgttaaattatacagagtacctatgtataattttttttttgggtgggggtggatggagtctccctctgttgcccaggctagtgtgcagtggtgtgatcttggctcattgcaacctctgcctcctgggttcaagcaattctcctgcctcagcctccccgagcagctgggactacaggtgtgcaccaccatgcccaactaattttttctgtatttttagtagagacgaggtttcaccacgttggcaaggctggtctcaaactcttgacctcatgtgacctgcacacctcggcctcccaaagtgctgggattacaagcatgagccaccgtgcttggcctataattgttaaattatacagattacctgccaaaaatttgtctaactgtattgctgacttgtagctgtatttgatattgttattagggaacttctgtgtaataatgcgactttggatgttgtatgtttgccctaggcatttccggagagttcttttgaagtcacttcagaaggatctacatgaggaaatgaactacatcactgcaataattgaggagcagcccaaaaactatcaagtttggtaagtttggagtctagctgtgtctcccaggctggagtgcagtggcatgacctcggctcactgcagcctctgcctcctgggttcaagtgattctccagcttcagcctcctgggtagctgggattacaggtgcacgcaaccacacctggctaattttgtatttttagtagagacggggttttgccatgttggccaggctggtctcgaacttctgacctcaggtgatccgccctcctcagcctcccaaagtgcagggattacaggtatgagccattgcgcctggcctagaattttatttaaaaactaccactgtagccaggtgcagtggcttctgcttgtaatcccagcagtttgggaggctgaggcgagcagatcacttgagttcaggagtttgagaccagcctggccaacatggtgaatccccgtctctactaaaaatacagaaattagccgggtgtggtggcgtgcctgtaatcccagctactcaaggagcgtgcctgtaatcccagctactcaaggagcgtgcctgtaatcccagctactcaggaggctgtcaggataatcacttgaacctgggaggtggaggtttcggtgagctgagattgcaccactgcactccagcctgggggaccgagtgagactctgtctcaaaaaaaataaaaaataaaaaataaattaaaaaactaaaaactttaccattgtagcctgttgattacaagattgttgtatttctaagaaattacattataaaataattggtttaatgggaaaagagattaaatggagagttgcagaccctcactaaagttatttaccctgtggaattaaggtgcttttatgtaaaaatctgtagctataaaattctgacatcacaggcattagtgtttgattacatcgagtttttgctaaagagaaattgcttttcttttctggatactgcacactgtcattagcacttcatcacccactgttatgtaaaacacaaaaccactcaaagtagctgctatggaaagcccagcagttttgaaattgttgtacatttctaattatccgctctgttcgttttataaccagtgtagtacaggcgatgcaaattctgtatcccagttaactaatcacttttattaacttctaactgaaaacttatgctataacataaagccgtgtaactccttaaatccgagaacatcagcatgaactttttcttcctcagtttgatatcctggaggatctgattcttagcttttctaaattactgaactcaccagcaacctggaaaaataaaatccagctagtgttcactgacttggaagatttctaaaataaatttggaaaccttctgtctaggcttttgtttttggtagtatcttgtcttaatctgtaagacgaattttttaattttccaggcatgtagaataggtcattcattaagcattaaatccttccctttttcctattgttctgctcacttttagttgaatgttatactctaatatagattttttaagggtccgttttattgagatatagttcacttaccatacaattcccccattcaaagtatataattcagtgttttttagtatatatacagatctgtacaaccatcaccatagtgagttttagaacattttcactaatagatttatataaatatttcagccaaagaaaattataaaaatggaacccaatataaaatccttaagtattttcctagcgcagaaactcctggccgggcgcggtggctcacgtctgtaatcccagcactttaggaggctgaggtgggcggatcacctgagggcaggagtttgagacctgcctggcaaacatggtgaaaccccgtctctacttaaaatccaaaaaattagccgggcgtggtggcaggcgcctgtaatcccagctactcgggaggctgaggcacgagaattgcttgaacctgggaggcggaggttgcagtgagctgagattgcgccattgcactccagcctgggggacaatgcactccagcctggggaacaagagcgagacttcgtctcaaaaaaaaaaaaaaaaacaaaaaaactcctctgttgacaacttgcaacttgtcatagctacttgccagtgtagcagtaaattcagttctgcccactcatttgtagaatgagaagctgcttgtttgatgacactttgcacttagggaaaattgacaggcgtgtgttaagtagaggaacttatatatttgataaaataatagcacattttgtcttgtctctcattatacaatctagtaatgtttcttaattttttgacacaatttcatggttgttgaaagatactaccagatgtagtttgagataaactatctgaattttttttctattttttttgtgttaccttttctccacagtggagtgttaagaattagagatgaatttttgtttattgtgtgtcctttcatgtcacctttacaacatgtgcaactgatattttagttcatgggtaaattaacaaaaaacttctctcccttctttgggctttaggcatcataggcgagtattagtggaatggctaagagatccatctcaggagcttgaatttattgctgatattcttaatcaggatgcaaagaattatcatgcctggcagcatcgacaatgggttattcaggtattgcctttcttgtacagtgtttttcagattttttttttaactgaactaaataaaattactcttaaagtctgtttctaaaccaaaacacacacatacgtagatcattgcacccaatatataactaaaaattattggccatgtgtggtggctcatgtctgtgatcccagtactttgggaggccaaggcaggaggattgagtgaggccaggagtttgagatcagcctgggcaacaaagtgagacccccgtctctacaaaaaatacaaaaattagccatgcatggtggcacacacctgtagtcccagctgcttgggaggctgaggcaggaggattgcttgagcccaagaatttgaggttgcagtgaactatgattacaccactgcagtctaccctgggcagcagagtgagaccctatctattttaaaaaaaaacaaacattattaacatacttaaaacctgacatccttcatgttagctaacctttataatctctttggatgtagtaaatttttagtattttttagattgaatttgtatcatatttgctagcaaattgagtataaagagtagcatatttttactacagatgtattattttaactaacaaaggcatattatacatttttttcatatataaactttggaataggattttacagtaacttaagttttttatttctacccatgtgtcaaagttttatgctaaattctgaatagaatagttgtaactcccactctgggtattttatttattttaaacagttctagtattgtttcctgtgaattttttccagggattgctactttctgcactattcattagaccaagagcatttcaccaaatacttaaaacttaaaaatttttaaacttttccaaatttgattaaaaggataacatattctaaaggtattcaatatttttacttatctctgaaaaacttaatcacataaaagcatacattttacacatacagctctctccatcttccacaatagattaagacataaaacataaccagtatttttgaaaagcccccttaactggcatgcttcttactgaaattatcataaaaggttcgtatgagaaaggattccagaatatcccttaattgtgttgtagcttatgcatttctatttattttatacattatttaattcatgtgagttacttacctggcagggaagatatgatcaccaaggtgcctttcacattcattgcactctggatgtgctgacccctgcaatttccccaaatgggggaagctcaactgcataatttgtgatagggggactgtgtggcactttcctctggtcttcgtggtttaagaacaggttttctctgcttatttttattaaaaaaaaaaaaattatgtgagtcagtggttctcaagcagcagtgattgtgccccctaggggacatttttggttgtcagaacttggggcatgttgctattggcatctattgggtagagggccaggatgctgctaaacatcccaaaatgcacaggacagtcccccacaacaaagaattatccagcccatactttcagtagtgtcaaagccaaggaactgtggtctatttctatatggaaaactattttattaatatttcagttattttcaatgaggatttaatgaattcagcatactctttgatgacctaaaatgggactatgagatctctaaaaaatatttcatgacatatatattaaaaacgtggtaaaattttagttttaaacgttagttttaaacatgaattataaacattcatggcctgtatgtcattggcattgactgtactagagcttcttaaatgaaggagtagaggacccttctttgtccccaaccgatcacagattggatgtattttactgtatttcatgtatatctcatttatataaaatacactaaaaatcaattactttaaaaatgagtctgggtacagtggctcacgcctgtaatcccaacactttgggaggcccaggcaagtggatcccgtgaggccaggagttcacgactagcctggcaacatggcaaaaccccgtctctacaaaaaatacaaaaaaatgagacgagcgtagtggcgcatgcttgtgttcgcagctactcaggaggctgaggcaggagaatcacttgagcccaagaggtggaggctgtggtgagctatgctcacgccaccacagtccatcctgggcaacaaaatgagaccctgtctcaaaagaaaaaaaattaaaagtgaaatacacacacacacacacacactactactcaccagtcaaaagaaatgaatgatccataccggcaacaacttggatggatctcaagggtatgatccttagtggaaggggaagtctcaggtttcatactgtatggctccattgagataatatccttgaaacagcaaaattatagacgtagagaacagatcagaggttgccagggtgagggaaaagggggtacagctataaaggggtagcatgaggtagtttctgtgtgctgagggaatagttctccatcttgattgtggtagttatactatacatgggattaaattgtgtagaattatattctacccccactcctccacctgtcccacatacccacaagtgagtacatgtaagatctgaataaggtgagcggttccattaacaataatgtacagatgtcattttctggttttgggattgcactttagtaagatgtttaccatttggggaatctaagtgaagggtacacagggcactgtgttatttttataacttccatgagtctgaaaacaaatagaaacatatgtatagaaaacactactctttgtttttcattattagactctacagacattaaattgttacattgatacaaaagcttgtaggtgtttactctctatccttagcatgctggagactgagaacagtgggaggacaccaatcagtgcccacactaggcactagttcctgaactccactaggaactttcacaaaaatgttactttccttaatgcgtttatttttatgatcacctgtaaaatcggggactatcataggagattcttacttttttgctgttaccaaataagaaaactccattatcttttttataatgtcccctactttcaaattatttataagttttttttatcattttcctcttttaaattatctttattggttctcttcccccatttttttttattaagagagctttataatataaaaaatttatattgcctgggtgtggtggctcatgcctgtaatcccagcactttgggaggccgaggtgggcagattacttgagttcaggagttcaagaccagcctggccaacatggtaaaacctggtctctacgaaaactacaaaaattagccggttatgttggctcacacctgtagtcccagctacttgaggagctgaggcaagaatatcgcttgagtctgggagttggaggttacagcgagctgagactatgccactgcactgcagcctgggcgaccaagtgagacgctgtctcaataaaaataatagaaatttatatctttgtccaattgtgtatatttcttttctttttctttttcttttttttttttgggacagggtctgtttctgtcgcccagagtgcagtggtgcagtcatagctcactgcagccttaaactccggggctcaagtgatcctcttcagcctcctgagtagctgggattctaggcatgtgccacgatgcccgactaatttttttatttttattgtttttattttttggagacagagccttgctctgtcccccaggcttgagtgcaatggcacgatctcagctcattgcaacctccacctcacgggttcaagcgattctcttgcctcagcctcccaagtaaccgggattacaggcgcctgtcatcacacccggctaatttttgtgtttttagtagagatggggtttagccatgttggccaggttggtctcaaactcctgacctcaggtgatccacccacctcgacctcccaaagtgctgggattacaaacttgagccaccgtgcccggactgtctttattatttttccagacaagatcttgttatgttgcctctgctggtctcgaactcctggcctcaagtgacctttctgcctcagcctcctgaagcagtgggattgcccatgagagccaccactattgaccatgtatgcttctctccatgtattttaatgtaattttatcatatgtgcacttttgaatgctacccttttacttaattttcatttttgaatgctgcccttttactttgatatattaatatcggccaggtacggtggcttacgcctgtaatcccagcactttaggagcccgaggtgggcggatcacctgaggttgggagttcaagaccagcctgaccaacgtggagaaaccccatctctactaaaaatacaaaattagccaggtgtggtggcgcatgcttgtaatcccagctacttgggaggctgaggcaggagaatcgcttgaacccaggaagtggaggttgcagtgagctgagttcacgccattgcactccagcctgggcaacaagagtgaaactgcctcaaaaaaataataataagatatattaatatcaagtcacatcaaatttatatctatactgtggtcactccttctcttactagtgagtttggggtttttttccctcaaaattttcttggatgtcttttttcctgctttctgtatgtgtctttccaggctctatcatcaatttcatacttgtatccccctctatttcctttacttgcagctatcactaccttctgaatttgtgataaatcctgtgtcctcagttctaccttctttgttgtagttttaatttattttttattcataaataatgggacatttctaattggatgatttttctaaatttttcctttaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccagttagtaatctccttcacttgctcattcgttacaaacatgtttgcatgcctaccatatctcaggcactggggatacagcagatcaagatcctaccccatggaactaaaagaggacagagtactgagtggaacataggatgatagatttacaaataatgtagcatacttctacttcattgtatcttaagtttcttgaaatattgctactggagattggaaagaaatcttaatgttatggggtattgtctaagaagctttattttaaaaccatctcattaaattttgttgcattttagataatcgtccccagatgccatgttaccctagtgcagagtttggggctggataagtttttgttgtaggtggctatcctgtgttttgtagggtatttagcagcatcctggccttaaaacaaaaatgttttcagacattgccaaatgtcccccgagcggtaaagtcacccccaagttgagaaccgctctatacaaagagctgttattagagctagacatttctgaattggcatcaatttctatattgtatccataaacattagtagccacgatttttgtgaccttatttgtccattgtgtctgagtgtctgttttacaatttgaacaggcttgttgttttcagagcctgatgagatgggagtcataattttagtgtaaatgtgtttgaacaactgttgagtggagctgatttgtatagtgcatctcctctcttccaagctcttgattttgcctggatcgaggcagcttgctcttcttttatctgctctatacaggattctggtgacttaaaatttataaaaggctttaatccatgtctcaccttaacactctgctctgggcttttgtctggagcgtgcactacccctcaagcacacttcatgctttttttctagtgctctcctatataaagctgtacaggcatacctggttttttgagccttgtatatattatgttttttttttttgtttgttttttgttttttttaacaagttgaagcatcttgagcaatcttgagttgagcatgtcttcattgccattctttctaacagcatgtgctcacttgtgtctccgtgtcacattttggtactcctcagtatttcacattttttcataatcattatatctgttccagtgatttgtgatcagtcatctttgatcagtcatctattgtaattgtttgggggtgccactaactgcacccatataaaacagagaatatcactgttgcatgtgttccaccatctctctccctcacctcaggcctccctattccctgagacacaacaatattgaaattaagccaattaaccctacagtgtcctctgagtgttcaagtgaaaggaagagtcacagcctctcactttaaatcaaaagccagaagtgattaagcttagtgaggaacacatatcaaaagctgagataggtccaaagctaggcctcttgcaccaaacaccaaactcataagaaagagttcttgaaggaaattaaaagtgctgctccagtgaacacctggacaaaacagcattattgctggtatagagaaagtttgagtggcctggataaaagataaaaccagccacaacattcccttaagccaaagcctaatccagaggaagccctaattctctttaatttgatgaaggctgagagaagtgaggaagctgcagaagaaaacttggatgctagcagaggttggttcatgaggtataagaaagaagccatctccatagcatggaagtgcaaggtgaagcagcaagtgctgctggagaagctgcagtgagttttccagatcccgctcagatcactaatgaaggtggctgcatgtaaacagaagattttcagtgtagatgaaacagccttctattggaagaagatgccatctaagacttttcatagctagagagaaggcactgcttcaaagcttcacacagctggctgaatcttgttagggcccaatgcagctggtgacttgaagttgaaaccagtgttcggtgatgattctggaaatcttagggcccttaagaattatgctgaatctcctctgcctgtgctctataaatggaacaacaaagcctggatgacagcacatctgtttacagcatggtttactgaatattttaagccctctttgaggtctgttgttcagaaaaatttcttggaaaatatgattgttcatggacaacggacctcatcacccaagagctctaatggagatgtgcaaggagatgctgttttcatgcctgcgaacacaacatccattctgcagcccatggataaaggagtcattttgattttaaagtctcactatttaagaaataaattttgtaaggctatgagctaccatagatagtgattcctccaatgaatctgcagagtcaattgaaaaccttctgggaagaatttaccattctaggtgctattaggaatattcgtgattcataggaggaggtcagaataccaacattaacaggagtttggaagaagttgattccagccctcatggatgactttgaggggttcaagactttagaggaagaaggaactgctgctgtggtggaaacagcaaggaaactagaattagaagtggagcctgaagatgtgaccgaactgctgcatcaagacaatacttgatcagatgaggagtcgcttcttatggatgagcaaaagaagtggtttctcaagatggaatctaatcctggcaacgacgttgtgaaatgacattgttgaaatgacaacaaaggattttaaatattgtaaatattacctgaacttagttgataaagcagcaggatatatgagaggattgactccagttttgaaaagttttactgtgagtaaaatgctatcagacagcatcacatgctacagagaaatcttttattgttgtcttattttaagaaattgccacagccatctcatccttcagcacccagcaccctaccctgatcagtcagcagccatcaacatggaggccagaccctccaccagcagaaagattacgacttgctgaaggctcagatgatcattagcattttttagcaataaagtattttttaattgaggtatgtacattgtttttttagatatgatgctattgcatactagactacaatatagtgtaaacataatttatatgtgctgggaaaaagaaaagtcgtgtgacttgcttaattgtgataaaattgctttactgaaccttccatatctgcaaggtattcctgtattgttcagtatggtagctactagccacatatggctatttaagtttcaatcggtatgattataaaaaattaaaaatacaattatttcattgcacatgtcctattttgggcgttcagtacgtacatgtggctagtgactaccatattggacagcacatacaaaacatttgcatcatcactggcagttttattgaacattattcgtctaaagattgacagtagttagcggtaacaaagcattttaaaaattgaatatgaagagttttcaaaatgcaaacgtttagccttttcagaggcagatcactggcttcctgttgccaaatagaaacagaaataattacccaagaatctaaaagagcttcctatacttaggatttattttccttttaagatgggtaaaagaagtatttaaaatgtgaagagtagctgtaggtatctagaatttacagtttgttaaattttttttaactctaagcatacacagatagatgtacataattatttttgtcatttttttctttttattataaaagtaatgcaatgtagttatggggggggaaattgtactaaattctataaagtaaaaagtcaaagtcttttactgttcttcatcccacatcccattttccagagtgagctataattgggtgaatttttccaaactttataaatacacttgcaaacatttatacacagcaacctagataataatgttacaggcattgccttttcagttaatgtgtcatggccctttttctagactatgagtgcatagtcttctagtactaccaataacagcatttatcaagcatttactatatgccactaattctaacagctctgtgagacacttcatgaagaacttgaggttccaggtaattctgtaatttgcccaagagcacataatttatgggaccaggatttgaagcgaggcagcctgacctcaaagttcatcggtctttttgtttgtttgttttcctaagagacagggtttcactctgtcacccaggctggagtgcagtgacggatcatagctcactgctgccttgagctcctgagctgaaggaatcctcccacctcagcctgcgagtagctgggactacaggcatgtgccactgcatccagctaattgttaaaattttttgtagcgatgaggtctcactatgttgcccagactggtcttgatctcctggcctcaagcagtcttcccgctttgatctctgaaagtgctgggattacagatgtgagccaccatgcccagctaaagttcatgttttaaccataaaaataggtaatgctttagtacacatgtatgtaaataaaaatttagatattgccaaaatgaaattaagaatcttaaacaaggaccagctaagacctgcggggacatggtttcgcaaataattggaaacattaagtcatgtaaaagtagttggaaaagtatttttataatgttgaatgagtttattattactctgtggaaaaaaaaaaattatagtaacagcactgcagcagaaccaagactaccaagctttagtcagtgacttactcatctgagcaattatgtggtaaagcaagttctgtggcttccttgggatttgtgataattgagtctgaattatatttaatctgtttaaggggaagataaaggtatggagcacccattttgacagggaatcacatcacagtttactagtcatcttgctttggaatataagaaatacattcttgtgttgatttttcatttttattctttgcctatgtaatttccatgccattttttaatgatagctaaagattatgtaaattctcctatttcagtgactagggatttgttgggacgtaagtagagcttagactgtttccccaaggttgctttaccaataaatggaaagtttccttcttttagctgatgtttccttcaaaaggaaaatcttccatattatttaaaggaaatattttatgttcctttttttcctattgtgaattgaagcttttagattagttttgtgtccttccctagaactgaattgacagctgcagccttaagggattctcgtgatttaaatatgactgagagaggtgccacagtacactaagaaacgctgacacaagtgaaagtgtgtttacaaagctgtgccacagtcttagtaaaactgtgtcttggccgggcgcagtggctcatgcctataatcccagcactttgggaggccgaggcaggcggatcacaaggtcaggagttcaagaccagtctggccaatatggtgaaaccctgtctctactaaaaatacaaaaattagctgggtgtggtggtgggcgcctgtagtcccagctactcgggaggctgaggcaggagtatgacttgaacctgggaggcggaggttgcagtgagctgagattgtgccactgcactccagcctgggtgacagagcaagactccgtttcagaaaaaaaaaaaaactgtgtctcatcattgcactgttcttttaaaattgtatatatatatttttcttgcagatacactctggaaatgattaaactagtaccacataatgaaagtgcatggaactatttgaaagggtaagaggttgtttttgctttttttatatataaaaaagaagtggctatatgatgcatcatggagtgtattccataatcagattccaaaaggatagtaaataatttttcatttttctgaacctaagagcagaagtataacagcattatggaaactctctgggagtttgcccttctatgcacctcccaagtacctaccaacactgttttcagaataatccaccagtaaataatgccattttaattgtatttaagaatcctgtagtctttatatcaaagaatggaacacacacacccccaggctctagttggctcaggaacacagtaaagcggggtagtttacaggtagattttgccagtgggcagccaacctttctgttttcatttctagagatctccgccttcaggttaacctactcctcaactagaaaaggtttcacttgcctggccactgacgtaactaagctccttgttgaacataagaggtcttcaaggaaactaggctcaaagagcacaaagtatggaaccagttacccttggagatgtgtcaggggaggtgcctgtagtatttggagagctcgagggatgagaagccatctcaagagaagacgagggctgggcatgttagctcatgcctgcaatcccagcactttgggaggccaagatgggcggattacttgaggctaggaggtcgagaccagcctggccaacatggcaaaaccccgtctctactaaaaatatacaaattagctgagcatgttggtgcacacctgtaatcccagctacttgggaggctgaagcacgagagttgcttgaacctggaggtggaggtcagagtgagccaagatcacaccactgtgccccagcctgggcgacaagagaccctgtctcaaagaaaaaaaaaaaagaagaacatctctcctggttttgtccttcactttttaagatgatttattttgtgtgttgtacagtttaagttataaatgaacacttttaaacttcatttttaaaaactttttctacttagcttgtaattatcctttttttttttttttttttggagacaggatctcactctgttgcctaggctggagggcagtggcatgatcgtggcccactgcagtctcgatctcctaggctctagtgattctcccacctcagcctcccaagtagctgagactataggtgccaccactaggcatggctgatttttaaaaaaattttagtagagacgagatcttgctattttacccaggctggtcttgaactcctgggttcaagtgttcctcctgcctctgtttcccagagtgtttcccaggcatgagccactgcacctggccagctcttaattaactaatgatctatgataagactcatgtaatttaaaagtttcattatagtttcagcgtcattcattcaaaataactctccttttcttgtttgtgtttcagggtttattttctcttgatctttctactgcttttgttcttccttcacaaaatcaagtctttgttttttgttgttgtttacaggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagaggtaagctggtggggctcagtgctgtcatttttggtatctcagaattgatctgcccaataccactaatatccatgtcccctttcaacatcgttcctcagaattcagtgcagggctatttctggttaggggcagcattgacatcacttggcaacacagccggtgactcttaatagtgtgtcttcatttgaatgtgatttgagttaaattgtattggctcaaaggcatttgcgcttgaaattgaattacatattactttaatttttatttttcattttcagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaacaa

SEQ ID NO: 1207 - DNA, 29491 bp, Homo sapiens; identical to SEQ ID NO: 1206

SEQ ID NO: 1208 - DNA, 29668 bp, Homo sapiens
ccagtgcgtgctggcccggggtggcaggagccgcagaggcttgggctgcaggtaggtgctgcggcgaggggtgagagggcgaaggggcgagggggcgtgcagctgggtttcccgggggaccctgtacgtggcctgggccgcaccccccgcagccccggccgcctgcccgcggcctgtccggaggctccctaggaggctgcgctgggcctgagcggccgtgtccaccgcgcccagcccctatctccgcgtccacccctgcgcggtagcgggacgttaaagaaccagagaagggcccggcgaggtggctccagcctgtaatcccagcgctttgggaggccgaggcgggaggatcgcgtgagctcaggcgagagcagcctgggcaacatggcggaacttctgtctccgtaaaaaagcacttagccgggcgcggtggcgccgcctatagtcttatctactccggaggctgaggcgggagaatgcttgaacccggcgggggcggaggtttcagtgagccgaaatcgcgccactgcacttcagcctgggggccagagtgagaggctgtttctattattattactttatcattattattattatttgagacggagtctcgctctgtcgcccaggctggagtgtagtggcgcggtcttggctcctgggattacaggcgtccgccaccacgcccggctaatttttgtatttttagtagaaacggggtttccccatgttggtcaggctggtctcgaacgcctgacctcaggtgatccgcccgcctctgcctcccaaagtgctgggattacaggcgtgagctactgggtccggcagaggctgtctctgtttaaaaaaacaaaaaccaaaccaaaccaaaacaaaacaaaaaacaaaaaaaccagaaaggaccgaggactctgtctcagctctttgcctttgggtgtttattctgcacgagatcattgttgccaggaggtgttaagtgtaatcatattctcttttttttagaaagcaaaatttcgctgttttgttgcataatcttgtctttgccaccctttgcctttgctatagaaccttaaggctaaataagcgttcagaatatttaaaataatcctcttaatgtaccttgtgctttattggcgcaatggaattctactctaaactgtattggatgacattactctgtgtcttccctagttgtagaaaatatcttgtaagtcggtaaaaactagttttgtccctttgcttttcttttctttttaagctgtaaatgtggagcagtgggtcccaagcctttctctatcaataagccttcctatcagtgtcagaaatgctttgcatttcagtcgtgcctgaatttcttctgcccaacctgccccaccatctttattccttaatgtgcaggctgttttcaggaccagtaaatttcagtggtttttgcttacttctggacacgaaagttcctttagccacacagcctcatgctatgctctgggcggcctactccagaatatgcctgtgaaacaaaaaagcaaatcggggttgaggtgggctgaagtcttctttaagaaaccggcagtcccagggtaccccagcccagcccctagctgaccacgctgggtttgatttagttcaactcccgagcattgcggtatttaggggaagaatgggcttgaggccagaaaacttggctcttctgtgtatagttcagtgaccttagatatattacttcacctctgactcagttgtcttatctgtgaaatgggaataacaacaattacatccacttcacagaattggtgtgaagttgacagtgtataaaagtcaaatgaattttggggtattttttttatttgttttgttttggtttggtttggtttgtttttgccgagagaggattcagaagtgaatgtgaggacttagggatatataaaaggtttttggggcatatgaaatttggattcagcaagaaatgcattaaaggttttctgagtaatgctgagggtccaagagagattagaaaatatgcatttctagagtcccacagagttttgtagctgatgttggcagcctttgagtggaaatgaagaagtggacagggcaagttacatgggtctggtgaatgacaagcagatctgggtttatgatgaagcctctagcctcttcacttgcacaaataccttccaaaaccttgcacaaatcctcttgccaaaactctggcaagaggctcagcacttttacattcataactattcttctcttaaggaattaccactccttgccccaacttgtataagcttcaggccccataaaacctgaatccactagtggcaaggaaggattggtgggaggttaggggtaaggagggttggagggttgaaaggatttatcgcagggtttgagctgggaaacttggattggagaaggaggtggcagatgagggtcctcagaagacaggagccgtgaggagaggaagagcggattccgtggagcgaacacaggagagggaaagcagcctgtgcggctgaggccatgaagagggagaggtgcagagtgaccaggcagttggtgcgtctttgccgagtacccgctgtgtgccaggcactggggtgcagtggtgaacaggacaggcaggcaggcttcttggtgctcagaatctagaggaagccggggcctgggtatcccagaaagggagcctttgaggaaagctcaggggccagagagtgtggtgcagggagggtttagggaagcagataggggctagatttcaggaggccacataagagtttggacttgatcctgtgggccgagtggggggctgttgaatgttaagcaaggtgggatcagatccgtgctttagaaagctctccctgcatgggccggacatggtggctcatgcctgtaatcccagcactttgggaagccaaggtgggcggatcacgaggtcaggagattgagaccatctggccaacatagtgaaactccgtctctattaaaatactaaaattagctgggcatggtggcacgtgcctgtaatcccagctctgtaatcccagctactcaggaggctgaggcaggagaatccctttaacaagggagtcagaggttgcagtgagctgagattgtgctatagcactccagcctggtgacagagtgagactccttctcaaaaaaagaaaaaagaaaaaaaagaaagctctccctgcatgtatcagagaaacttccatgtatgcctggggagatgtatacacagcttgtctcactaattgtggaaaagtcaaaccagttgaaaatagtgaactgagttttgtgcatctgcatggataaatctcagaaatgtaatgttgagcttttaaaaaaaactggttgcaggaggataataccagcccatcactgtttgtataaagcttgaaaacatatgtatgatttatgggcacatacttgtgaaaataagcatgtatgagaagcggagtttggtaacccatccctgtagtcagtcccagctgcttgggaggtggaggcaggaggatcacttgagtctagcctgggcaacatagtgagactccatgtcttaagtagatagataagtaggtaggtaaatagataagatcgattagatagatagacagcatgtataggaattatatacaccagtggttttcagactttagcatgcatccaaatcacctagaggatttattaaaacacagatgttcatttctgattcagtaggtttggagtgtggacccaagaatttgcatttctcccaggttcctgggctatgacgccacaggtctggggagcacagtttgagaatctctgatgtccaccaacttgaagatagtgatcacttcttgagggggagtagaattggatggggaggagtccagagggtcttcaactctatttgtaatatttaatttctttaaaaaaagatctgaaaaaatgatgcagtgtgacttgacaaagctggatgaatgcttatgattttttttttctctgtgtgtgaaacacttaaagaaaaaggatcctgtttgctgtgtaatcctgagaatggactgcaagagaggaaaaactgggcgtctgcttgggaatctattgtggaaacccaggtgagaggtgctgctggctcacgcagcggggtggaggggaagggcagcaaggaaggagatatgcaagcagttgtgagggaggttttggtgggagcattgactgcatgtggtaatcggttggtttagagtttaggggagggaggaatcaagtcacacacacctggtctgtaacttgagtgggtggttgggtcatgagcccatgacagagggaaccctggaggaggggcctgtggggactggggagttctgcagtggacatcccataccttgataggccagtgagcaaagcataggagagacctgggctgcagtgcagacttagaaagcagcagagttcagatggctgctagtgtcccaggtgtgggtgaggttacctgggtctttggcagacctggaggaatgccatcacctaaggcagggcttggccaaccacagcttctgcttgtttttgcgtagcctgagagctgggaatgcttttatctttttaaatgttagggggagacttcaaggaagatataattcacaaaccataacatttgacattttaaagtgtacaattcagtgatatttagcatatttacaaggttgtacaatcatcatcactgtctaattcaggaacattttagccaaaaagagaccccatccctgtcagcagctattccaccccctgcctccccagcctctgggagccacaaatctatgttctgtgtctgaatttgctgtttctggacatttcatgtaaatggaatcttacagcatgtggcctttttgtcaggcttatttcactgagcatgatgtttccagggttcacccatgttgcagcatgaattagtgctttattttttatggctgaataatattccatttatggatgtaccacattttgtctatccattcatctgccaatggacacttggcttgtttccactgtttggcagttgtggataatgcttccgtgaacattcatgtatgagtgtgtgtgtgagtgtgtgtgttttcataggtacatactgggcagtggagttgctgggtcgtgtggtgactgtgcttaaccttttgaggagcggccagactgctttccacagtggctgcattttactttctcaccagtgatgtttgaggatttcagtttttccacattcccctatgttgttactgatttttgtattatagccatcctcatgggtgtaaaatgccatcttgtcacacttctgatctgcgtttgccttgatgactggtgaagctgagcatctttcatgtatgtgcctgttggccatctgtgtatctactttggagaaatgtctgttcaagtcctttgcccattttaaaaattttatttgtttatttttttgagacagggtctcactgtcactcaggctggagtgttgtggcacgatcacagctcactgcagccttggtctcctggactcaaatgatcctcccacctcagcctcctgagtagctgggcctataggcacaggccaacatgcctggctaatttttaaatttagtttttgtagacaggaggtcttactatgttaccctggctggtctggaactcctaggctcaagcgatcctcccaccttggcctcccaaagtgccgggattacaagtgtgagccaccaatgcctgaccctttgcacatttttaaattgagttgttttttttgaatcttttgagttgttcaccagacatccacatggagatgtcaaggaagcaagccttgggttctgaggagaggctgggaatggagttttacctttggaagttgtcagcaggcagcgatgaaaagtcctgagtctgggtgagctctcccagggagtgtggcagaggcctgagctctgaactctgggggaccccactacgtggactcagagatgaggagctgccagaatgtagtttcctggaaaccaattatataaggcgtttaaggagggagttatcaatcacggtagatgctattgatagatcaaggaagactggggctgtgctttgactgttgtgtttagtgatgtggaggccacctgtgctgactgtgataaggtcagtttgggtgcagtggcagtgagttggagagaatgagaggacagagctgggcgtggggtttgcctgagctgggctcggggccagtttcatggtaacacactgtttgtagtaataggagagtgcaggaacctggggtggggcttgggaactggtggaaatgctctctgattgcttctgtttttctagtaaaataggatgatctcgttagatgatcagctgagagtgaaggtgggggaacaggtggtacatgtttggagaaggagagtgtgagcttccagctagcctaaggccactcgggacacacctatcacttttattgactcactgcaataagcgaggctgcatactggcgggacttgcatatcttcatcagagggacagagagtcatctgagagggcacagggcaggagtccttcggggcctctctgacctggcccggggcagggagctggggatggaagtgccatgagtgcaaatagggagcagggggtcagaggaacagaggatatgggaatgggtggtggagccgggagagactggagctttgccaatgggggcctgggctgagcagggctcagagcatgtggtgatgagccttatggcaggtgaggctcaaggcccagtgtgtgcttagggaagtgggcagcagagcgggtgagggacccgtgggtgtatcacaggggtagggtgttgaggaagttccaaagcaagctaataggggttatggctggagagaggcccagtgtgtgtgctaatgggggatagtgtggtagaggcaccagggtgtgtgctaataggcctctgaggcctcgtgtgtggtgatgggggtgtgtatggtgttagtgctgtgtgtgtgtctgtgggggcctgcagggtaggagagaatggggtgcttatggaggggaggtggttgaaggactcaagtgctgggtgtgcgcttgtgggggttgtgccgtggtgggtgtgtgcatgcgctaataaaggtctgggtagttggagcccagtgcatgctaatggaacagagctggagggacctcatggagggatctgatggagggaggacggtgggagacctgagcctgtgctagcggggatgaggattgtggatctctgtgaggtagggggtggtggtggtgcgggaagggtcttggtaccgtcagaggcccggtgcgctaagggtcaagttggtgtgaggtgcacgtgtgtccctgagcacgaggacactctaggaaggggcagccggatggtttaaggcgttctagaggctgctactgtgggtttagagccatagaggcactgaagtgtgtgccattgctgggagagtcagcagtgtgaggtctggagtacgctcaagagcgccagaacagtatgagcttgtgtgcttgcatctgtggggtactggaatgtgttgaggttccagggaatactgatgcaggggatgagtagagccgtggaggggataaaaataaatttaaaaggccaggtgcagtggctcatgcctgtaatcccagcaatttgggaggctgacgcaggaggattgcttgaggccaggagttcaaggccagcctgagcaacatcgtgagacccagtctctacaaaaaaaaatacaaaaattagctggatgtggtgatgcgcacctgtagtcccagctactaaggaggcagaggtgacaggattgcttgagtttgaggctgcattgagctatgattgcaccactgcactccagcccgagtgacagagtcagaccctatgtcaaaaaaaaaaaaaaaaaaaaggaagaaaatcatagaattttggagatgagtaaagtttaggcaaatttaaatgaagtagtgttttgatgggctcaaagccatgtagaactgagtgtaaaggggccaagatctagtctggactgcaaagtggtcctctttccttggagactaccaggttaacatagatgtgcaggattatctccagaaactccttatctgaaggtctgccctgtttgggaactgaggttgcttctgtgtgtcagagtgactttgatcctccaggaaagcatgggatgttttatcccaactgataagacttcaaactgcaaaatttctggtagtctgtgattgtagagaacagaatttctaggtagtaaaaaaggagtcttcatccaaagggggtttttgacactttatggctgcagtgtgttctaaggagaaatgccgtttcctgttaactttgtggtttcattgacgtcttgtcccagctctgtatatgggagtggattttgttttctcaaggaggaggtaggaacaagcttcctgtcctggatttttcatggctggctcctctcaggcctctagtcacagtgtgaaggtcacctccttagagaggtctcctgggatgcttcctccagggagttcctacacagttactctctatctttgaacccccatcacaggatgatgatagacctatttgtttacttgtttattgtctgtcttccccactagacttttcccctaagctccagcaggataggaaccatgctggtgtaattcactgtgtgtgaatgtctccagcacccactgcagggctgggcacatagaagctgctcaggacatgttgcgggaatgagcagctggaagtcagtgatggagaagaagagagcagactgggacagagagactctgatgggcttccccacggccctgctctgtcctggggcttgagaacctgaggaaacctggacttgaggcaggaggagggccctgggaaagttggaccgtttggactatggcgatttgtctgggtacatagctgcagtttctgtttacacacttcctgtttggtactttgtggcagggtgtttcccgaccagtccctgggcgccaactagagtatggactgaccaggtacctggatggagacctgagctggagaaggagatgcgcttgggaggtaaccctgcatgtcacagctgtctctgacccagttctgtcccagtgccccagcattccagtgctgtttagctggctcccactggcatggccacatccactgttaaagtctccatatacttccattctgctccattctgcttctgtaaatcacctctgccatccacggtcctacttcaggcttctccgcagccaggcccctccaccatggccttgcacggctccagcggtagagcccacacattatcagtggttacttatcgctggtgtgacatctgagtggtcatctctccaatctcatcgctgttattctagctcatgtacttgtcagctcctgtccgtggtcataaccagggcttcttaataactggtctcccagcctcagtctctttcaccccaaatctacctttcataactgctgaagagtagcttttatttcttaaaactgttgaggggattctgagtacctcccagggaacaggacagctgcttagctgagttcgacagaggccctcagcttcccagcctccacctgctaccctaagcagcctccttctgctgtcctttgtccaccctctgtccctgtcccaccagttgactaatacattttgctttcattttactgaatattcatgagcatctatttaatgcatgctactgtgagtcggacagagtcagacacaaacacctcccacctaacctaatctagaggaacccgcattttagtttgtaataaaaagtaatgattatggaaacagctaacattgggcatttgggataagcctggtgttcgatacctgctttaatccccacggtaacgctgcagcttacaggacccttgagtagaagaggcatcagaacacatttttggaaatgaaaggaagtgaaagctgactgtcatgacttcttgtttcattgtgtattttaggaaattgcagaggccgtcaacatggaaaagcagccccagaacagcaggagaggcctcgccccccgagaggtgccgccagctgttgggctgctgctgatcatggccctgatgaatactctgctctacctctgcctcgaccacttcttcatcgctcctcgacaatccactgtggaccccacacactgtccctatggtcacttcaggataggacagatgaaaaactgctcaccttggctgtcctgcgaggagctgagaacagaagtgagacagctgaagcgtgttggggaaggagctgtaaagagagtgagtccgggttcatttgcgattgctgtcatcctgttatttcgcttaacacagtgtcctccagctccatccatgctggcacggattacggaatttcatcctttgttactgccaaagtgtactccattgcatatgtgcaccacatttgctttggttgattctgtatcttggcaattgtgaatagtgctgcagtaggcataggtttcagcccttagggaagcagtgtggcatccagtgttaggagccctgctagctctacgtttttattgttgagctcaataatcttacatctggcactttatctttttttttttgagagtctcgctctgtcacccaggctggagtgcaatggcgccatctcggtgcactgcaatctccacctcctgggttcaagtgattctcgtgactcagcctcccgagtagctgggactatgggcatatgccaccacgcctggctaattttttaattttagtagagatggggtttcaccatgttggccaggctggtcttgaactcctgaccttaagtgatctacctgcctcggcctcccaatcggactttatcttaataagtaatccaaggcaggaaaaaagtcaaatgcataaaagagtgccatagtgatagaaaactagaaacaaaacttttagaatagttcattaaatgatggtccatccacttgacggaatattctgcaactgttgtgtagttaggaaccccaagaggcaacatgaataaaaccttatgatgataagtgaagaaaacaagatataaaattgtataattgacttttcaactgtgaaattacgtgtatatgtagataaatacaaaaatggtcaggcgcagtgtcttatacatgtaatcccagcactttgggaggcggaggtgggcggattacttaagcacaggagttccagaccaacctgggcaacatggcaaaacccagtttctacaaaaatacaaaaattagcctggcataatggtgcgcactacttgggaagctcaggtgggagaatctcttgagcctggggagtttgaggctacagtaagccatgatcttgccactgcattccagactgggtgacagagcaagatgctgtctccaaaggaaaaaaaaaatatgaaaatgatagaaattgtgctagggtgaaagggggattatgggcaatttcttttcctgtttttcaaactctgtgatggtattatactgatttttaacaatttatttttaattggcatgtaataattatccatatttatggggtacacagtgatgtttccatacctacttacagtgtgtagttagcggatcagggcatatctgccatctcaaacatgtatcacttcttttggttgggaacattcaatatcttctcttctggctatttgagagtgtataatatattgttaattatagtcatcctatggtgctatgaaacactggaacttgcttctcttatctagctgtaattttgtatcctttaacaaatctctgcctatcctcgcctttgctctacccttcccagcctctagaaaactgttaggctttttacttctttgagtaagcttttttaaacttctgcatatgaatgagaacttgtagtgtttaactttctgttcctagtttatttcacgtaacataatgtcctccagttcctttcatgttgccataaatgacagatttccttcttttttatagctgaatagtattctattttgtgtatatataccacattttctttatccattcatctgctgaaggacacttaggttgattccatatcttggctattgtgaatagtgctgcaataaacatcgggatgcacatatctctttttttgttgttgttttttgagacggagtttccctcttgttgcccaggctggagtgcaatgatgcagtctcgactcactaccacctccacttctgggttcaagcaattctcctgcctcagcctcctgagtagctggagttacaggcatgtgccaccatgcccggctaattttatatttttagtagagatggggtttctccatgttggccaggctggtcttgaactcctgaccttgtgatccacccaccttggcctcccaaagtgctgggattacaggcgtgagccacttagcctggctgtgcatatctctttgatatattgatttcctttcctttggatatatacccagtagtggaattgctggatcatatgttagttctgtttgtaattttctgcggaacctccatactgttttccataatggctgtactaatttacattctcactaacagagtataagcgttcccatttctctgcatcttcaccagcatttgttattttttgtctttttgataatggccatcctaactggggtgagatggtatctcattgtgattttggtttgcattttcctgatgattagtaacattgagcattttttcacaaatttattggccatttgtatgtcttctttcgagaatgtcagtttagatcatttgcccattttttgatcatattgttatttttttctgttgagatgtttgagttccttggatattgatcccttgttagatgaatagcttgcaaatattttctcccattatgtagtttgtctcttaactctatttgtttcctttgctgggaagaaggtttttggtttgttataatcccattggtttacttttgcttttttttttttttttttttgactgagtcttgctctatcgcccaggctggagtgctgtgacatgatcttggctcaccgcaacctccacctcccaggttcaagagattctcgtgcctcagcctcctgagtagctgggattacaggcgcccaccaccatgcctgtatttttagtaaaaatggggtttctccatgttggccaggctggtcttgaactcttgacctcaggtgatccgccctcctcgacctcccaaaatgctgggattacaggcatgagccactgggcccagccctcagttataattttgcaaaggcggtttcaatccctccctttggggttttgtagcatcttattcttaaggtgtgggctatgaagatggaaaaaggccattgatcactctagcttcttcatgctgacagggggcatagttggggtcggagttgaccctaaggtgagaggagtagaactgctttgcagctgtctgagtatattcatgcaggccgggctgtggttccaaggctttcgtgacaaaggcagtagtatctttatagttttagtacagcatttaaacagacagtctactataaggtaaataatgagttttaggataaggagtgcaatttccagttttaaaagtaaaggtttgaaagcattagtctggggacttatagtccacaaaaatattaggatttagtctaaattgaagaaaaaaaaaactaacaacatgtgtaccatagtttttggaacataatttttctctctttagtccttatttttattaaaacaaatcacgataggactgatttgttggcaaaataaactttaattttattatgcttggcctgattatttgcataaagcgcatcagtaatactttttttttccgagatggagccttgctctgtcgcccaggctggagtgcagtggcgtgatctcagctcactgcaacctccgcctcccgggttcaagcagttttcctgcctcagcctcctgagtagctgggattacaggtgagtgccaccacacctggctaatttttgtatttttagtagagacagggtttcaccacgttggtcaggctggtctcgaactcctgacctcgtgatctgcctgccttggtctcccaaagtgctgggattacaggcatgaatcagtaatcacctggcaagaatactttttttttttttggtagagatggagtcttgctccgtcacccaggctggattgcagtggtgtgattgtggcttactgcaacctccgcctcccgggttcaagcaattcttctgcctcagcctctcgagtagctgggactataggtgcacgtcgccatgcctggctgatttcttttgtattttagtaaagacggggtttcactgtgttgcccaggctggtcttgaactcctgagctcaggcaatccgcctgccttggcctctcaaagtactaggattacaggcatgagcctctgcgcctggctagaataattattttttacataggctttttaaattgcctttgatggaactctgttccataaggaatctcagataagactttctaaagctgagtccagccataggtttgtaccttcaaatacttatgagttgggtaagttcctctcctcttgatgcccctagataacttggggctcctgggcctgtcagaaagtgacattctatacttaccatgggtcaggaaccctgtacagggactgtgtagacaaagtatgagctcagttttcccaagggcttttactggctttacaagtacaagtcaaggttgattccataaaggaaagcatgccattctagtcaaacccttggtaaaataaccagtgttttcaatagtgtcctgttacaaaagaaaacagattcttattgtatttatgaaaataactgtattgccataaattaagaatactcacaaatagtttttaaattctggagaaatcaagtagaaacaaatatgcgccaaattttattcacaggagtgtactttactcagttgctacaagctgtaaatagcttaaaagaaatttccctgactctgaaaaagcaaagaatcagcagcattttaaacaaaaaggttacttcagacttttattagtttagtccatgcatttaacttctgtttgatatttatgaacatttcagctttccatgagagttctaaaagtttttttcctttattctatgtcataatctccagagttatcagaaacttgcattcaagagcacatatcaaagttttatagctgattataaaaccatcttctaaagaggaccaaattaaaacagcagttatctttggatgagaaaagcattttagggaagccacaaagacacaattaacaaggaaatttgtgaatctgtggcacacaataattcaacacaacagttattactgatgacatatactgagtcatatcagaattgtaggaattttatacagttttgcagcacgtaactttatatcacaaatttatatgaatataacccaaagaaagttaagcaccattttctatttgacagtgtttcctgcatgattttaatacattaaataagctgaatatgtcttttgtactttaggggacttaatttttaaaaattttttattttaacttagagcttgattttgaaaggtttgttaaataccaaacgtttaaaacattggatattacaaaatggagtcttaggtttccgtaagtcattcatttagccaaagtaactcaaaaattttcaaaaggaaaaaccattattctggtaggagactcagctttccaaacaagacccaatgaaggtagcatgaggctgattgcctcctctctctcccctcccccttttttcttttgtagtttacttaaaaggtaaataaaaacctttcattatcttttaatattccataaaaatcctttttaaaagagaaaactgaattttatgtttccattagtgtatttttaacgttaaagccagttttaattacatcttataaatctgtctagttctaattagtttgaccataaggtaagattttttttttattttttatttttttcaagacgcagtctctctctgttgcccaggctggagtgcaatggcatggtctcggctcactgcagcctccatctcctgggttcaagtgattctcctgcctcagcctcccgagtagctgggactataggcatgtgccaccacacctggctaatttttgtatttttagtagagacagggtttcactatgttggccaggctggtctcgaactcttgaccccttgatctacctgcctcagcctcccaaagtgttggtataacaggcgtgagccaccacacctggcttgccataaggtaagatttttatgaatcttttataaccctttacaattttgtttttttcttagaacaaaactgttttaagaaaactctgttgtgcttttattccaatttccaatttatggaaaaactgcataacgtgacttaaactttagccaatatgttcacacacagaatctcttacaattaagtttttataaccctttcacaacttgttcaaacctttagacttttcctatctcatttaaaacagtccgttaacactctaaacttaggcaagaaatccacattcccatgccttctcataatcttttaccaaaagtacattttacttcccttacatgcctcgtgtatagaactgtttcttcagtagtctcaagtgcatattacactgttaactcaatgacttttacttttggtggaaagcctggtgagtaagcaatttcaattacgtaccaggagtggagcctaggacaccagaaggtctgactgtttccagtgtagctagggagtgtggctaactccacatgtctcaggccttacctagctataaagcaggcaagttgtacagtaagagtcatagtggcattttatgaagtatttaacaggcctaacaacctttgaattgtacaacatttcttgcataaattgccttttcatgaatacgttcacaacttacagagaccatctacaacatgcttggactttcagacttttcctaaacatccctctttttaaacagtcattttactttaggaccagattttaccatacaagatcttttcttatataaaatttcttggctgggcgtggtggctcacgcctataatcccagcactttgggaggccggggcagaaggatcacctgaggtcaggagttaagagaccagccaacatggtaaaaccccatctctattagaaatactaatattagccgggcgttgtgctgggtgcatatattccaagctactcgggaggctgaggcaggagaattgcttgaagctgaagccgggaggcggaggttgcagtgagccgagatcgcgccattgcactccagcctggggtacaagagtgagcctccgtcttaaaaaaaaaaagtcttgggggtgaagccaagatggccgaataggaacagctccagtctacagcacccagtgtgagcgacgcagaagacgggtgatttctgcatttccaactgaggtaccaggttcatctcactggggagtgccggacagtgggtgcaggacagtgggtgcagcacaccatgcgtgagccgaagcagggcgaggcattgccccacccgggaagcgtaaggagtcagggagtcccttttctagtcaaagaaagtggagacagatggcacctggaaaatcgggtcactcccaccctaatactgcacttttccagcgagctcaacaagtggcacaccaggagattatatcctgcacctggctcggagggtcctacgcccatggagcctcactcattgctagcacagcagtctgagatcaaactgcaaggccgcagcgaggctgggggaggggcgcccgccattgctcaggcttgagtaggtaaacaaagcagctgggaagctcaaactgggtggagcccaccacagctcaaggaggcctgcctgcccctataggctccacctctgggggcagggcacagacaaacaaaagacagtaataacctctgcggacttaaatgtccctgtgtgacagctttgaagagagtagtggttctcccagcatgcagcttgagatctcagaatgggcagactacctcctcaagtgggtccctgacccccgagtagcctaactgggaggcaccccccagtaggggcagactgacacctcacacggccaggtactcctctgagacaaaacttccagaggaacgatcgggcagcagcatttgcggttcaccaatatctgctgttctgcagcccccgctgctgatacccaggcaaacagggtctggagtggacttccagtaaactccaacaaacctgcagctgagggtcctgactgttagaaggaaaactaacaaacaggacgtccacaccaaaaacccatctgtacgtcaccatcatcaaagaccaaaagtagataaaaccacaaagatggggaaaaaacagagcagaaaaactggaaactctaaaaatcagagcgcctctcctcctccaaaggaacgcagctcctcaccagcaatggaacaaaactggacggagaatgactttgatgagttgagagaggaaggcttcagatgatcaaactactgcgagctaaaggaggaagttcgaaccaatgggaaagaagttaaaaacttcgaaaaaaaattagacgaatggctaactagaataaccaatgcagagaagtccttaaaggacctgaaggagctgaaaaccacggcacaagaactacgtgacaaatgcacaagcctcagtaacctatgcgatcaactggaagatagggtatcagtgatggaagacgaaatgaatgaaatgaagcgtgaagagaagtttagagaaaaaataataagaaatgaacaaagcctctaagaaatgtgggactatgtgaaaagaccaaatctacgtctgattggtgtacctgaaggtgacggggagaatggaaccaagttggaaaacactctgcaggatattatccaggagaacttccccaatctagcaaggcaggccaacattcacattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaatagcggatctctcagcagaaactctacaagccagaagagagtgggggccaatattcaacattcttagagaaaagaattttcaacccagaatttcatatccagccaaactaagcttcatcagtgaaggagaaataaaatactttacagacaagcaaatgctgagagattttgtcaccaccaggcctgccctaaaagagctcctgaaggaagcgctaaacatggaaaggaacaaccggtaccagccactgcaaaatcatgccaattgtaaagaccatcaaggctaggaagaaactgcatcaactaacgaggaaaataaccagctaacatcataatcacaggatcaaatacacacataacaattggtgaatctcacaattatgtgtcttggagttgctcttctcgaggagtatctttgtggcattttctgtatttcctgaatctgaaagttggcctgccttgctagattgtggaagttctcctggataatatcctgcagagtgttttccaacttggttccattctccccatcactttcaggtacaccaatcagacgtagatttggtcttttcacatagtctcatatttcttggaggctttgttcatttctttttattcttttttctctaaacttcccttcttgcttcatttctttcatttcgtcttccatcactgataccctttcttccagttgattgcatcgactcctgaggcttcttcactcttcatgtagttctcgagccttggctttcagctccatcagctcctttaagcacttctctgtattggttattctagttatacattcatctaaattttttcaaagttttcaacttctttgcctttggtttgaatttcctcctgtagctcggcgtagtttgattgtctgaagccttcttctctgaactcgtcaaagtcattctccgtccagcttttttccgttgctggtgaggaggtgcattcctttggaggaggagagacgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcctgggtaccagcagcggtggctgcagaacagcggattttcgtgaaccgcgaatgctgctgtctgatcgttcctctggaagttttgtctcagaggagtacccggccccgtgaggtgtcagtctgcccctactgggggctgcctcccagttaggctgcttgggggtcaggggtcagggacccacttgaggcagtctgcctgttgtcagatctccagctgcgtgctgggagaaccactgctctcttcaaagctgtcagacagggacatttaagtctgcagaggttactgctgtcttttcgtttctctgtgccctgtccccagaggtggagcctacagaggcaggcaggcctccttgagctgtggtgggctccacccagttagagcttcccggctgctttgtttacctaagcaagcctgagcaatggcgggcacccctcccccaggctcgctgcggccttgcagtttgatctcagactgctgtgctagcaatcagtgagactccgtgggcgtaggaccctccgagccacgtgcgggatataatctcctggtgtgccgttttttaagcccgtgggaaaagtgcagtattagggtgggagtgccctgattttccaggtgccgtctgtcacccctttctttgactaggaaagggaatgccctgaccccttgcgcttcctgagtgaggcactgcctcgccgtgcttcggctcgtgcacggtgcgctgcacccactgtcctgcacccactgtctggcactccctagtgaggtgaacctggtacctcagatggaaatgcagaaatcacctgtcttctgcgtcgctcacgctgggagctgtagaccagagctgttcctattcggccatcttgccccttcgatgctttgagatttttaaacccaagattacattaaaagaaccagttgtgcactctcccagtcatctcaaggacacagtacacctgtgtcaggggagctgctcaaagtctggaatgtagatttggggcaacaggtatattaagaagaaagattatagcagagctgggagtcaaatttttttttctcatcgttataatgaaatgacttattgaagggcctgttgtatagtacattaaaaatccatacagtatagcttggatcctgtcagaagagtggatttgattctttctcttaaattattttgtagctctcattttgtgtaacctttgggaggatcccttgtgatgtcttaatgtttgaggctatatttaatgcttaccttctggaaagatgttacatgaacagtctgtttaaagcatggaggaatagtgtccacttcttggcctcttgccagctctgcctcctcatcccttccatcccttctaatcctggacctctcgtcttctgtgcttgtaccccgcatgacgtcatccagccttctggcttcatctgtgcagagactgcttccctgaagttttctatacagctgcctacccgacatgtacctggggtttctgagaggcttctcaaactcaccacgtcacagatctccctcagagcctactcaccttttattatttcctaactccatcagtcctgctgttctggccacctatcttgtcaatatcctgacctctctctcatccaccttcagtacatcagcaagttacattgtttctacttttggaagagacctggaatttgaccactcctcaggcttgcaccaggacccagcccagccccccaaaccaccctgaccctggacttaaattgtttcaccagcctccaaaaatggtctttctgcttcacacttgctccctacctcttcagtctattctgaacacagcactcagaatgcctcttctaaattattggtcaaatagtgtcattcctctgctcaaaatcctttggtgctctctgtctcattctgagtaaaagagcccttgcaacgacaaggccctgcgagacttaacagcctccctccagctctctcctgctccatggtccctgtccggtctactccagcatcagagccatgctgttctggaagcctgtgggcatgctgccactccagggcccttggcccttgctgttttctgtctgggctgtagttccacaaataacaagtggttccttcccttacctccttcacggtcttgctcaaaggccaccccagtgagaagtccttcaaccccgtttaaaattgcaaaccatccctgcttaattcttctctaaagcgcatttctctttccaatatactttatacatttcctatttactttattcattgtttgcctactgcactagtatgtaaatttcatggtggtagggatttatgtttattgacataatgaagacacatttgactacatagcagttaaaatattgtaagaccacattaactaagttaattatattctttttcttttcagagacagagtctctctcttttgcccagtctggagtgcagtggtgcgatcatagcttattgcaacctcaaactccagtgatcctcccacctcagcctcttgagtaactgggaccacaggcgtgtgccaccatgcctggctaattaaaactttttttttttaaagagttgagatcttgttatgttgcccaggccggtctcgaattctgggctcaagtagtcctcctgccttggcctcccaaagtgctaggattacaggtgtgagccactgtgtctggcctaattattttctggatcttgtcttttacatttgcaataaaggatctcataggtaatacattgacccttgaacaatgtggagattaggggcactgatcccccacataataagaaatctgcttatactgtttgattccttaaaaacttaacaactaaaagcctactactgatatcatagttggttaactgtactttatataagtattatatactgtattcttcaagataggtagatttcatgcatgtccgtgtgaagagaccaccaaacaggctttgtgtgagcaataaagcatttaatcacctgggtgcaggcgggctgagtccgaaaagagagtcagccaagggagataggggtagggccatttttataagatttgggtaggtaaaggaaaattacagtcaaggggggtttgttctgtggtgggcaggagtgggggtcgcaaggtgctcagtgggggagctttttgagccaggatgagccaggaaaaggactttcacaaggtaatgtcatcgcttaaggcaaggactggccattttcacttcttttgtggtggaatatcatcagttaaggcaaggagcggccatttacacttcttttgtggtggaatgtcatcagttaaggcggggcagggcaaattcacttcttttgtgattcttcagttacttcaggccatctgggcgtatatgtgcaagtcacaggggatgcgatggcttggcttgggctcagaagcctgacgagagaaatgttattaagaaaaatcataagaaaaaatacatttactgttaattaaatacatttactgttctttaagtggaagtggatccatcatccatcgcaaacgtctttatccttggttttttcacagtgagtgggctgaggaggaggaggaaaggaagaggttggtcttggtatccaaggggtggtaaaggcagaagaaaatctgtgtgtaagtggaactgcgcagttcaaacccgtgttgttcaagggtcaagtatatataaagagctcccagtaattaataagcacaaggcagacaaccctatagaaaattggataaaggacagtgaacagacttttgacagcagaaatacagaaatgcctaaaaagatgacaaatgcctagccttattagtaatcagggaaatacaaattagaagagtaaggtattttcatccattgattggcacaaattacaaacagtggtaataatctggtgtgactaagggtgtattcctaagattctatcatgcgctgctggtgaaagtgcatgctagcacagactttggagggtaatgatggcaatagatatttggtaaattctgtctgcctacctagcttataaaatatttgtgcatgtacatagacatgtaaatataaggctatacactgtagcattgtcattagaaaagggactaacttaaatgtccaggtctttagaaatagatcatataagatcttattaaaggtctttacaaaattatagctacataataatcttaagaaagaatccagtctattttgacagcatcaattccaaattcctggtatttttattatattatactttaattttaaagaaaaaaggtagtagtatctgtaaaagcttactggaaatacacaagtgtaggtattatgcccacactatgaaacattactcagctttaaaaagaatggcctagatctacatgtatatatggaaaggatttctgaggctcagttaaatgaaaaaagagctgcaatgtatgtatgttataacgccattagtataacagcaaacccaaatgctgttttacaagtgtacattaataaataaaggcatagaaaaacttctgggaggatgacagccagttaccaggtttcctttgggtcgggaagtaaaactgggggcagggagacatcctgcctatcctctgtatttgagtttttaccaagaaaagtgttcacgattaattttataataaaaaagtaaagtattttaactgttctttccaaataaaagtcttttagaaaatgattaaaagcaactaaattagaggttgtgagaaatgattcttaaacagtccatgactagcaaattttttatattggaggattcaaatatttgtgtgtgatctcaaagactaatagtatttcataataatatttaataatcttcatttatctgaaacaaaaatgaatgagacacaaatgagggatcaggagccctggggcctgtggctgagcctccccaacttactgttttttttgttgttgttgttacggagtctcgctctgttgcccaggctggagtgcagtggcctgatctcggctaactgcaagctccgcctccacggttcatgccattctgccattctcctgcctcagcctcctgagtagctgggactacaggcacctgccaccatgcccggctaattttttgtatttttagtagagatgggatttcaccatgttagccaggatggtcttgatctcctgacctcgtgatccacccgcctcggcctcttgaagtgctgggattacaggcatgagccactgcggccggccccccacttattgttgaatgtgtagcagcagcttcccaaaagccagcatcgtttttaggtgaaaaatgggcctagaaaaccaaagccattgccagttctggtggtgaccatgcagaggtgggcgtaaggaagccatggatctgaacaaaacctcagttgttcgtattagagccaattatcagattcagtgggatgcaaatctatggagagcgtgtgttcaatatgaaaatttaaaaaaatcttgaacttttagaatgtggtcttatctagtccttaaaaattaggaaatttttagtgcatgtagcagccagagtgaaaaacagcttttttttttttttttttttttttgagacgaagtctctaaccaggctggtgtgcagtggtgtgatcttggctcacttcagcctctgcctcctgggttcaagcaattctcctgcctcagcctcctgagtagctgggactgcaggcgcgcgccaccacgcccagctaattattttgtatttttagtagagatggggtttcaccatgttgccaggctggtctcgatctcctgaccttgtgatcctcttgcctcggctcccaaagtgctgggattacaggcgtgagccaccgcgtccggcccaaaaacagctttttaatagaagttattatccttagtgaaatttctcaaatatgaggattagagagtcttgaaagagttttcatttgaatgttatgagccaatcaaagttatctgggtttttccataatgaacctcccttcttagatccagaaaagatcttcatggtccttgggtctaactccattttatataatatttctttttctttttttttttttaaattcccaatgttagtttttctgaaattttatatatttttgagttaaaaaatttaagttgtaaaagtaatatatgttcatcttggaaaataccaaaagatatgaaggaaaaaaaaatcacccagaatcttaccacataaagacaactaaggcattagcatatttcctttgatttccatgtgctgtaatttaaatttgtctcgttttatgcagttggaacaatattatacaaatggttttgtatacttctcatttgtaacattgctttttttttttttgagatggagtttcactcttgttcacccaggctggagtgcaatggtgtgatcttggctctctgcaacctccacctcctggggttcaagctactcttctgcctcagcctcctgagtagctgggattacaggcatgcaccaccatgcccggctaattttgtatttttagtagaggttttaggttttaggtttcgtcatgttggctaggctggtctccaactcctgacctcaggtgatctgcctgccttggcttccaaaagtgctgggattataggtatgagccaccgcacccagccgtaccattacttttatctgttataactgtataaatatatacattttggtgaccgcatgatatatatatatattgaatgatcctcccacctcagcctcccctgagtagctgggggtacatgtacgctccattacaccctgcttgtttcttaatttctttctttttttttttttttgagacagagtttcactcttgttgcccaggctggagcacagtggcgtgatcttggcttacggcaacctctgcctcccgggttcaagtgattctcctgcctcagcctcccaggtagctgggattacaggcatgcaccaccacgcctggctaattttgtatttttagtagagtcagggtttctccatgttggtcaggctggtcttgaattcctgacctcaggtgatccacccgccttggcctcccaaagtgttggaattacaggtgtgagccaccacgcctggcccaccctgctagtttctaaaaaatgttttgtagagatgggttctcactatgttgatcatgctgctcccatcttttgataagtttcagtgtatgcttttataaataatgtcagatttttattcctggagcttcttacctatttccgattattgccttagatttagatgttagagtctcttgataaataatgcaaaaaactgctttggaaaccataacctttatttgaacaatgacatggcacactgcttgcagaatgagcctggggcaggaatctcctgagtcctgagcctgctttctcttttgtaatcttctgccttctcttgggatttaagcaaaagatcagaggttcttcctttaattacagtgcttcctgcaagcaaatgaaaggtgaaaatccaaggcagaaatgtgaacttgctcttctattagctgtggactctatgagaaggtctagtgtttatgtagcatttcagctcctgcctttacagctgaagtaacaccaaaccacagaacatgcaaaaatgttttccttacatataaatgttcctatttatgatttactatgccaccttttaaaattaatgagtaacattgttacacgtgatgggcagggctctacgccctcatgtaggcttttcggggtctccacacttacccacttttccagtccactcccctgcctcctcttcctccccacccactgtgtggtggtccattggaactggcagtctacttgccactcctccctgccatgcagttatatggagtcttccctcctgagctagcactcccctgccctacattgaatctgcaggtccccctcgttctatgagaccagcttcccaaagccttccagcaccctctgcagcagctctcagtgtcctgcccagaggcaatcgcttcctgccctgaggttccacccactaatgtggcacttgccttgctgaatgctgtgtttgctcatcggtctctcttcataactagacggagagcaactctacgatggggtctgcaccttgttaatttctgtatcttctgcagaacacctgccacttaaaagatatttgttgttctttggtcactaaattaggtgagagttcaggcctgatgctctctatggctttgttgcaggtctttctgtctgagtggaaggagcacaaagttgcactctcacagctcaccagcctggagatgaaagatgatttcctccatggactgcagatgctgaaatctctccaaggcacacatgttgtcacgctgcttggctattgtgaggatgacaacactatgcttactgaatatcaccctctaggttccttgagtaacctggaagaaacactaaacctttcaaagtaccaaaatgtgaacacgtggcagcacaggctggagctggccatggactatgtcagcatcattaattacctgcaccacagccctgtgggcacacgggtcatgtgcgactccaacgacctgccgaagacactgtcccagtatctgctaacaagcaacttcagcattttggcaaatgacttggacgccttacccctggtgaaccacagctccgggatgctggtgaagtgcggccacagggagctgcatggggatttcgtggctccagagcaactgtggccctatggagaggacgtgcctttccacgatgatctcatgccctcatatgatgagaagattgacatttggaagatcccagacatctccagtttccttctggggcacattgaagggagtgatatggtccgattccatttgtttgatattcacaaagcatgcaagagccagactccctcagaaagacccactgcccaggacgttctggagacctaccagaaggtcttggatacacttagagatgccatgatgtctcaggcaagagagatgctgtgaaaaccagtccagccaatgaaggtgggattgaagggctgaatggaagttacagcattctactctgatggtggagttttttgcctgagtttcgtgttttattgttttttttatggcttagccatgtggttcgttgtccacatccacatgtacgtttgtatgtagtccacattggttgttagatttttttttttttctttgagatgcggtcttgctctgttgctgaggctggagtgcagtgatgtgatcttggctcactgcagcctctgcctcccaggttcaagcaattctcccacctcagcctcc

SEQ ID NO: 1209 - DNA, 70745 bp, Homo sapiens
tgacagacaccatctgctcgctactaccaggctgttgaaagcagatggtggctgaggtttctccaaagctggctgcctcccctatgaagaagccctttggcttcaggggcaagatgggcaagtggtgctgctgctgcttcccctgctgcaggggaagcggcaagaacaacatgggtgcttggagagaccacgacgacagcgccttcacggagccaaggtatcacgtccgtcgagaagatctgggcaagctccacagagctgcctggtggggtgaagtccccagagcggatctcatcgtcatgctcaggggccctggcattaacaaaagggacaagaagaagaggtaaccgggcctggggctgggaggaggcgggaccttgggggatggggttggacgtgccctcgtgtgtgtgtgtgtgtttgtggggggcgccctggctttcttgcctcctcaggtcccacgccacccggtgtgtggatacttcagagagctcggggcacaggcctctttatgagcagcaacacaaaaacaaaactttagttgatttccaatcccataataatttcccttatggaacacttaagagactgttttaaagtgatttaactctcaaaattaagtcgatgcagcagattatttttaatgtacacattttaaaacaatgttatatacattatagaaaggagtataatgagaactaagtcccataatatatcaaattctgagattaaatattcttcagataaaatccaatatgcattttatatcaatgtacccctatgtaaatatgttctttactgaggaaccttagaaggaaactgaaatgggaagatagttcgtgtccttgaataggaagatttatttttcttaagatgtgagctcttttgtgtttatcacttttacccaagccaaataaaaatagtaaagttttaacattttaaaattacacatgctgtcttttactattgtgataaatgtttgtgacagaatggaaaaagacttgctcttccagatatcaaaatgttcatgtgctatttccacaaattgtttactaacagctcaaaagacataaataaatagaacagaatacaaaatccagaaatacccaaatatatgaatttagaacttgatagtggtgatgtttcatagtagtataaaaagatgaattattcataaatgaaatgcatgctgtttggagaaaactagctagattttttatgtcacaaaaataagttcctggggtatacattaaaaattttaaatatacaaattaagaaaagtgccagaaggaaacacaaatgtctatttttatatgcagatatattttatgttcacagagacctaagaacctcaaaaacaagtattctgaagggtggtttggcaaaataaaaattaaaacaccctgtaaataagaaaaaaattaacaaaggacaaaacacttgcaaaacatgtattttcattttacagagaattctttcaaatcaacaagaagacaactaaataaaacaagctcaatttaaaattgggcaaagtacttttttgcatgtctaccaatgacctatgcacataggagaacatagtgttcctgataagagaaggaatttaaattagaagagaaatgaaatactcttttctatctaagttagaagaggaatgaaattctgtttctatccacaaagtttgtgaggatgaagaacagtggtacttatacagcttcttaaggtttaagttgctgtgagttttcaaatagacattttggtggtaagaaccacattttaaaaatgtatatgccttttacccatcaattccattatactgaaatatcttttggaaatagatacatctgcttttcttagtattacttaaatagcagtgtattgagaagaactcatgtaaagattttatgaacaaatttcagtccatccatatgatggaataatatgtaaccattgagggtgtcaatagatacagagataagttgacatgcaaagatgtacttaggtatatatcaagtgagaaaaaaatcagttatacgcaaacagaatctgctcttgtgttagctgaaaatatgtcaaaaatatgataaaacttatttctggggatttgtattgtaagtgaagtttttccctttatcttatctgcgatttctgcgatgaacgtctgaaaagttttagttaagtttcactagtaatgaaataatccttgggaagagaaggagtatgctatttgcataaatacaactaatttctcacattctagtatttatttttctttctgtggatgcgtatcttctgtgaatttttttttttttcgacacggagtctcactctgtcacctaggctggagtggggtggtgcgatcttggctcactgcaacctctgcctcctgggttcaagtggttatcctgcctcagcctcctgagtagctgggattacaggcacgtgccactacgccatgctaatttttgtatttttagtagagatggggtttcaccatggtggtcaggctggtctcgaactactgacctcttgatctgcctgcctcggcttcccaaagtgctgagattacaggggtgagccaccatgcctggcctcttctgtgaactttcattcttttcagaagtagagggaatctgtttacctgttactgtagattttattgtgtatatattttattatataattatcttttcattgtatatagattaacatgtgtaagaagtatggattaattattttagttatatatgaaaattaaaatagcaaatataaatgattattactattgtgaatgtattgctgtactatacaggagttttctttgaaaatattgaattcttcagctgtgtttatcaattctttcaatcgatttattcatcaaacataagccagacacctattatgtggcaggcatattctactatctcttaggatccttctatctttgaaaatttcatgtttccctgccaggcctgagcaaactgagagatttaaaattggactattaggacttaatctcaattgacgcttttcctctctcctttcagaaaaaagcgtttcggaaggtagaaaataataaaacgtaaactttaactgcctttttgaaaatttataacagtcacgggtaaagactagtttaggacttttaagaactaaaacatgatacttaaacagcgtggaatattatgcagccatagaaaaagaacaagagcatgtcctttgccagtgacttggatggagctgcaggccattattcttagcaaactaacccaggaatagaaaaccaaatactgcatgttctcacttacaggtgggagctaaatggtaagaatgcacagacacgtagaggggagcaacacacactggggcctatcagagggtggaggatgggaggaaggaaagaagcaggaaataaaactaatgggtactgggcttaatacctgtgtgatgaaataacctgtacaactaatgcccttggcacacgtctgcctatgtaacaaacctgcacaccctgcagatgtacccctgaatataaaagttgaaaaaaaattccacaaatagtttcataaatccattttaaaaaataaaatttataacaatcttaaatcctaatattaatgattgtaaatatctgatttacatacattctacaaatctaagtattgaaaaaaattagctacacctattcatttgaattccatgttttctttggcttaaagatttttgaacaccaaagtaagaattagtttattttagaaatttgtttttgttttcacctcagccctcttaatgtgtagttcttttaagaactaaaattcatctaaatgtcagtcatctgaccagaactgccccagacctgttatagataccatattctacttaatgtaaggcaccatagattttatgatgccccattattttatgtcacaagaagagagttatttaaatgctgccaattatagtaaattgtgaattataagcggtattccagtgtaagaaatgtgaaaacatggagacaatgaacatcttagaatcaataaaatacaatgttatctgtaatctttaagacatatctcaaagtgtaggtgtaattgtatcatgtcacttatttcaaatagtcttcattaagtagtagtattaatacaaattataatatctgacaattattgagctgttatttgtgttaggaactattctacatattttgtgtagagtctcatttaagcattatagtggttttctgtgagaaagctattttttgcatccccattttattgatgacgaaattgagacacaaaaagactaagcaacagctaggaagtgacagagcttaaaacagttttccagctcaagttgaatggaatccaagggctgcgctctttctgttctgatactctgctctttcattaacacagtgagaataagaggtaataaatagtgtgctttcttcacaggaatattaaatatttgttttgaaggctgggatagcatgctattcagcatttgcaattacatgagtcattggtatggctttagatagtgcattacaatttcctaaaaaagtctctcactctcttaggactgctctacacttggcctgtgccaatggcaattcagaagtagtaagtcttctgctggacagacaatgtcaacttcatgtctttgacagcaaaaagaggacagctctgataaaggtatgcagtagccaactatatcagcatgaggtagatttaagataattaaaaaaatgagttttctcatgtaaatataacttggtgaaatctgtggaatgtttattttgaattcctaggatttacaattgatttcttggtctaatactgacaggccgtacaatgccaggaggatgaatgtgcgttaatgttgctacaacatggcactgatccaaatcttccagatatgtatgggaatactgctctacactatgcagtctacaatgaagataaattaatggccaaaacactgcttttatacggtgctgacattgaatcaaaaaacaaggtacagatctaccaattttattttcaaaatactgaaatacatttgttttaacatcgacttgtgtaagggtcagtttgccatatttggaagctcaagcataacctgaatgaaaatattttgaaatgacttaattatctaagatttaattttaaatattgttacttttaaagaggcatcagcaggtacagctttttttatgcacttgtggtaaaatttttttgaaaacactgaatttgtaaaaggtaatacttattttttttcaatttttcccttccaggttttcttttccctaatcaatgtaaaatgacaaaatttgccctggaagcaagtttttcattaaaactccaagaaaactaaaacatgtttcagtgaatagaaatcttgctgctttggcaagttcctaaaaaaaaaaaagtaatagatatgaagcgatgtatcttttagtggcaaggcttaagatatttctgattccttataaggcagaaatagaaaatgaaaaggagagcaatcagaaatatcgaggccaatttggaaattaggtaatggaggaaaaagaccatgaagagattctgtgtgtgtgtgcttttttttgttgtttgttcatttctttcctttgcgtggtgaaacaaggttctcttcagttttagagaatgacagttttttagtttgggagagggagttagtgggttgtaaactgcctagagattaattttaggagccctctgaggaagcagattggcagtgaataggtggtatgtaatgggaaacccttgagcagagggaatatcagggaattatttgacttattatcctattctggtagaaatggccacttagatagagtctaaactctgctttcaaatctagaatgtcttgatgggaaggtgggagataaagagcttataagtaataagatcaagttggattttgagtttactaggccctgttctaaccccatccaggaaaattaagtggtgttttcagcaaatgagtctctcactctttccttttttttggccaaaagctcaaatgataaagggaattggccatgtgggtgagagatgagactgaagtaattgtctgttgcactagttttcaactagaagtgtgcatctcagtaacttgaggaacattttaaaataatctacaagcctagaccctctcctgaagattttgatacagtaagtctaataaagcctggatatgtccatttaaaaatgtttccttgaaggcaggcatgctggttatggatgccttcctcccagctgctagagaggctgaggtgggaggattgattgagctcaagagtttgaatctagcctggacaacataatgagaccatgtctgtaacaacaatgacagcaacaacaacaacaacaacaacaacaacaaattccttaaaatgcagatacacttctgcttaagaaccactgaatagataagtgtaatatgtaaattctcatatctcagaaacttaagacatctctagaagagttggagttggatatgcgcaatttcctttaaatctttcctttccaataatattagtttgactttctctttctttctttctttctttcttctttctttctttttttctttctttctttctttctttctttctttctttctttctttctttctttctttctttctttcttctttcttctttctttcttctttctttctttctttttttctttctctctctctttctctttctctctttctttctttctttctttctttctttctttctttctttctttctttctttctttctttctttctttctttctgactgggtctcacattgtttcccaggctggagcacagtggtgcaatcacagctcactgcaggcttgacctccccaagtacaggtggtcctcccacctccagtttgtattttatttatttatttatttttttagtagagatgggttttttgccatgtttcccaggctggtcttgaattcctgtggtcaagcgattcagctgcctcagtgtcccaaaatgctaggattacagttgtgagccaccatgcctagcctagtctgactttcttctctgtggttgggacattaaaatgaatattattggtagtatctatcagcttacagaataataccttttccttcctaccatcagttattcactgccattcagaaggtctttagaaatttgcagtgagtattctttcaataagtagaggctggccctctcaggattttgtgtctctttgttattcaagtgcttaagtcagtaagtcattactaagagcagagttttctcaattaaaattgtagcaaattccaaaccatttttgtcaattaaagccatattatggactatccagtatgtctcttaagtttgtagaactttggcataatcaggatggtagtattaaacactaaaaaccatgcagttattaagaatacacatgggaattctgttaatttagtttcagcagtcctatgaactgattatttagttaacaatcaggaaaattaaatataaatagatttcaaatgaataaatatgggaaaaattcttgaaatgggcagtatgagccttaatagcaattttttactgcacattggagcttgattttttgggtaaaacatctgaaactgaagaaatattttacatgcaaattcttgctttatacacaacaatttgtcacagggtttgaggatatagggataaaagatacagaccctgccctcaagaagatttttgtttagataggaaaaattattatcatccaataataccatgtcacaaatgctgggatagagtcaaagattcttgaaaccagtaaatgtttaaagtgagttttcaagatgaccagggttaatgtggtgaggcagaggaggggtgtttccaagggaagagcagtgtgtgggaaagcacggaagagtgagaaggaaacaactacattttatttactttctatgagtataagtccataggatctttatataaagtttccaattcagttgagaaatatataattttttcagttacatattatttttggtttctattgttttacagggtggcctcacaccacttttgcttgctgtacatggacaaaaacagcgaatggtgaaatttttaatcaagaaaaaagctaatttaaatgcacttgataggtttggaaggtatagttatttcttttaatctctgtgttgttctagattgatagcagtcactcaagtcataaatattaaattaataatactaacttatacttattgggacatagttatcagtagcaacacaaatcagttaagtagaaaaaaacagttatttagactgggcaacataaagaacagttttagtaggactcattttattattttgactgatgttatttgttatgtgatgttattggttgtatgttcttatgttagctaaagggatttcatattagttttagaaagtgtgaactttaactttcagttatgactcagtcttgaacttcttaaccctttctagtagtttttaacctctgcttcttatatggttttccactaaatatgctatattaaacataaataggagttgcaaatcattttgtcttttgaataactctgctttaagttgctttctttaaagaatattaatgttagcttatccctacttgacaatcaattgctattcccacatactgtgggttcatcagatttttccctttttatttccagtgtattttgatgtttttatttttaattagtatggagagagggagcgaagatagtcttaagtggatacacttttcctttcatgaaggcaagccataggtgggtgataaagagaaaagagctaggctttagagtcacacaagactgggtttaattcctagctttcttacttgctaggtgtgtgacattgtgaatgttatttaccaccaaatatgttgtcatgtatgaaaaggaggagaatatatccttcaaagttagctgtgcatagtaagaaagatatatatatatatatatctttatatatatctttttatagcatttaattcagggcctagcacatgcttattggtattcattaactgaaaccactatgaccactattcttaccatttgttattactgctttcagcatgcagatagctcttatttatctgatccctagctgattttctattacagtgtatcagtctagggacctgggaagaaaacttcacttaaatctttgtctacttcagataagcagccctagcatagtttcttgcccatcaaaggcctttaaattagtagctgctactatgcaataccccactgagataagaggtttcctttttgtcccttccttttaaccttgatggtactttataaagatgaacccttgagcacccaagatgcttatgtcttttagtacatgtaaatgtttaattctgcatggacgggcaagatattaaattggcaaagtatattgaattagcttttaaaatcacttgaagttcctaagggagaaattatctctatattattttagaactgccctcatacttgctgtacgttgtggatcagcaagtatagttagtcttctacttcagcaaaatattgatgtattttctcaagatgtatttggacaaactgctgaagattatgcagtttctagtcatcatagtatgtaagtgtttacattaaaagtctagttaaaactacattgaggtttaaaataattataatgattgcatcttatatatcaggtgagatgtgatagattgattcaggtagttttagagtggctatgatttagtccactgcatcagctagaaatgaaacaaaaaactagactagttagaagtaccaatgggtgcaggattctttatctcgggacttttaagacctttatccttagagattccaacattgttcatttcattccatgtataacacctatgcatgggataaaaaatagtgccatatctttaatttttctagttagttatttgggtcttgaaatgttcagtttaggagaaagtcttgtactgtcttctggggactgtctcctatatactccctgaattttttgagaaccaaagggattcactaagtccaaggaagacagtcctttttttcaagtcataaggaggagaaaaaaaggacattttaatcattcttttgtttctgttgattctgttgctgcatcgttgccactgaaactggtcctgctgcctggtaatggttggcctttgacatcaagatgcgcttactgattcaaatccctcaagtcttcatggtgatccatacatggacttcaaagttataaaattttttacattcacatacctatgcctatgtgttcagccattgttcccaaagcaccagcaccctgctctggcagcttagcatcctggctttatccacacacaaagtgagcaaattgacccttccacccacattcaaaacctgatgtggaacccacatgttatcctacacttaactgagactgtcatggtaagagatcctttgagtcccatgttggtcttttctctagcagatattagctgggcttgttctaaactgtcagagaggttcaaataatgtggcagaaagaggtcagtgtttgtttattcttctttgctaccatatctgtaccctgaggcacatttatattgtgtatagtaccttaggcagtagaaagtcccatattaaccttccccagagcagtgagcacccagttatagttgaccccttgaatgatccattttccataataatgagaatctcccaagctacttgcatctcttcctcaagatttaaaaatattttcaaattctacctcactggaagatattgaagagatttctcaggatctcaagtaggttagttggacttagagccaaaccttgtcaatgactcatcactgtccatgtgtaaaagtagagctttgtgcttgcttaggcagcacatatcctaaaattggaacaatacaaagaaaattagcatggtgcctgcataaggaggctgaaccaatttttgaaggattccaagttttgtgcagtcactggaaggtcatttgactattttctgactagctccaaggaaatggtgtgaatcaaagcaaaatgggtgccacctaaatattgaaattgtgattttttgctacaaaaatattcatgtaaggtggtctaagagatgaccccagagctgaataatgtgtggggtgttgtgtgaaaaatatattgccagcatgtgacttgaaaattcaagaaggtcaacttacaacttcttcatggaacctaaaaaaaaaaaaaaaaaagtagggttttagtctcccatgtcagctggagatgagcagggagatgaagcatcatcctaacaaacatctgctggtttagagtttgagtctgtagagaaggatcattggtccaagccaggtgttgacatccagtggattttctgcccttgttgtgattggtaaactccgtaatagtgggcaatcatgttttctactttaatgagatatttatgaataaatttagttacaaactatgaaatagttgagattccttgaattataagccataaagagtaggacaactaataaggaaaattaggacttaacatttcctgaaaattacaacatttgcatattagggcctatgaacaaaatatacattgggttttatttgggattctgagataatttcagtataaagtttaggaatagattatttcattgctttactatttttctgagcatttagaaaatgttatattgttaagtctttgtaacaacctagtgaaataacaacctagtgaaataaggcagcaaagtccccactttgtagaaataacaacctagtgaaataaagcagcaaagtcctcactttgtagaagaagacattgagcctaagagaagtaacttgtccaagaacaagttgagcacttaggcataggtatggatcagctgttcattatggagctaggccttatgcagagttgggacactttctattgtgtcaagctaatgcaagttagtttattgagtcataatgcccttgatttatgagtatttcaccttacttttttcttctttaattagaagcttaatgagaggtttgtagaatgtacacagaactgtatgggataatattgttaagttctgatattctgatactgtttgaaatactcaaagaatttttgcatttggtaagcatttttatatcagtattaaaatagtaattttatttattacatttttatacatagaatttgccaattactttctgactacaaagaaaaccagatgccaaacaactcttctggaaatagcaatccaggtaagacttctgatagtgaattactttaggtcagttgtccccaaccttttcgccttcttggcagcagggaccagttttgtggaagacaatttttgcatggactaggtgaaggtgtggatggtttcagaattattcaagcacattacatttattatgctactttatttatattattattaccttataatatataatgaaataattatacaacttaccataatgtagaatcagtggaaactctgagcttgttttcctgcaactagatgtcccatctgggggcaaagggagacagtgacagatcatcaggcattacattctgataagaagcacacaacctagatccctcacatgggcagttcacaacagggttcatgctccaatgagtatctaatgcaaccactgatctgacaggaggtggagagcaggcagtaatatgagtcatggggtgtggctgtaaatagagatgaagcttccctggcttgcttgcttctcaccttctactctgtggcatggttcctaacaagccatggactggtaccagtccatggcctgggagttgtggatgcttgatctgggtggtcctatcacagataaaaaggtaaaagtaaggaagttttgatcacaaaagaagagcgaagcacaggttatgtttcatatgcttgtaccaacaaagtctcactattactgacttcattcctcctaatttgaaattgaaagagatagatttactttgttggaacaagatgtattcttctacctgctggttaattgtcatgataaacagtaattttgttagaacaagatgctttgctgccagtcgccaaaagattgtcataataaatacacaaattgcccaattctaggctcagcagattataataaaagtacaaaaatgtttcacagtaagaaaaatgctagtatgctacctggatgtggacacctaacgcatcgtacaatccagactctataaggacatctttaatttagccctatgtttatcaaagagcttctgtaagttagattgtgtacattgcaagagacaaagatggaatagatgtagttctgatctttaaggtgctcataatagaatacagctgcctctatttcatttctctgccttttcaacagaatttacaaagaaaatatttttatgttttcacttgtccacttaacaaataactataaaatgtcttttaggtactaagcatttttctaatgctagagaacagaaacaattaaaaatacagacaggagtttgtcattatcattgtcatttttattatgttcctaccttattcagtgcttactgtgtgctagatgcccactggaagtttataattatgatttattgtatattatattgattatgtgccagacatacgtgatgaggaatgaaagctttaaaaaaaagtaggtaggatttaaggtaagcatgcagagtgagtagaatttttctacgtaaagaagtagaagaatgatgtttggcagaaggaacatgtaatgagattgcctgttgggaggaagagcagcaagtgcaaaagacaagatgcttaagcgaactttgtagggtttatgagcagttcacttttgctagtacaactagtgtgagataagagaggttgggaatgaggtgaatatttagctaaggcaagtttatgatagactttttaatactgttgaaatgagtaggtcttattctggggaccacgggaaatttaccttcgatatcttccagtgaggtatttgctttggactgcaaatactagatgagcagtggctaaaacagtaggaaccagagttgttttggttgttcagtgatatactaggttccccttgtccctctttcagctgtgcttcatgtctcctttcatggttggctaatccacaacagttccaaacatcttgttctcacaacacaacatcacaagggctgcttttcttcacacatgtcttttaaatagggagaaaccttagaagcatgcagtggacttcctgtaacatattattggctaggtcacaacatatgcttatccctaaaccaggcactggaagagcaaatgtaagtatgtgattagcttagaataatcatttctctttctgaagctgaggagggggattggaatactgtctcagaagacttgtgtttcttctgcaagaaagaataaggaataagaaagaataagggagccagcaatgtttgctgcagggactcattggagaaatttgagcaggggagtcacaagattaaattagagtattaaggccttttggtaatgttgtaaaacaggggttggcaagctttttctgtaaatgaccaggtggggaatgttttagactatgtggtctctgtcatatctacttaaccctgctgttgtgtgagagcaactatggataatatgtaagcaaataggaatgagtgagctccaataaaatgttattttttttttcacttttggcatttttaataggatttttaggcataacatcttacataaccacacagaaactgtttctggtctttttttattattatactttaagttttagggtacatgtgcacattgtgcaggttagttacatatgtatacatgtgccatgctggtgagctgcacccactaactcgtcatctagtattatgtatatctcccaatgctatcactccccactcctcccaccccacaacagttcccagagtgtgatattccccttcctgtgtccatgtgatctcattgttcaattcccacctatgagtgagaatatgtggtgtttggttttttgttcttgtgatagtttactgagaatgatgatttccaatttcatccatgtccctacaaaggacatgaactcatcattatttatggctgcatagtattccatggtgtatatgtgccacattttcttaatccagtctatcattgttggatatttgggttggttccaagtctttgctattgtgaataatgcctcgataaacatacgtgtgaatgtgtctttatagcagcatgatttatagtcctttgggtacatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcactttttcatgtgttttttggctgcataaatgttttcttctgagaagcgtcttttcatctcctttgcccactttttgatgaggttgtttgtttttttcttgtaaatttgtttgagttcattgtagattctggatattagccctttgtcagatgagtaggttgtgaaaattttctcccattttgtaggttgcctgttcaatctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacctttaagtctttaatccatcttgaattgatttttgtataatgtgtaaggaagggacccagtttcagctttctccatatggctagccagttttcacagcaccatttattaaatagggaatcctttccccattgcttgtttttgtcaggtttgtcaaagatcagatagttgtagatatgcggtgttatttctgagggctctgttctgttccattgatctatatctctgttttactaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggcagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctggaagaggtccttcacatcccttgtaagttggattcctaggtattttattctctttgaagcaattgtgaatgggagttcactgatgatttggctctctgtttgtctgttgttggtgtataagaatgcttgtggtttttgtacattgattttgcatcctgagactttgctggagttgcttatcagcttaaggagattttgggctgagacgatggggttttctagatatacaatcatgtcgtctgcaaacagggacaatttgatttcctcttttcctaattgaataccctttatttccttctcctgcctaattgccctggccagaacttccaacactatgttgaatagaagtggtgaaagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaaggttgttgaactttgtcaaaggctttttctgcatctattgagataatgatgtggtttttgtctttggttctgtttatatgctggattacatttattcatttgcgtatattgaaccagccttgcatcccagggatgaagcccacttgatcatggtggataagctttttgatgttctgctggattcgttttgccagtattttattgaggatttttgcatcagtgttcatcaaggatattggtctaaaattctccttttttgttgtgtctctgcccggctttggtatcagaatgatgctggcctcataaaatgagttatggaggattccctctttttctgttgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggaccggtggtgatatcccctttatcattttttattgcatctatttgattcttctctctttttttctttattagtcttgctagcagtctatcaattttgttgatcctttcaaaaaaaccagctcctgggttcattaattttttgaagggttttttgtgtctctatttccttcagttctgctctgattttagttatttcttgccttctgctagtttttgaatgtgtttgctcttgcttttctagttcttttaattgtgatgttagggtgtcaattttcaatctttcctgctttctcttgtgggcatttagtgctataaatttccctctacacactgctttgaatgcatcccggagattctggtatgttgtgtctttgttctcgttggtttcaaagaacatctttatttctgccttcatttagttatgtacccagtagtcattcaggagcaggttgttcagtttccatgtagttgagcggtttagagtgagattcttaatcctgagttctagtttgattgcactgtggtctgagagatagtttgttataatttctgttcttttacatttgctgaggagagctttacttccaagtaggtggtcaattttggaataggtgtggtgtggtgctgaagaaaatgtatattctgttgatttagggtggagagttctgtagatgtctattaggtctgcttggtgcagagctgagttcaattcctgggtatccttgttaactttctgtctcattgatctgtctaatgttgacagtggggtgttaaagtctcccattattaatgtgtgggagtctaagtttctttgtaggtcactcagaacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggatcacaacccctgcctttttttattttccatttgcttggtagatcttcctccatccttttattttgagcctatgtgtgtctctgcatgtgagatggttttcccgaatacagcacacactcgactctttatccaatttgccagtctgtgtcttttaattggaccatttagtccatttacatttaaagttaatattgttatgtgtgaatttgatcctgtcattatgatgttagctggttattttgctcgttagttcatgcaatttcttcctagtctcgatggtctttacattttggcatgatttttcagcggctggtacccgttgttcctttccatgtttagcacttccttcaggagctcttttagggcaggcctggtggtgacaaaatctctcagcatttgcttgtctgtaaagtattttatttctcctttgcttatgaagcttagtttggctggatatgaaattctgggttgaaaattcttttcttgaagaatgttgaatattggcccccactctcttctggcttgtagagtttctgctgagagatccgctgttagtctgatgggcttccctttgagggtaatccgacctttctctctggctgcccttaacattttttccttcatttcaactttggtgaatctcacaattatgtgtcttggagttgctcttctcgaggagtatctttgtggcattttctgtatttcctgaatctgaaagttggcctgccttgctagatggggaaagttctcctgggtaatatcctgcagagtgttttccaacttggttccattctccccgtcagtttcaggtacaccaatcagacgtagatttggtcttttcacatagtcccatatttcttggaggctttgctcatttctttttattcttttttctctaaacttcccttctcgcttcatttcattcatttcattttccatcattgataccctttcttccagttgatcacatcggcccctgaggcttctgcattcttcacgtagttctcgagccttggttttcagctccatcacctcctttaagcacttctctgtattggttattctaattatacattcttctaaatttttttcgaagttttcaacttctttgcctttggtttgaatgtcctcctgcagctcagagtaatttgatcgtctgaagccttcttctctcagcttgtcaaagtcattctccatccagctttgttccgttgctggtgaggaactgcgttcctttggaggaggagagatgctctgctttttagagtttccagtttttctgttctgtttttttccccatctttgtggttttatctacttttggtctttgatgatggtgacgtacagatgggtttttggtgtggatgtcctttctgtttgttagttttccttctaacagacaggaccctcagctgcaggtctgttggaataccctgccgtgtgagatgtcagtgtgcccctgctggggggtgcctcctagttaggctgctcggggtcaggggtcagggacccacttgaggaggcagtctgcccgttctcagatctccagctacgtgctgggagaaccactgctctcttcaaagctgtcagacagggacatttaagtctgcagaggttactgctgtctttttgtttgtctgtgccctgcccccagaggtggagcctatagaggcaggcaggcctccttgagctgtggtgggctccaccgagttcaagcttcctggctgctttgtttagctaagcaagcctgggcaatggcgggcgcccgttgcccagccttgctgccgccttgcagtttgatctcacactgctgtgctagcaatcagcgagactctgtgggcgtaggaccctctgagccaggtgcgggatataatctcgtggtgcgccgttttttaagcaggtcagaaaagcgcagtattcgggtgggagtgacccgattttccaggtgcgtccgtcacccctttctttgactcagaaaaggaactccctgaccccttgtgcttcccaagtgaggcaatgcctcaccccgctttggctcacacacggtgcacgcacccactgacctgcgcccactgtctggcacttccaagtgagatgaacccagtacctcagatggaaatgcagaaatcacccatcttctgcgttgctcacgctgggtgctgtagaccggagttcaataaaatgttatttagaaaaccataagggagactggatttggcctgtggcctatagttttctgacccctcatagaggattgatggaaggtaaccatgtaaagaaaccaggagacaaaggaagatttgctgtagtcagctacagtttccttgtcacatgtccttggactagtatcaatttattataaggttttcacccatccatcgtgaaataaataaagttaggaatctcagttattcattttaaaatgttggcctttttttggtgttatgcctttttcatttgttttgttttaattttttttcatgtaagaaataacattaacagctgggttttttaaaaaaataaaagccactttgtaaatgtttatgttcccagtggcagtgggaatataaaatggaagcagaagagaggtatagtcaatatgatttagtgactgttgaatgagaaaatttaggggacagagagaaatcccagatgattcacaggtttccaggttgtacagtattatttaacctgaacatgaggaaggagtaggaaattttctggtgaatacagaagagcaaagaagagcagctcaagaggaatgactaattatttttctgtgcatgtttaatgggatattcatataggatttttgaatagatcattgaatatcagcatttatagctggcatcctactagtttgactctcagtaataagacttgtcaaagatccaagaatctgaaagttgatgataaatttccatgtgtatcaccatcaatgactgaaagtcagcatccacagaattgggagagatgaacttaatagataaagatgaattggagttgtgtttctcttagagaatgatactctccatgacttgtgtgagtcacagctgccagaaaacaaagaggccaaggaacatattaaagaagcacagcaaattcagtcctagagtgcctctgcttggcttcgtgttatagttctgacttctaaaaaatcactttttggcaaaatatactttgtgtttcttcccctcttgcaaactgcaaccaaacagaatcctttttagcaaggcatttttgtgttctttgaccaaagcaacatataaataacaaaaagaagtaagagaaagaacttttttttgtgtgtataggctagtatttaacataaacttgagagtgagtgccagtattatatttaggatttagggactagataggaaaactggatagaaatctaaagattgctgactcaaacacaatgtggtttctttgctttattttcacagctctgaattcacaactattagttatatttatatgcactataactttagaaagcaccttcccaaaccaaattttatgtgatttcttataatttagatgactttattatagaattgaatttccaactgttcataagaattattgagcatttgctgcatagtatcatctcagctgtgtccacatgagctacctatcaccttgtgttaatgaataatggttcaccaggaatattggttttggcatttaaagtgatctgtatttaatgcagataggaccagggaccactcttgaacattaatgtccaagcatcttaaaattacacagaatgctttcataatcagaattctgcctcactctccatctttagcccttttccccatgtgccctttctctggcattactgaactgcctgcaatgccctactcactcatccttctcttgtaggcaaatacattcactctttcacaccttactccctctcttgctgcttcctggcatactgccaacctttcctgccctctaccccttgtaatctggctagcctcaatatttaagtctctgcttggccatgatttctagaaaaccatccctgacatgctttattttcattctttttaaatcctaatgcctactatgtatgtagcaggactcagtaaaaaattgctgagtaaaataaagaatgtttatacaaaggtgatatgcaagactgtcccctacagtcttggagccgaggggacagacatgtggagcaataacgtacatttgagatggtaaagatgcagtagaaaaataagtaaagtattaaggcagcctcaaggaaggaggtacctgtttatctggggaaagacatgcagaatcaaggaagacttcacatagcattgttttaaaagatgaaaaaaattgtcagaatagtggagggaaacatttaaatattaggaagacattgtacactaataaaggtgtcagcagtgattttggaaatcatttacaaggcactattaggaagtggagaacagtatactgtgttaccttatatgtttctgccgtattttaatattgtgttcctggtggttttgttcatttacgttgggtggatgaatttgtgagtgaatgtttgacatgtttgtatgtcctcaatctggtggactctggtatctccccaagtggtttgttgaagttttggagaattattacttaagtaactatttcatgaaagattaagcttcatttaagcgctcaatttatgaaatgaaatgtcttaaatctatttttataaaaacaatagttttaaattgttctaagtggttcattttaaccaaatatatggatttcacttcagaacaagacttaaagctgacatcagaggaagagccacaaaggcttaaaggaagtgaaaatagtcagcatgaggcatgtaaaattttaaatttaaatttctggtttaatgttcttttctttgctttgataatagtagatagtccaaatgaaattacctttcagactaggctttgataatcaataaattttttaaaataattttttaatagattcttaaagtttattttaatagatttagtgaccttattaacagaagaatcaatagaatctaatttaatatttgatatttaacttaaagattataacccactataaaatttaaaatattcttatttaaaatattcttatctgccttcttgattggcttatagctaatctttccctttggaatagaggcaaaacaaatccagaactttatttgttcttttatttttacaacatccttacatgataaagaaagtaacatcaattattggatcatattatcaagcaattgaaattatgaacaatgtagcagtgatggtccctgagctggattcatggcaaaggagtaatcatggccagtgattgaaaatctgcggttttatattgccagtcagtgatgccaaggttaaagatgaattctacctgtggtctctcactgacctcagggtttctgttcagggagagaaccaggtcttaaaagcaacccaactgcctattacaataatcatatcttgcagaatgagacctttgttgttagtgtacaaacacagtaacattttaacatttcagttgcagaacatcagtacatattatttaaaaatttttatcctctgtcattagtacacattagaatatattagaactggacttaagccgatagtctagatacataacatgatcgtattatagtacataatttcaattaaaatgtaacaatttgcatttctttctgtttggtgttgattttggctcctaataatttaaagtgtgcctacactccagttagtaatcttttaaaaaaccacctaaatgcactgtaggggctcactacttaaggtatggtgaagtaaaatcttttcaagtgagaaaaaccctacaaattacctgctaattcattttggtagatttaacacataatgaattaagtttaatccaaacaaaaggtgacaaagttaagttttccagttcatgtttttcttctttctttggctaaggtgaatttttttatgttttagtcagaagccagtgatgtggcagtagctaaacatagaataaaatgttaattcttcattttagttatttaattattatttctttaattattttaacaggtaaattttaattttaattattttctaattttttattgtccatacttgattacttaagaataaaattattttaaaaacatgtactccaaaagagcagacatctgagaaacacaacaagcaaattaaccttctataattgcatctgcagaaagtgactcaagaaccagacataaataaggattgcgatagagaggtatacctttatattcaaatgtttccgttgaattagatttttacattatgttgtttaacaaagtataataagtttaggcatgtatgattctatcatgtaagtagcataaatcatcagtgaaaaatttagtatgtaactcagaaagctgagttgtgtacattaagttttaaagagagacaaaccctagaaatattcttcattattatggaataatcctgaatggtgccaaaaatgctacgtaatgctactttaggagctttggatcaatcattttatctttcttggtattagtctgattatcaatagataatatggctaaagaagataatttgttattctgtatatcctctagctagaaagttttatggccactgaatgtgaaatttggggagcgtctcatttactggaattccatgctagcacctcagcagttttattctgctttttgtgttgtgggaaactttggttcccatgtttcagtgagcactttcatgtttttgatatcccagcaaccatatgaaaaagcaatgatcacaggcagtgggggagaagaatattttagtgcaggaaagggaaatcttcctttctattcctggagcccgacagtgtctcatcctctaaatctgactgcttaatggaaaatccaggttgtaaagatggaagaagacacattttgcatctttgtgtttttatttgtgtgttcccacaagtcaaatggggtgaatatttatattagattctgaagagtggttgggaataaaagcacaaaatgaaattttgaaattttggaaattttgaaattttggaaaattgttctattcattcaaagagaaataaagcaaactttacaaaaattttaatgatatactaatgatgtaataattacatcttaaaattatatggtaacagttctgtatatatgatcaaatttaagtgtgaaatatttttaatgacaaattatgacaaactgagtcaaatgataaaatcaattaaaacaaaaaggtactttttattcaataaagcaataactgtccttaatatcaaacttccactcaaggttgaagaagaaatgcagaagcatggaagtaataatgtgggattatcagaaaacctgactgatggtgctgctgctggcaatggtgatggtggattagttccacaaagaaagagcagaaagcatgaaaatcagcaatttcctaacacagagattgaagagtatcacaggtaagcctatggcaacatttaacaggagataactatgtgctatcaaactaatccgaatttggactaatattcatgatgaaaaaattttatacttttcctaggatattcagccttgcctggtaatcagaagaatgaaaatcagcaaacaatgagttatattttttccagtcattaatttatttgaaaaataaccagtgttggcaaatgtgagggaaaaagcattttcttttctttttagtgaacttttattttagcttcaggggtacacgtgcaggtttgttacataggtaaactgtatcatggagattggggttacagattatttcatcagtcagataataagaatgatacccaataggtagttttttggtcctctccctcctgccatgctccaccctcaagtaggccgcagttgtctgttgttctcctctttgtgtccatgagttctcattgtttggttctgacaaatgagtgagaatatgtggcatttgattttctgttcctgcattagtttgcttaggataatgacctccagctccatctgtgttgctgcagaggaaatggactcactgaaaaggatattttcatacactgttggtaaatacattttgagtgttaatttagtagcatattcacacacacacatatataacagtaaggatataaaatatatgtatgttatggatatttgtatagatatattacatatatacttatgtataaggacatttattatagcataattatatcaaaaagttggagctagtccaaatccttatcaataggaaatagctcagaaaataatatagtatgcaatcagttttttaaaatgaagttagatctagagtgtactgattatttcacaattaacatgtatttaaagcatttagtttgctgacccatcttaagacaattttgttagaattcttgtagtatctgctgtgttgcaaatggaagctacatgctatgttgacactgtaccttgttagcaacaatatcgctagttattaaattatggttgtcagtgcctgagtgctgaaataattggaccctcaactgaacattgccaaaggattgcacatggggatctgtattttatgtaaatatttcagtatattggataaaacttgtttaaatacatcaaaggatctttgatctactaaaacaggaattggccagcttttttctgtaaagagccagttggtaaatattttaatctttgtggactatatgtacttatttttttgagacaggttctcactctgttgcccaggctggagtgcatttgcgtgatcatggctcactgcagcctcaactttctgggctctagtgatcctcccacctcagtctctctactagctgggaccacaggtgtgcaatatcacacccagatgattgactctatggactataaagtaaataagcatggctgtgtttcaagataccttacttaaaaaaacaggcagtgggctggagtgggcccacaagtgttaatttgctgacccttgtgctaaaaggaaggtgttgctaatgcagtgaatcttatttgtaagtgtcctgcatgcatgacattatccttcctttgaaaaaagaatatatttcagtattcacctcaccatagttttcaagtgacttcatataatttttatattgatgtaattcatgtaattatacttcataaaatttttaaaatttcatttataaaataagattattttctgcatttctcctattttattcctgttaataggactcagtattttactgtgatcaattactttgtatatgtgatgagtatcaactgtcctagatttcactgatttttatcaagcaagaaatactcctcttgaaacttttagtattccttggtctttatttttattcatttatttttattttattttattattattatactttaagttttagggtacatgtgcacaatgtgcaggttagttacatatgtatacatgtgccatgctggtgtgctgcacacattaactcatcatttagcattaggtatatctcctaatgctatccctctcccttccccccaccccacaacagtccccagagtgtgatgttccccttcctgtgtccatgtgttctcattgttcaattcccacctatgagtgagaatatgcagtgtttggctttttgttcttgcgatagtttactgagaatgatgatttccaatttcatccatgtccctacaaaggacatgaaatcatccttttttatggctgcatagtattccatggtgtatatgtgccacattttcttaatccagtccatcattgttggacatttgggttggtttcaagtctttgctattgtgaatagtgccgcaataaacatacgtgtgcatgtgtctttatagcagcatgatttataatcctttgtgtatatacccagtaatgggatggctgggtcaaatggtatttctagttctagatccctgaggaatcaccatactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgaacattttttcatgttttttggctgcataaatgtcttcttttgagaagtgtctgttcatgtcttttgcccactttttgatggggctgtttgtttttttcttgtaaatttgtttgagttcattgtagattgtggatattagccctttgtcagatgagtaggttgtgaaaattttctcccattttgtaggttgcctgttcactctgatggtagtttcttttgctgtgcaggagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatgtggctagccagttttcccagcaccatttattaaatagggaatcctttccctatttcttttttttgtcaggtttgtcaaagatcagacagttgtaggtatgcagcattatttctgagggctctgttctgttccattgatctatatctctgttttggtaccagtagcaggcttaggattgacttggcgatgcgggctcttttttggttccatatgaactttaaagtagttttttccaattctgtgaagaaagtcattggtagcttgatggggatggcattgaatctaaaaattaccttgggctgtatggccatttttatgatattgattcttcctacccatgagcatggaatgttcttccatttctttgtatcctcttctatttcattgagcagtggtttgtagctctcctcgaagagttcctttacgtcccttgtaagttggattcctaggtattttattctctttgaagcaattgtgaatgggagttcactcatgatttggctctctgtttgtctgttattggtgtatgagaatgcttgtgatttttgtacattgattttgtatcctgagactttgctgaagttgcttatcagcttaaggagattttgggctgagacaatggggttttctagatatacaaacatgtcatctgcaaacagggacaatttgacttcctcttttcctaattgagtaccctttatttccttctccggcctaattgccctggccagaacttccaacactatgttgaataggagtggtgagagagggcatccctgtctcgtgccagttttcagagggaatgcttccagtttttgcccattcatatgatatttgctgtgggtttttcatagatagctcttattattttgagatacatcctatcaatacctaatttattgggagtttttggcatgaagggttgttgaattttgtcaaaggccttttctgcatctattgagataatgatgtggtttttgtctttggttctgtttatatgctggattacatttattgatttgcgtgtattgaaccagccttgcatcccagggatgaagcccacttgagcatgttggataagctttttgatatgctgctggattcggtttgccagtattttgttgaggatttttgcatcaatgctcatcaaggatattggtctaaaattctctttttttgttgtgtctctgcccggctttggtatcaggatgatgctggcctcataaaatgagttatggaggattccctctttttctattgattggaataatttcagaaggaatggtaccagttcctccttgtacctctggtagaattcggctgtgaatccatctggtcctggacttttttttgttggtaagctgttgattagtgccacaaattcagagactgttattggtctattcagagattcaacttcttcctggtttagtgttgggaaggtatatgtgtcaaggaatttatccatttttctagattttctagtttatttgcgtagaggtgtttgtagtattctctgatggtagtttgtatttctgggggatcagtggtgatatcccctttatcattttttattgcatctatttgattcttctctcttttcttctttaatagtcttgttagcggtctatcaattttgttgatcctttcaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttaggttgtcaattttggatctttcctgctttctcttgtggaaattttgtgctataaatttccctctacacactgctttgaatgcgtcccagagattctggtatgttgtgtctttgttctcgttggtttcaaagaacatctttatttctgccttcatttctttatgtacccagtagtcattcagaagcaggttgttcagtttccatgtacttgagcggttttgagtgagtttcttaatcctgagttctggtttgattgcactgtggtctgacagacagtttgttataatttctgatcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcattgatctgtctaatattgacagtggggtgttaaagtctcccattattattgtgtgggagtctatgtctctttgtaggtcactcaggacttgctttatgaatctgggtgctcctgtattgggtgcatatatatttaggatagttagctcttcctgttgaattgatccctttaccattaagtaatggccttctttgtctcttttgatctttgttggtttaaagtctgttttatctgagactaggattgcaacccctgcttttttttgtttttcatttgcttggtagatcttcctccatccctttattttgagcttatgtgtgtctctgcacatgagatggttttcccgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattatttgatgcagtttcttcctagtctcgatggtctttacattttggcatgattttgcagcggctggtacccgttgttcctttccatgtgtagtgcttccttcaggagctcctttagggcaggcctggtggtgacaaaatctctcagcatttgcttgtctgtaaagtattttatttctcctttgcttatgaagcttattttggctggatatgaaattctgggttgaaaattcttttcttcaagaatgttgaatattggcccccactctcttctggcttgtagagtttctgctgagtctcatgggcttccctttgagggtaacccgacctttctctctggctgcccttaacatttttttcttcatttcaactttggtgaatctgacaattatgtgtcttggagttgctcttctcgaggagtatctttgtggcgttttctgtatttcctgaatgtgaatgttggcctgccttgctagatgggggaagttctcctgcataatatcctgcagagtgttttccaacttggttccattctccccgtcactttcaggtacaccaatcagacatagatttggtcttttcacatagtcccatatttcttggaggctttgttcatttctttttattcttttttctctaaacttcccttctcacttcatttcattcatttcattttccatcattgataccctttcttccagttgactgcatcggctcctgaggcttctgcattcttcaggtagttctcgagtcttggctttcagctccatcagctcctttaagtacttctctggattgattattctagttatccattcatgtaaatttttttcagagttttcaacttctttgcctttggtttgaatttcctcccatagcttggagtagtttgatcatctgaagacttcttctctcaactcgtcaaagtcattctccatccagctttgttccattgctgttaaggaactgtgttcctttagaggaggagaggtgttctgctttttagagtttccagtttttctgctctgttttttccccatgtttgtggttttatctccttttggtctttgatgatggtgatgtacagatgggtttttggtgtggatgtcctctctgtttgttagttttccttctaacagacaggaccctcagctgcaggtctgttggagtttgctagaggtccactccagaccctatttgtttgtgtatcagcagcggtggctgcagaacagcagatttttgtgaactgcgaatgctgctgtctgatagttcctctggaagttttgtctcagaggagtacccggccgtgtgaggtgtcagtctgcccctactggggggtgcctcccagttaggctgctcaggggtcggggtcagggacccacttgaggaggcagtctgcccgttgtcaaatctccagctgcatgctgggaggaccaatgctctcttcaaagctgtcagacaggtacatttaagtctgcagaggttactgctgtctttttgtttgtctgttccctgcccccagaggtggagcctacagaggcaggcaggcctccttgagctgtggtgggctccacgcagttcgagcttcctggctgctttgtttatgtaagcaagcctgggcaatggtgggtgcccttcccccagcctcactgccaccttgcagtttgatctcagactgctgtgctagcaatcagcgagactctgtgggtgtaggaccctccgagccaggtgggggagataatctcctggagcaccgttttttaagccccttggaaaagcgcagtattcgggtgggagtgacccgattttcttggtgtcgtctgtcacccctttctttgactaggaaaaggaactccttgaccccttttgcttcccaagtgaggcaatgcctcaccctgcttcggctcacacatgttgtgctgcacccactgtcctgcgcccagtgtctggcactctctagttagatgaacctggtaccgcagatggaaatgcagaaatcacccgtcttctgtgtcactcatgctgggagctgtagaccggcgctgttcctacttggccatcttggcctgggacccccttggtctttatttataagcatgaacaaaatgataatcagcttatataatccagaaatgttcacggggtcttttagttgtataatttttttattattatactttaagttctagggtacatgttcacaacatgcaggtttgttacatgggttatacatgtgccatgttggtttgctgcccacattaactcatcatttacattaggcatttctcctaaggctatccctccccctgggccccacactctgacaggccccagggtgtgatgttccccatggtgtgtccaaatgttctcattgttcaattcccacctgtgagtgagaacgtgcggtgtttggttttttgtccttgtgatagtttactgagaatgatggtttccagcttcatccatgtccctgcaaaggacatgaactcatcctttttcatggttgcatagtattccatggtgtacatgtgccacattttcttaattcagtctatcattgatggatatttggattggttccaagtctctgctattgtgagtagtgccccaataaacatatgtgtgcatgtgtctttatagcagcatgatttataatcctttggatatatacccagtaatgggatgactgagtcaaatggtatttctagttttagatccttgaggaatcaccacactgtcttcgacgtggttgaactagtttacactcccatccacagtataaaagtgttcctatttctccacatcctctccagcacctgttgttccctgacttttaaatgatcaccattctaactggtgtgagatggtatctcattgtggttttaatttgcatttctctgatgaccagtgatagcattttttcatgtgtctgttggctgcataaatgtcttcttttgagaagtgtctgttcatatccttcagccaattgttgatgtgattgttagtttttttcttgtaaatttgtttgagttctttgtagattcttgatattagccttttgtcagatgggtagattgcaaaaattttctcccattctgtaggttgcctgttcactctgatggtagtttcttttactgtgcagaagctcttcagtttaactagatcccatttttcaattttggcttttgttgccattgcttttggtgttttagtcatgaagttgttgcctatgcctacatcctgagtagtattgcctaggttttcttctacgatttttatagttttaggtctaacatttaagtctttaatcaattttgaattaatttttgtataaagtctaaggaagggatccagtttcagctttctacataagctagccagttttctcagcaccatttattaaatagggaatcctttccccgtttcttgtgtttttttttttttttttgagagggagtctcgatctatcacccaggctggagtgcagtggcgtgatctcggctcactgcaacctctgcctcctgggttcacatgactctcctgccttagcctcccaagtagctgggactacaggcgcttgccactacgcccggctaattttttgtattttttagtagagatggggtttcaccatgttagccaggatggtctcaatctcctgacctcgtgatctgcgcaacttggcctccgaaagtgctgggattacagacaagagccaccacacctggccccccatttcttgtttttgccaggtttgtcaaagatcagatagttgtagatgtgtggtattatttatgagggctctgttctgttccattggtctgtatctttgtttggtaccagtaccatgctgttttggttactgtagccttgtagtatagtttgaagttaggtagcatgatgcttccagctttgttcttttggctgaggattgacttggcaatgcaggctcttttttggttccatatgaactttaaagtagtttttccagttctgtgaagaaaatcattggtagcttggtggggatggcattgaatctataaattaccttgggcagtatggccattttcacgatattgattcttcctatccatgagcatggaatgttcttccatttgtttgtatcctcttttatttcattgagcagtggtttgtagttctcctcgaagagttcctttacgtcccttgtaagttggattcctaggtattttattctctttgaagcaattgtgaatgggagttcactcatgatttggttctccgtttgcctgttattggtgtataagaatgcttgtgatttttgcgcattgattttgtatcctgagactttgctgaagttgcttatcagcttaaggagattttgggctgagacgatggggttttctagacatacagtcatgtcatcttcaaacagggacaatttgactttctcttttcctaattgaatgccttttatttccttctcctgcctgattgccctggccagaacttccaacactacgttgaataggagtggtgagagagggcatccctgtcttgtgccagttttcaaagggaatgcttccagtttttgcccattcagtatgatattggctgtggatttgtcataaatagctcttattattttgaaatacatcctatcaatacctaatttattgagagtttttagcatgaagggctgttgaatgttgtcgaaggccctttctgcatctattgagttaatcatgtggtttttgtctttggttctgtttatatgctggattacatttattgatttgcatatgttgagccagccttgcatcccagggatgaagcccacttgagcatggtggataagctttttgatgtgttgctgcattcggtttgccagtattttattgaggattttgcatcgatgttcatcaaggatattggtctaaaattctctgtttttgttgtgtctgtggcaggctttggtatcaggatgatgctgacctcataaaatgagttagggaggattccctctttttctattgtttggaatagtttcagaaggaatggtgccagctccttcttgtacctctagtagaatttggctgtgaatctatctggtctttgactttttttggtttgaaagctattaattattgcctcaatttcagagcctattattggtctattcagagattcaacttcttcctggtttagacttgggagggtatatgtgtccaggaatttatcaatttcttctagattttctagtttacttgcatagagatgtttataatattctctgatggtagtttgtatttctgtgggatcggtggtgatatcccctttatcattttttattgcatctatttgattcttctctcttttcttctgtattattcttgcttgcagtctatcaattttgttgatcttttcaaaaaaccagctcctggattctttgattttttgaagggctttttatgtttctatctccttcagttctgctctgaccttagctatttcttgccttctgttagcttttgaatttgtttgctcttgcctctctagatcttttaattgtagtgttagggtgtcagttttagatctttcctgctttctcttgtgggtacttagtgctataaatttccctctatacactgctttaaatgtgtcccagatattttggtacatcatgtctttgttctcattggtttcaaagaatatctttatttcagccttcatttcattatttatccagtagttatttgggagcaggttgttcagtttccatgtagttaagtggttttgagtgagtttctttatcccgagtcctaatttgattgcactgtggtctgagagaccgtttgttgtgatttctgttcttttacatttgctgaggagtgctttacttacaactatgtggtcaattttggaaaaagtgcaatgtggtgctgagaatgtatattctgttgagttggggtggagagttctgtagatgtctattaggtctgcttggtgcagagctgagttcaagtcctagatatcctttttaaacttctgtcttgttgagctttctaatattgacagtggggtgttaaattctcccattattattgtgtgggattctaagtctctttgtaggcctttgaggacttggtttatgaatctgggtgctcctgtattgggtgtatatatatttaggatagttagctcttcttgttgaattgatccctttaccattaggtaatggccttctttgtctcttttgagctttgttgatttaaagtctgttttatcagagagtagaattgcaacctctgcttttttttcctttccatttgcttggtagatcttcctccatccctttattttgagcctatgtgtgtctctgaatgtgagatgggtctcctgaatagagcacactgatgggtcttgaatctttatccaatttgccagtctgtgtcttttaattggagcatttagcccattacatttaagattggtattgttttgtgtgaatttgattctgtcattatgatgttagctggttattttgcccgttagttgatgcagtttcttcctggcatctatgatctttacaatttggcatgtttttgcagtggctggtactggttgttactttccatgtttagtgcttcattcaggagctcttgtaaggcaggcctggtggtgacaaaatctctcagcatttgcttgcctgtaaagtgttttatttctccttcacttatgaagcttagtttggctggatatgaaattctgggttgaaaatttttttctttaagaatgttgataccttacatctacaaccatctgatctttgacaagcctggtaaaaacaagaaatggggaaaggattccctgtttaataagtggtgctggaaaaactggctatccatatgtagaaagctgaaactggatcccttctttacaccttatactaaaattacttcaagatggattaaagacttacatgttaaatctgaaactttaaaaaccccagaagaaaacctaggcaataccattcaggacataggcatggataaggacttcatgtttaaacaccaaaggcaatggcaacaaaaaccaaaattgacaaatgggatctaattaaactaaagagcttctgcacagcaaaagaaactaccatgagacttaacaggcaacctacagaatgggagaaaatttttgcaatccactcttttgacaaagggctaatattcagaatctacaaagaactcaaacaaatttacaagaaaaaaacaaccccatcaacaaatgggcaaaggatatgaacagacacttctcaaaagaagacatttatgcagcccacaaactcatgaaaaaatgctcatcatcactggccatcagagaaatgcaaatcaaaagcataatgtgataccacctcacaccagttagaatggtgatcattaaaaagtcaggaaacaacaggtgctggagaggatgtggagaaataggaacacttttacactgttgggagtgtaaactagttcaaccattgtgaaagacagtgtggcaattcctcaagggtctagaactagaaataccattggacccagccatcccattactgggtatatacccaaaggattataaatcatgctgctataaagacacatgcacacgtatgtttattgtagctctattcagaatagcaaagacttggaaccaacccaaatgtccatcaatgatagactggattaagaaaatgtggcacatatgcgccatggaatactatgcaaccattaaaaatgatgagttgatgtcctttgtagggacatggatgaagctggaaaccctcattctcagcaaactatcgcaaggacaaaaaaacagacaccgcatgttctcactcataggtgggaattgaacaatgagaacagttggacacaggaaggggaacatcatacactggggcgttttgtggagtggggggaggggggatagcattaggagatatacttaatgtaagtgatgagttaatgtgtgcagcacaccaacatggcacatgtatacatacataacaaacgtgcacgttgtgcacatgtgccctagaacttaaaaaaaatgttgaatattggcccccactctcttctggcttgtagagtctcccaagagatctgctgttagtctgatgggcttccctttgtgggtaacctgacctttctctctggttgcccttaacattttttccttcattttaaccttggtgaatttcacaattatgtgtcttggggttgctcttcttgaggagtagctttgtggtgttctctgtatttcccaaattttaatgttggcctgccttgctaggttggggaagttcccctggataatgtcctgaagagtattttcctagttggttccatccttccttgtcactttcaggtacaccaatcaaacgtagatttgttcttttcacatagtcccatatttcttggaggctttgttcatttctttttactcttttttctctaaacttgtcttcgttctttatttcattaatttgatcttcaatcactgataccctttcttccactttagcaaatcagctattgaagcttgtgctttcatcatgtagttctcatgccatggttttcagctccatcaggtcatttaaggtcttttctacattgtttattctagttagccattcatctaatcttttttcaaggttccttgcaatgggttcgaacatcttcttttagcttggaggtttgttattaccgaccttctgaagcctacttctgtcagctcatcaaagtcattctccagccagctttgttccgttgctggtgaagagctgcgatcctttggagggaagaggggctctggtttttagaattttcagattttctgctctggtttctccccatctttgtagttttatatacctttggcctttgatgtcggtggccagaaatggggttttggtgtggatgtccttttagttgatgttgatgttattcctttctgtttgttagttttccttctaacagtcaggtccctcagctgcaggtctgttggagtttgctggaggtccactccagagcttgtttgcctgcatatcaccagtggaggctcagttggaaatgcagaaatcacccatcttctgtgtcaatcatgctgggagctgcagatgggagctcttcctatttggccatcttggaacgtaatattttagttctataattttaagaatataataccttggtctggcatgtttaaatgccattttgtataatttttataacctttaaaatatacaattgttacttaaaatttgaaaactgcaccatttatataaaattataaactactatttcttatctatcactagtccatgactgtggaagaaaattacatcattcactgtcatgactcctaaatatgatgtccttaaaagaactgtctgcactcacaaactgaaattttctttccattcattcttgatcttatttcagtagtcttcaatttcagcactcctccaaagttgtttttctcaagattatcacaacttttattgtgtaataaatctaggcattttttcttacatctcattttatttaatttatcagcagtatttgacccagtggaggatatctccttcataacagcatcttcacttggttttcaagacctcactccctcaggctttttctcctgccttcgtagtccattcatcatggtctgtttttgttgctcctcctcatctttcaccttttgcacattgttgtttcccagggctcagtccctaatcttctttctcatgacttttttttttttttgaggtggagtctcactctgtcacccatgctagagtgcagtggtgaaacctcagctcattgcaacctgtcttgtgggttcaagcaattctgctgcttaaacctcctgagtagctggaattacaggcacctgccaccatgcctggctaatttttgtctttttagtagcagcatggtttctccatgttggccaggctgttctcaaactccggatctcagatgatctgcccacctcagcctcccaaagtgctgggattaaggtatgagccagcaccccagcccctcatgactttttctaatgtgtatatgctagtgatttccaaatgtatgtctctagctcagacctctcaccttaattccagatctctatatcaacctgcctacttgacatctctttttggttggctattgggcatcacacacttgccagatccaaaattgggctactggtgcccttcctgaaatcgacacctcatgcaatctttcctaatttggttagtggccactcttccagttgctctaccaaaaaccttggtgtcattcttgactcatctttctttctctcttatacctcacatccaatctatcagtaaatcttgtcaggtctactggaagaatatatccagaagccagtcatatcttttatatctgagccaccatcatctgtagtctagatgagtgtcatagactggtaatggatagtcctggtttttaaaaaatttcctttaaatctattcttaactcagtggcaaaacataagtcgaattgtgtcattcctctgccccaacccttctgattgccttccatttcactctgagtatgtgacaaaattcctcctaataactaaaaggcagtacaccatctagcatgttttctctcctgcttaaacttctattacttctctcctttgctctgcttcagccacactgaacttctcgctattccttatctatctctcttgctgaacgactccaggtacacctctatacttggcagttccttgtgttcttcagttctttacttaaaaatcccctttctcagcagggacctttctggccatcccaacttttccaccacccttcccctcaaacacataatcatttcattttcctgctttagtttttctcctctaacatactgtatattttgccttatctgtctattgttgtgtgtttatctcattctcatgaataggatttttattgttcactaccatatcctcagtgcctagaaaaaggcctagcatatcggatgtatctacctaacaaatactcgtgggtatattacatttgattgattctcacttaaaaaatgtttgacaaggttcactctaacaacttagcctggtaattatatgcataaattcttttggctctttataataagctacattcttaatattttttcatttagggagaaaatcccaatattgtggttattcaccatttattattttactggtaatcatgataattttaattatggtaaaatgcatcagaggaattgcaaactttactggtattttatctgaaaaatattagggtggtaaatttaatggacttacaaattctttccaacggattatgaaacttcagtatttgaaataaaaaaacagagttggaattttttgcttgctgtataagaggtgtactgatcaggcactgtctgctctgatggagcagctgctgctgcttggctgtctttcagaagcaagctgctcacattgatattggtgggcaagcaagggcagcggtcattgatcgattgactagatttagaacttgccctgggtggcttcttgttatcatggctacaggtcagttcttttctaagtttgtgctgtttaaaggttgccttccattaactattttcaaaatgaaactattttatattccagaattgcatacttaattttaaagttttttcaagatgaattggttaataatagctctcaggaagacctttttttttttttttttttgctacatagtcttgtcttaaccagaagagttctctgtataatttatttcttaaaaataatggttttgtttttgttttcagtgtttttagaagcttttgctcaagtcctaacataaactccaatgggagattttaatctctttgtcagttcatggatgtgtatgatagtgatattctctctttttaaattccttttcttgttcactttcttctttgtacaataatagtgatattcttgtgcatgtttacctcattaaaaagtaattacaattttctgctggcaaatccagctttttatattttgactaaataggaggctaaaagtgaagaacatttaccagattgttttattttcaaacaaaatcataactaatcaaaaattgctatttttgaaatataaataatgacatttagatattttaaaagtaaggatagcccccgatgtaggttggctttgtgtccccacccaaatctcatgtcaaattgtgattcccaggtgttgtgagaaagacctggtgggaggtgattagatcatagggttggtttcccccatgctgttctcatgatagtgaatgagttttcacaagagctgatggtttcttaaagggctctatccccttcacttctctctctcctgccaccttatgaagaaggtgtctgcttccccttcaccttaccatgattgtaagttttctgaggcctccccagccatgtgtaactgtgaatcaattaagcttctttcctttatgaattaccccatctcagatatttctttgtagcagtgtgaaaatggactaatacagagaattggtaccagggatagtggggtattgttaaaaagataatgtgaaaaggtggaagtgactttggaactgagtaacagaggttttaacagtttggagggctcaaaagaagacaggaagatgtgggaaagtttggaacttcctacagacttgttgaatagttttttttaccaaaatgctgatagtgatatggccaatgaagtccaggctgaggtgatcttaggtggagataaggaacttgttggggactggaacaaaggtgactcttgatatgctttagcaaagagactgacagcattttgcccctgcactagcaatctgtaaaactttgaacttgagagagatgatttaggctatctggtagaagaaatttctaagcagcaaggcattcaagaggtgacctggttgattctgaaagcattcagttttatgcattcacaaagagatggttttaagctggggcttatgtttaaaagggaagcagagcataaatttggaaaatttgtagcctgaccatttggtagaaaagagaaacaacacattttctatggacgaatgcaagttggctgcagaaatttgcataaataacgaggagcggaatgttaattgccatgaaatggagaaagtgtctttagggcatgacagagatcttcgtggcagccactcgcatcacaggcccagagtcctggaaggaaaaaatggtttcataggtttgggtccagggccctggtactgtgtgcagcctcaggacttgctgccctgcattcagccactacaggtccaactgtggctaaaagggaccaaggagaaacttagcctttatgaattacccagtcttcagtatttctttatagcagtgtgaaaatggactaatacaccctccctgaagacattttcctgatttcgtctttcatgttttatgtgccacagctacttttgaaattgtatttaaaggtaaacattattatattgaataatagaaacagaaatatagcccaaatctaattgtgattttcatgtttaacagtcatttctcatattcagtggactccagctttttaatatagcattcaagtgtagtgtagattcatctcctattcttagcttccaagtattttacacttttcctttcaagttcttagtaagcatctagacttcatgtgcttaatctttgtgctcacattctgttctctaactggaaggattttctctcactgtttttccctagtgggcccttcttatattttgcctcttctctaaagccttccttgtgctaaaatataactttttaatatatcaactcttacagaacacaatgtattataattgtatattaccttgtttttgaagcaggggatgcacatttccttttatgttgtttgtagttctaaacatttaaaaaattaatcagtgcaatgagatggaaaacagttggagttttacaaaaattgtggtttttttgttcattgtcaatagagttattaggaaacattggctttttatagagtttttaaagtagagcttttgccttgcatatgaagaaagaaacatgaaaataaaaaacggacctcaaaataatctgtgattacacccatatttgagaaggccaatttactaactcatggtctgcaacaagtaaatgatgatagcagtttaagtgaaatagatggtaaagaaggtaaaatttataagtcctttataagaaatatctgggaacaccccctcaaaaagtgggcaaaggatatgtgcagacacatctcaaaagaggacatttacgtggccaagaaacatgaagaaaagctcatcatcactgatcattagaaaaatgcacatcaaagccacaatgaggtaccatctcatgccagttagaatggtgatcattaaaaagtcaggaaacaacagatgctggtgagcctgtggagaaacaggaacacttttacactgttggtgggagtgtaaattggttcaaccattgtggaagacagtgtggtgattcctcaaggatctagaaccagaaataccatttgacccagcaatcccattagtgggtatatacccaaaggattataaatcatgctactataaagacacatgcacacgtaagtttattgcggtattatttacaatagcaaagacttgtaaccaacccaaatatccatcaatgatagactggataaaaaaagtgacaaatataatccatggaatactgttcagccataaaaaagaatgagttcatgtcctttgcagggacatggatgaagtgagaaactatcattctcagcaaactaacatgggaacagaaaaccaaacactgcatattctcactcacaagtgggagttggacaataagagcacatggacatagggaggggaacatcacacactggggcctgcctgggggtgagggagcaaggggagggagagcattaggacaaatacctagtgcatgcaggacttaaaacctagatgacaggttgataggtgaagcaaatgaccatggcacatgtatacctttgtaacaaacctgcacgttctgcacatgtatcccagaacttaaggttaaaaaaattttaaagtcaaaaaaaaaaaaaaaaagaaagaacaaaaaagaaagaaaagaaaataaatctctaggaaagaacgttaacaccaattacttttcctggaactagaataatatagtctcctcaaactggaaatactcaactgtatcagtgctgttgaaagattgattataataaggattagtgactttgactaggagaagtttcaacaaatgatagccatggaaatctgtagtggatgaatgtagacaactcttgagagaaaatttgctgggaaaggcaatatagaaatgggcaataattaaaaaagagtgtgggatttgagggagttttctctctttgtgtttcaaaacagaaatttttagagtttattttttactgttgggaatgatccataagagaagaacatggttatgaaaggtaattttgtttgcttggttgcatgtctaagcattagacagcttgattcattatcttttatggatttttagcaaactaattgcccttagaacttctattcatgtatagttttatgattagagttgttttttcagaattggttcagaagtgtaacatgttagtgtaactgtacatgccgatgatgacctaaaacttaaactgtcatacacagatttttaaaaagaattataataaacattcacacacttaggccatgctgaatagaatttaaatgttccttcataattgcacatcttgcactacctttgacagtagcatcatgaatagccatgatttgcttaggtacttactctaaaatatcaggtgtatcaactttatgattgtttagattctggggagtagggaaggattttgttcatgaagttgagaaaagcaaactattgacaatctattgcagattattacttcaggattataaactcctaaagcatcaaagccatattttcctgggccagcaatgttatcagcatatattgtatgctcaatgagtatttgttgaatgcatgaataaacagttgaagaaataaatgaatgacattgataaatttcttttaaaaactaatttttagttttttgaaagtagtaggtttccaaacttgcctctgtataaagtctttattttttaaaaaagtgcaggattcatgttctcactcataggtgggaattgaacaatgagaacacatggacacaggaaggggaatatcacataccagggactgttgtggggtggggggaggggggagggatagcattaggagatatacctaatgctaaatgatgagttaatgggtgcagcacaccaacatggcacatgtatacatatgtaacaaacctgcacgttatgcacatgtaccctaaacttaaagtatgtatatataaaaaaaagacactgcaattttcaaaaggtgaaaaaaaagtgcaggattcagaaattattagttatagccaaaaacagaatgataatcagaaatttttagttatagccaaaaacagaatgataatatggatttgtctgctatcatatctcttaaaaacacttgaatataaatattaccttcacagcatattgcaaaacacatgttttggagggagaattcttggatttcaatgctgtgtcaattactgaccagctctatgggctgggaaaatttatatggcctttctgggcctagtttctttctttatagaagccctaatattacctacctcaaagaattgttatgatgattaaaatgagcttgacacatgcacagtgcttagaatgatgcatagtgtctgcataataagtcctgaaaaagctaatattatcatttaaaaaagggttcccctcacataagaacataaataatgttttccaaataggtttcagtgccagtaaaagcttgtttttattgaaaaggacagcaatgagaagtcctggtatatgtctttctatcacataatatcagtaacatgtttttccttttgccttgactgtcagaaagcttgatctaaattcaattctttgtaatgatattattattatcatattttctttctcccttaatgttactctttctgtttatagtttaattccccatgtggaaaatagttatatttacattacctgttaaaaaatgacctgaacacttaatggatagaataaataacttataaatgccgagattttatataataaaataatagatttggacattatttgtattttatgtatttgtttgtctaagaagaattgtttcttttttcaggcctgaaaagaaatctaatgaaaagaacaaggtattgtaataagtaaattatctgaaacattattgttaaaaaaacacattataaaaggtaaagtgagaaccttttttaataaagacaattagttagaataaaagggcttaataacaagtacccattgataacggtacccttttaagaaaaatctgttgttttaagaagcacctgtggttttgctcatataaaaatatgaataaataccacttctgtacaactggtatattctatgaatattttgaggacatttgaggcagtattatttatcttacaggtcaaaagccaaatacattcagtggataaccttgatgacataacatggccatcagaaatagcgtcagaggattatgatttgcttttctctaattatgagacttttacattgctcattgaacaactcaaaatggattttaacggtaggaccattgcataagtagaaggccttttaatgtatcccacagtaatattcacacacattgcttagtattgcaccacagagcactgacgtgtgatagggatgatcatctcagaaacgtgtttgacattaaaatagactgagaaataatgtatattgtataccaaagagctatgataactccactgtacctttctcagtgtgaagggcagtctcagcctttttattgactctgcttctcccagatcgggttaccattctctcccactcagaatactgcagtaaccttagaactatttttcctgctaccccacttcctgagaccatggtctactctgaaactataattattaatttaaaaaaattcagatctgatgttgtctcttccttgtaactcagcataccacttgccattgctattaggttaagatctgaatattctagctctctcttgcatcatttaatacccttttttccctgccctagccattgtcttagatgtttattcctgcaatttatagctttagtgaggtataactgatatatgataggctgaatgtacgtaaaatatacgatttgataagttttggcatacgtatgcacatgtgaaaccatcaccataatcaagagcagtaacatgcccatcatccataaaaatctcttcctgtccgtttgtattctccttattaagaaactactaaatgtttaagtatttatactgtattccattcccatcagcagtatatgacaattctcattgtgcaatgtcatcatgagctcttagtattgctgtttattagtttttactgttagccattccaatgggtgcatattgtgcgtgtcactgtggtgtgaatatgcattgacctaaggactaagaatgttgaacatcttcccgtgtgctgatttgccacctgtatatcttctttagtgaactgtcttttccaatctggatagcttataaagatttaaaaattagatagtttttattcttatttgctgagttttaagagttttttaaaataaattctggatatcattccattattatgctttttcagaaagattttttcccagtttgtagcttgactttttgttttcttaataatatattttaaagagctgaagtttttcgttttgatgaaatgtgatatatctgttcgtttaattacagactttgctttttgtctcatgcctaaaaaaagtctttgtccagcacagggtcccagagatttttctcctctgctttcttgaagaatttttatagttttaggttttatatttagatctgtgatccacattgtgtacatttttgcatatgagtgaggtgtgatgtaagttcattgtatggatgtggatatctatctgttccagcagcatatgttgaaaatgctgtcttttctccatacattgctattgtccctttgtgaaaagtaagctggcatatgtgtgtgtgtctatttctggaccatttgttgtattccatcaatctgcgtattcttctagagttatactgatgaaccaatcataatttgaaaatcaatttaataccccaataaacccattgtacagttgaaaaattctaagtagaaccatcttaaactggagactatctctatctggctttcttcatgtaggtctagcatccctaatccaaaatccaaaatcagaaatgctgcaaaatccaaaactttttgagtgccaaaatgatgccacaagtagaaaatttcaaactagacatcaggtacacaaactttcatctgcaaatttactaaaagtgttccataaaattacctttaagccctgcatataaggtgcatgtaacataagtgtattttgtgtttagagttcgattccatttttgagatatctcattatatatgtgcaaatattccaaaacccaaaacacttttggtaccatgcacttgtagagatattccacccatatcacactgtttcattactgtaaatttatactaaatcttgacaccagcccttcagttttcttcttttttaagggttattttgattatgttggatcttttgcatttgcacttgagttttagaatcagattgttaatttttttttgtagttcaaatttaactttttaaaaaattttatcattattatactttaagttttagggtacatgtgcacaacgtgcacgtttgttacatatgtatacatgtgccatgttggtgtgctgcacccattaactcatcatttagcattaggtatatctcctaatgccatccctcccccctcccccaaccccacaacactccccggtgtgtgatgttccccaccctgtgaccaagtgttctcattgttcaattcccacctatgagtgagaacatgtggtgtttttttttttgtccttgcaatagtttgctgagaatgatggtttccagcttcatccatgtccctacaaaggacatgaactcatcctttttatggctgcatagtattccatggtgcatatgtgccacattttcttaatccagtctatcattgatggacatttcggttggttccaagtcattgatattgtgaatagtgctgcaataaacatacgtgtgcatgtgtcttcatagcagcatgatttataatcctttgggtatatacccagtaatgggatggctgggtcaaatggtatttccacttctagatctctaaggaatcgccacactgacttccacaatggttgaactagtttacaatcccatcaacagtgtaaaagtgttcctatttctccacatcctctccagcacctgttgtttcctgactttttaatgatcaccattctaactggtgtgagatggtatctcattgtggttttgatttgcgtttctctgatggccagtgatggtgagcatttcttcatgtgttttttggctgcatgaatgtcttcttttgagaagtgtctgttcatacccttcacccacattttgatggggttctttgtttttttcttgtaaatttgtttgagttcattgtagatagccctttgtcagatgagtaggttgcaaaaactctctcccattctgtatgttgcctgttaagtctgatggtagtttcttttgctgtgcagaagctctttagtttaattagatcccatttgtcaattttggcttttgttgccattgcttttggtgatttagacatgaagtccttgcccatgcctatgtcctgaatggtattgcctaggttttcttctagggtttttatggttttaggtctaacatgtaagtctctaatccatcttgaattaatttttgtataatgtgtaaggaagggatccagtttcagctttctacatatggctagccagttttcccagcaccatttattaaatagggactcctttccccattgcttgttttttgtcagatttgtcaaagatcagatagttgtagataatgcagtgttatttctgagggctctgttctgttccattgttctatatctgtgttttggtaccagtaccatgctgttttgtttactgtagccttgtagtatagtttgaagtcaggtagtgtgatgcctccagctttgttcttttggcttaggattgacttggcagtgtgggctcttttttggttccatatgaattttaaagtagtttttttccaattttgtgaagaaagtcattggtagcttgatggggatggcattgaatctatgaattgccttgggcagtatggccattttcacgatattaattcttcctacccatgggcatgaaatgttcttccatttctttgtatcctcttttatttcattgtgcagtggtttgtagttctccttgaagaggtacttcacgtcccttgtaagttgtattcctaggtattttattctctttgaagcaattgtgaatgggagttcactcatgatttggttctctgtttgtctgttattggtgtataagaatgcttgtgatttttgcacattgattttgtatcctgagagtttgctgaaattgcttatcagcttagggagattttgggctgagacgatggggttttctagatatacaatcatgtcatctgtaaagagggacagtttgacttcctctttccctaattgaatgccctttattaacttctcctgcctgattgccctggccagaacttccaacactgtgttgaataggagtggtgacagagggcatccctgtcttgtgccagttttcagagggaatgcttcctgtttttgcccattcagtatgatattggctgtgggtttgtcatagatagctcttattattttgagttatgtcccatcaatacctaatttattgagagtctttagcatgaagtgttattgaattttgtcaaaggccttttctgcatctattgagataatcatgtggtttttgtctttggttctgtttatatgctgtattacatttattgattttcatatgttgaactagccttgcatcccagggatgaagccgacttgatcatggtggataagctttttaatgtgttgctggattcagttggcggtattttattgaggatttttgcatcaatgtttatcaaggttattggtctaaaattctcttttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttagttggtaaactattaattattgcctcaatttcagagcctgttattggtctattcagagattcaactcttgctggtttagacttgggagggtgtatgtgttgaggaatttatccgtttcttctagattttctagtttatttgcatggaggtgtttatagtattctctgatggtagtttgtatttctgtgggatcggtggtgacattccctttgtcattttttattgtgtctacttgattcttctctcttttcttctttattagtcttgctagtggtctatcaatttttttgatcttttcaaaaaaccagctcctggattcgttgattttttgaagggtttttttgtgtctctatttccttcatttctgctctgatcttagttatttcttgccttctgttagcttttgaatgtgtttgctcttgcttctctagttctcttttattgtgatgttggggtgtcaattttagatctttcctgctttctcttgtgggcatgtagtgctgtaaatttccctccacacactgctttgaatgtgtcccagagattcttgtacgttgtgcctttgttctctctggtttcaaagaacatctttatttctgccttcatttcgttatgtactcagtagtcattcaggagcaggttgttgagtttccatgtattttagcagttttgagtgagtttcttaatcctgagttctactttgattgccctgtcatctgagagacagtttgttataatttctgttcttttacatttgctgaggagtgctttacttccaactgtgtggtcaattttggaataggtgtggtgtggtgatgaaaaaaatgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtcactaaggacctgcttcatgaatctgggtgctcttgtattggtggcatatatatttaagatagttggctcttcttgttgaattgatccctttaccattatgtaatggccttctttgtctcttttgatctttgttggtttaaagtctgttttatctgagactaggattgcaacccttgcctttttttgttttccatttgtttgttagatcttcctccatccctttattttgagcttatgtgtgtctctgcacgtgagatgggtttcctgaatacagcacactgatgggtcttgactctttatccaatttgccagtctgtgtcttttaattggaacatttagcccatttatatttaaggttaatattgttatgtgtgaatttgatcatgtcattatgatgttagctggttattttgctcattagttcatgctgtttctttctagccttgatagtctttacaatttggcatgtttttgcagtgtctggtactggttgttcctttccatgtttagtgcttccatcaggagctcttttagggctggcctggtggtgacaaaatctctcagcatttgcttgtctgtaaagtattttatttctcctttgcttatgaagcttagtttggctggatatgaaattctgggttgaaaattctttctttaagaatgttgaatattggcccccactgtcttgtggcttgtagagtttctgctgagagatcagctgttagtctaatgggcttccctttgttgttaatccgacctttctctctggctgctcttaacattttttccttcatttcagttttggtgaatctgacaattatgtgtcttggagtttctcttctccaggagtatctttgtggcattctctgtatttcctgaatttgaatgttggcctgccatgctagattggggaagttctcctggataatatcccgcagagtgttttccaacttggttccattcttcccatcactttcaggtacaccaatcagatgtagttttggtcttttcacatagtcccatatttcttgaaggctttgttcatttctttttattcttttttctctgaacttctcttctcactcatttcattcattttgtcttccattgctgataccctttctgccagttgatcgcatcagctactgaggcttgtgcatttgtcacatagttctcataccttgggtttcagctccgtcaggtcctttaaggacttctcttcactggttattctagttagccattcatctaattgtttttcaagatttttaacttctttgccattggttccaacttcctcctttagctcagaatagtttgatcttctgaagcgttcttctctcaactcatcaaagtcattctccgtccagctttgttccattagctagtgaggagctgtgttcctctggaagaggagaggacctctgatttttagagtttccagtttttctgctctgttttttccccatctttgtggttttatctacctttggtctttgatgatggtgacatacagatggggttttggtgtggatgtcctttctgtttgttagttttccttctaacagttaggacccccagctgcaggtctgttggagtttactggaggtccactccagaccctctttgcctgggtatcagcagcagtggctgcagaacagcggatattggtgaacagcaaatgctgctgcctgatcgttcctctggaagttttgtctcagaggagtacccagccatttgaggtgtcagtctgcccctactgttgggtgcctcccagttaggctactcagcagtcagggacccacttgaggaggcagtctgtccattctcagatctcaagctgtgtgctgggagaaccactattctcttcaaagctgtcagacacggacttttaagtctgcagaggttactgctgcctcttgttagtctgtgccctgcccccagaggtggagcctacagaggcaggcaggcctgcttgagctgtggtgggctcctccgagttagaacttcctggcagctttgtttacctactgaagcctgagcaattgtgggtgcccctcccccagcctcactgctgccttgcagtttgatctcagactgctgtgctagcaatgagtgaggctccgtgggcataggaccctctcagccaggtgtggggtataatctcctgatgtgccatttgttaagcccattggaaatgcaaagtattagggtgggagtgacctgattttccaggtgccatctgtcacccctttctttcactaggaaagggaattccctgaccccttgtgcttcctggtgaggtgatgcctcaccctgctttgcctcatgcatggtgtgctgcacccactgtccagcactcctctgtgggatgaacccagtacctcagttggaaatgcagaaatcacccatcttctgcatgtctcacgttgggagctgtatactggagctgttcctatttggccatcttggctccacccctctcccagatagttaattttttaaaaacctgctgtgctggaaattacactgagttagtgatgaatctatacattaattgggggaagatttacattttaatgagaatgcattttttgactcctgtgaaatggtttctatttatataggtcaaatttaattttctcagtaatattttatagattttaaaatatggctttcctttctttttgagacagtttcactccaggctggattgcggtgcctcgatcttggcctactgcaacctctgcctcctgggttcaaatgattctcctgcctcagcctcctaagtaactgggattataggcatgagccactgcacccagctaagttttgtatttttagtagagatggggtttcaccattttgtccagagtggtcttaaattcctgaactcaagtaatcctcccggcttggcttcccaaaatgctgggattacaggcatgagccactgtgcccagccttggtgtttccttattttatcagattcatctgtatctcattttttaatgaagttataaatgacatttaaaaaaatttcaagttgattgtttactgctaggatataggaatacagctgatttttgtatgttgatttttgtatcctccctccttgctaaacttagacttacttattagttctagtagcttttttggtagatttgatcagattttatacatacaacaaagattatcaaatcttttcattctcaaactactttcttactatggataggaagtcttttagacttgtggcaaagcagtctctgttgcagctagtcaactctgccattgtagtatgagagcagtcagggaagttacctacattaataaactcagctgtgttccaataaaactttatttacaaaagccagaagctggcccagaggctgtagtttatctgcccctattatgtgatcatggttgtgaataaagacagttttacttcttctttccaacctggataacttttatttatttttcttgtctgacagcactggctagaatcttcagcacaatgcttactaaagtgttgaaagcaggcattattgtgtcattcctgatacggggaaagcattcagtttgtcatcatgatacacattaactgtaggtttattatagatgctttgtatcatgctgatgaagttcatttgtattcttaggttgctgagtttttttttctttttaaatcaagaatgaagttgaattttatcaaatgtctttatttactgagataatcataaggttcttctcttttagtgttttaatggggtgaataactgatattttaatgttaaaccaacctttcattttagaataaaacttattttcttaggatgtaggcttttaaaaagtatatcattggggccggacacggtggctcatgcttgtaattttagtactttgggaggtcaaggcaggaggattgcttgaagctggagttcgagaccaacctgggcaaaaaaatgagaccctatatttatttgtattcagtttgccaaaattctgtttagaaaattttaaaagactatgtaaatgtagttttaggttcacagcaacattgaaagtatggtacagagattgtctgtgcttcctgtccacagacatgcatagcttcccccattatcagtatctctcactatagtggtacagttgatatgattgatgaaccaaaattgcatgtcataatcatccagatttcatagtttatattagtgtgcactcttggtgttgtacattctgtaggtttggaaaggactgatattcatcattatagtattgtacaaagtaattttactgctctaaaatttatttatgtttcacctatctgccctttcatgccctcctcaaccacaggtaaccactgatctttttactgtatccatagttttgccctttctacaatgtcatatagctgaaatcatacagtgcatagccttcagattggcatctttcacttagtaatatgcgtttatgtttccatcatgtcttctcatgacctgatagctcgtttctgtttagaactgaataatggttcattgtgtaactgtaccagaggttgttcactcacctattgcaaggtatcttggttgcttcagaaatttgtgaaatattttgtcaatgttcatgagggagttttcttttttgtaatatcattgtttggttcagggtaatgctagcattatagaatgagttgtgttgtatttctcctctttattatttgggagagaggttgtgtaaaattatattacatctgcctaaactgtttgatagaattcactagcatagctatctgggcctggagttttctcaactttattttctttcatagatatagggtgatttggattatctatttcttcttgattgagctttggtaatttttattttttaaggaacgtgcccacttaatctaagtggtaatggttagttacataaagcttgcactattatcttgctattcttttaatatctgtagaatgtataaaaatgttacattaattatctctgaagttagtaatttattctcttttttatgatcagcctggctaggtcaaggtttatcacttccactgatgacctcaaagtatttggttttattgattttccctattgttctcctgtttcatctttgatgtcatcatcggtttggcctgctctcacaaaataccatagacttggtagcttataaacaacagaaactgatttcatacattcctaaaggctgcaaagtccaagatcaaggtgccagaagattcagtgtctggtgagggacaaattcctgatttctatattcctttatttcccctgtgtgcttcatatggcagaaggggtgaatgagctttctggggtctcttatataagaagggcactaatcccattcattagggcttggattccatgagctatcacctccacaaagctgcagtatctaataacatcacctctgtgattaagtttcagcatatgagttttgggaggacaaaaatgttcacactatgttctgatgtttattattttctctgcttctgttgggtttaatttgctctctttttttgtagtttcttcttttttacttacttttcgtttgtttgcttgtttttgagacagagtctcattctgtcatctagcctggagtgcagtggtgtgatttcagctcactgcaacctctgcctctggattcaagcaattctcatgcctcagcctcctaagtagctaggactacaggtgtgcaccactgcacccagctaatttttgtatttttagtagagatggggtttcaccatattggccagggtggactcgaactcctgacttcatgacccatccacctaggccaccgaaagtgctgggattataggcatgagccactgtgtccagaccttttttactttcttaagatagaagtcaaggctattgatctgaatgtcttccagtatagacattccgtgctaacttttcatttaggaactgttgtagctatattccacaaagtctaacatgtagtattttcatttttattcagttcaaaatagtttccaatttctctttgtgtcaccactttgcctaggattatttagatatgtgttactttgtttccaaatttttgagtattttgatgagctattttgttactgatttctaattttattcttttgtggtcagggaccatactttgtatgacttaaatacttttgacttaatactttcatgaagatttattgtatggcctagaatgtggtctgttttgctaagtgttccaagggcacttgagaagcatagtgttcttcaagtctactcttgtcttgctgattttctgcctccttgttttatcatgtattcagtacgcaatattgaaatctcacactatacctgtgaatttgtcaatttcttctatcagtttttagctcatatttcgaagccgttatgttaccaggtacataaacatttaagattatgtgttcttgaataactaaatattttatcattctgaaatgatgttgtttataactagtaatattttttgttgtgaaatctactttagtattaatataatgattcctgattagatttcttttgtcatctgtttgcatgggatatatttttcttccttttaaccaatttgtgtctttatatttaaagtgtgtttcttataggtagcatggagtaggatcttgctttttatacagtttgacaatttgtcttttaatttaggttattagacccatttcatttataatgtgattattgatatattaatatttaagtttatctgtcatcgcgctgtttgattttcattagtcccagctattctttgttcccttctttttctaatttcctttcaattagttatgtaacttttatggtttagttttatctctcattttttggcttattggctctatttttttttttgctatcttaatggttgcattacaatttgtactgtatgattttaacttatcacagttcactttcagacaatattatatcatatcacatatggcataagaaaatcagaatagtatgctttcatttcctctctcccagccagattcttcctggatttgtggaattatggttttcattaagtttagaaagtttctgttcattttctctttatgttttgtcattgtctctccctccctctttggggacaggtatattattgcttaaagtttttgcataattctctgatgtcccaaatttatgaatcttctcttttgtggtatctagtctgtatttacttctaccagtgtcctttccgtcatgactttgtttttgtttgtttgtttgtttgttttttgaaacaaagtctgactccattgcccaggccggagagcaatggctcgatcacctctcactgcatcctctgcctcctgggttcaagccattctcctgcctcagcctcccgagtagctggggttacaggtgcctgccatgatgcccagctaatttctttgtacttttagtagagatgggatttcaccatgttggccaggctggtctcgaactcctgacctcaagtgatccacctgccttggcctcccaaaatgctgggattacaggcatgagccaccataactggcccagtcctgacattttaatttgaattcctactagtgtaattttctttcaagaaatatcttccatgtctctacttgagatttatttggggacacagttgacttataaacaacttgatctttctggtcttgttttttgatttggtctaattttccactcctgaatcaaggtgtttctgataactctattctttgccctgtgaagtcttgagttttttcagcatcattcagacgaatggacactcttcctggtacactgtgagcaacaggcactgtttcttacaattttttaaggattttttccccctggtctcaagtagtttcctaggacaaatatactgttcattattctgctaaataaatacccaatgagattctcagcttcattgttcgaactcagagaatctggggctctacctcagtttttggtagactctacctcagttttttttccttcaattgtcatggcctggaaactttgccaagtcagggggctggggtgtttgtaaggcttatttctcttgtttcctatcttacagggttcattgtcttcattacctgaaatccttgttcttgaaaatcgtggtattatgtattttgtcttttttggttttgttttaagtgagaaggtaaatcagtatctgctgctccatcgtggccagaagcagactgcagcagagcttcagtacatgacatagactagctagaatgcttttctaccccctttacttaacagcttccttctcacccttcatttctcagtgtagcccgctcttccccaggggaatcttcctgagcccagtatagatcaaatcctgtgtgatcatagaactgttttcttgcagcatctatctgaatttgtaatttcacttctttgtattttttcttcactacacctaaagctaaacaagagcagagttactgtttgttttatctgcagagctcagtagactgtgttcgccatggtaggaactcagtgcatatttgtttggtgtatggatgggtgaaggttaaaatgcacgggactttatatccaaaaactactcttatattttatttccaccttgtttccccccgatgcagattctgctagcctatcaaaaatccaggatgcagttatttcagaagaacacttactagaactcaaaaatagccactatgagcaacttacagtagaagttgaacaaatggaaaatatggttcatgtactacaaaaatagctatctgaggcaaaagaaacacaattacagttagctcctcagaaaggtgaatgtgagcaagaacgctacagttcgaggtatgacattctagttttagagaaatattttaactctttattctaaatatatatgtgagaattgtgattgctgactttctggggcttaatgggagaaaacgtcttggtcttatggagtctgaaaatcttggaaataatacaacaaattcttaactgtgcttcttttatttattgcatatgcttttaaattgtgattttaatggctatttagaagtttaccatatagaaatctcattatttaacaaacagaatttggggtttttgattcttttgtattagaattaatgctgcaagaaatactttttattattactattatcattattattatgattattattattagaattttgctctgtcactgaggctgcagtgcactggtgcaaacatagcttactacaactttgaacttttggggtcaagggatcctcttgcctcaaattcctaagcagctcagactgtaggcacatgctcccatgcctggctaacttttgaaatttttcattgagacaaggtctcactatcttgcccagtctgatctccaactcctgacctccaacagtcctcctgccttggcctcccaaagcattgggattacaggagtgagccatcacgcccagcccagaatatcttttatataaatcattttctgcatttctaattatttactttgtataaagtcttcaatatagaattttttggttaaaatatagaaactttttcaaaaaggccttggatcaatatttctaaattgtcctcaagaatatttgtattgaatgcatgctgagcttaatacctaggtgatgggttgataggtgcagcaaaccactgtggcacatgtttacctatgtaacaagcctgcacattctgcccatgtactctggaaattaaaattaaaattaaaaaaagaatatttgtattaatttacagttcaaccaacagagcatgaaatggccatttgtctcaaaccagaatactttttaaaaactttatacagttttattctttttttaactctctgtttaaattgatttatttttatttcaatagctttaggggtacaagtggtttttggttacatggatcaattttatagtggtgaagtctgggattttagtgtacccatcacccagtaggtagttttattgctcacttttcttctccccttccttcttctgagtctccaatgtcattataccactctacctgcctttacataacctagcatagctcccacttataaatgagaacatgtggtatttgtcgttccattcctgagttacttcacttagaataatggcctctagctccatccaatttgctggaaaaaacattatttcattcttctttatggctgagtagtattctgtggtgtgtgtgtgtgtgtgtgtgtatatatacgtatctatacatgtatgtatatgtagatgtatgtatataagtatatatatacacacatagatatatggactcacacacatatatgtgtatatatatcacattttctttatgccattcatcagtcaatggacactggttgattccatatattttcatgttgtaattgtgctgcagcaaacatatgtatgaaggtgtttttttgagagtacgatttcttttgtagatatccagaaatgagaatgctgggtacaatggtaggatctacttttagttctttgagagtctccacagattttgtactaacttgcattcccatcagcagtgtataactgttctcttttcaccacatccacaccaacgtctgttgtcttttgatttttaatagtggccattatggctgcagtgaggtgatatctcattgttgttttagtttacatttccctgatgattagtgatatttagtatgtttttatatgcttgttcagcatttgctcatcctcttttgagaaatgtctattcatgtcatgtgcacactttttaatggaatcatttgtatttttcctgctgatctgtttgagattcttgtaggttatggatattagtctttgacagattcataatttgcaaatatttttcccattctataggttgttggtttactcttatgattatcaatttgcggtgctgaagctgaagctttttagtttaattaggtcttatttatttattttcatttttgttgcatttgcttttagggtcttcatcataaattcttcacctaggtcaatgttttcaggtcttagttttaggcctttaatccatcttgaattaatttttgtatatgataagagatagagatccagtttcattcttctacatgtggctatctttttttcctagcgccatttattgaataatgtgtactttctccagtgtatgtttttgtatcctttctcagagatcatttggttgtaagtggctttatttctgaattgtctattctgtttcattgatctatgtatctacttttataccagtatggtgctgtttttgttactgtggctttagagcataatatgaagtcagataatgcgacgccaacatgtttgttccttttgcttggtacatctgttgttattcaggctcttttatggttctacataaatgtcaactttttttataattctgtgaagaatgacattggtactttcataggaattgtatcaaatctgtagactgctttgggtactatggtcatttttcacaatatcagttctttcagtccatgaacataggatgtattttcatttgtctgtgtcatctattattttcttcggtagtgttttccagttatccttatatagatcactcacctccttcattaagtatattcctaggtattttacacttttgcagccattgtaaaagagattgggttcttgatatgactctcagcttggttgtatttggtgtatagttgtgccactgattggtattcatttattttgtaacctctgagactttactgaatttatttatcaaatctaggagtgttttgtaagagtctttggggttttctaggtataagatcatatcattggtgaagagatagcttgacttcctcttttaaatttggatgccctttatttctcttgcccaattgctctgcctgggacttcccagttttattcttaatatgcatgaaataaaagtaaaatggaaaatgattcacgattagtttatttcacatctctgtctcataaacagataaaattaattcaccttgaattaattttgttatatgttaaatacatatattatatgtataataaaaacatgtaatatattatatgtataataaaaacatatatgttaaaaacaaaatattagaccctgtcttgttcaaaagaatgtctaagttgcttataaaatacataggaattaagaatataagttaaaaatgtttccaaaaaataaacatgaaaattatgggttaacacaggggttcccaatccccaggccaaggaccagtaccagtccctggtctgttagaaactgggccacacagcaggaggttagtggcaggtgagcaagtgaagcttcatctgtttgcagtccctctccatcactcacattaccgcctgagctcctcctcctgtcagatcagtggtggcactagattgtcataggagtgtgacctgaaccctgttgtaagttgctcatgcaggggatctaggttgttcactccttatgagaatctaatgccttatgatctgtcaccatctcctgtcacccccagatgagaccatacagtagcaggaaaacaagctcagggcccccagtgattcttctacattatggtgagttatagaattatttcattattaataatagtagaaataaagtgcagaataaatgtaatgtgcttgaataatcctggaagcatccccccacctcaggtctgtggaaaaattaccttccacaaaaccagtccctggtgccaacatggttggggacagctggcttaacagatgtgagacccctttgccttttcttggattaatctgcaagatatacattgtgtgaatgatatctgatgatgacaccttggcctgtaaatcattttagggataccttcagtatctcatgaaaattaaaatttcttctagtgaagaacaaaatgatacccggaagcaactttccaaggaacagaatgctagaatattacaagatgagattctgactactaaacagaagcagatagaagtggccgaaaaaaaaatgaattttgaggtattttctttagtcattttcaaatgcttttatataaaatgtatgtatttaaaaaaacaactatatatttcagaaagtataaaggatttttaaatcacatatatatgtatatatgtatatatcatttatcatgtgtctatatatgtacatataggataaagccatgttcttaattcaactccatttgcctgcaacagttgagtagtgacattcacaatggcctaaatccaaagaagcatttgatattttccataagaattgatgatctttccaatatcaaaaataagttttgctaacaacagattttccagtttttggacattagttcatcttttaaaaatattaatagagaagtcagtttattattttcactgctaagaaagtaggaaatgtatagttgggtcagaggccatattgtggatatcattatccttacttttgaggacagtaacagtttgctccaagtagtttctcatttcaatgcaaagagctttgaaaacaatgacatgcatgatatacattgagtgataatttattgataagtattttgttcccagagaaagagttcagtatattttcctctatttcacacttattactgtttcaaacattataaagaagaaataagttattgcaatggcaaataatctcatgatttctaagaaaagctctataagttgtatgctaccattcatattttgaaataaaaggcttcttttgtatttatatatttacaccacagaagtaactgtgattttgtggaggatcactagaagtagcatcagaagacctggagaaaatcctgcatcttgtgtatatacatatgtgtatatttgaatatatatgtatatattcaaaaatatgtatatatttttgagatggagtctcgcactgttgcctgggctggagtgcaatggcacgatcttgactcactgcaacctttgcctccctggttcactcgattctcctgcctcagactcccaagtagcttggattacaggtgcacaacaccatacctggctaattttttgtatttttagtagagacagggtttcactatgttggccaggctggtctcaaactcctgaccttgtgatctgcctgccttggcctcccaaagtgctggtattataggtgttagccactgcaatcagctgcatatatatttttttaacttcttttaagaattgtgatcttaaatgagttcagtgtcgtacatagaggtgcaatgtttagatgcagatgtgtacaatgtagaagggtacaatgtttagatttaacagttatgaataagtgtaattctcataactgactataacatattagaaaagtagaatattgataaaacattcttgagaaaaagtaacttaaagaattttgagaaattgcttctgccctaacatatgtatagctaaggctcctacaatgttatggtttataggtgagatatcagagtgtaaacccaatttaaaaaatatagtcaaatgtattaatcttatattttatgcctctgggttttttgtaattcagagaaatgcatttacaattctgagtttcttaaaaatcctccagtgatttaattttcataatctttaaataaatatttagatttgtggagtttacactctattaggtttgaagttttgtccaacttgtttttaggtaaatatccactatgggaattctttcattatacaaacatacaggttactttttaatttcagaagaaattatgatatgtccctctattgagtgctaactaaaatttccctttgtttactcagatttctcttagccataaggaagaaaaagaactcttgcatgaaaatagcatgatgcaggaagaaattgccatgctaagaatagaactagacacaataaaacatcagaaccagctaagggaaaagaaatatctggagtacattaaaagtgtgaaagaaaagaatgataatcttctaaaggctatacaattgaatgaggaagcactaacaaaagcagtagttcagtacagtggacagc

SEQ ID NO: 1210 - DNA, 70745 bp, Homo sapiens; identical to SEQ ID NO: 1209

SEQ ID NO: 1211 - DNA, 106207 bp, Homo sapiens
tgagactttaacatcagaaaaaggatggacttgttgcagttgctgtagcattcaaagtcaaggtaagaaccgtcgaggttgtctaattaaaacatttcttttatgtaagaaattttaacaaatttcagtgaaaatgtttttggtagttatgataaatattacagattttatgctctgtgtcttctccacacttttgttctgagcccttaaagccttgtaaatatcccttctagaaatagaagagcctcagatttatatactcaaaaataagagtaaatcatacctttataaagtgaaaaataaagtttggagtcctatttctattgctttctaaacaaatgaaacatgaagtctgaaaggatggacttctagttactctcttaaaatatactataagataattatttgtataaactgtattgaattactataccaggctccctatttctttgatttcactttaactggataagtaggagtgggcgggtggaggggtggaaaatatgtttcaaagtcacttaatcacctcactttcctccattcaactcgtttgatttagggtgaggggaaagagattttctagataacttttttatctctgttcaaataagagaaaaaaatcttctgggcacagctcttggaaagaattaacagctcaataaataatggtccccttcacccattcaggaaggtggcttccctgataagacagttatttttattgtgaaagtaaggtggggatgcagaaattctctcctctgaacaatctaagaagttaggaaatgctgttttcccttttatcctcctcagttccataggtacatgctagaaactgggtcacttggcctgcactggttttctataaccccttaaatatgaaaagctaaacagaaataagcagaggctggtaagattctgccctctacttcagcccaatcaaactgtgaagaactgacctgttctgttcagggaagagttgcaatgctgcatacaaatgcctgtggctctgtctataaacatattgtgtcctcaacatttatttatgtcaataatttggaactcagaaataatatgttcagagcaaaatatattaaacgcttctaaataaggcttaaaatgccacaatgaagtaaaaagtgtggtatttattcaaggctaaattgatattcaagttttgtaggtactttgtacttacttgatacatttttttttttttttttttgagaaggagtttcgctcttgttgcccaggctggagtgcaatggcgtgatttcagctcaccacaacctcagcctcctgggttcaagtgattctcctgcctgagcttccagagtagctgagattacaggcatgtaccaccacacccagctaattttgtatttttggcagaaatggggtttctctgtgttggtcaggctggtctcgaactcccaacctcaggtgatctgcccgcctcggcctcccaaagtgctgggattacaggcatgagtcactgctcccggcctacttgatacaatttaacctttctgagagatgagaaaccaagtgcccacatttcttatttttctggatgggtattttatctgaacataaaagagagaggtgtggaatagttgtcttggaaagtacgggaaataacagaaaaaagtaatgattattcgggtatgttctccagtggtacagaaggatgagaggatgagagagtttatttcaactagaggtaaatagggaaacattaaagtggtgtgatttggagccgcattacagccaagagatagggaaggacattccaggaatggaagacatatacatgaaggtagagagcttttctgttgggacagtggttccatacatctgcaagtgcttatggttgtattgggaaatgggactaaaaacttggattcatttaggctgtgaagaccctcaaataggaagtgtaagttttatttttgttgtaagagggatctttgaatgattccaagaatggacatgatatgcataggaaagaaagcaagctggaagacaggacaagtagaaattaatcaattgaaagaaacaaggcttgagtggtgagataatagtcttcaagccttcaagaatatttgtttagtataaagaaaaagaaaactctaaagctgaaggaagactatctgccttgcaagtcgttcaaaaagatttgcaattatagaattaattggtaaaaaataaatattttccaacttttaaattatgaagaaacagagatattcgtggaaaaagtggtgtaaatttattaaggggctgcttattaccttgagaccaccaaattattgatttttttcctcactttacctacaaaacacatacaaaaagtggaataattgaacttctcttagagatacataggtatgggtttctccattcatgagtgtatttatatacactcgcatatacataagtgataatatcttcagatattgatttttccatattcatgcattatccactaaatatgcatgatatatatttatggtttttatgcatttataatatagagaatcaataaatccttgttgagtaaattaatgcataaaatatgcagtagatcttcattattcacagattctatattagaaaatttgtctaaacactaaaatttgtttgtgacaccaaaattaatactgctgggcttttgtgatcattggcatgcatgagcagagtggtgaaaaatttgagttgctctgtttccagttgaagtggaacaaagtgaagctctgccttcctctctcagctcccatactataaacttcacagtgcatttatcgccacattgtttccatagttgtgctttgcgatgctgagtttactgttttaaatggacttcaagcatagccctgaagtgttgtcccgttgttcccacctcctagagggcctgacagaagaggtacatatgctatgtaagtttccctcaggcatgaactacagtgctattggccactaattcaatgttaatgaatcaacagtatatactaaggtgtctttaaacaaaaacatacataaaacattatgtattaagttatgtattgatccgttgattaaaatattgtgaccaaagccacacagtcacctaacactgtatctcttctaggaatgatggattaatatttgcaaattcagtgttcccagcaactttatggaacataattattgcaaaacgtgagaatcaattgtacatataacctatatcatacatattatataatcagtatcctattacaaatcggatgcttatatagataacattgatatttacatacttagatatttacatatctaaggtatctatatgagcagctacatagcaagtatctacatagcatgtatccacatatatatgctatatacataacatatacctatatctatgttatgtgtctgcttatatactttatatacataaatatgtgttatgcatatatgtatgaacaagaatacatctctaaaccttataaatattccactgttctatataaaagagtcaactgacgtaaaaagttgactcattttactggtctttaaaataggggcttaataactctgaaacttatgatttctcatatactttgacttcaaaacttcacttgtaggaatttatcctacagatatgaccacacagaaaatgacatataacatattaagaacattttctaatatgaaataattagatataagctaaatagttaacgatatagaactagttacatatattatgaacaacagaataccctgctaccataagcaaaatgaggacttttattaatataaagtatatacagaagataaaaaggtagagtgcagtaatactggtatgcttacatttatattaaaagagaaaatattatgtatttaattaaaaatgcatattaaggctgggcgcggtggttcacgcctgtaatcccagcactttgggaggccgaggcgggcggatcaggaggtcaggagatcgagaccatgctggctaacacggtgaaaccctgtctctactaaaaatacaaaacaattagccgggcgttgtggcacgcacctgcgcctgtggtcccagctactcaggaggctgaggcaggagaatggcgtgaacctgggaggcagagcttacagtgagccgagatcacgctactgccctccagcccgggagacagagcaagactccgtctcaaaaaaaaaaaataaaaaagcataccagatttctggataaggggacaaaggttataagcagaatcttgccttttcttttcttttctttttttttttttttgcatttttcaactacatgcatgtattttctcttgaaaaataagtggataaaccctaaatacagtaagatcatgatgatggtaaggtcaagcatggccagagtctctctgagagatacttggaatatattttgctcttttaaacaaatccaaactttatctgctttttgagccttgttccataggcatctcctctatgaaactgactgaggctatcctaatcattattatttacattatttttcaacccattttgagtatccactatgtgcaagtcatcatttggcactttataaacttataaggataacgtaaacataaatttcctttcataaatcttgtaatctggatatgtagaaaatataaaaattttaatttctataatttaaaattgttgttcatacaatctagtgtgtggttttatattatttacttgtttcaaatttctctctatgaaaattatttttctaagcaaattataatctctttaggctaggagtttgtctctgtctttcctcctctgtgtccagcattgacctagtcctgtggtcaggaaatagcaggccctgaatgaatattagagaatgattgattgattgatattgagcttgtggcttttcctatttttaaattgtatattgttaaagtaaaataaattatactttttcttttttaacaggtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaaggtagaatgggttttatattttcaaactaaaataagttaatggaaaatttttatgtatagaaaggccactaactgtcaaaaagaacattatatctcatattacaatttttccattgaagcgtacattaaaatattaacaaaataatccctatattgatttaaatcagtttttaatctgattgaagttatttctttgctagaattttttgatgaataaaggtttatttatttttaactttttaatttttaatttttgtgggtatgtagtaggtatgtatgtttatggggtacatgagatgatttggtacaggcatgcaatgtgaaataagcaaataatgaacaatgcggcatccatttcctcaagcattttttcattgagttgcacaccatccaattatactttattttaaaaggtacagttaagtaattgactatagtcaccctgtgggctatcaaatagtaggtcttattcattctttttaactattttttgtacccataaatcatccccatcttcctacccccacacccccatgaccctttccagcctctggtaaccatccttctactcactgtgtccatgaattcaattgttttgatgtttagatcccacaaataactgagaacatgcaatgtttgtctttctgtgcctggattatttcagttaacataatgatctccagttcattttgttgcaaatgactagatttcattctttctatagctgaatagtactccattgtgtatatgtcccacttttttttacgcattcatctgctgatgcacacttacattgcttccatatcttagttattgtaaacagtgctgcaacaaacatggaagtacagataatcttagatatacgaattcgctttcttttgggtatatacccagcagtgggattgctggatcacgtggtagctcaatttttagttccttgaggaacctccagactgttcttcatagtggtcctactaatttttattgctaccaacagtgtacaaggaattccttttactccacaacctcaccagcatttgttattgcctgtctttgggatataagccattttaactgggggtgagatagcatctcattgtagtattgatttgcatttctctgatgatcactgatgttgagcacttcttcctatgcctgtgtgctatttgtatgtcttcttttgagaaatgtatattcaaatattttgcctaccttttgatcggattattagatttggtcctatagaattgtttgatctacttagacattctggtgattaattccttgacagatgggtagtttacaaatattttctcctactctgtgggttgtctcttcactttgttgattgtatccttttctatgcagaaacattttaactagatgtgatcctgtttgtcaatttttctttggttgcctgtgtttctggggtaagaaatttgctcaagaaatttttgcccagatgaacgtcctggagagtttccccaatattttattgaggtagttttatgggttgaggtctttagatttaagtctttagttcattttgatttgtttttgtatatggctagaaataggggtctagtttcatcctagcaccatttattgaagtgactgtcttttccccattgaatgttcctggcacctttgtcaagaataagctcactgtaggtgtgtggatttgtttctgggttctctattctgattcattggtctatgtgtctgtttatatgccagtaccatgctgttttggttactataactctatagtataatttttttttgagatggagtctcgctctgtcacccaggctggagtgcagtggcatgatctcggctcactgcaagctccacctgctgggttcatgccattatcctgcctcagcctcctgagtagctgggactacaggcacccgccaccacacccagctaatttttttttttatttgtagtagagatgaggtttcaccatgttagccaggatggtctcgatctcctgacctcgtgatccgcctgcctcggcctccgaaagtgctgggattacagcttgagccaccgtgcctggccactctgtagtcactcttctagagtggcagtttggggatagcaccaggagatatcagctgtgatggcttggagaaacggtgtaaaccagcagtgtaaacaagagcagggcatgtatgagtagttgagaacggtgaataggagtatgactagacagaagatagtagggatgaaaagtttttttggggcacagtctaagttggtctggtgtctggaatgagactggggcctaataaaaaggagcgtctatacaggagcttaaatgggctgtaccttgtagcattctgaggacaggtctgacttctgagaagggaaagtggtaaaagtagtgtccagtcctttttaagttggtggctgagcttggtgaggtgtgtttttaatagactattagtttgtcactggatactaagagcctaaaaaaatgcttgactgatttgactaataagggctggtcttttatcagactgtatagaggtgggaaggctaaactgaggaattatgtctgacagaagggaagaaatgactgcagtggccttctcagaccctataggaaaggcctctacctatctagtgaaagtgtctacttagacaaagaggtattttagtttttgggactcggggtatgttgagtaaagctaatttgccagtcctgggtgggggcaaatcctcgagcttgttgtgtagggaaggggcctgaataatccttgaggagtagcagatggaatagcagatggaacactaagaagttatttccttgaggatagatttctacgatggaaaggaaatgaaaggttctaagaggcgggctagtggcttgtactatagcatagcctgcctttgctggtgtgtggtgattaggcctggtggaactgccatcaataaatcaagcgtgatcagggtgagaaacagggacgaaggaaatgtggggaaatgggatgaacatcaggtggatcagagagatgcagtcatgagggtcaggtgtggtgtctggaataatgtgggaggctggattgaagtccgggccaggaacaatggtaattgtgggacttaacaaagagtgagtacagctgaaggagccagggagcagaaagtatatgcgtcaggtatgaggaagaaaatagattttggaagttatgagaaatgtagagagtgagttgagcatagtttgtgattttgagggcctctaaaagtactaaagcagcggcagccgctgcacgcggacatgagggctaggctaaaacagtaaggtcaagttgtttggacagaaaggctacagggtgcggtcctggctcttgtgtaagaattctgaccacattaaccatgcctaggaaggaaaggagttgttgttttgtaagggattgaggtttgggagattaatcggacacgatcatcagggagagcatgtgtgtttttacgagaattatgccgagataggtaacagatgaggatgaaatttgcgcttgactgaagtaatggggtctgtctgtgaagccttgtggcagtgcagcccaggtaatttgctgagcctgatgggtgtcagggtcagtccaagtgaaagcgaagagaggcttggatgactggtgcaaaagaatagtaaagaaagcatgtttgagatccagaacagaataatggattgtggagggaggtattgaggatagtagagtatatgggtttggtaccatgaggtggataggcaaaataatttggttgataaggcatagatcctgagctaacttgtaaggcttgtctggttttaggacaggtaaaatgggggaattgtaaggagagtttataggctttaaaaggccatgctgtagcaggcgagtgataacaggctttaatcctttcaaagcatgctgtaatgggatattggcactgagcggggtaagggtgattaggttttaatgagatgataaggggtgcatgatcggtcaccaaggagggagtagaggtatcttatacttgtgggttaaggtgggggaatacaagaagaggatgcaaaggaggctttggattgggaagaagggcagcaatgagatgcggctgtagtccaggaatagtcagggaagcagataatttggttaaaatatctcggcctaataagggaactgggcaggtggggataactaaaaaagagtgcataaaagagtattgtctaagttggcaccagagttggggagttttaagaggtttagaagcctggctgtcaatacccacaacagttatggaggcaagggaaacaggcccttgaaaagaaggtaatgtggagtgggtagcctccatattgattaagaaggggacggacttaccctccactgtgagagttacctaaagctcggcgtccgtgatggtctatggggcttctgaggtgatcaggcagcatcagtcttcagccgctacgccaagaaggagtcagtcagagagccttgggccagagttccaggggctctgggagtggctgccaggtgagttgaacagtccgatttccactggggtcccacacagatgggacacggcttaggaggaatcctgggctgcgggcattacttggcctggtggtcagatttctggcacttgtagcaagctcctgggggaggaggttctggaggaatgcctggccactgaggttcaggcgtttggaagttcttgtgtgctggagatgtggctggggtttgtctcacagtggaggcaaggaattgcaactttgttttattactgtacaccttgaaagtgaggttaattaagtcctgttatggggtttgagggccagattccaatttttggagttttatttaatgtcaggagcagattgggtaataaaatgtatattgagaataagatggccttttgaccttttagggtctagggctgtaaagcatctcagggttgctgccgaatgagccatgaactgggctgggtttttatatttgatgaaaaagagcctaaacgcttctgatttgggataaagaaaaaggagcattaaccttgactatgcctttggctccagccacctttttaagagtaaattgctgggcaggtgggggaggggtagtcatggaacaaaactgtaagccggatcaggtgtgaggaggggaggcgataaaaagtttatagggtggaggagcagaggctgaggaagaattgggaactagctcggcctggcgaggaggggagaggtcagatgggtctgtagaaaaggaagattagaaagactcagcgacgcttggggttgggcctgaggggacaggcgggagggaaagaaggaagatttgggatgaattgcattgggcagagactaggaagggactgatgtgtaaaagaatgcctggacatcaggcacctcagaccatttgcccgttttacgacaagaattatttaggtcttgtaggatggaaaaattgaaagtgccgtttttctggcaatttgtaactactgtcgagtttgtactggggtcaagcggcattgcagaagaaaaaagacgcttagattttaggtcaggtgagagttgaagaggttttaagttcttaagaatacaggctaagggagaagaaggaggaatggaaggtggaagctagtccatagtgaaggaggcaagcccagagaaaagagtagagacacggagaagtgatgggggtttcttgccctccagaaaagcagagaaagggttggggcacggaaataagggattgggggttcttgccccctagaaaagcgggacttgccactaagggtgaaggagaaggggttgaggggtacttgcccctcccccagaaaagcagagaaggggtagagacatggagagaaggggttggggtacttgcccctcccccagaaaagcgggacttgcggctaagggtgaaggaccaaggcaggcatccctgcgtggtctgacacctttgaaatgtgggtgaataatcagagaggcatccctgcaatgattaaacaccaagggaaggctgccttcccagtccgtgaccggcaccggagttttgggtccacggataaaacatgtctcctttgtctctatccgaaaatgaaaggaattgaaattaagagaagggagagattgaagtgtggtgtcaagattgaaaggagaaagaggttgagggatagtgaaggaagttggagaagagagtaaaaagaggccgcttaccggatttgaaattggtgagatgtttcttgggctggtcggtctgaggacctgaggtcgtagatggatctttctcacggagcaaagagcaggaggacgggggattgatctcccaagggaggtcccccgatccaagtcacggcaccaaatttcatgtgtgtccatgtgaagagaccaccaaacaggctttgtgtgagcaataaagctgtttatttcacctggatgcggttgggctgagtccgaaaagagagtcagtgaagggagataagggtggggccgttttataggatttgggaaggtaaaggaaaattacagtcaaagggggttgttctctggtgggcaggggcgggggtcacaaggtgctcggtgggggagcttctgagccaggagaaggaaattcaaagggttagtcactcagttaaggtggggcaggaacaaatcacaatggtggaatgtcatcagttaaggcggggcagggcctttcacttcttttgtgattcttcagttacttcaggccatctcggcgtatacgtgcaagtcacaggggatgggatggcttggcttgggctcagagacctgacagtggcaatgtatggccacgttactgaatctacatgttgcaagagaaaaactagcaggtaagggaatggtcagttatttatttgtcttgtgctcagtaaatcggcactttacacaatataaggtgaacatagactagctacctgtggaaatatttaaccttttatctgtagctatctgcttaaggaagggcatctttttgcagaactcagcttttagcttaattttgtttcttatgtcatagtgaattggggtctcaagtttttattttcctttcatacccctgcctttttccttttaaaatcttttgaagaaagcattttagaagaaaattactccctggtcttgaattttgtctgatctcgcatggctgtgatgttttattcctagaccaatagatcccacgttattaggaatgctcatttttagcaggttgtgaaatcttatgtcctgcaaagaaaaaaataggaggaggaagagagacaaacacacagtagaaggaacaatcctggaaaactgatataggccatatcactctgaagtgtgttgtcagtaggcacatatgaaaatgtttcgtgtgtataaatcggtttctgttattttcttctgaagtttaagttgtctagtttgcatccccatggcttaagaaaatcacagcttaatatttagtaatttcaaattggacaatagggggaaaaggaaaatgaaaggaaaggagaaaagaaagaaaaaattgaaaacattatttggagacttgtagtcaggaaaaattttagactttatttcatattgtagaaaataataaaaactgataaaccttaggcaagactagaatcaaacaacaggtactataatttatagaagcataatttttctctcttcaattccccagttttattaaacagaaaatcatagtaggaccaatttattggtaaaataaattttagtacttttacacttggtttaattatttgtataaagtgcaacaagaataatcatttgccatataggagctctctctctttttgtgaattggctttgctggatctttttgcactacgaatgtaagattagacgtttgtgaatgcctgaagcctagccaaggatttatctgtgcctgcagatacatatgtgaattgggtgaattcttctctttctgaggtcttaagaaagcttggagttcctggaccagtcaaaaagtgacattctttacttaccacaggtcatgaccctgtaaaggataagatatggggctagtttttccaaggggcttctattggctctgtaggtcagcctccttttctcaaggcaatcggaaaatgtcattccagtcaaggacttagtaaaataacgagtgtctcgaattacgtcctgtgataaaagaaaatatattcttattaaacttatgcaaataattatattgccataaattgagaatactctcaaaatagttttcaaattttggagaaattaggttgagagaaaggaattatatttttaattttgctcataagaacaaattttagtgaatttactaaattcactttattaaattgttaaagctgtaaatagcttaaaaggaaagttttcttgactctgaaaaataaaaccaatcagcaaatgttttaaacaaaatcttatacaagattatttcagtcttctattagtttggtccatgcaattaactccatgttctgctcaatattggatcagcaagacttattaatacatgagctctccatgaaaggcctggacattttcctatctattccaatgatgctatatctaaatttatcaaaaacttattttttaggagtactcctcagagttcaatagcagattacaaactgtcctataaaaggattaaagtaaaacaacaattgtgaatgacaaaaatcttagaacagccatggttaaagacaccattgacaagtaaatttggtttcttctgtggcatacagcaattttccataataatcataattactactgacaacatctactaagacatattagaatcacaggaattgcatatatttttgaaacacataataataacacattcacataaatataatataatccaaagaaggttaaatgtcattgtttatttgacagtgcttcctgtgtgactttactataccaaataagtcaaatatgtctcttttggacttccggtgacctattattaataaatatatgaagtcaaagtactaattttacaatttaattttggaaagtctgtcaaatgtcagaagtttaaaatacttaatatgataatataggctcataggtcattgtaaaagaaatcattcatttagtcaaagtgataactcaaagtttttttaaaaaaggcaaaaatctttattttttgagagaggagacttaatttcccaaacaatgagccctaagagagactgcatgaggccaattaaatctgtctctcaaatcttataaacaaatctattaaattttaatcattttgaccataagctataatttccataaacctttaaataaccttttaatgtttttttaaattaaaaagtgggttaatgctataagaaccttgtttatctaacgcaggggtcctgatgctggtctttcatcaaactataatattaatgtgtaatttatatggaaactctgaactaagtttatctctcaaaattggcccttataatttcacagacgcatgtcttctgtgacagtccctgggattagaggggttcagcagttttaatttctggcactgtgtctcatgaatgcagtttattttgattatcatcttttcctgggtctgaagatgagggtttgactggtgttacggtttaagatttagcaggacttggtgtgctttttagacccagaagtaaaagccctttaatttaacagaataggctggccacggtggctcattcttgtaatccaggtactttgggaggccaaggcgggcagatcacttgaggtctggacttcaagaccagcctggccaacatggtgaaacccagactctattaataaatatacaaaaattagccagatgtggtggtgtgcgcctgtaatcccagctgctcagaaagctaagacaggagaattgcttggatttgggaggcagagattgcagtgagtcgagattgtggcactgcactccagcctgggtgacagagcaagactctgtctcaaaaaaaaaaaaaaaaaagaaagaaagaagaaaaaccatgaaaacttaatagaattaggactttaaaagcaacacagaaagtaaaatggacatgataaccttaatttttaaaatctgtaaatctcaatttttctaagcaaataaaaacttaataagaataacgaattattttgataaatgtaaaatctgttagacaagttaacaaaaagaataaaaaagatcttctatattatgtttgctttttcctatgaggagtacatttaaataacatgcaatcaaaactaatgtaaaccgtacttgaattagttagatatagaaagagtgtgttccgggtgataaatgaaaattcttggtttcatagaacaattaaagccaagagcacagagggttatgttagaagaaaacattttatttagacctttaaggtaaaactttttttttataatgtcaggccacaatagcagaacctgagggaaaaaaattacagaagctattgacaaagttgaaggagaaagttattatctcaatccttctcaaagggaagagaaagctgaaagcagtgggacacaataaaagttgaacttttgggttaaaaaattaaaatctcttgtaattttattaagagtgaatcaataccttaagaaaatgttgttctaaccaattctttagtgaattaattcttttttaatatcaagtctcaatctctggaatgactattataaataatttccctttaattatagcaaacttgatcacttttttttttactcataaatcctcttcttacaaaccttattacaatttatacaaatcatgtatgatatgcttggactttctgtgttatcctaaaggtacctctttcttaaataaccagtcattttagaaaaaaaaaattaatcacacaagattctttctcatataaaattattttcccttcagcttttcttaccaaaaatacctctttatacctacaactttctgtgtatctctcttatatactagtttctttcactttgtttcataaactttagcctttgtattagacaaaaattattttcctttaaataagaacatattttttagaaaaatgtctccctatatttttttaaattggaaataacccagatacttaatgtaacataactttagattataaatggtcatcatttaaagttatttgtctgttaatcatttttatagcctgtgatttcagatgtttacctaagaaccttaaggttaaataacttttttcttgttgttgttttgccaataactcaaaagttagctgttttattaagccaacaattttcaatgcattatttttacaaaaattacacaaagatgaccatgttttgggttataagctttataaccctcatgccaaatttggacaccttataatatttagcagggataaatattaaactgcttgatcaagaaatctaaacaataatgtgaattgacaattctaaagacatttctaattttattttaccagcaattaaaacacacttatttattaaggattttcttaagtcacatgaacttgaaaaagcatttgggcttttctgtcttctgtttttctgataaagtatttgatttaaatgcttttgtaaatccaattaattacagctcctttatatatttttagtagtgaaacgtacatgacacataaatacgtagacttattagtcatgaagataaaagtagatcttaaagattcatattttagatattttagacttccaatttagatatttcagacttccaatttcttttttttttctttttgagacagagtctcactccgttgcccgggctggagtgcagtggcatgatctcagttcactgcaatctgtatctcctgggttcaagcgattcttctgccgcagcctcccgagtagctgggactgcaggcacatgccaccatgccaatctaatttttgtatttttgtagagacagggtttaccatattggccaggctgctctcgaactcctgacctcatgatccgcccgccttggccttccaaagtgctgagattacaggtgtgagccacggtgcacaagctccaatttcttatgacctgtttaactagatagccctaaatttgcatactaaaggaacaactcttaggtgaaaatcagatagcaaaatttacatctcaaggtacagagagagagtggtgtgctagagggagattaaaaatggataccaagtcaaacatgaaattgtagaaatctaccttatgattgtatagaagaccaattttatttagataggtagttttaaatttagtctctatcttttaattggatctctgagctctttgcacaaagctccactgaatcctaggtctccaaaaggaaagagattcatgagactaggacatgtaatgcttttacggtgcacttggctacaaagacatttctctaagtgtctaaaccacacccttttgtatcttaaacacccatgaatagcacctgttgtaagaactattttagtaaaaaaaaaaaaaaaaaggtaacacaatacaaaaacaggcattaagaactgagaaacttgtctgattgcactcttggggttccataaggaaaaacagagatttctccccaaaaaggagtctgggaggaaacctgtattttcttaaggaatcccaggctgttagaaatgattttaggtccctcacacagtggagggtggcaagaagaaggaaagacatgtagaagtaaatgaatgaaacagtcaactgagctgtttcttctcagccaactgagaagaaaaaagaactttttctcaaaaaacaagatcctaggagagaaagaaagcataaaggcacacacacacatacacacacacacacacacactcacacacacatcttggatattagcttttaattaagctgatttttaaccatggaactaaatacatccttttaaatttcattaccatattttagctgtgacaaactgctgatatttcaaaagtaacacaactatcaacccagaaaagattggatttaggaaccaaacccaggctgtcatggtgaaaaaagggcagaatcttagctactgaactacagcatggggtaactaccattgctctgtcctcttggcttggctaggaataaatggccctgttatgtacataaaagcccctcaggtaattttttccttttgctggttgttttttaatttttctttccttttacagaggcaggaatttaatcaactcagtagcctttttccccataatttggaacttttctttggctttgaccatgttgagtagagttggtcaaacctaacgggaaaaagactgaaacaacaaaaacaaacaaacaaaaaccagttaagtcaaacaaacagacaattgtacaatttataggatcgctgagtgatctaatcgtacggagaaattaaggccagctagttgctaatcttaacttttagtaattaaggagaatttccaagacaaaaactacaattcagctactgcctaggaatggggcccaggctgaacactgctctctaccatcctagaagcagggaaaactcaaactcaccttccctgcgggaagtgggctgaaacttcagaaaggagttgttggtctccttcatcatcatggagcaggaaaactccccttctttgtttgaagcaagtgaaactccagaaaaggtgttgcacaacaaaataaatcttagatcttaaccaaattttgagagatcaggcattctctctgcagtgggagccccctgaccttggcaaaatgtgcaattggttttgttacaggaaaggggtcccaatccagaccacaagagagggttcttggatcttgctcaagaaggaattcagggcaagtccacagtgaaaagttaaagcaagtttattaagaaagtaaaggaataaaagaatagctattccatagagagagcagccccgagggctgctggttacccatttttatggttatttcttgatgatatgctaaacaaggggtggattattcatgcctcccctttgtagaccgtatagggtaacttgctgatgtggccatggcatttataaactgtcatggcgctggtgggagtgtagcagtgaggatgaccagaagtcactctgtggccatttggttttggtgggttttggccagctcctttactgcaacctgttttatcagcaaggtctttgtgacctatattttgtgctgaacttctgtctcatcctgtgacttagaatgccttaattgtcggggactgcagcccagtaggtttcagcctcattttatccagcctctattcaagatggagttgctctggttcacatgcctctgacagtgtgagcaatgaagatagctcaagcttgcacctggcgcccgtaagagccttgtgaaaggttagggccatctccactaagagtccttcccttggtcaccaatttacaaatttgtaaatcaaaaggtatgagagataggtcttaatcaatttagaagtttattttgcaaaggttaaggatgcatgggggagacaggcctgtgcctttctcaaaagattattttgagggcttcaatatttaaaggggaaaaataggttgaaggggaaggagaggtgagggtatgttcacaattctgaatccacaggttgccagagaaaaatgagcaggtaggtaaatagtcaagtatgtatgcatcttgcacttagtaaactgacactttaaacaagataaagtgaacatagagtacctactcctggagatatttaacctttatacctgtagctacctgcttaggaacaaaagaaaaagccgcttttggtgactcagcttcattttgtttcttttggcatagtaaattggggtcccaagtatttatttcctttcacagaattcacttgcaataatgttaaacaaggttccttttaactttgtccagggaacatagagtttgtttgttttctgagctatctggtaaagtctattgtgatgaaatatttgaataatatttcagcagaatggcaatcataaggaaaaagtattggctaatgcaagtgaattatcttctattgtctaagggtaatattaggcttaattatttttacttttaaatactgagtgttacagtgatttcactttcatgtgcatagcaaagtgacaacaaactggtggaagaaataagatttccagaataatcccttaaagcatatttggaatagaagctaggagttaggaagatagcagtgtatgtaaggcacattacctgcagtccaataaagaagccaggccgggcgcggtggctcacacctgtaatcccagcactttgggaggccgaggctggcagatcacgaggttaggagttcgagaccagcctggccagtatgatgaaaccctgtctctactaaaaatacacaaattatccgggcgtggtggcacgcgcctgtagttccagctacttaggaggctgaggcagaagagtcacttgtgcctgggaggcagaggttgaagtgagccgagatcccaccactccactccaggctgggtgacagagcgagacgccatatcaaaaaaaaaaaaaaaaaaaaaagccaggggaaaatgtttgaataaggttaacatcatcgaaaccattgctaaattgattaatcatatctacaagtgatgtttaaaggaatcttttcactaagttaaattgttaacattgaaagaatattaacctcaacaatcgcattacaacaattttgtaaagacttgtgtgtctgcagttgaatttagttgcatttctgtgcctactttgtattcatgaggaacaaaaatgtaatgcgataaaatttttaaattatcagtattttaattttttatgaagtttgggacatcaaactatcaacaaagtactgtttcagtaaaaataattaccaaaaatcttattaattttgaaatcttgtgaattaggagtatgcgcacatacagacagagataattaaaacaatggtaaaaatagatctaattcagcaacataaaaagagatggtgagagaaacaataatagtggctaacatttgttgagcacttactatatatgagatattgcgctagtgttttgtttgcgttaatagattttcttccttaccacagttccatcaaccagatgttattatctccctttgcagatgaaaaaaacctaggtatggaaaaggcaaatgaatttccctagttctcccagctcgtgaaagatggagccaaggtctgaattcaggcagtctgattccaaattccatgctctcaactctgtttcacattgctaaagtaactgtggacttttgtgctattagtacctttaagcggtgtggcctatttaatgatataccttattccatattattcagtatcaaacaaccatgggacttggtttacgtgcatgtgcgcacactaatacacgttgttactgagttgcatatacagactcagtggatggaaatgtataaaagcccaagtagattacaaacccatttaaataaaacgacacactttgattattttctaccattatttgattattttccctcagttttttgtattgaaccaactgtgttacacagaatctgccagtgtatacttcttcattacacttgtcttttctgctcttcaaattacctgtacccctatattgtaatgaaaatctttaacaacaaaaaagtaatgattattaaaaaaaaaatagagcaaaagaaaaagtctcccctttctgccttcattgtcactccctttctggaataatcactccacatatgtaactgccaccaagatccatatcccacaggttttattctgggtctcttttctccggccatggtggcctttttgctgtttctcaaacatgccaagcacacttctgacttggggaattttgcatttccttgttcctcttctaaaacgttcttcttccagatgtcttgtactttcatgtcattcagatctctgtttaaagatttctttactcctgaacaccccatataaaatagcattccctatccataactctttaaccagcttgattttcatagtatttatcaccagctgacactaagaccccaaaacgcacctgtgtagaagtgcgtgtttgcgcacgtgtgtttaatggcataaaacaaacaaaaaaaattatcttagagatctaaaatccagaaatcagaaataagtgtcagtgaactaaactcagggggttggcaagaccatgtttctttctgaaaattctagggacaatacacttctttgttttctccagtttctagaggctgtctgaattccttggctcatggcccttttccgtgttcaaagctagtgaagtccacgtcacatggatgcttctttcacatttaaaggagccttgtgattacaatggattcactaggccaggtcaagtcaatctctttgttttaagtcatctgtttagcaaccttaattccatgtgcaattttaatatctccttgccatgttacctaacatatttacaagttctggagattaggacctggatgtctttaagggtcattactctacctaaggttatattatatataacattacatctatatattctccatatatatgaagaatacatatatatagtttatatatgtttactatatatacacacatatatagtttgatatataaatatatacacacatatacacagatatatacatatgtttactatgtatgtatatacatatatagtttatatatgtatattgtacacatatgtttactatatatacatgaatatatacatatattgcatatatacactatatatagtatataaaatagagtatgtaaactattatatacacacaaactgtgtgtgtgcatatatacatacactttatggtatagagagagatgataaattacatgtatattacatatatttacatatgtaatttatttatgtaatatgtattacatatatgtagtttatcatctatctctctatttcataaagtgtgtgtgtatatatctatatatgcacacacacagtttgtgtttaaataagtttatatactctatatactatatatagtgtatgtatacaatatatatattcatgtatatatagtaaacatgtgtacacatacatatgtacacatatacatatataagctgtatatgtatatacatacatagtaaacatatatgtctatgtgtggatatgtgtatatgtattatatttatatatgtatttatatattatatgtgtgcatatataaaaatataaatatatataaatatatacacatatataatatataaatgcatacatagatataatacatacatacacatataaaatatatgtatttatatatcaaactatgtatgtatatagtaaacatatataaactatatatgtattcatatacatggagaaagtgtgtatatatagtaaacatatatataacctgtatacatagtcttcatatacatggagaatatatatatataattatatataggttgtatatatacatatatatgttgtaagctatatatgtagtcttcatatacgtggagactatatatatatataattatatataggttatatataatataacctttggtagagtaacaggttatatataatataaccttaggtagggtaatgattatatatgtatatatattataatatatattatgatatgtaacatatgtatttatcctatatttatatataatatatatgtaatttatttagcatctatctctctgtaccataaattaagctccatgaaaacataggtgtttgattcactgttctctctggcaaacatcagtgctcagtgtgtataagctgaatgactgatgcaagaggtgggtccctcagtcttgggcagctccactcctgtggctttgcagggaacaaccctcctcccagctgctttcatcagctggcattgggtatctgtggcttttccatgtgcacagtgcaatccacagtgtcagtggatctaccattctgggatctggaggatcgtagccctcttctcacagctccactaggcagtgccccagtggggacagtttgtgggagctctcgccccacatttcccttctgactgccatactgaaatttctccatgagggcttcacccttgaagcacacctctgcctgacatccaagcatttctatacatcctctgaaatctaggtggaggttcccaaacttcacttcttgacttctgtgcacctgtaagctcaacaccatgtggaagctgccaaggcatggggcttttaccttctgaagccacagtccaagctgtaccttggccccttttagccatggctggagtggctggaatgcagggcaccaagtcatgagactgcacacagcaggggggccctggaccaggctcaggaaaccatttttcccttctagacctccagacccgtgatgggcgtggctgctcccaaggtctctgatgtgccctggagtcattttccgcattgtcttggcaattaacatttgtctcctcattacttactcaaatttctgctgcctgcttgaatatccccccagaaaatgggtttttctttcctactgcattgccaggctgcaaatctttcacacttttatgttctgcttcctcttgtacactttgctgcttagaaatatcttccaccagataccctaaatcatctctctcaagttcaaagttccacagatctctagggcagaggcaaaattctgccagtctctttgctacagaataacaagaatcacatttgctctagttcccaaaaagtttctcatctttatctgataccacttcagcctggactttattgtccatatcagtatcagtgttttgataaaagccattcaacaagtctcttggaagtaccaaactttcccacatcttcctgtcttctgagccctccaattctctaggaagttcaaactttcccacattttcttgtcttcttctgagtcctccaaactgttccaacttctgcccattacccagttccaaagctgcttccccattatcaggtatcctgtagcaatgcccctcagtaccaatttactgtattattccattctcctgctgctaggaagaaacactgaagactgggtaatttataaagaaaaagaagtttaatggactcacaatttcaaatggcaagggaggcctcacaatcatggtgaaacgcagaggagcaaaggtacatcttacatggcagcaggcagaagagtgtgtacaggagaactgcactttataaaataatcagatcttgtgagacttattcactatcacaagagcagcataggaaaaacccatccccatgataaagttagctcccactgggtcccttccatgacacatggggattatgggagctacaatttaagatgagatttcagtggggacgcagccaaaacatatcactattataaatatcatcttttcaaattaagtttatgtgatagattacatgaattgattttcatacattgaaccagccatgcatacctggaataaatcccatttgatcatggtatttaattattttatgtttcgtgtattattgaatttttttactaatatttgttgaggatttttacatctatgttcatgagtgatattggtctacatttttttgttattgtaatatcttggattttagtatcagggtaatgctggcctcatggaataagatagaaagtattcctgatgcttttatcctgtgaagaaggttgtatacaattagtataacatgtttcttaaatgtttggtataattcaccagtgaaactatctgggcctcattctttctgttttttgttttgttttgtttttttgagatggagtctcgctctgttatccaggctggagtgcagtggtgctgtctcagctcactgcaacctctgcctccctggttcatgccattctcctgcctcagcctcctgagtagctgggactacaggcacccaccaccacgcctggctaattttttgtatttttactagagatggggtttcactgtgttagccaggatggtctcgatctcctgacctcgggatccgcctaccttggcctcccaaagtgctgggattacaggcgtgagccactgtgctaggcccattctttctgtttttgaaggttattacttgacaatctaatttcttaaacagataaaggcctaattcagatcatcagttttttcttgtaggagtttgagtagattgtttattttgggaaattggtcgatttaatttaggttattataattgcaggtatagttttttcatagtatttcattattatctttttaatgtctgtgggatttgtagtggtatcccctctgttatttttgatattggtaattagtattcactctctttttttttcccttagttaacctggttagaagcctataaattttatggatctttctaaagaacaagtctttggttgtgtatattttctctattgaattcctgtttttaatgtcattgacttatgttttaatttttattattaactttcttcttcttgctttgaatttcatttgctgtttttttccaagtttcctaaggtagaaacttaaatactgattttaaatgtttcctcttttctcatatatgtattcagtgtaataaattttcctctaagcattgcttttgctacctcccacaaactttgatgaattgtgtttttatttttatttagtcaaaatatttaaaaacttatcttgagatttcctttgacctaaatgttacttaaaaatgtgttacttagtctctacatatttggggatttttccagttatttctgttattgattctactttaattctattgttgtctgagaacaaatgctatcacttctttttgaaaataaattggataagatatattttatggcttagaatgtggtctttcttggtgaatgttccatgtgagcttaagaatgtctattctactgttgttggatgtaatacatgaagttgtaaagtaatatatagatgttaattatatccagttgattaatggtgttattaaggtcaagtattttctatctgtttctgcctgctggatttgttcccttcccacagaggagtattgatgtctccaactatgatagtgtattcatctatttctccttgcagttctaccagtttttacttcatagaatttgatgctctgttgttgggtgcatatatgttaaggagtattatatcttttttgagaactgatgtccttattattctgtaatgccccctcccacctttttttttaaatcaatttccttttgcttttctttttttttaaattttattattattatactttaagttttagggtacatgtgcacaacatgcaggtttgttacatttgtatacctttttttaacctctggtaactttccttgctttgaagtttgctgtgtctaaaattaatatagctattcctgatttcttttgattattgttagcatagaatatttttctccatccatttacttttattctatatgtgtttttatatttaaagtgggtgtcatgcacacaacatgtagttggccttgttacttgatttactgtcaccttctatcttttagttggtgcatttagataattgatgttaaagttcattattaatatacagtcatggaacattaaatgacaggaatgcattctgagaagtgcactgtcatacaaattttttaattttgcaaacatcatagactgtacttacacaagcctagatagattagcctgctagacacctaggctatatgttatagcctattgctttgaggctacaaacctttacagcctgttattgtactaaatactgcaggaattgtaacacaataagtatttttgtatctaagcatagaaaaagtacagtaaaatatggtgttataatctaatgggaccactatcatatatgcagtccactggtaactaaaatgtcatcatgtggtacatgattgtagttgaattaatatctaccatacttcttactgtatttctgtcttgttcttctttgtttctatatttgtattccactctttttgtgctttttgtggtttcaaatgagcattttatataataccattaattttttttctcctttcttagcatatttgttatatttcttctttgacttatatagtagttgccctggtgcttgtaagatatatttacaactatttcaagtttactttcaaattacaccatactgcttcatgggtagtgtaacttgcaaaacaaattatttttattcttctctcccgtttattgcatcattgtgtcattctttttattttagtgtaagcatacataatcaaatacattatagatattattattttgaataactgttatttcttagatcaattaagaattaaaaaaaactttttaatttaccttcacttattttctgcagtgtctctctgtttttatgaagttttgagcttctgatctatattattttctctttctctaaaaaactgctcttaacatcttgcaaggcaactctgacgagaaattcctttaatttttgtttatctgagaaatccttatttttctttcatgttagaagataattgcacaggtttcataattttaggttgttgttttctatcaatgctttacatatttttattccactctttctgtgctggcatggtttctgagaagtcaaatgcaattcttatctttgttcctatataggtaaggataggtattttattttccctctggtttcttttgggacttttttccccttgtctttgattttgtgtagtttgaaaatgatattcctaggtggactctttaaagcatttattctgcttgtttttctatgaacttccaagatctgtggtatgttgtctgacataaatttggggaaattctcagttattattgtttcaaatatttattctgtttcatattctatttttggggtgtccctattatgtgcatgttgctacttttgtagttatcccttagcttttgggtattttcttctgatatttttctgtctttgttcattttgctttttacttctgcagattttaattggtatattctgaagctcatatagccttttctcaggtatgccaagtatactaatatgcttgtcaaaggaattacttatttctgctacaatattttgatctctagcatttgtttttggttctttcttagaatttttatctcggcttaaattgctcatctgttcttgcatactgtctcttttacttttatagcccttagcatgttgctcatagtcattttaaattcccagtctgataattccaacatctctgccatatgtgagtttggtcctgattcttgctctgtctcttctaattgtgttatttgccttttaggtgacttgtaatatctccttgatagcaagggaggatgtattggataaaaacctgctatacatgtgccttcaataatgtgttggtaaggcacagtccggagaagaggcatcctacagttccaagcttaggtatcagtctttgaatgaacctctgactctggaccataaatttcacaaatgcttctcaatttttttttttttttttttgagatggagtctcactctgttgcccaggctggaatgcagtggtgtgatcttagctcactacagcctctccctccctggttcaagcaattctctgcctcagcctcccagtagctgagattacaggcactcaacaccacacccagctaatttttttgtattttttagtagagacggggtttcaccatcttggccaggctggtcttgaactcctgacctcacaatccaccagcttcatcttcccaaagtgtcaatttttaaaaaaatgtttttctccctaggcaggataggatggctagagtgggctgtaattgaatatttctctctgtaatatggtaggctagaactggctgaagttgggtatttcctttacctcaggtcagttaagcttagataacaccagagcttatgaggctccaattaattagtttttcctgagggcaagtctcataatccctattaaaaacaaagtgctctggcctatttcaaaatgattcctttctctttcactctgctagaatgagaagatttttctccaacatttactataagatccaggtcgagctcctgaagagaaaatcatcaaaaaagggggtccttgaattggtccccctggagttattagccctcagacttgtccaacctgaggctctagcaattcaattatagtacatttttttttcttttttaccctagcactatttcctttctggtttttgttatgagtttctgctccaggaagctgttactccttatatttactttgtctctccatctccaatcttggagacagtggtttgccacatgtcctcatctcttttatggatccaagaatcattgctttttcagtcggtttagtgttttacttgatgttagaaaaaaatggcgccctccaactttcttttctgcaaaagtagcacccagaagtcccagtatattttttaaaattgtattcacttatctcatgtcttatcagtcctaaacttgtacttaaaattccactataatttcttaattaatacacaagttatttaaaataagatttgccccaaatatgtagggattcttatttaaaaatgttttctaccattgcctgccataattgcactgtggcagatattgtctgtacgatacctactttttgcaacctgttgagttctctttttcttttcaacttttattttaggttcagggggtacatatgcaggtttgttacataggtaaattgtgtgtcatgggagtttggtgtacagattatttcagcactcagataataatcatagttaccaacaggtacttttttagatttcaccctcctcctaccctccaccctcaagtaggcctcagcatctattgttcacctgtttgtgtccatgtgtactgttgggatttttttatgtccgaatatatcatcagtttttgtaattctccctcatgtacttgagaaaaatgcatattctttgaattgttggatgtagttttttttttttttttttgagacagagtctcactctttcacccaggctagagtgcagtggagcaatctcggctcactgcagcctctgtcgcccagtttcaagtgaggttcaagtgattttcctgcctcagcctcctgagtagctgggattacaggcacatgccactgtgcctggctaatttttgtatttttagtagagactgggtttcaccgtattggtcaggctggtcttgaactcctgacctcgtgatccacctgccttggcctcacaaagtgctgggattacaggcatgagccaccatgcccaaccagatgtagaattttatatgaattttatatgtatcttagaggtcagtcttgttaattgtgttattcaggtcttttatgttcttgctaatattttgactacttgacctatcataattgagaaacaaagatatgttgaaatttcctctagtgacaataattctactgacttttgtttatatattttatacctattaaatccattgttttataatcattgtatcttttaggttgatatatcaatatgtagaaacctctatccataatgatgtttatgtaaatctatttgggctattatttatacagctacaagtttttttttaattgcttcttattcttttaccatcatcaacacttcctcatgaattaggaatacctgttatcaagatcgcatatttagatttttcaaaaaatagccaaactgaaaaatctctgcctttaaactagcaattttgtccacttacgtttattgtattttatatagtcagacttgtttctactatcttagaatattatgccaatttactcccttccctgttgccttttaatgttttcttatactttttgaattgatatatttatctctcttacaacaaggcaaatactgtagcatattgctatggtctgaatatttgtactgtctctgatccaaaggtaaagacttcgagaagtgattaggtcatgaaagcagacccctcatgaatgggcttagtgtttttataaaagagaccccagagagctattttgcccttcccactgtgagattactgtaagaagatggccctcttcctgctgctgtcctgatctcagacttttcaacctctggaactgtgacaagtaaatttctgttgtttataaggtactcagttttgttgtatgctatattttgctatatttttaatagaagccccaaacatactaaaatacatgttctcatgttctttgatacgcctctttaacctttatactctctgatactatctcgattttccatctaaaattttaaattttagatattatatctattttctttccttttctatttttggtctcattttttaaaagacaattacaaaattatcaagtgttttattcaccttgttttacaaatctcacacaatatcttcagtatttgattcttgttttattgaagtatatcttccgaatttgatttcagtgtgtatctttacatgccacacttttgagaccttatatgctcaataatatatttccttatagttgaatgactacatggctaaatataaaattacagttttaatgttctcttacctcaatacttcaaaagtattattcatccacggggctcatgcctataatcccagcactttgggaggctgacgtgggtggatcacaagatcaggagattgagaccatcctggctaacatggtgaaaccccgtctctactaaaaatacaaaaaaattagctgggtgtggtggtgggcacctatagtcccagctactcaggaggctgaggcaggagaatggcatgaaccctggaggcggagcttgcagtgagctgagattgtgtcactgcactccagcctgggcaacagagtgagactctgtctcaaaaaaaaaaaaaagtactattaatcttttgtacatccacacttactgtttaaaattgatatgctttcttttctgaaagacttcaaatttttttcttgtcattgatattcttatctaaactttctccatatatatgtgtgtccctatgtcttttgctgggtgttcaacaggcactctcaatctgaggttttcacatttttgttgaatattggaaaatgtgcatttattttattttttaaattttctcctcttcaacttattatactccttttaaggaattcattattaagttattgttaattttaattaaaatctttgtacactttaaacatatatatatagtatataagttgtgtgtatatatatgtgtgtgtgtgtatatatacaccttaaactttgtataccttaaacttaaagatatttatatatacataagtgtaagttatataaagataccttacatatatatatgtatgtatttccaaatttttaaataaaatttctggccaggcgcagtggctcctccgtgtaatcccagcactttggaaggctgaggtgggcgaatcacttgaggttgggagttcaggaccagcctggccaaggttgtgaaaccccctctctactaaaatacaaaaattagccaggcatggtggcatatacccctgtagtaccagttacctgggaagctgagacaggaggatcacttgaacctaggaggcagtggttgcagtgagccgagatcacaccattgcactccagcctggttgacagagcaagcatctgtctcaaagaaaaaaaaaattccatcttgcattaattgataacccccaaatcattcaggagcagattgtttattttccatgtatttgtgtagttttaggagttccttctggagttgatttctagttttattccactgtggtctgaaaaaaatagttgatatgatttcaattaaaaaaaattattcggccaggtgtggtagctcatgcctgtaatcccagcactttgggaggccaaggtgggcgaatcatctgaggccaggaattcaagaccagcctggccaacatggtgaaaccacatctctattaaaaatacaaaaattagccaggtgtggtggtgcatgcctgtaatctcagctactcgggaggctgaggcaggagaattgcttgaacccgggaggcagaagttgcagtgagccaagattgtgtcactgcactccagtccatgtgacagagcaagactgtctcaaaaaaaaaaaaaaaaaaaagcaccagttctatccctctaagtttcagagatggattcattgctaaccaaggtgatggaagccattttattatccagcaagacttagactatgtcattgagctcaccgggctgattgtgaccctatgtacaaggtagccacatgggagaagcagatctacacatactgttaagatggtcttgtatgattctaccagctttctgacctctgacctcttggaaagagcagccccagttagtgaaaaggtttgaccctgatcaacaatgagtagaaacatcatcagtccttaatgtcttgggcgccccttggaaatcacagaaagtcagctgtcctggctatatgggactctcatcccaagacctactttgaactgagtaagaagctcacctgtgactaccgcatttgtctcaacttctccttgtgtaaactcaccccagcaacacagggcaaggatatagatgcttcagtttgttcttttgtgttaaatgtttacaaggacctcagaactaaagcctgttctctggaggaaataaagaaaatatgtttggaggtgcctgaatatgaaaaaaaaaattgagatttgtgatgtatcatatgatctatatttgagaatgttccatgtgttgatgacaagaatgtatattctgcagttcttgggtagaatgttctgtaatatctgttaggctcatttgttctagagtgtagtttaagtacattgtttttgttgactttctctctagatcatctgtctagtgcggtcagtgaagtttttaagttctccactataattgtgttgctgtctactgatttcttaggtctagtagtaattgttttatgaatctgggagctccattgttaggtgcataaaaatttaatctctttttgttggattgatttcttctatcattatataatcatcttccttgtctttttttttttttaactgttgttccattctgtggaaatcgaaatcaaaaagtgagcaggagctattcttacatcagataaaacagactttaaagcaacaacagttacacatatttatttcacatattccaattttttttcattttcatagcttacttcctttggtaacattcactatattttcatttactatgacattgttttcctttatatcaaagagaatagttagaatagttctttcaaaattctggtcagtgattccaacatatgtgccatctatgggttggtttttgttgattgtcatttctcatgagaatatctcacattttcctggaccttcacatgtggataattttgaacattgttatattcttccaaagagtgttattctttagttagttagttagtttctttgttttataaggtatttaacttcgttgacttggaattgcaaactatgtgttggtgttttaatcagctcaggtgctaaaacaaaaaccatcaacatatatatttgaaggatatgcaaacattcagtccttaacagatggtaataaaaacaatgacaatgagtgagtttgcccagaaaaagtatatgaagtaaaaagaggagagtgtctgaaacaaatccctggaagaacaggggataaccagaataacataatccatggatacttgtgaggaatgatgcaaaaaacaggatttgagtcatgcaggtgtagtcaagtctaagcttctactggaaaggacacaagggagagttatgggaaagagaaggttcagtggggcaggggagttattttttaaaataaaataaactgtagaagcttagaactgtcttctgactgttaagtccagaaattttaccgtattacactaatgaacagcttgccgtgactgcaggtagatagagactttacctcttatctcgatgccagttgtctcttcctgccagtgacacattaaaatctctctgacaattatgtacatttgtatctctgttttgtttttatttgaatgaacttaaagcagagagctggaggttggtagttcacaattttaataaaaatagaaatttatcaagcttactgtgaagctagcacttcatgttcctggaggtatttagaaagcctcgcatatgcccagggtagtagactcacttgtaaaacacctgagaagaccataagcttttacctaaggctgatcctcaggctcagcccaaggcttaccaaaggtggaagaattaaaaaaaaaatagctaaaataaaaatttataagaaaagagttatggactgaatatttgtgccttccttgccaattacatattgaaaccctgagcccaaggtgttggtatttgaggcctttggcaggtaaatagatcatgagagaggaacccttcatgatgggatttgtgcccttagataatgtgagaaagccaactaaatttttccctccctgtgagggtacgagtagaagctagctgtcttcaacctaaaagagggccttcaccagaattcaactgtgttggccccttgatctcagacaacccagctttcagaattatgaaatatacatgtttatttctcaacccatttagtctatagtaatttattatagcagcctgaactaaaaccaaagttcagtggcaaccttaagcaggcagaatacagaatcatcgaattttaagataggccaattgaaaatttcagtctgagaagcagaaaatatatatatatatatgaagaaaagtgaacaaaacctaaggacctgtcatataccatcaggtgaaccaggatacaaattacagggatttcagaaggagaatagagagagaaaagggaaaaaagaatatttgaaaaatgggctggctgagaacaccacaaatttgatgaaagacataaatctcaatagcctagaagcttaaggaactccaagtaaaaaaactgaaagaaattcactttgagatattttgtaatcaaaccattaaaagtcaaaataataataataatacagaatcttggaagcagctagaatgggaatcatcatgtacaagtgctgtcccataggattaataactaatttcttgtcagaaactatggagactagtgaatgatatatttaataaggggctgatattcaaaatctacaaagaacactaaaactcaatgataagaaaacagccaattataaaatgggaaaaagatctgaacagataccttactgatgggcatatacagatggtaaacaactatatgaaaacatgttcaacataatatgtcaatagtgaattgccaattcaaacaatgagctttcattacatacttattagagtgagtaacattccaaacacaaaaaatgccaaatgctggcaaatatgaggagcaaccagaattctcatttattgctggtaggaatgcaaaatggtagagccactttgtaaaacaatctgatagtttcttatgaatctaaagacaggcttactgtacaatcctgcagtcatagaccttagtatttacccaaatgacttgaaaacttatatccacataaaagcctgcacacaagtgttatagcagctttattcatgattgtcatgacttaaaagcaaccaagatatctttcaataggtgaataggtaaagaaactgtgatacagtcaaacaatgtaattttttttagtgattaaaaagaaatggaacatcaagtcataaaaatacatggaaagacatccaaaacataactgtaagcaaagaagcaaatcttaaaatgttatatattgtaagatttcaaatatatgagattctggagaagaaaaatctaaagaaaggaatgtgttcagtagttgccaagtgtttgaggaagagaggaagaaagaaagaaacagtgcagaggatttttaggtaagggagactattctttatgatacagtaatgaagaagacctatcaatatacatttatcagaatcgatagactgtaaaacacaccaagtgaaccctaatgtaataatgcatccaaattggttcatcagtgtaaacaaatgtaccacaccaatagaaggtaaacataatagtaggggaaactgtgtgtggatagagggaatatgtggaagctctctgtaatttatggtcaaattttttttttgtgaatctaaattgctctaaaaaataaagtctattaagtatattaaaaaatttttcaagaaaatactagccaattaattccaacagcacatttaaaagattgtacaccataacaaaaatggattcatcctggaaatttaagcatgattaaatacatgaaactcaaaggaatgcaatatattaagcaaagaaaaaagccacatgaccatcttactagatgcatttgacacaaatccaacaccctttctcaacacaaacacccagaaaactagtaatataagggacctctctcaacatgataagggcatttatgaaaaatcttcagctggcatcatatttgatattgaaagactgaaagttttgtccctgtaattaaaaacaatacaagaatattcatttttactaatgctattcaagattgttctagaagttctagccagatccattagacaagaaaaagaaacaaaaggcattcaaattagaaagaaggaaaactgtctttatttacagataacataattatatgtaaagagaagcccaaagaatccacaagaaatctactagagctaataaataaagaaaaattacatagtagaaaatcacacacacacacacacacacacacacacacacatattacttgtgtttctgtacaccgggaataagcattgaaaaataattaaaggagtaaatccatttatcatagcatctcaaaaatatatataggaacaaatttaaacaaaaaggttaaaaaaaatcacacactgtaaactataaaacattgcttaaaaaattaaagacccacataaatggaaaaacatccagtgtttatagattataaaatttagtatttttgaaatgacagtgctacccagatttctctgcagatttaccgcacattctatctaaatcccaacagcctttttttttttttttttcttgcagacatggaaaaatccatactgaaagtcatatgaaatggcaagggtccccaaataaacaaaataatattgaaaaaataacaaagttggaaaaaaatttttaaaacttttattttaacttcaggggtacatgtaccagttagttatataggtaaattgtgtgttgcagatgtttgatgtacagattatttttattattattattttatttatttatttatttatttatttatttatttatttttgagacagagtctcgctctgtcgccaaggctggagtgccatggcgcattctcggctcactgcaagctctgcctcccgggatcacgccattctcctgcctcagcctcctgagtagctgggactgcaggcacccaccaccactcccggctaatttttttttgtattcttagtagagatgaggtttcaccgcattagccaggatggtctcgatctcctgacctcgtgatccacccgcctcggcctcccaaagcgctgggaatataggcgtaagccaccatgcccggccgatgtacagattattttatcagccaagtaataaacatagtacttgataggtagtttttctattcgctgtattctcctaacttccaccctcaggtagccacaatgtctattgttcccttctttgtatccatatgtacttaattttttgttcacacttataagtgagaacgtgcaatatttgattttctgttcctgtgttagtttgcttaggataatggccaccagcttcatccatgttgctggaatacaattgctgggttgaatgataattctattttaagttctttgagaaattgccaaagtgcttttcacaatggttgagctaatttacacttccaccatcaaggtataagtgttcccttttcttcacaacttcaccagcatctgttattttttgacttgttaataatagccattctgactagcatgagatgatatctcattgtggttttgatttgcattatcatattttatttatctattcatttgtcaatgaacattttagttgcttctacctcttggctattgtaaataatgctgtgatgaacgtgggtgtgtgaaaatctcttcaagatcccagtttgaatttctttgaatatatacacagaagaaggattgatggcttctatggtaattctgcttgtaacttttttgtgaaaactccaaactagttttcatgatggcagcactattttacatttcaaacaacaaacacagtggatccaactttttcacatacttattaacatttgttgtttttctttgaatagtgagtattctgatgagcgtggggtgatagctcatggtagttttgatttgcatttcccttatgattagtgatgttgagcatcttttcatatgtttattggccatttatacatcttgtttggagaaatgtttattcaagtcctttgtccattttttagttgcattatttgttttttgttgttgttaagttgcagaagttacttatatattctgggtattagctccttattaaatatgggatttgcaattattttctgccattctataggttaaattttcatcttgtttctttttatgtgcagaggtctttaagtttgatgtagtcacatttgtctattttttattttgttgcctgtgctttgggtgtcatactcaagaaattattgtcaaatcaaatgttctgaagcattttctctgtattttcttctaagagtgtaaggtcttacatttaggcatttaatcccattttgagttagttttcacatatggtgtaagacaatgggtcaacttcattcctttgtatgtggatacccagttttctcaacatcaattgttgaagagactggttctctccctgtcatgcagtgttggcacccttgttgaaaatcacttgtccatataggcaacagttcatttctgaactctattctattccattgttttatatgattatctttatttcagtacacaccatcttaattacagttgctctgcagtatattttgaaaacaggaaatatgaagcatccagctgtgttattcttcaagattattttggctacgcagggtgcctttggattctctgtaaattttatatttgttttttctatttctatacaaatgctggctaggaatggtggttcatacctgtatccccagggctttggaagtctgaggctggaggatcacttgaggccagaagtttgagactagctctagtccaagcaacacagcaagatgccacatctttaaaaaaaagtaattagttaggcatagtggtgcacagctgtagtaccagctattgaggaggctgaggtgggaggattgatagagcccaagaggttgggactgcagtgagccatgatcactccattgtactccagactgggcaacagagcaagactctgtaaaaattcaaaatttaaaaaattaaatggcattgaaattaaaatctgtagatgagtttggatagtatggatgttttaacaatactaaatcttccaatctatgagaattgaatgtttcccatttatttgtgttttatttattttggtaatatttaataggtttcagtgtaaaaatcttcactttgtcatttaagtttattcctaagtgttttatcttttttatgatctagtgagattttcttaatttccttttgaaatgttcattggtagtgcatagaaacacttcttaattttgaatgttgatttgtgtcctgcaactttgctaaatgtgtttattttttctaaattttttttggtagaatctttacatataagatgatgtcatctgtgaacagagataattttatttcttttccaatctgaatgcattttatttctttttcttgtttaatttcttttcctagaacttccagcagtaggttgaattaatattaatgttaggagtgggcatcttgtcaaatgttttttctgcattaattgagatgatcatgtggttttgtccttcatttagtgaatgtgatgtattatgctgatttaattttgtatgttaaaccatccttgtattccaggtatatattttgctggatcatgatgtgattttttaaaatatgctgttgaattcagtctgctagtattacatttaggagttttgtatcaatattcaccaggaatatttttctgtagttttctttttttctgtctttatgttattttggtattagggtaattctggccacattaagtgaattttggagtttctttcaaaagtattggtgttacttattctttaggagtttggtaaaattctctagtgaagacattggttactggttttatcttttttggaagtatttgatactgcttcaatgtcctaattatagttctgttcagatttttaaaattgaatcataattcaattttagtaggttgtatgtttctaggaatgtattcatttattctatgttttccagtttgttggcttataattgttcatagtcatctcttataattctttttaatttctgagacagccgttgtaatgcctgctctttcagttctaattttagctatttaagtctctctctcttttttattttagctaaaggtctctcagttttgttgatatattcaaaagaccaacttgggttcattaatttttttctgttgtttttgtttattttctattttattttttctactctaatgtttaatattttcttcgtctcttaatttcaggtttgtttttgttttcctggttccttgatggatacagttatgttatttatttgagatttttctttccttaatatcaatttataaactttccctttagtgctgcttccactgcatcacataagttttggtttcttgtgttttcattttcatttttcctcagatattttattaattcttgttattcctcctttgacccattggttgtgtaagaaagaattttttaatttcacatatctgtggattttcttgttttattcctgcttttaaatactattttcattgcactgtaggagaaaagatacttaatataattacaacatttttaatttgttaagatttgttgtgtgggccacggtggtctatcttggagaatgttccatttctgctggagaaaagatgtattctgttgttatttgatagagagtgctctatttgtctgttaggttaattggtctatcatgttcaagtcatttgattcctatgatagtctccctggttgttctgtatatgaatgaatgcaggatattgaagtatcattattattattatgttactgtccatttttccttcagttgtatctatgtttgtttcatatatctcattgctttagttttaggtgcagatctatttataattgttggctcttcctggtgaattgataattttatgccgctataatgtcctttgtctcctgagacagattttgtcataaaatctagtttttctgatatgattatggacatacctgctctctttaggttcctgtttgcatcggatacctttgtctgtcttgatacagtcacttgtgttggtcataaaattcctctttgcctccacaaagttctatttttcagctggcttcctgaaagtgctactcctgcatgcactgccattcccctcccagttagccagggctattcacatggaaataaagaaaatagctcaccatcatggccatctgagaacagtgtctagcttcctataaatcagttaatgaaattagtttaaaaatagcaaccttaactatactcctctagcaatcgaatgttgtaaccaagttagaaaatcatgctttagtagtgtactgatgatagtattatagggctgagaagtttcaacttgtatagggaaaaatgggtatttttttatgataatgttttcgagtaaagaagaaaaactgttttagttccatgtacctataaacattatatagttctttgattaaccaattttcattttttcttctattgtttttagatgttcttggcagccctgtcattcagctatattgctaaagcactaggtggaatcattatgaaaatttccatcactcaaatagaaaggagatttgacatatcctcttctcttgctggtttaattgatggaagctttgaaattggtaacttttattttttctatttgataaccatacttgcataagttgaaaaacaaactgttcatgcatgctttatatcactgggtctggactaggtgtaaatttgtctctcatgggcaatttggcaatatgttaggatatttttgttgctataaatgggctggggcagggaggatgccactggtacctaggggtagaggtcaggtatgctgctaaacactgtgcaatgcaccagacagacttaccaacaaagaattatccttcccaaaatgtctatagtgaggatgttgaaaaactctggtcctacacaaactcatggtttgcaaattaactttttaggaaactttatctcccttgtctcaaggtgccccagtgtgaagaaaggttgagggaggacgataattcttatggttttaggtggaaggactgcataggagcaacctacactagattctactgtttaactgtgtacaacattgggggtttaaagtctttttttttttttgaacattgaagatactgctttgatgtaatcattttaatttggatttctccaacaatagtgagattttatataataattgaaaatattatataataattgaaaataatatattttcaatataataatttttcaaagaaaaattaaaatttttcttattttacaaactgctagcttatagcctctgctaattttccctttttcttttcactttctaattatttggagggaccaccaaattgtctattatatagactgcaaatattttctacaattcatgtttctattctaactgtatttacacaatgcttaactaatgactaaaatgtaattgtcaaaggaagatttatctctttatataaattcagaatatttgtgattcaaagatatgacactctacatgtccttcacttgtttacctcccaggctcaatgaaatcatctagaattttagaattggaatgttattagttttaacgtttaattcactgtatgtctatttttattatgaaattaatccttaacatttttgttaaactttgcagctatttaacagcaattatttgaacatcattatcagtttggtttcttacctctatttcttgaatcctatgactgcaaatctcatctttactctttctggagtataccttcatgtatagatgaccctctgtatccacaggttccacacccacggatgcaagtcacattcaaaaaatataaaacttaaaaatggccatatattaataaaaatgatgcgaataaaaacaacatagaatagcaactatttacatagtatttacattgtattagaagtattagaagttatctagagatgatataaagcatacaggaggatgttgataggttttatgaaatactacatcttttgtttgtttgtttttgtttttcaaggcagagtctccctctgtcgcccatgctcgtgcagtgccctgatgtcatctcacagcaacctccacctcctgggtttaagcaattctcctgtctcagcctcccgagtagctgggattagaggcgtgtgccaccacatccggctaattttcgtatttttaagtggagacaggttttcaccatttggccaggctgatctcaaactcctagcctcaagtgatctgctagcctcagcctttcagagtgctgagattacagacgtgaccctccacatccaggcaatactacacctttttacctaaaggacttgagcatccacaaatcttggtgtctacagagcatcttagaaccaataaccagtggacacgagggatgactgtaattatttttttttaggaagaattgaaaacgtggcatattttctaagcccttgcctgttggaatatttattttagtatcatatttaattgataatttgtctgggtatggaattaaaatttccaaatccctttttctcaaaacattaaaaatattcatctactgttttataacattcaatgttgtatatgagaaattattaccactgtaattttcatgcactgatatgcatctcttttttatctttaaatatccaaaaatttactagcatgtatccgagactctatctttctacgttatttctgctggacaaacgtaggaactttcatatgaaagcttacgtcttcctctaacacaaaaactttattttctgtttcctatttgtttcttcctgtattttattctttcttttcttctgaaacatgtatgagataaataatatattttctgaatatttttcctttaaaattttttcctctgaatttctacctcttttctttatgtttcatcaattttctctgatgtgtgatgtcatcttttatatcaagttctaatttgtaaatttttaattatattttaaatttataacaacactttattgttgtcttattatttttagtctgccagttctgattctatggctgcaacatgccattttacctctaaatatactaacaggattttttttaaaaaaagtttctactctttttagtttaatattgtttaagtatttattcttgtgttgctttatctgctggtccattctggtgctttctttcgtgaaactattttccatcagtgttcaataattcttgattattgtctgttcaatgttatatataaggctacagataaatctgaattggtctactcttattgctcttcttccatgttttaatctaaataatttatactcaacattacatctcaaataatgtatcctccaggaaactttcacaaagcccctaattaatttaagctccctatttccataatctaatagcacatctatccatctgttttattttattactagtgtgtttctagagaacaagtaccacgatttttttttatatttctgactctgagcactgtggtaggtacatagtataaatttaaagaatgcctagaataagtttaaaatatgcatgaatgattatctttccctcagattaggaagacattttccattccaatgcaatccagtaaactccaaattttcaaaaaaaaactttgcttctctcatatagccaaattacccaagtgctttctttgcatataaaacctattctacttattaatactatacaacttttcaatgagtggtttaatgtaggagagtttaccttcacagttaaattacatggtctttgagggaaggtacaatgtcttgggcatatttgcattcatttggggcattcagttctactagatacaaaattacactaagtcatatcaacataattttgttttttttctaggaaatttgcttgtgattgtatttgtaagttactttggatctaaactacacagaccgaagttaattggaattggttgtctccttatgggaactggaagtattttgacatctttaccacatttcttcatgggatagtaagtgttaaacagctctgagccatttattatcagctacttgtaaattagcagtagaattttatttttatacttgtaagtgggcagttaccttttgagaggaatacctataggtatgcatagagaaatggagtatatttcctatataatagttcatgtattgctttattcatcatgtatttctttatttatcatggcttttataaacttttaaataagaataatattatataaggtatacagttttatatgaaatgaatatcttatttaccaattttagtataacatatgtattttatgtttttgcctgtaagattttgattatcctcagtaaggcttcacaacttcacctgctgctgtacaggttttcccatcagcatttcactgaagctgctctttctaaggtaactgtgtagttatgattagagtaagaagctcatatgagaaaactgaaaatagcaataacttaaataagatagaagtttattttttacattttttcaagtccaaggatgatatgattctacttttcatcatagtgctatgccttgcatggccttgtcctcttgttacaaattgtggcaatgtatttccaggcaacaggatagaagaagagaagaacaagaacaaagagtgcacacaggctgagctccaggagcattttcagaagcaaaacactttcactgatttcacatttacgggaagtcagttacgttttacacatagatatgtagatgttggaaaaatgtactttattccaggcttccgtatttccagctaaaaaaaccaacttctgttactatggaaggagagaagaaaggatactgagagacaacgagcagtttgttagagacaccaattccttaatgccaaatccagcaatcatgcctgttggtcaccatatgaattctgtttttttccccctctacatttggcccttataagaactttcttcttaatggtactgctctaatactcatcatattccacaatcttgattcatttttctatttttgtggcttcatcatgcccatctttttcctttgcttctgacaccataatttctgtgtcccataattccctctaatcttcttaatatcttattcttcattatttttatggagaatatgccttaaatgcaactaccccagcttcatcttccattgctccccacatttgaggaccacattctaggcttacagttctctaatgtgccataatatgtcatatctttgcatctgttatttctacagacttgaatacttttcttcctttgtctaccaatttgaattctacccatcttcaatattcatttaatctgtccttcacattgtgaagttttctttgatctaccctcacctccaagaaaagctgatcatttctttttttttttttttttttttgagacggagtctcgctagtcgcccaggctggagtgcagtggcgcgatctcggctcactgcaagccccgcctcccgggttcacaccattctcctgcctcagcctcccgagtagctgggactacaggcgcctgccaccacgcccggctaattttttgtatttttagtagagacggggtttcactgtgttagccagggtggtctggatctcctgacctcgtgatctgcccgcctccacctcccaaagtgctgggattacaggcgtgagccaccgcgcccagcccctgatcatttcttttttgtgggtgtgtgacaacccaggaccttgtatattaaatttactatatcttcgatcatacacatttatcttagagagtgtgaaatttccaaagtacaaacactgtgtgttttatttcttgatcttcatgttttatttcttgttctttgaagttgagcaaaatgcctggcacactatatgttgtccttagaactcacagagcggttagtatttttgagcatcagcgtctgtccctgatccagctccatctccgttgttcttattttttcctcataaagtttaaatgaattagaaatttgtttttattgagttttgaaaagtcaagcactttgtgtgtgtgtgtgtgtgtgtgtgtgtgtgtgtgtgtacatgaaagaaaatcagacagattgaccatctttgatggtaactcaaagggataaatagacatagttaacagataaaaaaacaacaggtgaaaccatgatatttcatatcttgaccagattataagcactcttaggataaaagcaaggtgataacccactttgttcatggtgtattgaagtatctttcttagtggacactcccatttcaccccctctcatcacctgttctgaaatacatgctgggaagttgacaaacaagattctggtaatttggagaagacagcggttcaaataaaggagaaaatttctctgtatttctgggaaaactgaaaatattcagtagataagcaaaatgttcaatttcatgttgctcttacagttataggtattctaaagaaacccatattaatccatcagaaaattcaacatcaagtttatcaacctgtttaattaatcaaaccttatcattcaatggaacatcacctgagatagtagaaaaaggtaagaattaatagtgacagtaaaacaaattctagattgatagatttaatcacgtctataaagtttctgatattctttaacaaaattgatttaagaacaaataggaagaacatttatcccttacatacagacaaaatcatactgttaatgtatgcagtcgattcttaaacaacacaggtttgaactgcacctgttcgcttatatgcagcttttgtccaaccaaacagaaggagaaacccaccaccgatgtggaggtctgacttctataggcggtttccacagggcaaatgagaggacttaagtctgtataaatttgtgtacatatgagttgtcctagaacaaacctcctagtgtacaaatggattattgtataccaagggcatttagaagtagataagaaaaaagaacaaatttagtaggaaatttgcaaagaacatacacatttaaaataaaaaagcagaaagtggtagaaatatgtgaataatataactttctctttataaagatgcaaaatgttatagcatttgaagactttgtaactattataaacacaataatataagtataattttaaccccaaaatttattaaaaataaatgaagtggaggaaaaaaaatgatttcaagttttctgtattgctgggagagtataaatttcaaagtctttctggagattaattttcaatacatattaaagaacaaaaatatacttgcctactttcttgattaatcttaaggaaatcatcagtaatgttcacaaggacatttcataatcacagccatgacatccatgtttaacagaataaaaaaaaatattttgtaacgacaaaagaagagattgtttaaccaaattaggaaactattattcaacacactactatgcagtaattaaaattttaatatagaagaactcttgacaacatggggaaattgtgacaatatagtgataattgtatatgcaccttaaaaataacctggatttttaaatatgtaatgtacataaggaatattatgcatattttgtgcactaaaaatgcagaagatctagaataacatttgcaatgatcgtctgtgtgtagtgtaattatagaaaatttttacttgttttctttgtgcccttccttattttcaaactttgtaaagtgaatatgaatcacttgtaattaggaaacaaacaaacaaaaaatggaaaaatgaaggatttaaagtagttaaatttctaataggaatgttaaaattaatgtttaaagtaaaacactctcttgtctcgatagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtaacgtacagaatatattaaatttcatgattacattccctggatctacccttgaaataataatgtcattatttttttcttttacctattagaaaaatatttgcagaagtgtattgtataatattacttttaaaagcatgttaaatgaaaaccaagtatttgtgacatctgattaaattgttttgtaatacttacaggtagtttgaatgcaataggaatgattggtccagtcattggctttgcactgggatctctgtttgctaaaatgtacgtggatattggatatgtagatctgagtaagtacaattagaacaaggtaccatgatagtgtcttttaagtgcaggacaccattcttccaaagaattaaattcagtctttcaatagttctttgtttactatttttcaagagttacaagtaggaaataaatccattaataatcagaataaaaaagaaatttagctcctatttatactttgcttttacaactaagtataaaaagagatttttaacaaatttattttagattacttgatccaaaataaccaaacttgaaatgtccctttcccaaaactgactggcccagtcaagtaaattttatttttcagttgatggtgacttggatgttgatgtgtagaactcagatgttgatgtttgctttgcgaaagcctccttgtggctgctgcattgacttacggcaggggtgggttaagagaggccacagtgcactttggttgtggtcatttttcctggttctcactgagggcttggcctatgggaacatttaatgagtgcttatagaacaaatgaatgaaggagaggatgcataaataaaatttacgacttttgtctttactctcagagcatgctttatttctcctcttgtagaagaataagaatcaatgttgtaatatctgcctcgacttcaggccctccttcctacagatataccttcaccatatccatatttatctttttttaacccatacttatgaaaaagtatttatctttagctaatattagtagatccaactggggtttagatttcctctttctgcctctcctccatctgcaccctctcttttcctcagcaaacacactgaagtctctcccatctatgtacacatacacatttttatatccccaaacaactttccaattgattaactgtttctcaatttatcttcaaagccaagtacctagaaaaacatcatctaacataagtatctcaccttctcatctcccatttacttctcatccactataatctgttttaccactaataaaacacaatcagcttctatgtaatttactaattgtaatggatatttttctataatttattttaatggatatttctactacttgttccatttttttcttcttagatttttttttaaataagtacctaaaactcaacctgtgaaaagctggtctcatcgtctgatttccaaacccactttgtttcctgtattccctctcttgatgaatatctgtaccttaattcaatgactgactgaattactatgccctgtaatctcacacttccctttatttaaaattggaaaaacttttctctcttttttatttttatggttctcaaagtctctttcaacatgtgacttttctcatgtaacccttacttcatcatttccattggtctcaaattcggtgctcctattaatcatcaagagcatgcctttattgtagcccttctcacaacaatctataaatatttgcatacttacccaccatctctttgagaacatgacagaatcgtgtctgtgttagcatataataactcatcagggtttgtgaataaacaaatatgattttctatctcttgaggacttaaatagatcactccaaagagaccaaaggattcattccaagatggaatagccattattgtaggccaagaaatcataaagtgttttctattataaaactaaagcaagtacctgatgatatgttttatatcttccatgttagacatgtggcttagtgtagctacacgttatgtacatcatttttactcatttgctctactttaatcattgcttttaacactgagtacaaagtaagtgttgaaggtctttaggatagtagttttgtagcctctctattcagaaataagcacaccattttagaattcatggtgattcaacttctacccctgactgttcagaccttatcacatcttctcttattctgtgagaagcatgaagtgaacttatgataaagtatactttggtaaattttaattcctacaggatccaaagacataacataaatgagtaaagaatatcaagggcaggaaattagggtatgatggttagaatggggagagttgttgttggtgcactactctccccatacacactaaaactcatgtgctccccagctctggtctatacttttcatacagaattttggcaccggcattaataaggctttctgattggttttccagagaatccaggaaccaagattttaatgtagaattttccaatttttaagattgtgtgtgagccacgggaagcactagcaggacatatctagcttggttatgacctttagttcctatatatagaccagtgaaagaaccaaaaacagtcatcaaaattacatttctgacaggtgataagtaaacacttagcatgtataatggagttactgatttaactagtcatttcctgaagtctgcctgagttgttgattatgaaacaatatgatcacataaatcaattttaaaaccagatcagtccatactagcaaataatatatttctaaatagttttaaatcaattcaatattttttcatgtcaatgatttttcttatagatcagagtaatggcatcagttaagtttgctacaaacttctatggtgtgtgtgtttccgtgtgtgtacgctttcttaatctttattatttttattttactgagataagaacaattaaaatggactctacctcccaaaaatacaattgaaccttgaacagcacagatttgaactgtgcaggtccacttatacatagtttttttgataaatgtattggaaacatttttcgagatttgtgacgacatgaaaaaccttgcagataaactaggcagcttacaaatacagaaaaagttaagagaaaattagttatattgtgaatacataaaatatatgtaaatattattttataatttactacaataaaatatgcacaaatctattattaaaagttaaaatttgttaaactttacacagagaaactcttatagaccttacatgatgccattcccagtcacagtattaaatcatgactgcataaaattaactgtagtgcctacttcactgctgtaaaaattctgtaatcatctcctgttgttattgcagtaagctcaagtgttgagagtatttatttaaaatgccatgtgtcattcatcatctccatatgagtagttttcatcactctccagtaagtgatgaatcacagtaaaaagtgaacccttgtgttttctgcgtatttttcatcctgttaagtgctgtaacatcaaccttaagtaacactgtgtgagccgtatgaagtaccactagtgatgctggaagtgctcccagaagcaaagaaaagtcatgacattataagaaaaagttgaattgtttaatatgtactgtagaatgagctctgcagctggccactgtttcaatataaatgcatccagtacaaggaccattgtaaaacaaaaacaaaaacccacacacagaaaaatggatcaacatgaagcctcactgcagctacaacattgggcacataaacctgtccttttagtgcaatagctttttatatcatattgaaaattcaacttttatgtagatgcaagattgctatcagaaaggcataactgtagactcgaaacatgattcaagaaaaagtgaagtcattatatgaaaacttaaagcaaaaggaaagtgaatgatttaaagctggagaacttcatgccactaatgcataatttgaaaattttctaaagaggtttgcctcaaaaaagtgtcagtataacaggagaagcagctcctgccacttaggagtaacagaaaagttctaaatggcataaagaaagtcattgaggagaaaggacatctacctgagcaggtttttaatccgatgaaagtgccctattctggaaaaaaaataccacaaagtacacttattaatgaggaagataagtgagtaccagtatttaaggcaggaagggataggctaacgctgatgttctgtgcaaatgcagtggggtttatgatcggaactgttcttacctatacaactgctaatccctaagccttgaaggggaaatagtaaaaaacagttgttagtcttttggttgtatgacaagaaggcctgaacaataactttttttctgaaaagttatgacagtttccttccatgctttgttcctgaagacaggaagtaccttggcaggaagggtttaccttttaaagtccttttgataattggcaatgctcttggtcatccagaacctcatgagttgaatactgaaggtgctgaagtggtctgctttaccccaaactcaatgtctctaattcaccctctagatgtggggtcctaaggacatttaaggctcattatacatgttaccctatagaaaggattgtaaatactgtggaagagaaccccaatagagagaacattataaaagtctgaaaagattacaccgttgaagtcgccatcattgttatgtaaaaagccacaaaagccttcaaacaggaaacaaatttctactggagaaaactgtccaaatgttgtgcatagcttcatggaattcataaccattcaagaaaattatgaagagattgtggatatggccaaaaaaaaaaaaggtgtggagtgaagaatttcaagacatggatcttggagacattcaagaggtaacaggcacaacagaggaattaacagaagacaacttgatggagataagtgcttctgaactaatgtcagatgatgaggaagaagacatggaagaagcagcgacagaaacaaattgacatcagacagtctggcagaagtgttctgattattcaagactgttttgatgtattttacaacatggaagcttctgtaatgtgggcactgaaatgaaagcaaacagtggaagaaggattggtatcatatagaaacattttcagagaaatgataaagtaacaaagtcaaatagaaattatgatgtatttctgtaaagccacactgtgtgtacctgtctttcctgtagaaattatgatgtgtttctgtaaagccacactgtgtgtacctgcctttcctgtctttctttttacctcctccactgcctctgcctctactaccctagagaaagcaagaacagtgcctccccttcctcctcctctacctgttcaatgtgaagagatgaggatgatgaaaagcgttatgatgacccacttccacttaatgaatagtaaacacatttccttgtgattttctaaatgtcattttctcctgcttattttatagaaagaatacagtttataatacatacagcatgcaaaatatatgttgactgtttatgctattggtaagaattctggccaactattagtgctaaaaaagcacttgataaaattcaacatcccttcataataaaagccctcaaaaatctggggatagaaggaacatacctacccaaatatatctacagattcaagttaagtttttggggaaccaaaagttacagacagattgtcaactgtttggggggtcagccaccctaaatcccatgttattcaaaggtcaactgtacaatacagtattattaactacaggcacaatgttgtacagcggatctctagagcttactcatcttgtataaatgaaactttttatacccattgactgggaactccctatttcccctttcccacaaccactggaaatcaccattctactttctgctttcatgagtttgactcttttgtatgcctcacataaatgtaatcactcagttgtagggaccagccccacagatttggtgggtctcttactgtgtgcggagatgagagagtgtagaaataaagacacaagacaaagagataaaagaaaagacccctgggcctgggggaccactaccaccaatgcacagagactggtagtggccccgaatgtctggctgtgctgttatttattggatacaaagcaaaaggggcagggtaaagagtgtgagtcatctccaatgataggtaaggtcacgtggatcacatgtccactagacagggggcccttccctgcctggcagccgaggcagagaagagagaggagacaaagagaaagacaacttacaccattatttctgcatatcagagacttttagtactttcactaatttactactgctatctagaaggcagagccaagtgtacaggatggaacatgaaggcggactaggaacgtgaccactgaagcacagcatcacagggagatggttaggcctctggataactgcgggcaagcctgactaatatcacaagaggtggaggagcagagtcttttctaaactcccccggggaaagggtgactccctttcccggtctgctaagtagcgggtgttgttccttgacacttcttgctaccgctagactgtggtccgcctggcaatgggcgtcttcccagacactggcgtcactgctagaacaaggagcccttctggtggccctgtgtgggcataacagaaggctcgcactcttgtcttttggtcacttctcactgtgtcccctcagcttctgtctctgtatggcctggcttttcctaggttatgattatagagtgaggattattataatattggaataaagagtaattgctacaaactaatgattaatgatattcatatataatcatatctaagatctatatctggtataacttcttgttttatattttattatactggaacagctcgtgtccttggtctcttgcctcggcacctgggtggcttgccgctcacactcagtatttgttcttctgtgactggcttatttcacttagcacaatgttggcaaagtttaaccacgttatcacatattgcaggatgtcctttctgtttaagggtgaatagcatttcattatacgtatatatcacattttctttgtttattcatctctctgtagatattaggttgttttcacatttagactgctgtgaagagtgctgcaatgaacatacaaatggaaatatctctgtgagatcctaatttcgattattttggatatacacctagaagtgagattgctccatcatatggtagttctatatttaattttttgaggaaacttcatactatttttttataccaggtgcacgattttgcattctaccaacagtgtataagtgttcaaatatctccacatctatgccaacacttttctcattctttatttttgataatagccatcctaatgggtgtatggtgatacgtaattgtgcttttgatttgcattattatgataataagtgatgttggatatcttttcatatacctgttcatttcgataccttctttggagaaatttctattcaggtctttcacctatttttaaatcaggcaattatatttttttgctatggagttgtaggaattttttgtacattttagaaattaacaccttatcacatatatgctttatgaatattttctcttattccgtatgttgccttttcactctgttgattatttcttttgctgggtagaagctttttagtttgaccagttccatttgtctaattttgcttttattgcctgtgcttttggtggtacatccatgaaattattgtcaagacaaatgtaatgaaattctttctctaagttttattctaagaattttatagtttctagttttaaattttagtcttcaacatagtctgagtttattttttcagtatatatatgataaggatataacatcattttcttgtatgtgaatatctggttttctcaacaccatttatcagagaaacaattatttcactatcgtggtcccttgtcaaagatcagatgactgtatacacacagatttctctgggctctgtattccattctgttggtctacatatctatctttatgccagtactgtaatgtattaattactttagctttgacatatatttgtaatcaggaagtgtgaaccatcacctttgttctttctcaaggttgctttggctatttgaggtcatttgttggtttcatatgaatttgaatctgtggatatatttgagtaggtatgttccttctattcccagatttttgagggcttttattatgaagggatgttgaattttatcaagtgcttttttagcatcaattgaaatgatcatatgatttttacctttcattctgtttatataatgtatcagatttattgatttgcatatgttgaactaactttggatcccaggataaatcccacttggtcatgatgaaggatcattctaatgtattgttgaatttggtttgtcactattttgttgaggatatttgcatcaatattcatcagagaaattggcctgtagtttttttgatgtgtgtttgtttgattttggtatcagggtaatattggcctcacagaaggagtttggaaatattccctgctcctccattttttggaatggtttgaatagtattggcattaattatttcagtctctttgttaaattatctgatagtttctgaattccttctctgtgttatcttgaatttctctgagtttcttcagaatagctatgttgaattctctgtttgaaagattacatatgtctgtttcaccaggattgttccctggtgccttatttaatttgtttggtgaggtcatgttttcctggctcatcttagtgcttatgttattcatcagtgtctgggcattgatgacttaggtatttattctagtctttgttgtctgggtttgtttttgcctatccttctttactaggctttttaggtatatgaagggactttggccacaacctcaataatactgtggtttttacagtcttagagaggtactgccttggtggccttggaaagtatatggaagaattctctggattattaggcagagactcttgttctcttcccctgctttctccaaagcaaatgtagtcttgctctttctgtgctgagctgccagaaactgggggttcactgatgcaagcaagcatccttgtggccccccaaccactgagactgtcctgggtaagacctgaagccagcacagcactgggtcttgcccaaggccctctttaactactgtcgggctaccatctatgttaactcaagatcaagggctctacaatcagtagttggccaagccagccaggtttgtatccttcccttcaatgcagtgagttcctctaggcctcaggctggcctacagatgctgtctgagagccaaggattggagcaaaaaacccttgcaatttacctgtaatagatatctgttttactatggctacgctggcacccaaaccacagcacaaagttcttcttgctcttctctccccttgccacaggcagaggagcctctccctgtgtccaccaccaccacaggcccaaggaagattctgccaggccaccacccatgttcaattaaagctctagggctcttcagtcagtttattatgaatgctgccaggtctcagagactcatccttcagggcagtgggtctcttagtccaggactaggctattggacagcatttctagacttgcctctggcccagggcaggtctagaaatgctttccaagagcttagtcctggactcagggaccccaaaagccttcttgttgctctgttctactgtagctgagctgctacctaaggtgcaagacaaagtcgcctttatttttccaccacttctcttaaacagaaggagtctttcaccgcaaccaccatggctgggattgtgcttggtcacacctgaagtcagcaaatctcagagcccaaggccctgagtgcattactttgcattactttggtaccactgctggttatttagggcctgagggctctttagtcaactgatgataaatgctgccaggagtgggtccttcccttcaaggcagtggattcctttttggcccaggatgtgcctagaaatgttgtccatgagttagggcctcaaaactctgcctggtgccctattttactgtggctgagctggtattagaaaaaatattttgcaatctatgccttagaaaaaaagaatcacctctccaactcttcatggactggccttattgtaggagaaaaccttcatcaatcagcccagccatatcttcttgggcctctcaaattttcatggtcatccaaacatctatctttgtcttaggatcccccaggcatctagagtatgcagggtcttatcagcacctttacacatttgagacagaagacagtccttagtcaactcttaggaaagtttgaatatttggcatgctgtccaaccctttcccttcccatggagaatttggaagctgagatttcttacctcatcactctgcttaaatctaggggcaggaagaacttggcaagtgcccatgtgctagtttaaatcatcatttttgtgttctttgtagcacccaggggccaagtgtatgcctaacctaaagacaaggaagacaaaatacctttccttgatagaactcagaaaagatgaaatgttatatatgtggtccaaatctttgtttccccatggaggagctaagagctgagatgttgttgttgtttttgtttttgtttgtttttgcctgctcactctgcactaacctagggggcaggatctgtgataaatgtccacatactggctcatctttattctctgtagttcccaggtgtctggcatatgctgggtcctctcagtacttcgagacagatgagatagaagctaatctattgggtagcacttggaaaggttgaaatgttgaatgtgcagtccagccctttctctccccaaggataagctgggagcattttttaaaaattttattttactttaagttccaggatacatgtgcagaatgtacaggtttgttacataggtaaacatgtgcaatggtggtttgctgcacctatcaacccatcacctaggtattaagtcccacatgcattagctatttgtcctgatgctctccctccttctgcccccatgacaggccccagtgtgtattgttcccctctttgtgtttatgtcttctcagtgttcagctccttcttgtgagaacatgcagtgtttgattttctgtttctgtgttagtttgctgaagataatggctttcagcttcatacatgtccctgcaaaggacattatctccttcctttttatggctgcatagtattccatggtgtatatgtaccacatttgccttatacagtctatcattgatgggtatttgggttggttccatgattttgctattgtaaataatgctgcaataaacatacatgtgcatgtatctttataatataatgatttatattcctttgggtatatacccagtaaagggattgctggatcaaatggcatttctggttctagatccttgaggaattgccacattttttgtttttttctttttctctcacacattcgctctgtgttaagccagagggaagagctgtgtcaagtgttcacatgccagtttaaactgctagtttttcccaattgtatggtataatactgaggaggagaatggcaagaggatgtctccaattatcttactggtttttatgtatctggttttgtactttcctgatgtatagcaatctctcagttagcttctgtatttctcacaaatgaaattgatctgaatattactgttgaatcagtatgttcatggagaaaaaggtatctgtccttcttattctggtatcttgctgatatctcatggatgcattcctgttacttaaactgtatattttctacctactaaaataactcattgacatttgagatatagcatttacacattactcttatacatactttaagggaaatatagttgaaataaaatggttaaatgatttctaacatttagagtccaatatttctgggttactcttaaactcagattttcattttgcatagtttttcatcctctgtgctgtctggagagttgcaaatgcaggttcctgggtagttagggtgctgtggatggaagctcctttattgtctctaagtattttttgccagctgcttaaattttatttctgaggctttcttgacctcattagatgattccaacattttcagacaacagtgaggattcatatttcttccatgaacagttattaaatggtctgaggagttaaatgtccaatgatgacagctgtccagtcatgaaatctgaaaagccaccaagtgcacacaagatcaggcaatgcgaacagtgtcatgactgactcctggacaatagcaattgcaagatgtcatcaacctagtttcagagataacaaaatatgaaaagaagaaaatagtgttttagaattgaaagtaaacatttggtttactttcttcatctatggaggactgcaatcattatcattatttcccagaacctactgtatttcaaaacgatttttgactggcttcttttaactgtttctcctaggcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggtaggtatttgacattcattgtcaacttggaattgttaatctcaatgaaacggagaagtgagtaaaaaaaaataaagcatactcaaatcatctagagtcagctttcttctctgctaaatttagctgaattattttttctaaaactcctattaaaattaacaaatatgtcttgagtacataaaaaggggaagaggattaggtttctgctctttagaagagagaaaccaatcaaaggctacaaacatctgttgcttataagccagagtatatattcattttaatataatatagtataaactgtgagggtttaaaggattataatttttcattcatttatttatttaacaaatgataccagccatcatactattctctggtaatagaacattgcctttattttttgagaacctggtggatgatattaagacgtatatagatcactgtaataaagtatcttaagtactatggtaggttatatttaactattctcaggtgtagagatgaaataaggagaaggaattcaggagaggagtctgtctaggtaattagagtaagattatttttcttggtaattaaaattatatcttattaaattaatttttatatatgaattaaaattatatatatacatatataatcttacctaagtattcaaaaatgaagtgaaaagcaacatcagtaattaagatatttggagtaaataatgtgaattaggattccttaccacttgatagtggtgcctctgtccaatataagccaaatgggctaatggagtaccattgagaagcaataatcaagagaatgatctggcagctgtcagagcaagatatatcaaatggtaaggtattgacagcagttttcagattagggagaaatggtgaagtagtaaaacctgaagcagtgcaaccaacacttaaacccttggcactttttaaagttttcattgaagtaaacttacaaactttccaaagtaacccatgttctttctctcatcagttccttcacttacctttttttttgttgttgttattttctcctctccaccacactaacccaagagcaatgggatggatgctggagccttgtgtattcactcatgagagtggattgctcaatttcagctgcgttggtagcttgaaattgtccatggtaggagaatttaccgtcatgtattaccatggaaattgaaaaatatcacaaatcgagtttgtttcccagtgaatctgttgttaaacatttaccagcacatcattgataagtttttgtagtttaacatgcatactaaaaacagcgtatcaaggattttttattttgtctatgctatgtttctactttaatcaaatccataacaattgatgaatttttttttttgagacagagtctcgctctgtcacccaggctggagtgcagtggtgcaatcttgactcactgcaacctccacctcccaggttcaagcaattctcctgcctcagcctcccgagtagctgggactacaggcacacactgccatacccggctaattttttgtatttttgtagagacggggtttcaccgtgttggccaggctggtctggaactcctgagctgagacaatccacctgccttggcctcccaaagtgctgggattacaggcgtgagccaccatgcccagccaattaatggattttctaaacctataaggaccagggttgactgtgagcccaaaaagaataaagaagataataaggtgcaaaaaaaggggcaactgtaaacattttctatattatgaactgtttttttaagggtagtgatgtgaatagtaaagcgaattttaattaggtgctcattaggaatggttaaaatactaagtacctatagtcagaaaaaaaattagatttattccatatattcttgagtagaactaagactaattgattagaaagcaaagaaaattccagttcattacaaagacaacatgtaaacaatgagaactgttcaaaagttgagcaaattgctctcaggtagcataatgtcacttgaattgtttattgatccattttttaatggatcaacattgtagtgagttatgattgtatagaagttcagtttagatgacatctgagttcctatttacctcaaaaatttaacaatttggttaattcacatgttccatttattttgagcaaaggtcgcgactctcttagaaagcctcacaaatcatttgtaactttaagtcttatataacttatatttacaaaattcagatattaatatatattttattattgaaatatgttatttttataactctataggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggtaagacatattttttacctgtttgcttgataaatgaaacactgctgagtacttgtgttccaagtcacattttattatgaaggtgattttatattttactaaatgtaatcttattatgtctcaaactttacaaaatttctccatcttgtaatatcatcgttgttctgcatttgaagttgcatctcatgttaggtgaatttaattccataggtgaaattcacctaattctataggtgaaattctaaagaaaaaaaattgcttgtgaataaaacatttagacgtagtatctgcataattggatcttataatatagtactgagatcctgagacaaacccttttataatataaccattataattctataattcatggactgaaataaggcctcagctacttacaaaagacataatattaatcttttcagaaggagaatcaatttaaatacattacaaaatatgcatgattcaaaacaaatgtcatattttagagaggtttattttgctacaatgcctattttcaaagtcatattgagaccttctcattaaggaaaggttatcttatatcccttttcccacaactccagtattgtagaaaccttgtagaaatttgataagtatttgatgagttaaacagtgtatcaaatggtatgtatctaggtcatatgtacataggaaagtaataattagaaaatgaatgtactgaagcattggaacaggcttctggatgatctccctgttgaactgacagatttaaacttaaaagattcagttttgactcccaataacctggcttgaattttttgttagaggaatcttcacctttaataacacttacgggactgtgaaatggaaaaaatgtaacagggatcagtcatttttaatcctgtatgtagacatttttatcatatcatggtagatatgtcttttatgaataataaagagatattaattcaagaatttaattctaaagcctgggcaaaattggagtgagttattgaggattgaaacattttgagaaatgtataaaggattttttagatggtaggatagaaatctcagagaaagaaagattttgtttttgttgttgattgccagaaaaaaagaaagctcctcatagaaataacctttttagacacgtaaatattcttagccactgcctttttcttgtgaggaagccaagccctcataattggccaaaataaattatttttgtctctcatgtgggtatacttgtcccttacctccaccctagtgtgccacccttctctctttttttttttttttttttttgagatggagtctcgctctgttgcccaggctggggtgcagtggcgcgatctcggctcactgcaagctccgcctcccaggttctccacccttctcttaaagaaataagaatgggtgaatttggttgatatacactgtgttttatatataaagacatatcagaaaaaccatatttgtataattatagcttttttctcttcttttatttctaggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatgggtttgtatatattgctatataaattgtgtaatatgttaaccatcaaattaaaagattatgtgcaagtaaaataaggtagaaaacaattgtaattaaactttattttaattgagagaaatttcaattttcaaattcttaaaatgtccatttcctaagacaataaaaatttgttttattccttccttaaggaaaagcaacatcggttgaaataataatacctatgatttctgggtaattaaaatgagtggtagacacttttaccccaattttatagatgggaaagtgagatttagagaaacacacacattatatggctagcaatgttaagattaagacacaaatttgagctattagaggtatcagatgtcattaaataaaattattcataatgtattttctaaattatcaatctccttatttttcttaatttaaattctatactcatttgaagatattttataaatccttaataattatcatatctttacaaaacaaataaaatctttaagcttaaacattatacaaataacattttataattttagtcataatataaaattatatcttatgatttataattatattataaagtaaatcagtataaacagtattatagttttattcagaaaatatgcagagattttttatcctttttcaactaattctattattcttgattttttattcctcagaggtttggttttaactacattgaaatctttttttttatgtagttaaaatatagattgtaaaattcaacaatgttaactaacatgcatagattcagaggattttaaagtgagcttagaggaacctcaatctaatgccattacctccctgaagagaaactgaatctcagaaaaatgaagttacttatataatgtaaagtttcattgatagaatgataaagacctcttgtctaagtcttatctaacctcttttatttcttttttaatttttactttttctaggtcataagtcatgtcttggtaaagaaggagagttaaaagtcaataagcattacaaaaattgccattttgacatcagcaaatcaaatttctctatctaattaaaggaaaaccctttctcttatttctcttctcttttcctcttctcttcctcctcctctatttcccctctccttatccccttgtctccctcttctgctctttctctacttcctctttctctttttttgatatatttctatcatatattttcagaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgagtattagttttcactttttctcctctccttaatcaaaatcacagatttgatttaataaatacttatcaaatcttcctataactaaggtctccaataaaaagataaaacaaaaagattccagtattatctgtcctcgtgatagctgtgaagtgtaaacaaagcttcatataaaactctgcttaggacacaatcagacttctctgttacttgaattctaattagagattacccactttttttcttgagattttaagaatatgacctgttagaatttgaatgcatttagggtctctaagaagcatctcatttgactaaagcacatgatttttattatttggaattactttaccctttggaagttaggggaaagttcagagttagcctgttgtcagcactacctgctttacgagaacaataatctatttgcattttaatatatacatactgataagtgtagctagggactcactgtggccttggactttccaagaaatgagtcaagtcttcatgttcacttgaattccctattcttgatttcctattttgatgttcccaaagctggcacttcttttactcagtataatttagtatcctactcactgattgccaacatatccattggaaattccatttctttcttaactcaaaggcttttttttttccatgtgacacatatcctgtttttcccaatatcctgggtaactcccaatgattggaaattaggtatgctgttccccatacctacaatcaattcaacatctcacaagttgcataactatttttcaggccctttccctattaccaacattagcaatatagtcagctgcgattatgactctctaccacactcttccatgcttcaattctaaacattttctatctttcccttgcccaatatcctaccaacgtattattaaacggcatggagaaatttgaagaataaagcctcctagtttccttgaagataggctacaactttagtaaacttgcacatttgtggcccaaagactatacttaaaagcccacatctcatattcatcagctatagtatctttcagtaagagtaccccatttaatccctggtcctgtgttgtccagtagtgaagacctgaaagagaggtgatattagtatcctaaagagagctctgtcttcatggagacatcatcttaatattggcaatggctatgctatgtgggggctactgcaaagttcctttactaaatcctcagtaaaattgttaaaataatgctctctgtatcaaagttgggtttcattggccaatgtgcttgctccataaaagattcctccatgttattcctattgaaaaaaaataaaaggaaaaaaggaatctttcttgaaccatacgagtatggatttaaattcttttttttgttttgagatggagtctcaccctgtcacccaggctggagtgcaatggcatggtctcggctcactgcagcctccacctcctgggttcaagcaattctcctgcctcagcctctcaagtagctgggattacaggttctcaccaccacacccggctaatttttttttatctttagtagagacggggtttcaccatgttgaccaggctggtcgcaaactcgtgacctcatgatacgcctgcctcatcctcccaaagtgctgggattacaggtgtgagtgaccacgcctggccaattcttttacaagttctccttcagtaaatagtcttcagcagtagtaggttcaagatgaacttaaatctttagcctagaatcagagcagaatttattaaagccacctaaccacatacactgcctgcctgatctctaaaattacttgttcctaatattcctcttctatattctaaccattagccagcacattcttttgtgttaaacctttctggtaataatatactatatcttgtcacctgtcattatggtcttgaatgttgcttttgcctgcttaaatagaattctggcaccactgcctggctctatttcctctgcactctgtcccattttcatgagtggctaagttttgtcccgtttcaaactatattttctggattcttttggtagttctttcccagagtaagtccctaatacttagaacctgccaaagagagtaagaatgtgtattttggaaagaaaatgtaggtggaagagaaatattttaaataatgtatattaatgaaaaaattatatacagaatttcatacactaatttcttaaattcctaaattcagggagctattttgccttcactattaagcaactatatttttataacattttttaaactgtaaatattttagtttgagacttctttaaatataatggaatgtattcatagccctgttgtatttggcaaatgtatttgttaatatttcaaaaactatttttaggtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagtaagtatgatcctgtaaaacattgtcatgtatattagactaaaacacacctaatgataggcatatttttctgtattttgagctcaaattcatattttgtcaatttttaattctttgagaatgcattttcttagaattattttgatatttcaataacatcattaataatttttgtctctaatacttccattgtcaaatctaggctctatactttcttctctttaataaaaatcttaaggcacacactgattgacagttgccttgattgtaggagaatctttgtgtgattgtaaaagaacttttaattttgagttgcgttgcatcctaatgagccagttaagagtaaatcatctgttgatttcattgaaagaaaacatttagcaaccaggtataaatacaaacttcaatttgtaatgaaattctaatgctttcaattcacccacagcatggcttttgacctggtatttcatgatacccttgtagggcataagaaaaatatgtgtaaataattcattccttttttcacttattagacagttatttagacaggatatgatgttcgatgaagaatatttcctagtaagtaaaaccaataaggtacttgttttctcacagcttagaaaatgacaagactgatgtgagacaaataagtataaaaataaacacataattacaaattgctgtttgtcttaataaggaaaaagactgccaattaaaggaataaaaagagaaactaaatttaggattaaagtaaggggatgtgaggggaaagactcccagagtacatctcaaaagaagtgacattatatctaaagatgtaaagaaaaagccaaatgaagggctttcagggagagggtctaggtgctgtttccttaagacaggaaagagctagaatttttgaggaatgaaaagaagccagtttattggaacacactgagtgagaggggtatggcagatgatgtttggagagttgaggggaagcagataatgtgtgccctactggccaaaataagcacacaatcacctaaaacgggaaacatgtaaagacatgcatgtagatcttaaaaatatacatgataagtagagtgacctggggtaacacctaattgtacttttaaaacctactagttgatcggaagttcatggccagccaacagcatgacatggtagaaaaaaaaaaagcaaccaacaatgtgttttaacttttgttaatatgaatataaacctgtaaactaagtcagtttacagttgttaaattttcaccctgcctgcaaattttcttaaattcataccataaatattccacaagtatagcttcatcttaatataaaatgtcaattcagaaggagaagccttctgtatttccaaattacagattcattaacttataaaaattcacttcataatttcatactagtttgcctctcaacatgttttagcttcttaattgaaaccttttcatgagaaaaggagagttttaaaaacattgttccatccttgatgatagttatattttatctgaataaaaagtgattaaatcaacattaccacttatcagagcatttattaatttctcacctgcctttgatttcctttgaagaaaagttttctgaagctgactggagaataaaaatacaaacttcattttattaatgattttctaatgcttgcatcataaggctattgctaaaactagactcagcaggagtgtagacatttactcatccagtacatattcattatgtgtgtcagccacaaatccatgcactgaggatgcaaatgtgaacgaaaatgataaaacttcattagcatccagtggggatagggtacagggagtggatatatatagaagaactaataaacaaataagcaagtaaatatgtaaaacagggtaaatgtgaagcactagaaagaaaaataaatcagagtcagaaaatagaaaaagtggggataggtaagagatgctagttcagatattgtgaaagttatatgacaagagacctaaatgaaaagatgaagagagaagctacaagccatgctaaatgaggacaggaaaggaacaagctaggcaaggtagagcaaagacaaaggcccttgggtggagcatacttgatacatacaaggttagaaaaaagtgtgtgaggaaaagagaggtacgaagtacaatgacagagctagcgtgatccagattatattgttcacaggaaaggctttggagcttattctaagtgtgttcagaagccccagagggtttaagcattagtattacctaatgcttaaggcttacctgagaagatcactctgactgtgcatgacttgtgtttttggaagacaagaatgaaatcagggaaaacaaaaggctatgatcattcttcacaatgaggtattattgagcatggttatgataaaggaagtgggaagatatttgtgcttcattctttgttttgttttgttttctaaggcaaagccaatatgatttgctggttgattgaatgtggcatgtgacaaagataatttaaggatgatcccaaggttctggcctgagctctggaaagatggtgatactattgaacaaaaggggaaacactaaggaagggtagtttggaggaagtagaaaagcaaaatttcttatatccctgtaaaactgagctgcctgttaggtatctaccaacaatgccatatgtagaagccaccatttaggaaaatcattaaagccatagacacaaatctagagttggcaatatacagatgctatttaaatccaatgccacattgagatcttctagggactgggtacagatagaaactacatcctaggaacaacaggcactctaactttagcgattaataatagaaggagaggacactaaaggaaactgaggaggtcccatgagttatgaggaaaattgggaaaggatcatgtccttgaagcacagtgaagaatatatgaagaagcagtgaataaagaaactatgtcaaggcctgctgagagttcataggagttatggactagaaagtgaccattggatttcattatatgctcatcactattaacctaaacaaaactagtgcatgaagatgggaggtgaaaaaaaggctgttttggttgttttaaattttttcatttttatggatttagagatacaattgtagttgtgaaacatggattatattgtgcagtggtaaagtctggggtttaatgttcccatcacccgaatcgtgtactttatattcaataggtagtatttcttccctcccactcccttccaccctcccacactttagggtctccaatgtcaattattccactctgtaagtccttgtgtgcccattgtttagctcccacatcaaagtaagtacatgcattttttactttctgtttctgaatcatttcactcaggataatggcctccatttctatccacattgctataaaatacatgatttcactttttaattgctcactagtattccatagtgtatacatatatacaaaatttttaatctaattatcagtgaatggaaatttagagtgattccatgactttgcttttgtcactagtgctgtagataagcatacaagtcagttgtctttttaataaaatgatttctttttctttaggtagacaccctgtggtgggattgctggattaaatggtagttcaatttttaggtcatcaggaaatctctatactgttttccatagaggttttactaatttacattcccaccaacagtgtataaacattcatttttcttttcatcttcaccaacatctcttgacttttgaccttgtaataatagctatcttgatgagtataagatgatatctcattacggttttaattttcatttctctgatgattagtgatgttgggcatttttatatatttattggccatttgtatgtcttcttttgaaaaatgtctgttcatgtcgtttacccactttttaatgaggtttttttcctttttttattgagttgtttgagttcttgtagattctggatattagccctttgtcagatgcattgtttgcaaatattttctcccattctgtggtttgtctgtatactctgttgattattattattatttttttttttactgaacaaaagttttgtagtttaattaagttccattggtgtattattttgttgcatttccttttgagggtgtagtcataatttctttgcctagatcattgtccagaaaagtttttcctaggtttacccctaggatttttatagtttcaggccttacaattacgtctttcatcctttttcagttaatttttatatatggtgagagatacgggttcaattttatgtctgtgtatatggctctccaattttcccagcaccatttattgaatagggtgtcctttcctcactgtatatgtatttgttactttgtcaaaaatcagtatgttgtaggtatgtggctttatttctggcttctccattctgttccattgatctatgtgtctatttttatactagtacccttttattttggcttatagccatgtagtataatttgaagtcaggtaatgtgataccttcagcttcatttttttgcttaggatggatttgctagtcagacttttttggttccgtatgaattttaggatttacattggtaatttcataaaaattgtgttgaatctgtagattgttttgggcaggatggtcattttacacaatattcattattccaattcatgagcgtaggatgtttttctattttttttgtgacatatatgacttttttcatcagtgttttgtagttctcctcgtagagacttttttacctcttagtttaaatgtattactattttttatattcattgtaaatgggattaagttgttgatttgattttgagcttgatcattattgttgtatggaaatggtacttatttttgtacattggttttgtatcctgaaactttactgaagtagtttatcaagtctaagaggctttcagaggagtttttagggttttctaggtgtaagattatatcataagtgaagaggaataattcaaattcttcttttcccatttggagaccttttattcctttatcttacatgattgttcctgataggacttccaatactacgttgaatacgagtagtgaaagtgggcatcctcatcttgggtccattcttagaagtaatgcttacgattttcccccattcagtatgttattgactgtggtttgtcatatacatggtttttattattttaaagtatgtttcttctatgcctagtttggtaagtgtttttatcataaagcgatgctggattttatcaaatgttttttctgcatcaatttattttatcatacgctttttgaaaaaagatttctgttaattttgtgaatcacatttttgattcgcatatgttgaaccatccttgcatttcaggaaaaagtccacttttcattgcgatgaacctttttatgtgctgctgaattttattttctagagtttttttttttttttgaggatatttggatctatgttcatcagggatattaatgtgtagttttctcttttatttgttatgtacttgcctggctttggtatcagcatgatgctgacttcatagaattagttgaagaggattccttcccccttgattttttggaatagttttagtagagttggtatcatttcttcctttttggtttggtagaatctggcagtaagttcatctttttgttgttgtcatcaggagattttttaattattattactaattcaatttaattgctcattattggtctgttaaggatttctgtttcttcctggttcaaacgtgtgaggttgtatgtttccaggaatttatccatttcctctaggttttccagtttatgtatgtagagatggtcatagtagtctctgatgatcttttatgtttctgtggtaatagttttaatgacaccagtaatatttctgattgtccttatttgaatcttctttctttttggttaagctactagtaagctatctatcttacttatattttcaaattacaactttttatttcactgatcctttgtaatttttttgcccaaatctcatttagattttttctttgatatttactatattctgctagctttgggtgcagtttattcttgttttactagttctgtgagacgtgacattagattgttaattttatatctttctgtctttttgttgtgggcatttaatgctacaaacttccctcttggcactgatttgttgtatctcagaggttttggtatgttgtgtctttattttcattcatttcattttcttaatttttttttttttgtttttggggacagaatctcactctgtcacccaggctggagtgaaatggtgtaatcttggctcactgcaacctctacctcttgggttcaagcagttctctggcctcagcctccctagtagctgggattaaagacctgtgccaccacacccagctaattttttttatttgtaatagagacggggtttcaccatgttggccaggctggtctcaaactcctgatctcaagtgatccacccacctcagcctcccaaagtgctaggattacaggtgtgagccaccacacccagcctcatttcaattaaaaaaaaaatctgccttgatttcattattgaccaaataattgttcaggaacaggctatttaattttcatgtatttgtgtagtattgagaattcttctaggtactaatttctatttttattccactgtactctgaaaaggtacttgatattattttgagttttaaaaaaaatcattgagtattgccttttggcatagcatgtggtcagtttttgaaaatgctgcatgtgtacatgagaagaatgtatattctgaggttgtagggtaaaatgttctgtaaaatgttctgtaaaatgttcgtcagatccattgggtctaatgtccattgtaaaagtttctttgtcgatttttggctgccatgatctgcctagtgctgtcagtggattattgaaagaccccactactgttgtattgctatctattttgttttccttaggcccagtagtgtttgttttatgaattggggtgctccaatgttgggtttatatgtttggaattgttatatcttcttgtttaattgatcctttatatgataaccttctttgtcattatttatggtttttgatttgaaatttgttttatctaatgccagtataactactactgctctgatttggtttgtattttcatagaatgtctttttgcacccctttggtttgagtctgaaaaggtctttaccagttacttgagttaggtgggttttttgtatgcagcatatagttggatttttaaaaattcattctgccagactatattttttaagaagagtgtttagtatatttatatataaggtcagtattgatttttgaggggttgtttctataatattgttaattatttcttaattgctttgcagtctcaattaggtaattttaaaataagatctgtaagttttatactttgtgtgtttccataatgataagtattgctctttcatttctatatgttagaactccttcaagcctttcttgtagagtcagtctgtttgcgacaaattcccttagtgtttgcttatttgggaagtactacttttcttcttgaattataagtcttagttgagcagtatacaaaattcttggctggcatttttttttttctttaagagactgataataagaccctaatttcttttggcttgtaagattcctgctgagaagtctgttgttagtctgataggattctttttacaggtaattagatacctctctcttgccacgtttaagatttttaaatttttgttgactttgagtagtctgatgactatatgtcttgtgctggttattcttgcaatgcatctcacaggaatcacctgagctttttatatttggatgtctggatctgtagtaagtcagggaagtttttgggagttattctttcaaacaagtttcccacacttttaactttttcttcttctccctctggaataccaatgattcataagtttgtatgcattccataatcccatatgtcctgaaggttctgttaggtttttcaatttacttttctatgtatttttcctaccaagtttatttgaaagacctgtcttctagctctgaaattgtttattctgcttggtctggcttattgttaaagctttcagaagtattttgcagtcccttcaatacatttttaatttttagaagttgtgtctgcttctcgtaataaaatctttctcttcttttataccctatgttattttttttcatttatttttggtaatttttaactttcttttggatctcaagctttacataatcccatattacttgaaggtcttatttctcgaagacttctttagaatcaatattttggattctttatcagcatatcaaagatttcattttggtttggattaatagctcaagagtcattgtggtcctttggacctttaacaatctatcttctttatacttccagaattctttctctggttctttctaacttagataggctatctctccttattttgaatttattttgtttgaattaggttttttccatttgaaaatgtggctataatgtgtgttatgtaggatctaacaggctatattgaagaggatagagagaaaatgccagaaagggaagtgcaacagtcagcacagcaagttattttcaggagtagtgctacaaaagaaacagacaaaagttgtggttgatagcaaagttgtggaataaaacttctgtttatgttcaatgctagacgtaatagcatgcttacatactgatgagaatcatcagtagagatgaaggaaactgacaatgcagaaaagagggaaagcaattacagaggaagatgaaaagagtttaaccaggacacagagtttttctctgtacaagaagggaaattttctatgtgggtaaaaggcaggtaaatgtgtacctgtagtgatgaagaatattgaacttttttctgctgcttctactttctttgttataaaaaaggaatgtaatcagatgagaaagaggaggaagaaaagaaagagtctttggatcagaaaatgtgaactagtaatcctgaagattaaagaaacatactgacagggaaaatggactagtagaatattggacgattgccctggaggccccctgaatgtctgtgcttatgaatttaaagtgagcacagtgagatgtttgaattctttcctccagggatgcagctctttgtatataggttcagagaaggcagaggattagatgaaagcatttttgcttgtctagtacagtaaaggatgagatggacaaaaatttacagaatatatgcagatgagcaattataacaaaagatcatgatgagaaaggaagtgaagaggtaaaactagatatgacctgtgaagaggttaggggaatcatagcctaaagagctagggctggagcttcttgtaacagatatattaaagggagtaaatttaaaacttaggaggtagttatgaggactgggatggccaaaatggagaattttaaaagtgggtactgatgaactgactgtgggtggaagactttccagaaaagaggtcaagaaactgaaaggccagagaacattgggagcataatctatatgatctatatttcctaaaataactaggaaaaagggcagaaataattttcacaaaaatgacagggagtttggaatgaaaattgtcaagaaatgatgagagttgtgatgtgccattctatagctaacttcagcaaggaggttagagaatagtatggtagggtggtgcacttcttcttgggacctagaggtctgtcagaagaaagactcagatctggaagtggtaaaaatgaaagatcaatgagaacttctacatttcaggcccattgatgtggaggttgtggaaggaaaaagcctacaggagagagttacatggagtgtcattgggagtaagccaggctttgtttagaacaagaaagtgaaagggctacaaagaatgtaggaactaaatattttgctggtaacaaatatgagtttccctgggaaaaatgaaagggtttgagtaatggaaaaagagtaagagagtgagtgggattaagggatgtagtaaaccatgtggaatgagagccttggtacccagacaggatctcaaaatcttgacattctgctggtgacaggatgtgaggcatgatgtaagtttatgacaaacaaaacatcaattgaaaaggcccaaaggagggtaatgtttcagaacttttttaaaaaactgcattttagtgggttagctagaaaagatttgtctcatatacacaataaattagagctgttcttcagtcttttgcaaacaggaaaacaagcattccctacctgtgctatctattgttagggtttcattaggtctaactggaaattacctcaagaaacagcaggtcatgatggttgattgtcattagaaagaacaacagaggatcaatgtaaatgaaatctcttaaattaaacaattaaatgaaatagcacatttaacttcttagggtgccttttgtgatgaattcatcctgagagaggtgccagctgctcaatatcatatgtaaagcaggagtcacactacagtggtaaataacttacatgataaccatgcacgagcgtgtgcacatcagtgaggatgtgagtatgagcaggcaagaagtagtgtgagtgtgcatgcatgtggatgtaggggtgagtgtgtgtgattgttattgtatatgaatattaccatatcacacacattcatcatctccactgaattgttgaagatttcaggccagctcttaggaaaatatcctccctatctgcaagtccccccaagtctcctgcatgccaccccttcccctgggtgaaaatacagctcaataacaaatttcagtttaccttgtgtgtgtagtataccgacaaagtgtaacttctgaaaatcaagtacagtgaaaaatacatgtcaggctattgtcaaaaaactcaaccagggttgaagtgcaatctctcccttcccaaaatctcctttgagaaatctgatatttgagagtaataactaaatagataagttaaactcccctttctactgatttcttcttgaccatctctttatgaaataaacttcctcctaaatagcaggcatggattctgtattcatttgtttttatgctgctgataaagacatacccaagactgagcagtttacaaaagagggaggatttagttggaattacagttccacgtggctgggtaagcctcacaatcatagtggaaggcaaggaggagcaagtcacatcttacatgggtggcagcaggcaaagggagcttgtgcaggaaaagtacgcattataaagcaatcaaacctcatgagacttattcactatcatggaacagcatgggaaagaccacgattcaatgatctcccactgggtccctccaacaacacgtgggaattatgtgagtaaaattcaagatgagatttggtggggacacagagccaaaccatttcattccacccctgtcccctccaaatctcatgtcctcacatttcaataccaatcattctttcccaacagtcccccagaatcttaactaatttcagcattaacccaaaagtccacagtccaaagtctcatctgagagaagtcaagtcccttccacctatgcacttgtaaaaacaaaagcaagctagttacttcctagatacaatgggggtacaggcattgggtaaatacagcctttccaaatgggagaaataggccaaaacaaaggggctacaggccttatgcaagtttgaaatccagcagggcagtcaaaacttgaagctccaaaatgatctcctttgactccatgtctcacatctgggtcacactgatgcaagaggtaggttcccgtagtcttgggcagctctatccctgtggctttgcagggtatagcctccctcctggctgccttctcgggttggcgttgagagtctgcagcttttccaggtgaatggtgcaagctgtcggtggatctactgacagcttctgggatctggaggatggtgaccctcttctcacagccccactaggcagtgccccagtagggactctgtgtgatggctttgacctgacattttccgttcatactgccctagcagaggttctctatgagcaccttgtccctgcagcaaacttcttcctgggcatccaggcatttccatacatcttctgaaatctaggcagaggttcccaaacctcaattattgacttttgtgcacccacaggctcaacaccacatggaagctgccaaggcttggggcttgcaccatgtgaaggcacagcccaagctctacattggtccctttcagccacagctggagcagctgggatgcagggcaccaagtccctaggctgcacatagcacagggaccctgggcctggctcaggaaaccatttctcctaggattccaggcctttgacgggaggggctaccatgaagacttctcacatgtcctaaagacattttccccattgtcttgggaattaacattcagctttcaaatttcaggtattcaaatttctgcagccagcttgaatttctcctcagaaaatggggttttcttttctatcacattgtcagactgcaaatgttccaaacttttatgctctgcttcccttataaaactgaatgcctttaacagcaccaaagtcacctcttgaatgctttgctgcttagaaattttttctgacagataccctaaatcatctccctcaagttcaaagttccacaaatctctagggcaggggcaaaatactgccagtcttttcactaaaatatgacaagcatcatctttgctccagtttccaacaagttccttatctccatctgagaccacctcaacctggaccttattgtccatatcactatcaggcttttagccaaagctattcaacaagtctctaggaagttccaaactttcccatattttcttgtttttttctgagccctccaaactgttccaacctctgcctgttacccagttccaaggtcacttccacattttcaggtatctttttagcaacgtcccactctaccggtaccaatttactgtattagtttgtttttacgctgctgataaagacatacctgagactgggcgatttacaaaagaaagaggtttaatatgacttatagttccatgtggctggggaaacctcacaatcatggtcgaaggcaaggaggctcaagtcacatcatatgtggatgaggcaagcaaggagagtttgtgcaggaaaactctgacttacaaagccatcagatcttgtgagacttattatcatgagaacagcacagaaaagacctgcccctatgattcaattatctcccaccggatccctcccacaacacgtgggtattatgtgagtaaaattcaagatgagatttaagtagggacacagagccaaatcgtatcagattcattgtcctcagtgtagttttgtgccctcagctgtgctaacaaagtgctgctgtcctttgtcaaagcagggccaaaacacactttctgtttattgtctctcctaatagataactattttagatttaactttcaatgtattatgtttaatttagtttttgtcttttaaaattttataagcgctattgaattcttttcagaatctcaataaatggcagttctctggcaaggtatagaggcaaatatgtgtacatgaaactgaggtttagagtgctagctcattgtgttggattcttataacatatgagataagcattatcatgcccacttagcaaacaaggaaactgaggctaagagagattaagtgatatacttctacaagtcatttggatgagagaaagcataatttgtctatttactttcaagaatattaactagcatggtatctcttagtaggtgcttagtgaatgtttcttgattgatggtggttacttagctctctgaaaaaaaccatccaacacttcgaggagaaaaaaaccctttttatcagttaattcaacatttcagtaaaagtgggttatttgagccacagtcatccacctcatcccagctctcctcctttactaatgaaagataatttcatttctcttggtatgtactaagttatcacagggatggtagtgtcatcagtttattgaacacagaaaaatggaattgtagaaatgtaagagtgagtgaatttccaagtgaggatacaaatatgctctgtagctttaatgtgacagtcaaatacattagacactagaatacagaaaagttttttgacccttctggttgtataatataatttacgaatcatattaataagctattctgttaacattgatgacagaaataaggtggtaaaaagaggtctgctaagaattactcctggataaaagtatataatcctttaataggaggtaccttgactaaatagtccacacaaaatcattttcttcataagcataataaagtctattccaaccactttcttataggattttcataaggatcaaatgtgaacatatttgttaaactgccttgaaatcataaagcatttaataaataaagaaattattattattatcactcaggtgtttaccttttaaaacagttgaaaatgtaactttatataacgtgggaaattcacttaagagtattcattctaccagggagaggaatgatgctgataaatgttttgatattaactcagtttgattttttaatgacatgtattatttctttgcctttatcatatttcaggattgttcaacctgaattgaaagcacttgcaatgggtttccagtcaatggttataagaacactaggtatgacaaatatatagattatacattttaacatataaatattaatgttaaatactaaagactgaatgcaattaattttcaactataagactgtataaaaaagaataggtaagaatcatttctattttgtgataagtgaaaataaaaaggaacgggaaaattgagtggtctaaaagataatttgatgttaattctagttagagtcaatctgttaagagcaaggaatcatcatatttatattatattctttctaacagaaacagaaagataggtggtctctgaggttttccttctttcaggaaaataagaatatttctcccaggtatacgcagagtggaggaccttccttccaaatggagacattacttaggacagccctaaagtagcttgggaaccctgggaatctggtcaggctgaggttgtctagaacaacagaagctgacattcactgtgccatttcccactgcctggtcctctatggctggacagctaaccattagcaggagttaatgcaaaagggaatgaaaattcatactctagaactaggcttgttggattatgaggatgtcctgaataaaagaaagctcagaaaattgtggtttatggtggcaagggtaggattttagactctagaggctaaaggcctatttctaaatattcaaaagtgatgagaaaagatttaggaaatgaacctttgtcccttattgccatttgccttttttactgcacagatacttgttgttaaataatgtctagtctaacctctgtgagtggtcctttgtaagaattgtaaacattatgtgcttattcctgggaagtaggaaaagggcatcattcatctagggattggtgcagaggactgattatggtccataggtaaccactgatggcagaaggaaaaggaagtgggaggggtcagtttctgggacccttgcaaggaaaggaaaaagtataactctatggccaaattaccgtgaagaagttgtacatgaagtgtattcggtgagaaggtcacagatcctgaaatgtaaaaggaaatataaaaggaataggagagagaagatgaagatgctgcagggttgcattgcctccatcctaaccgtccctttctgtgtccctaatcttccagcctctgtaatcttagcagttctctacctccagattcagagacgatacctcactcctggaatctgggccacagaggctgaaaatagcatctgggtagttaggactccttctgatatgttgaaatgagactatgacaatagaagacattgtttaagcaacataaaatagaaaaaaattgaattttgccattctaattgtgaacatccaattttgttatgtccaatatatggcacaatggaccctaaatgcttctgtgggaaacatccacacttggtagcaaacttccaattcatgaacaattgtcttaaatatgatatatgtgtaaatggtagaagacctatatagtgtattaaactaaaagaggtatttagaaaataggttatcagaagatttacaattctaataagacaaagtttgttacttaaaacatttacttcacaacgtttgtttaaaccagtggcataacgtgaagaaaataaattgttggcatctatttttttttatttttctaagggtcgctgtgattttttgaaatctgcaaatttctcacccattatctcagtaccagtttgcttcagatgcattggcctcagacaacattcccttgtgaatctactatttctcagtctcagaaaattgagaatgattaaaagtaaaatgaatcggtaaaacattcatgtataaatcactgtcattttttgtgacaaaataaaatctgaaaagtatgaatcacaaaacagaacaagaacaaagtaaaatcttgtatgcttcagttctgccatctgaatgatagctctctactatgatgtccctcaaaattttgaacaaattacctattcttaaaactaggagttaatctcagaatttatacttctcctataaacaacatatgtatccctggaatgcctcacagtcatcgaaatcaggcactacaaataaaaattgactttgggacagaccactgaaaatatatgcaccattgtgcactaacagaccactaacagaaacaaaatttagcaacggagaccctaacctgcagcccaggttgctttaggaggtattaaaaagtgcatgaaatcaatggagagaaaatgctgaattgtgggctctgatggcactaagaaagagagaattgggctctgagcctagaaggaagtaaaactggccaatagctcggagcaccccgtgaagctgggcctgaacttctctggggagggaatcctggtgtaagcatttactttttaattatcttaaaatagtattaaaatctcctgcctttacagcagtttagatgagagcttttccttttctcaagaagttataatttaactgtcagtaatccagccattcttgcctaagaaaaattccatatgaaccaacataactttcatgttttactaacaacattcccctttttaccaatcagacttaagttaataggtattgtaggaagaacagagtatataggcatataatactctttcttccctctgtatatagggagagaagagtagatcaaatacatctgtgacattaccatatgatttaagcctttgcgatttctaataattttgattcctgggtggatgtaagccaaaccaatggaataattttccaaaactttaaacttgtattaatccaaaatgtatcaatatcgactatcgctcagttacatttgaagcatttcacttggattgatatctttttatctcatgttgcaggaggaattctagctccaatatattttggggctctgattgataaaacatgtatgaagtggtccaccaacagctgtggagcacaaggggcttgtaggatatataattccgtattttttgggtaagttgtcgtaaacacatttcattaatagattttttctttgtctatgttaatgtctaagatatagcatttttagtgtgatcgtaatattaatgatagctaccatttagtgaacaattactttgtattcactattgtatcaagcattctggtatctcattttaatactcatagaaactgtaggaaatgtatatattcctcctttttccttaaatatgaagaaaacaagattgaagaataatgagtaacttgtcaaaaattgcacaactaaaagaaatacagctaggatttgtacttgaatctcttttgattacaaagctctctcccactggcttctccaggaagacacagaatgaccagctgcagctctggttatatggtaattgaggaaagaaatggaaaaacaaagtttcattactcttctattcataggcagaagtatcctgcaagtgacattaagacaactagattatctggaagaaacaaaaagctgctgcaattgtaccttacctcttatagaagcattaatttgtaatttatatattgatcaatatataaatttgatttctgaaactataagtattagaactactcatagtagaatttcttttaattatctaggaagaataaatgtgtttgtaagtatgacccaaatgcctgaaagtataatagaaaaataatggtgaaaggatttatattgctttgtgtatatacccaataataggactgatgggttgaatggtaattctgttttatgttctttgagaaatcgtcagactgctttctacaatgacagaacttatttacattcccactagtagtgtataagcgttcccttttctccactatgtcttcagtatctgttattttttgacccactaaaaatagccattctgacttgtgtgggatggtatctgattgtagttttggtttgtagttctctaataattagtgatgttgaatcctaattgaactaatgcatgaacagaaaaccaaatatcacgtgttctcccttgtaagtgggagctaaacattaagtacatatggacacaaagaagggaacaatagacactggagcctacttgtgggtgcagagtgagaggagggtgaagaaacaaaactacctgtaagtgactatgcttatttaaaaagagaaagagaacaagaacagataataaaatattttaaaaactgcattacacaaggtattgtaagcaaagttcaacagcaaggggtaaattagaagaatttataattcagagatagacacaaccaaatgtcctatgtatataaggatctcttaaaaatctccaaaaacaggccggatgcagtggctcacaactgtaatcctagcactttgggaggctgaggcaggcagatcacttgagaccaggagttcgagaccagcctgacaatcatggtgaaaccttatctctagtaaaaatacaaaaaaaaattagccaggcattgtggtacatgcctgtaatcttagttacttcagaggctgaggtgggacaactgcttgaacctgggaggtggaggtggcagtgagctgagatcaccaactgcacactccagcctgggcgacagagcaggattccatctcaaaaaaaaaaaaaaatcaatgcaaacatcaaatgctagcaagaatgggaaacaacaggaatttcctgtcattgctggaggtgatgtaaaatggtactggagtgttggaagacagagtgaaattttcttacaaagcaaatagagttattgtacgattaagccatcatgttcccaggtatttacataaattagttggagacatgtccacaaaaaaacctgtacttgaatataaaaaagtggaagcattgaagatgtccttcggtaggtaaatggataagtaaactatgttacattcatatagtggaatattagtaatcaatgtattagtctattctcacactgctatgaagagctacctgagactgggtaattcatgaagaaaagaggtttaattaactcccagttccacaggcttaacaagaagcatgacttggaggcctcagaaaactcacaatcatggcagaagcctaaaaggaagcaaggcatgtcttctcctagtgacaggagagagagagggagagagcaaagggggaagtgccacacacttctaaaccaccagacctcatgagaactcactcactatcttgagaacagaaagggagaaatccacccccaagatccagtcacctcccaccaggttccttctccaattcaacatgaaatttgggcagagacacaaacccaaaccatatctttcaatccctggtcgttcccaaatctcctgttcttctcatattgcaaaatacagttacccttctcaacagtccccgtgtcttaactcatttcagcattaactcaaaagcccacagtccaaagtctcttctgagacaaggtaagtcccttccacctatgagcctattaaattttaaaaagttagttacttctggccaggcgcggtggctcatgcctgtaatcccagcactttgggaggccaaggtgggtggatcacgaggtcaggagattgagaccatcctggttaacacggtgaaacctcatctttactaaaaataccaaaaaattagccaggcattgtagtgggtgcctgtagtcccagctacttgggaggctgaggcaggagaatggcatgaacccaggaggtggagcttgcagtgggccgagatcacaccactacactgcagcctgggcaacagagcgagactctgtctaaaaaaaaaaaaaattagttacttccaagatacaatgggggtacaggcatttggtaaatactcttattccaaatgggagaaattggccaaaacaaaggggttacaagccccatgcaagttcagaacccaacagggcagtcattaaatcttaaagctccaaaatgatctcctttgactccatgtcacacatctagggcacaatgatgcaagagatttgtgcccaaggctttgggcagctccactcctgtggctctgcaggtacagtccccatggctgctttcatgggctggtactgagtgcctgcagcttttccaggcacacagtgcaagctgttggtagatctaccattctggagtctggaggacagtggccctcttcttatagctccactaggtagtgcctcaatgggaactctgtgtgggaagtccaaccccacattttctctctgtactgccctagtataggtttttcatgagggctccacccctgcagcagacttctgcctggacatccaggctttttttttttttttttttttttttttttttttcttgagacagtgtcttgctctgatgcccaggctggagtgcagtggcatgatctcagcttcccgtaaccaccgcctcctgggttcaatcaattcttgtgcctcagcttcctgagtaggtgggaccacaggcatgcaccaccatacctgactacttttcatgtctttagtagagatggggtcttgccatgttggccaggctggtcatccaggcattttgatacatactaggaataggtcccaaacctcaactcttgctttctgcccactcataagcccaacaccatgtgaaaggcaccaaagcttggggcttgcaccctctgaagtcatggcccaagctgtaccttgactccccttagccatggctggagctggagtcagtgggaaataaggtgtcatctcccaaggttgcacagggcagcagggccctgggcctgacccacaaaaccatttaaccctcctaggcctccaggctggtgataggaggggcctccattaaggtctctaaaatgtcctagagatattttccccactgtcttggctattaacatttggatcctctttacttatgcaaatttctacagcaggcttgattttattctcagaaaatgagtttttcttttctaccacgtggctgggttgcatattttccaaacatttaaatgtaagttccagtttcagataatctctttgttcacacatatgagtaaacacttttagaaacagccaggtcacatcttgaatgctttgctgcttagaaatttcttccactagataccctaaatcatctctctcaagttgaaagttccacagatctctagagcagggacaaaatgccaccagtctctaagctaaagcatggcaagagtgacctttactccagttccccataagttcctcatctccatctgagacaatcctgaacttcattgtccatatcactagcagcattttggtcaaaaccattcaacagtctctaggaagtttcaatctttcccacatcttctgtctccttctgagcactcctaactgtttcaacctctgctcgttactcagttccaaagttgtttccacattttcacatatccttatagcagtgtcccactcccagtaccaatattctctattagtctgcctcagaaaacttacagtcatggtggaagggggaagcaagtcatgtcttctcattacaacaggagagagaaagtgtaaaaagggaaggactacacacttctaaaccatcagatctggtgagaactcactatcatgagaaaagcaagtgggaaatccacccccatgatccaatcacctcccaccaggccccttctccaatataacatgggatttgggcagggacagaaatccaaactatatcaatcaataaaaagaaatgagctatcagcctacaaaaagaaaaaaatgaaacttaaactcatatagctaaataaaagaaggcagtccaaaaaagcttcagattgtataattttaactgcgtgatcttgtagaaaaagcaaaacaatgggcaacaaaatcagtagtttcttggggctcagtgtggagaaggctggaatgagtaggcctagcacaaggaatttttagggcagtgaaactattctatatgatattgtaatattggatcatgacattatgcatttgccaaacctatagaactttacaacataaaaagtgaactctaatgtaaaatatgcatttaataatgtatcaatattccttcatcagttttaacaaatgtgctatactaatacaagatattaatgataggagaaactgtgtacctgttgggcagggagatctccatacagttttctggtaaaactaaaattgctataaaatataaagacaaaaaaatcacgaaacatttttcaaagaagaagtcactaatggttatgaaacatataaaaagattgcagctctgttattatcaattgtgttataattgtagttctgttattatcaatgaataagaacatgaacatcatcttgataataaaagaattataattaaaaatcacccagattgtcaacaatcaaaaatgttgcttgaagactgtgttggcaaagtatataactttgagccaacagcaatacttctaggaatttatcctaaagatatctatactcccaaaatactgaaaacaaagtaagaaccaatcaagaagatatcaattaaattaataatgtgcatgcaggcaaatgaatattctgagttcttaaaaaaaggaaaaatctttttacttactaatatggaaggctattcacaatatattggtatattcacatatatattatgtgaaaaaaggaagcattacatgaaaaatgtgtgcggaatatgctattatttatgtaaggtggggaatatttcttagttcaggttagatctctggtgaaaactccctggatctaatttactaaaagaactttcttctacctgatgtgtaaattcactgtctaacatccccaacaagtaatgatccagatttttctggaattacagtaaagcagcattcagcagcccacagacattctcttaaatttaaaataattatagaaaatctttccctaaatgggagatttctttcctccctccctccccttccttctttccttccttcccttcctttcttcctcccccttcccttccccttccttcccctcccttccccttccccttccccttcctcttctcctcccttcccttcccttcctttttttttttttttgagacgcagccccactctgtcatccaggctggagtgcagtagcgaaatctcggctcactgcaacctccgactcctgggttcaagcaattctcttgcctcagcctcctgagcagctgggattacaggcgcccgccattacggcaggctaatttttttgtatctctactagatacggtttcgccatgttggccaggctagtctcaaactcctgacctcaggtggcccgcccacctcagtctcccaatgtgctgggattacaggagtgagccactgctcccggctgggagatttcatttctatttataaaagtatggaaaaaaataacaaagaaaaacttaataaatttactttaagaaaatatttattttaattgaaatcataattcattttaaggacaactggcaagatgctccccagaatctccccgaagcaataatcaccaagtccaagcattagcataacattttgaaatggtgatactttagttatgttagtttcagtatgaaaaggccactaaaacattgttttaaaaactgtactacttctttttccttcagtaaaggtttaggtaaaagtaaaaggaaatgaaaagtggaattttaaagtataataaaaaaattttaaaaagggcagttcatttgccagttaatacactgaaagttaaataattaccttatgatttttaatagattttattttttagaatagtttcagaatcacagtaaaattgaggagaaagcacagagatttcccatatcttgcctgctcccgcatacatgcatagccttccccattatcaacatctcccatcaggatggtacatttgttacaattgacaaaccagattgacacatctttatcactcaggatccacagtttacatcaggtttcacatttagtgttgaactttctgtgggtttggatgaatgtaaaatgatacataaccaccactccactatcataaaaagtagtcttgctgccctaaaaatcttctgtgctctgcctgttcattcatcctttcccagtaatccctggatccctagaaaccaatagtctctttactacttccacaattttgtctgcttcagatcatatagttggaattatacattttgtagccttttcagagtagcttctttaactcagtaatatgcatttaagtttcctgtacttgtttgtattgcttgatgggttatttctttttagcactgaacaataattgattgtctcaatacaccatagtttatacatttgcctactgaaggacatcttgattgcttgcaggtttgggcaattataaataaaagttaataataaaagttatccatgtgccagtttttgtatagatacaggtctcaacttctttgtgtcaacaccaaagtgcaattacttgatcatatgataaaaatatgtatagttttataagaaattgtcagactggcttcaaaagtggctgtatcattttgcattttgaccaacaatgaatgagagtttctattgctccacttccttatccacatctaatgtctagtgttctggattttggccattctaataggtatgtagtggtatctcattgttgtttaaatgtgcatttgcttgatttccttgatgacataagatgtgaagcatctttttcttttttttttttttttttgagacagagtatcactctgtcgcccaggctggagtgcagtggcatgatctcggctcactgcaagctacgcctcccaggttcacgccattcttccacctcagcctcccgagtagctgggactacaggcacccaccaccacgcctggctaattttttttttttttgtatttttagtagagacagggtttcgccatgttagccaggatggtcttgatctcctgaccttgtgatccgcccgccttggcctcccaaagtgctgggattacaggtgtgagccaccacacccggtcatgaagcatcttcttatatgtttatttgccacctctatattttttgtggggagatatatgttaaagtctttggcctactttttaactgttttttctattgttgaattttgacagttcctaatatttttgaaaacagttattgaatatgccttttgaaaatattttctctcagtctgtggcctctgactctcatcttatccttttgacagtgtctcttactttctcagagcagaatttttttgttttgttttgttttggaaatggatctcgctctgttgcccaaacaggagtgcagtggcaccttcttagctcactgtagccttgcactcctaggctcagggaatccgctaaccttagcctcctattgatgtgatcatgtgattatttttcttagttagtccattaatatgatgaattatataaatgatttgtgaatgttgaacctgtcttccaaacctggaatatatgcctggataactgttttattcagaggttttaaattgtaatgaagtcctctttgtcaataagttctttcatggattgtgcttttgctgttgcatctgaaaagtcataaccgaatcctaggttgcttactcctgtgttacgtcctaggagttttatagttttgcattttacgttttggtttgtgattcattttgagttaatttttgtgaagcctaaattcattattttgcatgtggatatctaattgttccagcaccatttgttgcaaatactatattttctccattgtagtacctttatgtttttctacagatccattgactgtatttaagtgggtctatttctgggctatttattctttccacttacctattcgtatattattttaccaaagtcacactgtcttggttgctgtagcttcatagtaagtcttgaggtcaggtagtatcagtcctattattgtgttcttacacttaagtattgtcttggctatttagcatcttttgcctcttcacataaactttagaattagcttgtcaatatccacaaaataacttatagagattttgattgggcttgcattgaatctgtgtatcaagttgggacaaactgacatcttgacaatattgagtcttacgatactgtacatgaacatggaatatcacttcatattttagtgcttctttgatttctttcatcagagttgtatagttttctgcctatgccttttgtatatattttgctaaatttatacccaatgtttcatttttgggggtgttaacgtaaatagtaatgtatttttaatttcaaattccacttgttcattgctgatttataggaaaacttttcactttggcatattaatcttatatcctgcaaacttgttataactgcttattagttccagtagtgtttttgtctattatttgagattttctacatatacatatgcaaacaaaggtagttttattccttcctttcaatctgtatatataccattcccttttgacttttttttttaatcacatggactttctgtgtaccatgttgaaaattaatggtgaaaagggacattcttggcttgttccaaccttataaggaaagctctgagttcttcaccatcaagtaaaaaatgtgtagaatttttggtgtatatgtttttaatcaggttgataaaattctcctctattcctagtttaatgaaagtttttgttcacaaatggatgtttgattttgtcaaatgcattttctgcatctattgatgtgatcatgtgatttttttcttctttagcatgttaatataataaattatataattgatttttgaatgttggaccagtcttgtaaacctgaaatacattccacttggttgtggtgcctaaattgttaatgcaatgtcaaattcaattagctatttttgagaacttctgcacctgtatttgtgagatgtatcgctctgtagttttcttttcttgtaatgtttgtctgctttgggtattaggataatgctgacctcataggagacaggaagtattcctgctgcttctattcctctgtaggaaattgtaatgaattggtataaattcttacttaagtgttttatagaattcgcccatgaacccatcttggtttggtgttttctgctttagaaggttattatcaattcatttctttaacagatatagatctattcagatagtctgtttcttcttgtgtgaattcaggtagattgtatctttcaaggaattggtccatttctttcaggttattaaaattgggggcatgatgttgtttatggcattcccttttgatccttttaaggtcaatggggtctacagtgatgttccatctttgatttctgatattagtaaatcgtgtcctcctttttatctaaattagcctggcaagggactccaattttattgatttttttctgagaaacagcttttgtttttgttgattttctcccctcatgtcccattttaaatttcactgtgccctacttttactattatcttcggattactttggatttaatttgctcttctttttctagtttgctaaggtaaaagattaaatgattgatttaagatattcttcatttatctctaattctgctttcactgcatccataacatttgatgttataattttattttcacttatttcaaaatatttttaaatttctcatgaaatttcatcttgacccatatgtttcttagaagtgtattgcttaatcttcacagattttgagactttccaatgatctttctgttgttgacttctagtttaattcccttgtggtttaaggacagatattacatgattttcattctttcaaatttcttctattttatttttatttttatttatttatttatttatttatttatttatttatttatttattttgagaccgtcttgctctgttaccaaggctggagtgcagcagtacgatgtcactcactgcaacctctgcttcctgggttcaaacaattctcgtgtcttggccttctgagtagcggggattacaggtgtgtgctatcacacctggctaatttttttttttttttttgtattttttcttttcttttcttttttttcagatggagtttcactgctgtcgcccaggctggagtgcaatggtgcaatctcagttcactacaacctccacctcccaggttcaagtgattctcctacctcagcctcctgaatagctgggattacaggcctgcacccccacacgcagctaatttttgtatttttagtagagatggggtttcaccatgttggccaggatggtctcaatctcttgacctcatgatccacccatctcggcctcccaaagtgctgggattacaggtgtgagccactgcgcccagccttttttttttttttttgtatttttgtagagacggggtttcaccatgttgttcaccatgttgatcagtcttgtgtcaaattcttgacctcaagtgatctgcctgccttggcctcccaaagtgctgggattacaggcctgagccaccacgcctggccttaaatttcttaagatatcttttatagaccagaatgtggtctatcttggtgaatattctatatgagcttgggaagactttgtagtctgttgctgtttgatgtagtaggttacatctgttatactgttggttgatagtgttgttgagttcaactatgtctgattgaattttgcctggtgaatccgtgcatttctgatagaggcatgttgaagtctccaacataattgtgggttcatttacattaagtatccacttaacattgtccataggttcttagaaactgattttaagcaaaacaatacactatgtaccatagtaactatttttataccaattatctatggtgaaattggtttcattatacaatacataaattcacttttaaaattataatttccaagaacctgtagacaatgttaagtgaagacttactgcatttctctttgcagctctatcattttctcctcacatatttagacactccatttttacatgcttacatgttaagtattgttctgttttgtaaaaggataataggataactgatttctttgttattatgtaaagacttttttatccttcataaatttccttgctttgaagtctgctctgtttgaaattaaaaaattaaaataggtactcccattttcttttgattaatgttatcagtgtatatcttcctcagtctaattacttttattctgtatgtcttcatatttaaagtgagtttcttgtagactacatatagtttggttcttggttttaatcctctaacaatcttattgttatcttttgagatggggtctcactctgctacccaggctgtagagcagtggcttgaacatggctcactgtagcctcaacctcctgggctcaagagatccttctgcctcagcctcccatgtagctgggaacacaggcatgaactaacatgcctagctaattttttgattttttgtttgtttgtttgttttagagatgggcaactctgttgcccagtctggtctcaaactcctgtactcacttgattctcccatcttggccccccagagtgctgggattacaggcatgagccaccatgcctggcttattttggtcttttaattggtgtatttatatcattgacattcaaagtgattactgatataattgaaagaatactgacgatatttgttactattttctatttgctctccttgttctttgatcctatttttgtattccactctctgtcttcccgttttgttttaattgagcattttatataatttcattttctctcatttgttagtttattagttgtactttttaaataaaaatttcagtgattttcctagaatttgcaatatacatttagaactaatccaagtttatattttagtaacactttattagttcacagattatgagtacccttataataccaaaataaccctaattcttctttcctacacattgtgtcattgctgtcatttactccacttactgtaagcatacatacacatatgaataagcatgtatattatatataattaaatacattgtttctattattattttaaagaaactgatttctattaaatcaatttagaataatttttttatttaaccttaactgatttcttctctgatattcttccatctttatgtatatccgagtttatgacctatatcattttccttctaacaaacttcttttaagatttcttgcaaggagagtctactggcaaaacagtccctcaatttttgtttgtatgacagtgtctttatttcgacttagcttttgaaagataatttcatatggtacagaatttttaagttggtgttttatttttcttaacagttaaatatttcactttgctctcttcttgcttgcatggtttctgaagagaaggctgatgtaatcttttctactctataaataaggtttgcttttccttttggtttctttcaggatgttttcttcatctttgattttctatagcttgaaaataacaaacctatgcatagtttttctggcctttatccttcttggtgttttttgagcttcctggatctgtggtttggtgtctgacattaattcaataaaaattttctgtacttattatttgaaatctttattttgttcctttcattttccccttcaagtattttcattataaacacttgtgtagtccttccaatgttcttggttattctgttttttctttcttttgtcttatttttctttgctttttttattgatataaacttagagattgtttcctcagcagtgctctatctaataataaatccatgaaggcatttatcatttctgttacagttttcttatctgtattctttcattttggttcttagaatttttatctctttacttaaattgctaacctttcttacattctgtctacattatccattagaccacttgacaaattaataatagttgttttaaatttccatccctgatattccctgacatatctgggtctggttttaagtcttattcttttcagactgtgtttattgtcttttagtatgtgacttgcaaatttttcttgacagccagacaaaatgtattgggtaaaaggaattgctgtatataagcctttattaatgtggtgtaaggcgatgaagacaaagtagcatcctgtagttctatgataaggcctcaatcttttagtgagcctgtacctctggactgtgaacttcaaacttgcttctcagtttctgtctcccactccttaggtagaatgagatggcttgagggggctggagttatgtattttcctccctcccaaaggaaggctagagacagctggggtttagtttctgtagcttcatatgtttttttaataatagaaaaatatcttatgcccccaatgaaaataataaatagaattgttctcttaatatttgtatgtgtaacttgtttttctttcttttaagatatgcatactggggagaaaaaaatgtaagatattttacacatttaaaataataatcgactctctattttctcttttcacagaagggtctacttgggcttatctatagctttaagattcccagcacttgttttatatattgttttcatttttgctatgaagaaaaaatttcaaggaaaagataccaaggcatcggacaatgaaagaaaagtaatggatgaagcaaacttagaattcttaaataatggtgaacattttgtaccttctgctggaacagatagtaaaacatgtaatttggacatgcaagacaatgctgctgccaactaacattgcattgattcattaagatgttatttttgaggtgttcctggtctttcactgacaattccaacattctttacttacagtggaccaatggataagtctatgcatctataataaactataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatattattaatttaaaatttgaatttgtgtttgactaacaacctcgatggatcttcttccaacctcccattaagatcctgcagaagaaatagaaatattcaaatattgcaaggtgtaattgtgagacaacttattataatacgtgttaagtttctactggacccatggaagtggattaagaaaaaccgactttagcttgagaaagcaa
